United States Patent 7,816,076 (THERAPEUTIC TARGETS IN CANCER) - sequence listing, part 2

SEQ ID NO: 90 - DNA, 139613 bp, Mus musculus
  misc_feature (1)...(139613): n = A,T,C or G
gagagagataagacatccctactcatctagagcaagccttctctttcctaaccctcccccccccccccacacacacacccttatgtgtccacagggccagaaggctctgaacttttgaggttcttattttttcctcacctatcaaacctataacaaagacaggttagcaaaagaaagacattaaccaaagctttatggggcatcacagccttcagcagtaaaggcccagagacccaacaaaacctggattttgatgttaggtccagagaaatgtataggatggaggataaaattgcataagacctaaggataatggtccaatggaaaacccagttgggtctgcctcttccaattcttcttgggatctctgtgtgacattccttcttcctgagctaatgaggttcttatcaggcaaggtaggttaaagaattactttatggccaattcacacacaaaggagaggaagccagagtacttcttctcggttttatggcaggctttgggaaggaggaattctggttttcactcatagccttagggaagaggaattttcatttccatggcttgacctaacctggaaggaagcaagagaaagccaggaaaaacttgcttctgacaaagctcgcctgtcttacagtccgaagtactcaccatgctagggtaccagactttgaattcctgacttctgagtcctaacaacatccattcttattctcacgagtaaacagtatccaccttcgcaaagcaaattattttgaaaatagactgacattgtctcctcgaacattagaccaaggcatttcattcaagaaagctctttacttgaaggtatttcttgacttgaagctatgcactttcgtgaaacattacctagtgtgtagtatgggcacttatcatgactatgactggtaaattatgtttatacactcatttgctcaaccaaaatttaacacaaatattagatgtgttagtcactgcccttgttgccagggacctgacagcaagggaaagagacagcttttgctttgtttgtttattcttttgtttgtttggtttggtttggtttagtttggtttggtttggtttggtttggtttggtttggtttggtttggtttggttttagggggacagggtaggtagccctggccagcctgaaactccataggtagaccaaggctggccaagccttgtgggaggatcctcctaaggccctgaaatttccttataaggaaagaggggggaaagcctgaggtacataggttcaggatgcaagtaggtcaaagtggagtgagaagtagggagagaaggagggaatgaggctagataattgggagaaaggtcaggtcgtatgggctgcggattttaccccgaaggacgcaggaaaaaagtatggatggttttccacagcaaggggacatgattataacgaatgaattgaagtgtcatgttgatgttattgggaactagctgtaggcgagtgaggtcagccatagggcataggttgacatgctgctgggtgttctgatgaagatgaagatggtggtggcggggtcccatgtcgtaatgatggaaaggaggcgtgctaaaactctgcaccaagtttgaaggtcggccacagaatgtgctggtgactagtaacagatgagaatgggagctgggggtgggggtgctaggctgggtagccaaaggccagcatcattcggtgatagggtggactcagtacacagacagtgcttcctggcccacagaactaagtgcaatgtccttatacctcgagtctacaggaaaggtagcagtgaagaggaaacaaaacaaaacaaaacaaacaacaacaacaaaaccctaaactaaggtctgtattgactaggaaatgatgaaatgaggagggaaattccctgatgcaagagaatataggggggaaaaaaaagccaagccccgggctatcatgacagagctcggagcttggctgaggtagaagcctgggttagggacttttcaaaagttgacttcaccaggataaacacctttaaggggtggttcgtaaaaggaaatgactgagtcactttgaggcaggccaagaaagggtgagagcgaggcaaccacctcagggatttgtcactgatacagctcacgccgccatgacctctctggaaacagctatgtagacttcagttcagactctgagctaaggcattcctgtttcaatcagtgactaaggggagtaggtatcagagaggaggtcctcgtggctggatcctttgaatctctggggttagactgagtcccacggtgatagttacactcaacttcaacctacaggctatgtctagaagtgcttatatctagctagttaaatgacagcattgttttatagaacaattaactagagacttctcttgagtacaaaaatctcaagtaaagttaatgaaaatattcttataatttatacttatgcgtatttagggtgatttttcttaattatatattcaatagaattatttttatatagttaaaatcgaaacatatatttttaattaattaatttatttatttatatgtgggtataaggttctgtgggcacatgtgtggatgtcaaaagacaacttttggggtcagttctttctttccactactgtgggttcaggatcattaggctgactacaggtacccttacctgctgagctatcttcccagtcccaagcatataatttgtaaagtacactcgtggttatccaaaattacctaccgtaagtttagacgtttgacacagctatcttctgttgtacagctttcatgttaaatctaatgctaatccaggttgccgccatgtttctggttatgaaatgactcctaaatatacattcatcaaaaagagcccggaaacagctctcagctgatatcagtacagttttccagtgtaatctgaaaactaaaactggaacaacctgaggtgtaaatctcgctctgtgcatgtgcaggccagaataacccctcttctagctgggccttctgtgaagcaaaggcctgtggagagtctcatatacaagtgcatgttagctttcaccattcctctggccaaatgacaaattactaagtggcatctaatcagtcaattgatctaattttgaataggataggttacatttaggtaactacattttcaagtaaactcatatccaagtagatactgttaaggctaaatattaggaagaagggcgattacaaggctaggttggaaaaaaaaagaaagaaaccaaagacaatctttgttctatatcgtgtaacagatgaattcaactgcatctaaaggccttttgtgagggaaaaaaaaattagatttgtacgttctggtttgcttaacgtccattgttcattcattatcttatttctaatctaccattctcttaatcttgcaaacaataatttgatatgaggagtgaatggaggagggctttgctgtggtacagtggattgattgttgcgctccaggggaggcagcagggtgcaactattcacagaggggcagacagtaaatcactgttagcaaaccccacttgcatcacacccagtgggctcaagtcacagcttcacctcctgcgatgcatctcttagagttaggtttctcattgcttcctagtcccaagcatcttttcggatttactcaccacttactgtctctaagacctcccctccccccattcaatcaaaaatgctagacactgtaaggtggcagttaaatgtctggggtggcctttattcatctttagatctagaatcacaaaataagaagggcataattgctttccagtgtttctttttctttatcattttgaaatgctgctcttttacccaatgaactattctttatattactgaatcctttaagaagaactcaactgctttttactaagtcaacctttcctttatgaatggagttcttgctgtctgctaggcactggagataaaagtggaaaaatcagagactgtgcaagggtttaaggcttcttctagtcaaacagggaagaaaagcattgaacacaccatcgcacgggatctcaactctggctgtgatgtaatcagataaggctggatttggctatgaagtaaatgtacagagtcctttgagtatgaataaataatgagacgtgtgtgtgtgtgtgtgtgtgtatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccatgtgggtcctgggaaccaaacctggatcctctggaagaatggcaaggacccttaaacactgagccatctctccagccagataattaaacaatgtaaccatgtcttctttcagaaaggggggggggggaagaggtgggtgagaggaaaagactgaaaacaaatatgacacatttttaaacaattgttaattctgagtagtaaaagatgttagttgtaactctgtatctctgtatcttttggtttctcctctctctctctctctctctctattttattttattttattttattttattttattttatttagggaaggagatgtaggaaaagaagcaggggaccaacaggcactgtgtcacagaatgaaggaacagaaagtgttccagtttcacaaggagaaataactatttccactctgctgagaattcaaattaaatgaaaactttaaaatactcagtgcattggatgcaattgatacatttagggagaatcttgttgacggattgccaaaactatttggtaactttagtaccacgctctcatcaacaggtatgccatccgagcagaattaatcagagaaagacttgaactaaaacacttcagagagcccaacagagatcggcagaacactatccccaagcactatacaaaacgcattcctctcagaagccggtgagctttctctaaacggcatcacatatgcggatacagatatcaaaggaacgaatgagcaaacgggtaaggcaatcttccactatctttgacgatacttgcttttagaaaagacgaaagtgaaagatgacctaaaggaatagagagcccacagacaggtaacttctaagttgaaaaacaatgtttacatattgatggggagatgcaggaaagggactaaaatcaactgggctgaattttggaaaatgaatcaacaatgcagaacatgggaagagaaaggttgtgagaaatgcttccaccatgtaacagctatgaggaaaggagcaagcatatcccaataagttgcacagtaggtcctgcatagtccagccatggccagcctcgtgcagctggatgactagtagtcccaatctgactactgacgccctgaaagattcctgaacccttactggtcttcaatccatattggaaggctgaagatgctgagccttagtgttaccgaggcatggcagcagcagcaacaacagatgcattcaccatcaagaagcaaagacaagcaggccaagggaactgctttctcctcagagctgttcatatctgggtcaattatagaagccaccctcgaagacctgtataaaggtttgtctcttagttacttctagatcccatcaaattgacagtcaagattaaccattatgatcgtcatacagctgtccaatgcaagcgcagagaaggatgagcataattccgggctggctaaagagagtcaggtgttgacagatcagccaagaaactgcagagggggaggggaagaagaggggaaaggagagagggagggaagaaggaggagggggaggcggaggaggaagaagaggagcagagacagagactgagtcctggaggaaacaaggtttcaggacataggcaggctgcattgtcacagtgcttccgtgaggctgcacattagaattatctgaggagattcaacagacacccaggtccaggtgaaaaacttaaacctttgacacctgaccatttgcatcctttaaggtgctccctgggcgttctaatagcaaatggagtttgaaaccacagattgaaacataaaacaagtttggttaagatgtgtaggaaaggggcaggtttcttatcctcaaactgggctctccaggctnnnnnnnnnnnnnnnnnnnnttaaagtggcagagttcctcattaaatgactaggtatgttctttaaaggcatgcagggtgagcttacctttttaagtcttatttcacacacataacctccccccaccccattccaccccaccccatacaagcctttttaggtaatctgagggaagtgtggatatggtcacgtaagcatctcttgaaagtcactccaggtagcttctagccctgacctaattcttgacaggaagccaccttacctccgggcctccgtctgacccctgtaaaatgtgacctcaggacccacgcggacgatgacagatacgtttgctaatgcttactaggcagtgagtgtcctagattctctgttcacactggctggtccacagcattcctgagacgcgagtcaatgaggaacccctgggacaggtaagtcagctgtggctccagaaagatatcccgggtggcctcctgagaccctccacctcatgccactaaacaataaaacgagctaagtttttaaattctaacattctgtgattctttactttcgttggccttttctcttgacaatcagggtaaattgcagactctcagagcgttggaggggcagagatttttgttgaaaagttaaatttggcttttgggagagtctgaggctgtgaaggggaaatggcatcgtgaggtttctagggttggctcttcctgattcctggagcatcttttctctggcaggcgtaaaagtagtatcacgtggtcaggacatcgggcgcgtaattggatagtgagcccttaggatctaataattgccacgaagattctgggtggtatttctttaccgtcaaaagaaagttcaaattctttccctcttgtatcccacaattttaaattaggtaaatttaatctctctcctcgtggctcggtgttactacaagttaaacatgcaagtattaatattgaaaataattaccctttaaacaatatctggaaacacgatgtggggcacttccaatatatccataaagcaaacaagacagcttaattgtttgtttctccaagggaaggagctaaaccggaattaatttggttctgtctgtgaaacaattcgtttgctctgcctaattctgccaattaaagaacttttcccagacataatcagcatgtaaatcagcggtaggtagcgaagagggagccttggcgaccagcgcggggtgtagatgctggacgaaggaccgattgcccctgaatctgcccattcttagcctaaatctgggtgttagagaagtctccgccaagaaaacttgtccccccaaaccccagggctaggagagcgacacatggaggcagccctcacccaagcctccaaagcctgagcaagccagccatctcccatccccaaccttccagagtcgcgcccagagccgctggtgctgcgcgcgcacctagggccgcgcccccaaccacccgggatctatatcagcttttgctggcctgggaagggtggggatagcatcccctgctggtagttttggagaacagcaggactgatttttcaatttaatcattcttcccaccctttacccaggtggttttgttagagaaaagagagagagagagagagagagagagagagagagagaaaagcccgagggcggaggagatgttgaggacgttgccacgcattcgcttttctttcttgagcactcacgagcagatttttgcacaaacaagaatgaaaatcagggaacgtggacttagtggcagcagccccaaattggggaataggtacaatttctaataggaagcttctaagtcaacctgggtctgagactccgctgacctaacgtgcagtagagattgctccgggagctgcttggccacccggcgttactttccttgaaagctgtggcctcggtgggcaccatctgcgagacctactctgggagcagcagcctaggcgcgcagttgcttgcagggcgcaggcggcgcggccgggaaagcgccgcggctggggggaggggactgtagtgtggcctgactagttggcacatgcctgtaactgcaagacttctttcctattgtaagtccaagcagcggagagagtccgtgcctgccattcttcatgcttcataacaatagagccttggaaatagttgcgatttcccttttccaagaagctgccgggttcctttttggtattattgttcgagtcttatttctaaagtttactcatttctaagaacaatcctcattgcggactttgaaactaagagtttaaaacagatcgcgatctttaaccacgttctcagcacagtagtttatatgtttatttagcgtatgctatgaccgactgtgtgcacgaactatttttaaccacatcgtcttgtatctaattcatctgggtagggagagggtccatcacttccagaaccaaccacctcatacagtaatcagaaatagaaaggttcgccgactctttaaaacttttccatttaagaaaatcgatggagaaactctttcttgtaactcgctcctcaccaagtctatttttatttatttttctgatttggcagggctcagtaatgctgtctgggatttctttcctttttcttctttttcccccactttgctagagcagctgtgggggtggggagacaggggctgggcttctcctagagtcgcccccgctgggacctcccgggtgcgcgcccgggggaggggaattgaagtgataggaagccgggctggcgactcagtccaaagctccacctgcagtcgcacggcagcaggtctccttttcctttggctcgctcacactctctgcctccctctccctccctcgcgcacacaccacagctctccttcgggtcggaggagacgccagcccagggaggcggggttgctggaggagagtccgctctgcgcaatccagtccgggacttggctccgcccggagcgtcggcctctccagtgacacaggagtagtgtgccgcacggggtgaggctgcagccaactccgctccccacgcactcggctgcctaggcgctcgggacgcagcacaggcgcttttccgcggtgccgattgcccgagatgcccgcctaggagcgtgcggccgcggccagcgtcgccacacccgggacactgcactcggggttgcagagccggccagagccctgcacctctgcctcaaccccccacaccgccccccgccctgaaatgactagttaatgggcgctggcaccgccgaggggactcagaagtgaatccaagtggaatttggatttggaaaaagagtttcttgagcatttaccctggtcctcgctggttttcttcttttttctgttttttcccttttttctttttcttttttcagttattttattttactttttatttttattttttatttttggtcttcctctcacctcctcttctgtcattggagatgaacacagctcgcttgcatcccagaaagtaatcgccgtgactgttgcccccaaagagacaagcacacatgtaggaatgacaaaggcttgcgaaggaaagagcgcagctcaaggcccagagagatcttctcgataatggattactaaatgggatactcgccgtgtcagtccgctccgagccgcggccgcctgcccgtcgatgcaccgaaaaggtatggctctggcatccctggcgccccacctcctggatccaggctggagtgagggtcctggggttaccccgggtgtgctttgtgggctttgtagtgcttgtgttttatttggtctcacgtctctgtctcctgagcgttgtccctctctggggggactagccccgagccttgccttcagctcttttctgtcctgaaccccagagaccccgggctccatgtcaggagcttcctcacccgccttgcacacaccaccggcgccgccccggacagagaccgagaggatggctgtcctaccctgtggtgtgtgtgtgtgtgtgtgtgtgtgtgtgtgtgtgtgtgtgtgtgtgtatgaccgagtctaagagctcactcttgggctagtagggaggagagcggccctggagggtgggattctctaaagcgccgggtccccggtgtcgattgctggagaaggggaaagggaaagggttctgccctcgaggtgctagagagggtttgggagtacaaggttgtttgtgtcccagccacagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttttgttatcagtgcggggtctgggctgggcttggttgagtgcgtgaaacttgtaatggccctgagcatctgcgcgccctctctcttggtgggatccactcttcagtcgctgctggcaccagaggttccgggctttgtttgctggagaaagtgcctaggaacagtgtctttatatggcgcggcgcccccgccctaggtcctgtcccctgcctcagctcccactcgagcagggcaccatttgtcgcagctgcgtctctctcgagcactgagctctccacgctagggctggcccctgctgcgtcctcctccaagacctgtgcggtccctctcgagaaaagatgtgcccggggagagggaagggtggggagacctggtaagagctagctctgggcttgccactctgatgtaggctctgctgggctgcagattgtgggtgtcctgactgcttgctgtgtcctggagccctgcttctgtggggctgtggggagcctgaagcaagctggccaattccttcttagcgaccctactaggagggtagtgagtatcacttcccccgaatgccgcgttttactcagctctccacggagggagacagtgtatgaagcaggatctgaggtctcccgcgggctgtatagagccaggctgctgtcctggtcctgcgtgtgtcagtgagagaagccggaccccgacatttttttcccgctcgctcgccgctcctttcccagcgcctcctcccctttacagtgcagggtccctgtaccaggcgcttctggaaagtttctgtgatagcttaagactcccggaaacaccagctgagggctcagcgtggtcattctgagaccgaacgaattgagcggacaactgggatgggagtaggagctagacgcctgcccactggagaatggtacctcctgacccgccgcacttgctggaccagggtctcaagcaactggagtagggccggggcgagggggtgggggtggggttgtcgggacgaattaaattcacgatgctagtgtgaccacaagtggcggacataagctactgtgagggcgcgtgtggacactggctctagctcgctggctcacgagtttctggctccaagtgcagcatcccgaaccccctgcgccaggcgcaagccattgcggctcgcacatgcccagggagagagaagcagggccaggtgttcggagtggaagaaagaggaacgattggaggcgctgtcctcctagcctgggcaagcgtttccagggacggcctccagcctgtgcagaagtgggcagtcctgccgacgattccgtctcagtcggtgcagagcaattgtggcagccttgagtgtggtgagcaagcccagccacagagggacctctccctcttcactctggataaaatggagttactactgaatgggatccttgaaaggcttaaaatacggttgaaacctggacacacacacacacacacacacacacacacacacagtattcacaacttttctttccatttaactcagttgtaatgttctattagtgggtctcagaaaaggctatcgtttaaggaccctcagttctggttttcttgggttgggcaaccgagtgcctttgccttgtttttccttaatcctggtgatttgggccttccttcccctggtggacttaaaattttggcgtcaaatccaccatctgctactgtgatggcaggaggttagtggtttcagatacattaattctttatttagctccctccccgcccccctgtaaaggcgcctgtactggatttttgaatgaaaataccacagttttttttttttttcctctccctacccaaacagctaccagaagtcaaaatagcaagcgttttgtatggtttataaactccacatttagtcttccacaataaacttttattaaactactccaggcaccaaaggtaattattaacctaaccttaaatacagtggcagatctgtgtctcctctccccacctaaactgtctgttaaaatataattgccctggctgtttggattggggttacctatttctgtttatgtagtaactctttgactctttggtaacctagcctttgctttcatacattcttgaatgaaggactttgcaaggcaacctaagcagggaagaaggagcaacagatttgagaccttgattttgttccagattctttagagtcatcttgctgcaaagtatcctatttatttctttttgttatttactggggttgggagagatagtctccctcatgtgttaacattttacagctgtgaccacttagcaattgccgcatccccaagaatacatgcagcctgcatatatgaatgttaaaaagccatttacctttggaatcacatcttgaagagtatgtgttggataaaatgtccggattcaaatagggtaaaaatacatatgaccttgtgtagaactctcaagaaaatgatgaatgaataaagggatgaatgggcttgtcacgcatggttcactattttcatgtagagcaggcgggtttttcttttcctgtcgtgaagacagtgcttgccagtgagtgatgattacacagtgataataagggtgactctctgtacacaaacacacacctctcaagttctctccacatctagtagtgcttttgctctcattttaaaagggagaacatttgcattttgaggaggcgtgtaacgttgcaccagtgaaactggtcatgttacagaaggatggcaagagttacacaggctgttaccactgaataaaaataatgcgtcccagtttgaagaacttgtactaaatttacagtaagcacctatgcttgcaaagtgaagggtaattacacttacatacgaaatggggggggtactttcttgtataaggaagtttgtatgtgacccatacattgtaggcttgttcttttcagagtagtataaggggggtgtggatggggtgaaaggacattttagaactagttttgagggctagtgtactcttccatctaatttgtttacacaaagggaatcagagaacaagccaaactaattgaaatgctttaattagacacctgccatttcacctccacagcaagtctctgtctacacagcccctccccgccacaccctccctcgggttaagacgtttctggtcctcctcccagtgtggactcgctttgctttgttatttaagaaccatgtgttacagcacctaggtttgtgccaggggaaggtggggccgtggagcatcctgctgggccctcccctagccctgcctcttctcccagggtatcctggagccaaagagctctgagatatttttatttcagagtgaaggcttttctcatttgccttcaaatgtactgcaagagcaactgagctattctctctggcaaccacttggctgcctcttggggatatggtaaggtagggaagggagggaggcatttaatccctttgaaatgggcaaataagatgtcagacccacaaacctcaagggagaagcgagttcagggctacttagcatgggactattgcagagcagtagatacacaagggcatcttgccttgtgaaacaggcgagctcttgcaaaacatgttttattagaataattgtaattgcactcaggagggtcacgttatactaccagcacaccgatacccgtataacctcttcttccagaccaggataggaaatccctagggcacactgggtaggtagctcgtcttggaccttataggtctctcacgtctaatgtgttcagaaagcattattctagctcattctacccaaatcagcttactccatcacctccaccgtggtaactccatgagtggctcaggccccacagcctgtgttcaactccttcccttgtatcataggccagttgcagcggcgtacaccatcttcaggacgcacgcgcactctatctgggtcggccacctccctggccctcattcacatagtcctcctctgctgggctttgtgcagcattccattagttgccctgcttctgcttttgactcctatcaacttctctcaatacagcagcgaaaacacagcaagaatgaaaagtaaagaaattcctaagccagctcagctagcctatcattttctaccaaaaacttaagttcttcccctggcacaggatctgcactctaccctctctgtggcttccactgctctttgagtttactatacctgtgggcatgcggccctggaagtccttcacggggtctttttttcctttttctttaaaaagatctatttagtcatttaatgtatatgaatacactatcgctgtgttcagacacacgagaagagggcatcgggtcccattacagatggttgtgagccaccatgtggttgctgggatttgaactcaggacctgtggaagagcagtcagtgctctttaccgctaagccaaccctcacaggctcttttgtacgtgctttttgggaatttggggcttttatttgggaaaaaggcctaggaattgatttcagaaacgctgatactgctttgttgggggcatcatgtctgcatgatttgttcctctaccctacagacctccactcagataccactttctcagcaaagcctttccatgcatctgacttacttgacctctgacttcccacccttatcttctggaacacaataccaagaggatgagtgttatctttatggtttatgcactttattattgccccgcctccaaacaaagaaaacctgtctgatccattacccaccttccatgttgtttgttgcatgaataaagagggcatctttttctttttaaagatgtatttatttttattggaatgagtacactgtagctgtcttcagtcacaccagaagagggcatcggatcccaatacagatggttgtgagccaccacgtggttgctgggaattgaactcaggacctctggacgagcagtcagggctctttaccactgagtcatctctccagcccaagaggccatctttttgtaaataagtagtctaggtatcatctccttttctgcctcctttttcttccgtctcatgtgagatgcttccctcctgcatccctgactgtgcatctgctggcttccttgtacacaggcacgatttctcctctcctgttagtggaatagtcacagtgtgttgttttcccagccttgataatggattagagtctttcccttcccacaggctcacccagtccatttctagggccaagagcacacatctgttagacacctggttctagccagaggaagtctgaactagggaaaatcaacttgacaagaaatggagctaagaagtagccagcacttatggggactgagctattgactctagtctcatttgctctgcattctaatcactgaccactgaaccgttttcttccccccaataattttttctgtttttgtgtgtgtgtgtgtggggggggtttaatatgcctcttaacctttgcctttgccctttgccagaacagctgttaaagaacatactggaagacttgctctccctctcccgactcttatttcttggatgagacacgttacttccctgaaggtgcattatgttagaggagttctatgacttgtgggcctcctctctccaccttgtaggatcgcagatagaatgatatgaaataatatgaaacgtgactctatctcacaaaataacgactggcaacttggaaagtttgatgtctcttctttttgtctcagcccgtggtataattgtaggctctgcgctgtcttctgtatcatcagatgagtattgtatactgttggcatggcctgaatataaaccacattatgaaaatggacaatttcctgagaatcgttgaaaacacacagcccatttctagtgcgttactgcaccgtggatagtagctgtatcagtcagaatgtcaactgcatcaagtaaggactgctttcaatatgaccattatactggggcaaggtcatgagagtggcaatctgccagacattatagaagaagaaaaaataggaacaggattattctgcaatcatatgcatcaatgtcagtgtagccattaatgtagaacagatatgtcagggcgagcgaagaggactggaggaagttcccatatctgcagtaacaagggcaaattcactgtggttgggaatgtacaaggtgggatgcagagaatagtccagaagcagttctcaggtcaagcctggaagagggaatgcaatgcgtgcatgtatgtatgtgtgcgcccgtgcacatatgtgtacatatatgtacacatatgatatgtgtgtttgccagttacaaacaggatgactttgtttcttctgtttctgtttgttaaccctgagaatggtggtagtgctgtagtcgctggaggactaagcagctaacacctgcaaatagcacaatgcctggcacacacaagcgctcatccaacacaaaggcttgcttttatttggaaagtggcctgggaattgatttcagaaacgctgatactgctttgttgggggcagagaacagaaggaaatggctgcggatctggaatacagagggaggatacaaaggaaacaacccttggactctaaaggaacaatcacacacacacacacacacacacacacacacacacacacacactgagccagccatagcattacgggagttggaagcatgtgaacagtttgtgtcaggggaagaggggctatgatccttttctaaggtaataatatcacaccccaaacatgaaaagggaaacacaagcgaaacatcacaacactgtacagctgaacaatggaaatatcggagatttatggcagatcagagaccataagattgttgttgttgttgttgctgtagttactgccgcttataaacatttaaaaattagcgcacagcctttacccatatttagtacctgagggtcatctcttcagagatgagccaaattcccaaagagaaaatgtacagaagagaggcttggctgtccattggaggctctgcatgcagcctctacaagactgctttcagggtggccatgggacaacaggttgatcttccctaaccacacttgggatgagtttggaagaacagggtctccaagttaaatcttctccattacaagtgggaagtggtggactgcccggagcagagcctggcacttattcggctgactgatttcttcctaccaaatctaaacttttgagtcaagggacaagacatcagtgagggaaaaaaaaaatctgatttctaaaagatacaacagaaggataactaaactggtattaccaccacagttccctgaggttgctacctgtctgtgtcctccaggactccctccatccctgagaattacagttattttcagctccggagagaaggagtcttctcaagttctgtaagtggagaggccatggaaagagggaaacaagtcagtaattaacatgcctcaatggcgggctagacccttccaggcaacagatgagatgactcttactttgaaaggatgattagcaatagatatttccacataggtaccaccttgagacttggaactccctttaacatggcacggtgcgtttctcaatggtttccaattcctccttggccaatcttctgccacgatttgatttgatgcctagatagactaggacagaagctggcattttatacaatgaaaacatacccctgggctgggggtgggggcattgtatgagccagagaagaggaaaaaattaaaatgatatcttaattactgtgtgatgctatatggcagttctgcagatgaagagtctgtgatgggtcctcttttcctattgtctttgggtatttttcccttaaggaaagtggtcgtcttctcattggtatgacagtgtcagcagcaccaccctcccctttctgagactcttaatgccctagagtcagagataactgaatgaacaccagtagacccagcatgtgggcatagtcctgtccccagaatggaacacttcatgaacagtcatattctgtaaacatcctcagatgacccagtcagtccctgcccttcccccttcctaactcagggaaccatgtgacttcattcatatatttggggggttgaatgcatttgctcttaggcccccaggcaggcaggtgggaaactcttctagcctgcattcttctcgctattgtaagaacaagtgaggatctgagtcactaagcagagtctcaccctgcatagtgaatgagcaatagaaacgaaatcatctcgagccttccaaactccagtgtgtggagcggaatggcggggtgttggttttgtggaagaatacttgttaatggctttcgagatggaatctgcgctaattctgctcacatcatgaatgatggtcccagctagacaccatctcggggatcttcatctattaatcatggaggctgctttcttattcggttgccatagtttcagtgcctcagctagtattggggtgtctcggggaagatttgagacatactagggcttgcaagccttgcagttattttggcagggcgcgggggggggggcggcgctctagaagagctgaaagctgtttctggtgtaattcagggctagattaaaagaagcaactcctgagagtctctccctggaccttgttatgtgcacatccagctggtatttactccaggatttgcctcttcctcaagtcttgaaagaattcctcagtgaaaaagatttacagtccaaaggctgatgtcaccttcatcctcccgaaaggaggcagaggggctccccctcttcattaagggccattcctaaataaggaggtaaaacaaaggtatccgtagactttgctgacaatgtcaccttctcctagcttggtttgggcactgcaggttgctaagtaagggtgatgacatcattggggccacgccttgtgcttggctttgcaatgtaaaggtttgacctttactttgggtttaatcttcactctttttaagtccaagttattgaggtgtttgaggccatttggttgccttttatacaacaaagggataaccttggaccagccagcctcctgtccatgtcagctctccagcagattaatgttttcatgtatttgttattttaatgtctcgtctcggggacctgctgattaggggaagttctctagtggtgtgtatatcgggtggctacatcaagaaggcatttggggaggcaagagctgcaggagaggagacaaaggctatggtgctgtgcctccccatgtgaggcaggccacagctggcatcccatacccagtctggcccagggtcaggagcactcatgtgcttctcttagttcccgtttctcaagtggactttctggaactcctacatatccaagccaagcagtttgattcctttgtagattaaaacatttaaaaaaagaaaaagaaaaaaagaaaagaaagaaatcttacacggggagagacaaattgggctgaattctggacaggcaacacagcacgtgaagaggcaaactttgaaatcattacaaacaggactaatctagaaaattagtcatttaaaaaaaaaaaacaaacctagaaaatgactagtttttatttcaaagtgagcttcaaagcagccgttttaaatttccccagaccttgccaaaatgtctgtgtaagatcaacaagcgttttgaacgcacgcgcctattgtaaagatgcctcccttacccaaccgcaccgaatgattgattttagagaccaataatatgaagtaaatgaaaaggataacatggccgtaattgctactggcttcaccaggcttctgggcactggaattccttgtggagaaacacttttaagtgtcacatcgggttttgatcatgtggtctgcctgccttacacataggttgcaattactgactgcctgtgtttcacctccccctcatgtatctcccagaagcaaagaaagcatgcttttgtaaattcagaattatagacccttgatttttggggggggggggggggaagagcagggtaagaaaatgtttctgctcattttgcagaacatatatacatatatatatatatatatatatatatatatatatatatatatatatacacacacacaagcctaggttcacacacacacacacgcatgcgtgtacacacacatgcacatatccatgtactgatgcatgcacatgtatatgcatatggaggaggaacacaatgggaaaaaaagatcaaagctttttcgttgtttctaaaagaattacagtaaatttagttcattgccctctggatgataagaagattgtggctaccacttggggatccagttaaacataatattgcaatgctgtttttaggggaaaaaacaaattgatgctttctgcgtggatgccaatccaacgccaagtggacttgaagcaagtttgacgatcaccagtgtttcggggtggggtggtggctgtatttagatggagcattttgcacaggaggcttgtgcgcatgcactcactagatttctaggcaaaatgaagcgcactgggttctcagtgtgatggagagaatgaccctgcctcctcacagaatggccgtgtgaaggtaggaacaactggactgctgtaagcaatggagcctttgagtcttgtagaagagctaccttttacttcaagactttatcttcttcttcctatcttctgatatttactggctccacgctatttcttccaaagaatagaatgggactttgaatactgtcccaattctttcaaataaaagtgtgttatatatgggaggctgtggaccaagcagcatttcctttacccagaagcacctttagtgggtgctaaacataacactcagggaacttggaaaactctggaggaaacaggctctaactcttgtttacaagaggttttgtgtgtgtgtgtgtgtcatgagttttataacagatatcaagaaactgaattataaatgttaatgtgctatttacattcaacttttaaccagcgagtctaataaaagttagatataatatataaatgccaacttaagaattaaatttcggtctgaacaatcattctgtagcttatatgaaaccttaatgacatataggcccatctagtttagcataatttgtgcttatgaattataaatgcttagcttttacaattagacctacccagctgtaggcatcttaatgagaaattaccaaaattgaattgatttgtaatatccactctaccatgttccagaatggtgattaccggaggtagttttcagagccatctcccgcagtatgcggcaggaaagttctgtggtaggatccgtgtttgaccgtcagagagatgccagaatcgaaaggaacagaggcagttcatatggggccaagagtgtgcgcatgtgcatgcatgcagttcttcacatgtgtgctatgtggttacatggaggtcagaagacctccattttaaggatgtggttccctcgtccctcttattttgaggcagagtctctcctgtttctgccactctgtgtacttcaagctagctggtccaggggcgtccagtcaaggcttgccacctcatttggcttcttacatagatagactcagggattaaacccagctgctcaggctgcactgtacgagctttttattgaccaagccatctccctggccctagacactcttttaaagtgatgctcagagtccagggacatttctattttaaaaaagcaacatttatatacaaggtgtttcctcttatatgtgctgaggggaaattgaactccttgaatatgctgattaattaatcctccagggatatcgcagagggtggaggtttttcttgtcacattttactgggcctagaacacaagccctgttactattgcccaaccaacatccgttcccaagaataaagaggacagcagcagcatcgcctttgctatgagaaagcagccagcatccagtccttcagcagatctcaccagcgcgccaggtgtggaagagaagactttgaaatgttgtgaatagcttgacattatcacattattattgaaatgcaaattcttcccagcagaaatgaaagggcgaagacaatgtactttcttgcatattatcgatcatacctagccttatagccttgcctggagggcttgttctatgagaagtattcatgatgtgcatgccccgttcacctcgtgtgtttactgtgcacagcaccccctcccacgtgtgggactacttgtccttatcctcaaagggaaagatgagctgccagctgagagctgctcctagggggcccttctgtaaaggaaagggggtattgtccctggagactcttggcaagtccttcatcagaactggttggctatattgatcactgtcaagagtgttagtaataaggattcatttatatactgcttatactgcgtattctttccataagcgtgtcaacaaacattgcctcatttcagctcattacaactcgggttgtagggcaggtatggtaatgggttaggcagggcaggtgtcattatgctcaattttaagatgagataactgaaggttacagaggtcaaataatttgcccaagagcagatctctgataagagaaagacctacaatctttgagtgctgccctcccccacccccaaaatctaaaatgtcacagtgttgtttactcaggactttcataatttgtaaaaaggacagtttttcatcacagacattctcacctctgcctgcctgctctttgaaccctgctatgggacacatttagaaactgtcttgagaatgccctgccctgccctcagaggccacagagcaattaggtcctgaattcctttcttcttgatggagagcattgttgaagggggtgttgtcatccctggagactcctgaaatattaagacaaaagtctctcaagaaagaccagttgaccatggagagcatttttattcaggactcggctttacagctggagttggaaacagtacaaggtgtcaactttgtgacatgagggacaaaaagttcaattagatattatggtgggaatgactccctaggatatttgcacctatgggacagaaatgcactttttaaaaatgtaggaatgaagtagacctcataacacagccgaagtgactcgtccctctggcacccgtcttgctctgtctcagctcaactactggtctaacgaaaggagcagctggcctttaacttagcatttagacatttagtgctttctctaggcgcagaagcatcctacctgaggcacagacagtggggagtgggtttagaacatactgattaactgtgaacatgtagagggcgggaccaggagcccatgttctatcttttcagcaagaagatgacatcaccaaatagttcttcctgaagtacatatgcatgataggactgtgaatggacagaggcaagccctggctgtatgggcgtggttcagccagcaggacttgggaactcactggctgtgtgatgttattggatgtgtggggtacagagttgatgagtttcagatagctctgagatgtcccagctgggtaataggtaatgagagcagtgacactggccaagacaggaggtcaggttaacaaagtatttagttagcagctactatatcccgagtttaagtcatatgcagtaaactggatatcaaaggcttgcacacagatgtactgctctcatcctacctctgtatgatattgaaggctttcagatgaacggctccccctggcagccctgatgatgctttgcctagccttgagccggttctcagtaagttcaaaagtagataccacaaggaagactgagcactcaccaccctgggcgtatgtggctcatgtaaagaccaggcgtgtgtgaatgagcgcttttctgtgggctgcacagtcctaaaattgaacaccgctcacacagtggaagggagaatgtgccgtttaatgttttattaaaaacatcttcacggtataggcgattgaggtcgctcatatttcattttgtggctctaatctttagataaatattgacattgtatggttgcccagatgagtcttccaatgtagtataaatattaagaaatatttatctttttgtagagtctccagaagggtgagtctgctctgtttactttcatgttgcactttttccttatgggattttaaaaataaaactagtagtattaaaaaaaaaaaaaaaagtcttattcctacctaggagttccaaaacaaggctgagtattttgaggaagtaacagaatattaaaagtgggcaataaaatgagtaaagatgagaaagtttaagtgttttctagggttgggggcattttaacagactcggtttttagacaacagactcagtttttagacaacagactcagtttttagatgggaaaacctgtatttttaagagcacattcaaattgaaaattaatacttggattctttgagagaaaaaaaaaacctggtaccatgttttagtcgatgtcataatgctgagagctgaatttacatcactatcgattcccctgtcaaattattgcacagatgtgggacagctcgtctctaacttcactggtaggctgccctctagtggcagttggcctcagcgcacccacttttgttatgattccctggaaggtgagcgcagagtgttaccacttaatcaccagccacctccactacacggggcctctaaagcgacaaaacttccaatgaaaggtctggatggttatgataaattaaaaattcccatcacaaatgctcttgatagcagagaggataacagtgtatgtgacaaacacattgatgactaaaaagccaacactagaaaagtttcaggactattaggtagtagtgcttactatttgtttgtttgttattttctttgtgttccaaaagatccatatgtgctaaaaataagctctgtaagtaactttagaagctctttacataagatcaaatcaaagtagcaagtgccaggagaattgcggtcatccttggagctctcaggctagtgcattgccctgttccaagccctctaaaagtaagtttagcctttttgctttctgacaatatgaagaagcctggttgcagccacactgggtgtaagtcctgtgccgacagtgggtgccaactctgctttgccttggctggggaatgagcatactccagggtctccaataagtgcagagaaaatgtcagactcagcagctatgtctgcacgtgcgatgctagcactctgcctgaggtacagaggcggcatgtcaatgatccgagtgtatatccagaacacagcagcagaatggctgtcatatttcataacagtggcagtgtgctgctgtggctgccactgctgctggtggtacttatcctggcatttcaagacagagatcagaaggaacgaagaagaacctgctgatgccacacacacagcacagtgtagaaagtccaccttatgtcccttgtacatgatgttctgatggagttctagagttttatacttggtcgacagtggcttctttgggaagttactttatgtctctgtgccttgttttcttcatctgtaaaatgggactactaattgtgtccaccttatagggtaattgagataacatacctgaatgataacactcaagaaaagtcagccattattattcaccatcaagctgtcctaatagaactagctaacccctgttttctgttgctacctcagtgtaggttgttggaatggaagctaaaatggaaaaggcaaaacaaatcctgagagtgtgatagttcctggtgagacatttgcttgccctccgtatgattctgtgtgctcctctgagtgttagggtatggtttaaaatagctgacttagtaaccgtgagttcattaaaacatgtgagaccttacattcacaaaccttgtgttttgagacagggtcccactctggaaggcaggccgttgcaggcatcgcacccaggtccaaagtgttgagtaagtctttaagggtaaggaagttaaattccgtgggtccagggctcagtcaggagcaggtttgtgagactcttggtgcctgggccacatcgcagtgttcttatactggggcgtgcgaagctctgcgcttgcttgagactcgcgttgatgaagggattcctcgctgaatgagctttctgaatgcaatgtttagattggaagtgacgtcataatgttcaagaactgtcactcaaaaggctgtagggaagtctcttctaaattaacgttaggctcaaaactgacatatgagtgggaacaactttattttctacaaaacactgcaaaacactgtttcttagcctcatctactggcacgctggcctgtcaaattgaggtcttagcttcacacacacgtagtctccaaaagatctaattcctgaacagtaaagtggccaataggaaaacaactccctattctgagcaggacttcaccccctatttaggaaggcatcatgaggatatggaaaaactggagattgaagaagaatctagagggatggctcagtggttaagaacattgatgtcttccaatggtcttgaactcagttgacaggtccaactgcctgtcaactttaggtgaccccacaccctcttctgctccccaccggcacccacactcaaatacacaaacctgtacccagacacacacgtatacgtatcatgaaagtaaaagcagtattgtacacatatattcaagagtaaaataaacattttaagaaaaaaatatatataatgaaagcaagtgggcagtgggctggagatgtagctcagtcagtgtggtgcttgcccagcagggtcaaagctctggttcctacaaccagcataaacacaagcttgggggcacaagcctgctatcctgtaatctcagcatgtaggagacagaagggtcagaaattcaagacgctcttagtctacagagcaagtctgaaggcaaaccagtgtcagaagcaaaacaaaggagaaagatggggcgaagtaaggggtcaaactgatcagcaacctcgggcaagcaagaatcctgccttatcgactccacttgtttactcaaatggtccgcacagcctagtctgcaaaacataaggaagttgttggtcagggtttggggagtgtgctaacaagcaggagctcggagatgggctgtctctagagacagatgataggaaccggggccctccccagcggtagcaaaccttgttgctcatttggtattcatccaaagttggggaccatctgacagctgtttggtgttctttatgaaatggatttggaccccgaccagacgttagtggacagctgttcacaacacaaaacacttcctcagaagaggcactaatgggcagtgccctaatgtcttcacaagtaaggcaggagtgggcaggctcagcaatgaccctccccacccaagcctggctgcaggctgagggtggaggccttgttggccactgagccttctctacagtcagagactttggaccgcagggcttcttggggggggggggggtaaggagcctccaaaagagtgtttatgctttatgtatacctatgcctgtgtgtgtacggggctagccttttcaaaatggtcagccaatcagaggccacttggttgccaccacaccatatttactaagccaaattcagtagagaattttttccacagctttgcttcctgtacagtatttgttagcaatttttataaaagttactttgtaaaagttatttataaaagttttatgaaggttattatgcattgctttcatgtgagtatctctaaatgaaccagtatagtccattcctccttctccaccctgctaattactgactagtgaccactgccatggagttttgaatatacagtccggttacaatggactttaaaaaccactgaccacgttaaagcaggtgcttgaggggccaattggtttgacaactgttcatcaataattacatgggcttgcacctacctgtgtacctgcctgtgcagccttcaatgggctgttttttaattcagcagtcactggagtgtctgaggcacttttttgagttagaattctctcatcttttcctttcaactttgcaagttaggaacaagctcgaagtcactcttgccgtttactgatggaatctcagccttccacggattggcgggtgactctttgtcagagtgcagtgatggggaaacagcttgctccccattaactgttcgtcgcttctctttacagagtcaggccatgtgcagacacagaaagggacactctgtgctctgttcccgtcaccccattcaccccctctttccagaggtaaaagtctgtcctattctctacttccttctaaaatacgatctatgtaagccagtcctgatgctggatacactttactaatcatagcagtttatttagaagagattatagtctttgttgaagctgcgtccagttgggtggggaaagtggtatgtcctgaccctggtatgcaagtatgttggggttttcctgccgtcctgcgctcagcatttccacagcagtaagacaccctcctccccttcattttatagtgtggctcctgctcccatgaatgaaaggccccgactaaaggagctagaatacacccagcagccagtgctgggtactattgagcccattgttttctcccagctccgtggagccaaatctcattttatagcacagtgtattctaggaattccactccatcacaacagactttctctaatgccttcctattttccccatttgccgctgtcacaggcagcgccacatagtcctgcagcaggcaattagaattcactcctccccaaggctctgctctgccccatttgcaaagggaccacaaggcatcagctgccatattaaagagacactaatgacagcaggggccaagatcagccaaagcagtgatggagaggaggtgtttaagattcaattcctatgagggactaaacctggagttcagacacgctcccactcccgtgctaacatcgaggtttaggagacatagggctaagactgtacttgatgggtttttcatatacttaagggtaagtgaggtgggtgtgtttaaagtaaatgcacgaatgaaagttccccaatagggtcgcacaaaattacgtagtgctgggtgtatttgagctgtgtgtgtggttttttttttttttttcctttatagttttcaaagaagaatgcaaactagtaatactgtcctttggaggtgccatttgaagatttccaaagtatcttggagtctgttttcttcctgctggggcccctggtgttttgatctgagatgtggagtctacattgtgactaattggaccctgaacataatccagaaacttttcaaagactttctggtgcactttgacaatggctgaatgacacattattcatttttgtcacatctggcaccacaggaccactcgtggaataatttcctattgggcttatgaagctgccccattagtaatattccctgggagatggagtgtgaggaattatggtgtgcctgggccttcccatgatagaagtcgtcccgccacgttaaattgatcgaggtcttccctgtagagagcagacagcccagcgccacatttagagtgggttgtctcactttcttactcttcaggcctttgtgactggagattctgccgtggcccgtgcactgggcttcggatggagcagcagcgccatcctctactgacgtggaccctggaggaatttcattgagtcccaaatcattaattgacccaggcggtggccaagtaatcagtgtagttttcaaaggtcttctgcattcaccatctcatttccgtttcacagaaccgtccacgcctgcctttgcctcatttgagaaatagatggaacattcttctctcaacacaaagagagtctgtataaagttatgaggtttttttaaaatattttcccccagatattacaccgtgtgctccccagcttgacaaactaaagcttggtggatgtatggctgcctgcaaaatcttccttttccaagcagtatgaacatcggaggatgccctaggccatagactcgtcttttcacatgtgaaagaccaagtcctagccagtggctcttcttatagtgagtgctcttggttagactatggttctttgatgggtgtcagtgacattccagggtggagtgaccgtcaggtttttctcttgtggtttcctcaggtgagtctagaaaactacacagaagctctataccctgggcaccatgtcttgcaagaaaatgcttccggtaaataacaggcaggtgctccaaagcccaggcttggctgtcagagagttgatggcgcctgatgcttaaagttgtccccagacactcacgtatcctgaggttattgttgttgcctttgtagtatgtctgcatttaattgcgaacacagagctgatacaggaagttttgattacaacttatgtaacatctagtgtgtccaagtccactaatcagaacaagacttaggtggctggagggaagtgaacagaagtctgtgtgtgtggagcagacagtagagccagtgcctaaggtcagatccatgtggcatcactctgactgtgtggcctcaggcaaacagtaacctcgttatgtctttatttgctgtcttgtacagtggagtagtagttggggctgcctcacaggtagccataaggattcaatgagtcaatatgtgtggcttgctttaagtacttgttacactgttaatactaggtaagaactcaccacccccatcctctgtgaatttatataagcatgctggggagatgagccgatgagcccagagaattttcacgtgtgtgtgtgtgtgtgtgtgtgtgtgtgcgtgcgcgcgcgcatgtatatgctagaaattagcacacagtgatgattgaacacctggatttggcttttgtagcccttcttcgcccattttgataccttctctgatatcaaagctactatgtctcgccctcttcctccacaccccttcttccactctgccacccatatttcttttagtagtgatgagtatctcatccaggtgacactccatgaaggccataaagccactcatcttcgaagtcaccagtcatttatgttccacgttgcttgttgaatgtgctcatgggtgacgtaaggctgaaaggggagctaatttcttctgtcagggttggaatcctgttttgttgtttgctgttgagacaggatctcatgtatcccaagttggccatatattctcagcagatttggttagtttaggatgaccttgactttctactcctcctgcctctacctcccttgtgataagattacaggtgtgagccaccatacctgatttcatgtcatgctgaagtgatcaaacccagaggtttatacatgctaggcaagcactctataaacagaactacacccccagcccagtgacctgctagatccagtttgggattcagaaaatccatgggaataaataccctccttttgctggcagtggtaattctttctagaggcttctgactagggaaccactccgaggatagcatttcttgttttgtgagatgattctggtgctgaccgcatgatgtcctgtctgtttgaacacagcacgaagctccagtcaaacctaaggggtctctatcattactagccaaagaacaccagggcgcttgtcccaggccctcagactacagagcacagagatgtccactgggcacacgctgacaagtccttccagagctggtcactggggaagattacgtcaacctgtctgggaaaaacatctctccctgttttcatcgaggttcaggaaggccagtcagaggcaaagtgtcaagttcaggagactcacggggctcttcatatcccatggtcttgttggcagtggcactttagcagtattacttcacagaccttatttcaagtttaagactaaaaggcagaatagtggtgtcagataaccctactcttgataatccccctctcttaaaataatccagacgttgctgatgctgtgaaatttgtgctgatccttcagtacatgtgtacattttttttctctcttaaaataaagacctagtaggcttagaaggagatgttagggaaaataactactgacaatgagcaggactgtgtaaaatttacgttttgaaatgacagtgatcactttaagtttggtcagcaccaaaataaatgaatgaataaaaacaaaccaacaactctttaaactgtcaacccctttccaacgagactataaagggggccatggggcttcttattttctaggttaggttctatcagcaacttaggtgtgacatcaagatgacccctcagtgggagcttggaggttgtaactggtatttggggtcacagctagttgagtttgaggtgtgtcatgaggggctatatataggtagtatatgccattgtcagagagacggctgtgatgttgtaaaaccattgatcattctgattatcgtctatatgctagtatttgttctgtaaaagtattataatttgcatgtggcataaaggacaggggaagcctcgtgaacttctaagtgaagaatgctatgcttcacttctgtggtggccaggaaggcactcatgtgctaccttctggtaacagtaattggatatttatgcctcattagaagagtgtaacttcctagatattataaatcagctcatttttgttttgtgtctccagtttccacctccacttatatgtctagtcattgttgacaaagttaaggtaaaaagtgtcctttatagcccctattagaggagaggcaactagggggccactgggtctccccactggagatgtctccactggagcacccattcctcttcctgacgccacaaggctatttcttctgtcagacaataacataatcaaccaagaatctgtttccagtctctccaagccatagtgttcccttcttaatgtctggactttccctattccaggggggatagattcaggttttaaagggacctcctaaactcccaagagaaagttttatctcttgactcagttctcatatactagaaatacatgagacttatcaaataatctcttagatccttgatacccaaggattcaatacgtgattttcttttctccctggtttttgggtatcaaggagaaaatacatcaggcttactttattgtacgttattgtgtgtacatttatttgatctttccattagctaaaaaccaaagctccctttaaagctagttgctagtactgcataagaccatgctttgcttcttgtgtggttctttccagaagtgggaagtgcagggagaaaaggctgctcatttctatgacgcctttattttctagggctgcattcttcaaagcatagagtttaaagtactctggtgcccattgtggtttacgcaaggagactgtgcggctgtttggagatgaattgaagacatccagacagtgagaatagaccatcttcttatctcttctcctggctccgtataatctgcaggcaactgttccctggcctcagtgatcatctcactgacaagcacatttggtggctaggggtatatctcaaactcctcagctgaggatgcttaacgagcctactgtgtgagtggactaactttcccatgacgggcaacattatctttacatactacacaatgctaagagatctatctgcccaagcaggagtttcaaacttgtctccattcaccatcccaaagcccattcttttctccagtgtcgcaaggagtgtgatgttcaccaaggtacaacatgagctttgagaacccattgttcaactccctttacgtgagagtaccctgtatcaggaatctgtacgtcctcctgggaaacaaggattaagattcctaaagtaccttaagtaccacattgagaaaagaaagctgtcaggaagggtagaggcactgtaaagtggccctagctccatagtgcgacgctatgctacttactggagctttggagtcagtttaagattgatcagcccaacatctctattggcaggtgtaaatgaagagatagggtagacggtcttacacagaaaccagaacaactatgaggctagaagccctagcatcaaagatgcacctggagagggatgctttgcttcatggttggaaatggtattagtttgcaacacctaaggacaccatagctcttagaaagaggagtttatagattgcaagatgcaaagtataatgtatctaattaatcatgctggtcatgtccctccttatttgcagactgctttacattcattggtgttgactggaggtcactcggtatcttaataaaagtatcagatgtacagccatttacatcattgcattccctcctctgatttagatccaaagatatcattcgccagccctaatgcttgcttgttaataacattggtaagaaataaagcttcagttagtggcttccttaatagaatcagtgttttactaaggagaatcaaatagtgaagcgataaaggaaaaatgataaaaaaaaaaaaaggcttctaaaatagcctctttaggaatatagagaactgactcacttttgataacaaccccttcctatgtctgaatactggaacataaacataaattgcagttggacaccctcagagggcttagtgtatgccctggtaggctccacttcagatgacctgtatgaaaaggatcaaagtacatattttctataacactgaatatgaaatttttttcagccacgtcaatgcccaccttttcaggacacttagtgctgatggtattacctaccatttttctttaatgccacaagataaaaaggacagcttttttttttctttttttaaaattctaatagatttttagaaatccctttaaaacctcttttagaacagcaggaaaaactgattcaaaggcagagcacaaacagaatgacttaatggacataaggcaacaaacacaagggaaaaaactaggctgggaacctaaaataaattgaatatataacacctttccatttccctcgttttgtgtgtgtgtgtgtgtgagaatgtgttatttatggaaaagccagttgattacttatcaggccaaagcttgtgtttgctcagactagtgataataaacaataaaaagagatagaaatggctaagccatgcagagatgggacagggaaaataggtgtgttcagtataggctgtgagcccagtaccgagagctctggaattccctgcagtgctcttacgttaattggaggggggttactataaggaactataatgagtatgggggcttcccaggcaatctcctggccccagggaagagctctcagtaattacttagttctatcccacagttgggtggagaggcatctgaaaccttgttctgagccagctgcagcacggtgaccctagagctgattagaaatgcaaatagtcagacccatgccagcccacccagagaggactcctcaccctgtctgcaggtgattggctgcaggttgaactgtgggaggccctggttgaaatgacacctggacttgaggtagagggtgcagatatggggggttatcttaggaaaaggaggggcaggttatttttaaccagtgagttaagtacattgtagacgcacgagggtgtttgttagtaggtttatctttcaagttggaaaggaatcacagtgtctctgggaatgaattacctggaccttgatttgcttgtgactccacgtagtgcagtgcacagactactatttacctaacagccctggggccacgcggacaaatgcagccgaggtaagagaaaacactggctgataaggaagatgggcatttcagtggcccgccggattataattaccaccatgttctagctccttgcatcagtaaaactttgacgccgcctgggtctccagcacatacttattattgaaatgatttatcattttattaaagcttcttgcttccaaaatggtttatagcccttaaaaaaaaaaatctcaactgtcctaacagcctcgtgaacaactaacagctcagagctgtgtgttcccttaattttaaaagctaaatgatttctgccactgtgcctgcagagttatgatggatgacagaacgcatggtcaccgtgaggatggtgggatgaaaagatccctccttggaacaggttatcaccgaatctgaatgatacctctgaacctacatcacacactgcatgtgctccttgtcctcatccggtgctgccatttaccagaacaaacaagcccattaggtggtacttgagccagctctttttacacggttgcctgtatcagtggaaggcgaggctgataaatcatcgtccaattcatcttttaagtcaaagtttaaaagcaataaataccaagctagagaaacattgaccagaaacgatgacatcacaggaatcacaagtctctctttgtccctggaaatttctttgtataatggcctcagtctttttgacagatacactccattctcagggtcatgggagaactctccacagaagcataaaaggaagctgtaaaacgggtagatatcatagaccccgtgtccatgttaccgcacatccacgtcccagggtcatcctccagaaaaactgggaaggaaattcttcagtgaccctagaaactcactttgacaaggaagggccactcacagttgacatggttggaagggttaccttcagacttcttacaaacaagcaaggaaacacaactgtaaatatattactaggaaaaaaaaaacaaaccagaagctagccccatctttcccaatacctaagttattagcaacctaagttattaatagaaacattgaggggcaaaagaaaattctttgtctcatctttaccaaggtgaagatcatcctgagatgaggggtaaaagccttctgctccgggttcaggcttgtgaatctatcaacaagcccacctaatcaaaggacctccacgagtacatttaagagctgcctccaaagatcgtagacctcaccagagaagcaaaggaaacagatccaaagacaaaagcagtggaggcaaaagtgataagggatgggctggtcctgaatttaaccacactggggcgttgaccaggaacactgaggctcaccacggtatcgccccgcatctgccagctttatcacctcatccctcttttccttttgccagcaaacactcaggtcagcacgtgggagtcttctttcacccacctaatcggtgttaaacagtcctggaggctcaggaatccagttagattataaacctttggagaagattaaatagtcatcatgtgttaatcgctcttgacgcgctttgggcttgaaagtggagttcttggccttgttctgaaaagtcacacgtttaggtgttaacgttaagcagcgttagttgagatgtatggggattactcgggagcccgggtatgtttcaggtgtaatgcaaataatctgggggagaaaatggtgttctcagtagaacccactgaaggagaaaaacagaagattaaggaagattcagcagcagtcttgaagaacacttgaagaaagatgagagccaagggctcttgagtgagagagaaccacttctcaactgggtcatttagtcacatattatatgggacagcgtggagaagggcactttactggaccaaggggtgtggcaagagtcttctagaaacattaagtacagtttagttagtcacaaagtgctaggtgcccacgacttaaagattccagttattgtcataacagtaaaagctatcacctctccatcgtacttggaaatgactgtgacatcatcttgaaagagaaaaaactactatttcctgagactggaggtgggggtggggctttcaataccgtgtttaggtttttgagtttgtctagagtctcgagtactccacataggactgaatctcagcattatcatctgaaaataaaatgtctccaaaatgccacaaacaaacaagcaaacaaacaaataaaccaaaacagggaaggttcaagggttttgagaacatgcagatgcaatggcctctgatcgtcaagaaagtggtgacagtctaggggtaagtagagagaggcactgtcacggtgcctgcacacaagagggatagatttgcccttcctttctcaccaacaagcccacagacaccacagatacttccttccttcaccacagacacttcctgcttctcaagcatgatggaaggacatctgtattgggcgtctcaagtgatgacggggcaccacactttcggcgccaattgaggactttccagaaacttcatcttcaaagaaatccagactctaggagtcccagtagaacacagtgttcaacttttatcctgttagtttatttgatgcaacagatgtatgcactcatggtgcttttaagttctgtgtagtagaaagttttgggggaggaggcaaatgttttctggatgcttttaatgaaagataaaaggacaggaagggttgctgtgaatggggctattaaaattacatgcctatacatatatgtagcgagcttggagatggttctcgtgggaagaagcacagtagaggagtaaagaggagaatggccttgaggcccttcagaagggaatttactcctcgaagtgaagagatattttgttttcaagaacacccaaacagcgatccgctttggcagcagacttgagcggatgagcccgcacaatccgattagtagagagcatccgaagatgatgcactaattatctcccggctctctatccaggctcttaggggctggagaagctcagtggttaaaagcactggttgtccttctggaggaccagggttccatttccagcatccacatggtgattcagagccatctgtgattcataactagctggagttccagttccagaggatcccgtggccacgaggcatacgtgtggttcaaagacatacgtgcaagcagaaaaaagttcatatatatgaaataagaactaatttaaaaatttctccattgcttcctggatgtccatggaagagaaagtagagagagacttcatcaatggttccccaagaaaacagagcgccttgccctaatggttccccaagaaaacagagcgacttgccctaatggttgcctaagagtcaggtactgaatcctcagcaaacaaagaagaaaatgaacagggagtttccagcacctttgccaaaacccagatttgcggttctgctaagatctaactgaattttgaaaataaaaataaaataaaaggcatcttcaagaacttgaggggtttttgttgttctggtatccattcatatgtaaagtgtttctaagttacccctaattgttaattagtgtttgaactggtaatgataggcaagcttagcactgacagaatgaacctgtatgggtggcctctgagcactgaaacatgcgcaataattaaccctttactatgtcccatttgtgtagcatggctccctttgagaacattggtttcacatgttactggatattagcaaccatcatcgtcatcatcaccaccaccaccatcatcatcatcatagatttcatgattccatcccattctatagtacaggacttttgaacactaacacatcaagtttaggcaaagaccataacctttccatattaacatgaagtgaccagagttttggtatttactgcactcaggcacattgattgtcaccagcttgtagtctaggtagcaagaacagcatgtggttcttggtggcctgtccccctccgtatccacccatttcactgctgagcctcatgaatactatcaagcgtttgcagcctgagaaagactcgatccaggtctgactcctgaattttgccccaaataatatcaaacaagacagagcaacctgccctgtaaatagtttatgttgtcatcttaataccattgagaactttattgtcttgagatgcgttgagagttttgacgtgagttcagtgccagtgacgggaaatgttatttacacaagactctttcctgaccgctttcaaccatgtgtagaaattcgctatcatctaagtgcccaacgatgctgatctgaagtagaaatcgttggcaggtaatggtgccagtaagatgagaatgaacagtcaagaaatacacaagtgaaaatgttaacataggccattcattttcatattctctctcctctccatctctttccctgcctgctcacccacctctttcctacatggtgcatctatacagtgccaatccactggagtaacaaagcctggctgatttagagacagacacagagccttgggggtggaaaagctctataacccacccctgatgttgccaatttacacacagcctaaatctttccatagcagggttcatgtcaagtgtcataagaaggagctgatttctttgctatttcagactgtgacaagggctgggccctccaggaacagtgatgcagcgagaagcatggcttttctgcgaacacccaaagcaggagggcatccagggggaaagccttacaatgaggtggatagaaatgccacgcaggcctgggcagaaatcagcctccagccacctgcttcagggcatgtttgtaacaatggcagagttaactgtgactggaaggcaccatagtaattcactcattatattaaaggaagtatttaaaattattttcaatcaagagtgtggtgacgcaatttttccaatgaaaacatggctgtttcaggcttacagtaactacaggctttgaacacagtatttggatcctgtgtcgttatatgtaaagaaaatagactaaccatatacagaaccctttaacttagccaagatgctgaagtgcggaaaagaaattttacagaagttatacagtgaatgggacaaagtgaacttgtaatggaaagaataaaaaaataacattaagaaaagaacagcagaaaagaacagggccagtaggttctcacgctttcatccacaaactaaaactgagccagacaaaggcatgtgttgcttcctgttgctttaagatatattaagaatgacagcaacatctgaaaacctaaatgactacaattgtatgtaacaatcaaaaggttcgtgttcagaccagaagtaagataataactgagtataaagtatctgcatttcaagaattctgggaaataatttatctgagcatctaccactggtgttaacctttccagggggggtgaatactaaggaggaaatctatctatcttttgacactgtgtgtgtgtgtgtgtgtgtgtgtgtgttttgaggggacttaattgggcacaaatgaagggaagtgcacacgccagagtgagagcagttgttgaaatggattgcagtgaggtacaaggtcaccacgctggactcccaggagcctctctctggagagccagcctggctcatgggagcagctctgcacaccattccatgcagctgcctaagcacgagccctctcccttcatgactctcaatgatttgttttgttctcagattgcaaaacagggcaactgcttgctttcaaaggctgccatgttatgcgcacacccccctgtctatagagttttaattaccttagatttaggaatatgtgacatttcaggaggaacactataaacatgaaacaaaaactgcaaaagcaacctactattgcctccagctttagaggcagggccacagtgcaaagcttcacactgaagaccttgcagagacttagctcctgtcagataaagtggtgcacacctttgattcccaacacttgggaggctgatgcaggtggatcgctgtgatttttcaggccagcctgatctacagagtgagttccaggataaccagtgctacattgtgagaccctggctcaaaaaaaaaaaaaaatcaacaaaacaaacaacaacaaagagagttagctccttccaaaggaagaaatgctgtttcttgccacttctcaagatggaggcctggtgttgttgtacatatggaaaggggtggagtagtagaggtatttaagactgattggtctataatgaagagtttgcagaacacaaaatattttgttagctgttattagcgagttccagggcaaactatggccaacaaactccaagtactgacaataaactacattgttgaacaaacatgcaaagaaaaaaaaaccttcagaaagtatatacgaattggaatgcttatgaatgtcgtcactcctgtgggttagactgggagagctataaagtaaggaatttggagtgatggtcatgttggacctgatctttgtgtatttacttaatgagaaaatcaccatgcattaagtatatcctttatatgtaaaaaacagtcacataaaaataaagaataagtaaatgaatgaggtaccaataattgttgaaataaaagccacagctgtgactgggaatgtagcttagtttgtagggtgcctgcctattcctgaggcccttggctacttggccagcactgtataaatttcccagaaggctcatggtgcatgtgcagttttgatgtcaggacaattcgggacattgcctcttggccatccacattaatacttcagggtagccagaatactgatcatcagggggcacggggggagggaatctaaaatgttcagcaattaattattttgaggaaaacaacgatgcttttaaaggatcaaggaaccctattactaatattggaaaaaatgaagaccaaccattgagcctatttagctggctgagaggcatggtattcaagtctgagggtggctgataattactcacactaagcatttggcccaggttttcaaaggcagataaagccatgaaacctctggcttgggtgacctgcctacatctatctgtccctcgcatgctgactctcatttactctgtagttatgccctatgtatttcccattaccgtgcttctnnnnnnnnnnnnnnnnnnnnctccctccctcttcccctccctccctctttccctccctccccctctcctttcaatgcctgagataaaaatagcacctccccttttagtagcaacaagctcactaagcaacacttctctgatgcccagagtttatcttggtagcactcctaaaggcatacgttactccttatccccagttttgagtcacgtcacttgagctttggaagaatagaggaattttccctgaagtcgctgctagaaaataacaatgctagagtctcaagtcactcactagtctagtccctaagccggtgacaaggtctccatggaaacttccacactgctcctggtgcaaagtgggtaaaagggccatccatggtatccccagtaaaaggtgtgtgtgtttgaagatattgtttgtttatgaaatatgcagggtcctttggggtgaatcctttaacttctctggaagcacaggcttgtctgacgactggggcactaacttcccttgttctgtggttcatcctggccctaaccttcctgggaagggaatacattttctattagtgtctcagtgtcaggcatttttgtttgttttgttttgttttgttttgttttgcttttgtgaagatgtcctttcacatggataggtgtgtatacgtgtgtgtctgtgctcatgtgtttgtgtgactgctgcctgcagacactcaccttctaactgctggctaggtaggtgtccctcacattgacctgctcttgctatggacttcattctcaggaatgcctattctctttgtccacacacacatgctaatacactgtccatcttgcctctcctaatagcccgttgagtcttgaacttggagccagcaaagtactgcctttgtaaagcacaaaagaacaccagtttggtgggtttttttttttcccctaatcacacaaggcctgaataaaaagcttttctgctattcagaggccactcgcattgtgcagctgcccctggactgctgagaccatctcaaggctgacaatggagtacctgactgagcttctgctcacaggacttattcaggagcccccaggcctgggactggtgccagcgtgctctgggggtgggggttggggggggggagattgaggcccttttcttggtcagaccctgataagcatattggagtttgttggagctgttgtttgttgtttgcctgccagtgagggttccacaatcttattgcacggctgtcttctcagcaggctggctgtcagggtaggttttgttcctggttgggtcccacctctgtgaaatgtacagtgagacttgggtcatagtccactcgcagtgagccatacatcaccgtgtggactcaattcccatgactctggctcctcgggacaatgtctctttcttcaccatgctgatggtaaatatctggtcagcctcatctatttaaaaccagccaagcaggaatcctgatgctggggagtggattcttttatttgtttgtaagtaaacaagggactcagctcttcctaactgaaattgaattccagtcactcttaccataataccaaaggacactccatcttcagtagctaggagggacaagggtataccgaggcaggtttactgtttctggttgctgtttagcacctatgcctaatacctgtcttcatgactgataacccctgtgggaagagaatcatgttccttcctggctcgcagaattgggcaaatcaaagccaggtgggcatcttggtttgaagtcactctgttcttgaaaaattggattggattagttgagatacttgagggttggcatttaagcatttgtagatttttttattttaagctaactaaagtgttgtgcaaaatgaccagcttatatttttgttctacaatgatcccgggtttctgagtagtctctctctgtaagtggaaatctgatgctgaaaactttgagcgagtgggactgatgttttagagattctgttgatcacaagccctgtacttacgttagaagctggtgtgtttggatgcttgacttggcttgcctggcatatctgaggccccaggttcagccagcaggaagacaaagaataattaattaatgatttaattaattagtaaatgctagattgatgttgaaagaagctatggattcccaagaactgaggtccagctggtgttatggggtgttttagtaccccacagaatgaatagcatggaaatgatgttgctttgaagcttcctgtgaatctgagcacgtaggctgtgaccccttcaagttgaattttgccctcttccctgctatctaatattgaatctatcaacctttttgcctgtattctcacataatacatcctgatgttgcttcccccttcctctatccctcctggtaaccccccaccttccctcccatctgaatccattccctttctgtctctcattagaaaagaactttggctgtatttcttgctggatacaaactcaaaatgatattacctttatcatggtgtcaaaatccaaagatcacataccttccctagactgcttttgcttgctcagatgggcacattaccctcttgtaccagcctgcattttctgtttctgtttatggtctctctgcccagcttgcctgtttcctcactagggcagtgaccttattgcttggtctgtgttttaccactttctggtgccccatgtcttcctctgcaggtttctgcgcctctcttaaaggcttggctcctccagcctttatgtttcactttccctctagtgacacaagagcctgctcctcctgtgtggctgagtggcttggtttacatacatacatacgtgtgtgtgtgtgtgtgtgtgtgtgtgtgtgtgtgtgtgtatgtatgtatgtatgtatgtatgtatgtatgtatgtatatttgggtcactaagtaccctttctggtatttaaattgctagaaaacttgatatgtgaattgcttccattgtggttccttaagtaggatttctgcagttctagaaaagccttgattaataaaggaaggtcttcgccttcccattcctaaattcaatagcattgttcctgacccagaccttagcacatgggttcacagcctggggggtggatatgtatggaaggacacttctgtttacagctgatccttacttgtgaagggagagcctgcattaaggagaatcctgtggcgaggaaggtgagctgagattgtctccaggccagaaggagctcgctctagcactaagcccaaaaggcagttgactggaagttacacacaaagccaccagctcctggaaatggagtggtggggctgagagctgcaccggatatctgcccattgtcctctgtgctttgggaagtgctgataaggccggattgacactgggcacaagtgaagttaagcaaaacaaaatggtggcgtcgatctgagcagggagaaggaatgctggttgaatttaggaagaaataacaagccttggatacggtggcttgtctttgatggcgggtgctttggctctggggaggttactgcgcgaggagagactcccttctgagtagatgggagaatgctttgtaaatgctgttcatagctcaggcatttggccttccattcaagcaaaaggtagaagaaaaagaaataggcatgtttatagaagtgtctgtgaactagaaggtgatgccaccagagaaagggtgagcggatggagagcctgctggagagaatgaggaccagaattggctttaactgagggggggggggggcagcttgggagtcaagggcagcctgcaagtgggcggatgggagagggaaggctgcctccttctgcctattgtttggtcccggaataagctaggaagtactgctaccaggggcaagaggctttgagataaaaacaaaacaaagcaaaacaaaacaactcagaatcctaaactgcctcagggaactgctttctagcaagaggaaggtctgatgagcagttagcagcttttctaaatttgtttttctgcctttcaaaacagctctgtacatttctctgccgcggctctacctcactccagagaaaagtgttctgacatactttggaaagattttcaataacgagggcttcctaaataactttcagtttctccaagaaatcagtcagccagaatgcccttcccccgcgaattccagttagtcaaagttttactgaaacatgtcagcactgagaaatgcagaaggcagctaagcccgtccaatcagaaggcggaagaagtttcacatctgtggaagagcaacggagtctggctcttcggattcgcaggagcccgctggctcaaaagaagaaacacaaaggggatctatggctcctcacagaaagcctagctcttcccaggggtccaggacacatgtgcttgtgttctatagaacattcccaaatgctaacttggaaattacccattagcttcgaatagctgtagaattcttatttacttatcagcgcgcatgcgtgcacggtgtgcagagaggggtgtgtgtagaggtcagaggacaactcagtgcggttgactccctccttccagctttatgtgggttccagggcttgaactttggtcagggtcctgcacagcaagagtgttcacctgctaaactattttactaacttcgaatggttttaaaagtgatcgatttaaagagtcgagaatgctcgaagtgctacccaataaatgtgctccagggtttatttaaaaaaaaaaaaaaacaacagtcctgtaatagtgtgtacagtgcacacacacaaagctgagattgggtgtgtttgtgagcagttggcagaggctgtggaggaacctgatcctgggtgtcgtaaattatgaagtgtttacacctgtcaactctgtctgtgtccctgctaatgataccttaacaactggccagggtgacacaacacaaagggtcattccttttgagctctgtgatgtgggtgaggaccttgccaccgggttctggtggttttagaaaggtggcttggcccttagagatgcactcacaggtcattggggaggtcctcacacaagggcctttgaactgggcacgggttaaagtatcagaaggaaccaaaggttcataaaggaacgatcagggaaaaaaaaaaaaaaggcaatgtttatgatttgagtgtgcagccattgaatcgtgttccgctggcccacaaaatagtgtaaacacagaggggtatatgtgtgcactggcacatgtacatacatggaagctggaggctggtgacgggtatatcgtctttgctttctgtctttcacagggtctctcagcgaaacagaagtgcctctgttcagaacacaattcacaaacacaaagcatcctttcttattaaatgtaggttctggggacttgaactcaggacctcaggcttgtatagcaggtaccttactggctgagctgtctgtctctccagcacctgagtttgtttctctcccatccccccagcttataccttcccccacctctagtacaatgccctgtactaacaaagtggcaactaagtgacacatattaaatgttcagtgaattaaagatcagagaaatggctgtaggaaactggagagtacacatagcagttaggaatgtgcgcttcggagccagcttggccaggcccaaacccctgatccccactgactagttagtgtgtggccttggggagtctcctcacctgtaaaatggggttaataaccgcttgcacccaaaggtgttgcaaggatgaaatgactgcctcattacatgtcaaccgcctggttggggtcagacacccggtaaacctacaaaacactgttctacaagaacagatcgctttgagcagagaacgcttatgaaaacatgcagcgcaaaggcaagcgggtacttttggtcattgattcacggaagactggcagcctgcgaatgtctaatagcctcttcttaggctataaactttgtaaacatgggcttttaccattcagaagccaaagaaaattttaaaataataataattttaaaagtccagtataaatctttaacagcaaggagctattttttctaaaatatttttcccttttggaggaaaaagaaagtgcttagtagagtctgtttccttattggaaataaattcacatctgggatgccaaatttcaatctttttctttttttaaagatttatttatttattatatgtaagtacactgtagctgtcttcagacacaccagaagagggagtcagatctcgttacaaatggttgtgagccaccatgtggttgctgggatttgaactctggacctttggaagagcagtcgggtgctcttacctgctgagccatctcaccagccccaccaaatttcaatcttaatgcagcgctgagcagctgagttataatttgttagcctcctggaacgcacagacttctggaacgtgggaaagagcagttatcttttcagttcagtgaagacaaagcccacaatagtttagagaacccagagaaaaattcatacttaaaaattaagaccatgtgtgatagggagtgtctacatagctacaaccctggactccatgagattcccctatggtcatagttgtctgtcttgtaccaatgatcagacacaccagtgattcatatattgatatgtgactaatataaatggtggtaacttaaacaaggagtttacaacctttgacccaaatagatgtacctgcagtgacagcgaatgcctcctgactcagaaaacaaaatgctacacttacagagaggagatagaattcaaaactgcttccataatgggcaattttcatcttcacaaccgtcttatagataactataagtctgaatatactaaaataacttattgaaatagaaaaaagttgtcctggctcacacagccgacatttttcattcaccttggctagattctgttcggttcttcttctggttttgttagggtctaaggttaatgatgccctcagagactggaaacacccaccccgtaccatcagcgtcttagcttattaagttatgccaatttcacaaccaaaaatccattagttaatttaacatagtcagagaaaaactcatttgtctccttcactgtgtttcacagtcagagtgacacctgagcaccactgtctggagggggacagtgaagtcctcccccacccctgggtacagccatccccagccctggagtggatgcgtgtgaggctgggtataattactaaaccacagcagcccccacagccccctggggatctaggaagtgtctgtaccatgaagcacagttttgtatatctttgattagggcttaggcaactgctgtttgcatttggggaactggaaatgcagagttgagttttcagatgggcagagaggatcaagggctgctaaactgctgacccttctgccagggttctagctcaggctcattagctgagtggacatctgagcctagtctgtctcaatgctgacggcgtcctcagtttcatcccgataatgcacttgagctggctttcctgacgttcagctgctttctgcactagcagcttggtattacatgcagaccagagttgggctggcaagagggacgcaggtctggatggttgttcctcctttcaggagagccgtttcccaaacgcacgcattatgtttgtaggtgtgagagatagcaggaggtttgctaaagcttgttaaccacttttgatttcaaaggattaggttggaagtaggggaaccctgctccctgttaatcatttaagaatattaggtagccattaaggagatgagacaaggaagagacagcaaaagagacttcacatttgctgactgcgtggttaactctagtggggctgaagtactggaaattgctttacaactagatccacttaactgatacggcctaaaggaaaccttatctatactacaacttaatcccccatgaggagaacctggtaatgaaagagaagccagcattgctcccctcccccatctctctctttttaacctgcatcttagttctctttggtttcattaatgtttaaaattagtgacagaagccgggtgatggtgcatgccttcagtcccagcacccaggagatagatggaggcaggctgatctctgtgagttcgaggtcagcctggtctacggagccagttccaggacagccagagacacacaaagaaaatctgccttgaaaaacaaacaaacaaacaaacaaacaccacccaaaacagtagcaacaacaaaacaaaacggtgacagaatttattatattttcttttttagcaaaaaaaaaaaaattgtttttaaagactatgtgttatgtacaggaccctgcttgcgtttatgtgtagcagacgtatgcaggagcccttagaggccagaaaaggcactgggctgtaagaggtcgtgagccaccatgtgggggccaggacctaagcccaactcctctgcaaaggcatgctgtaaatggccgagacaccgcttcagccaccagatgatattttcatacatatgtacaaggtatgcgcctcccatgactgtcctcgccccatccctccattcggtatccttccatctcccaaataaacttttctgccaaatgtgggagaaaagatacctttgcctcttcgcccactataaccctcttgttctccttccctcttccctttagacccctccctccctccctccctccacaccgtcctcctgcattcatcacacacacacacacacacacacacacacacacacactgcgttctccatgtgagagaaacacatggtctttttttttttttttttttttttttgtgagtctgacttttgcttaacaagataatatccacttccgtttactttcccacagatgggaaatgttcacttttcctttatgatgggaacaaaacattgcgtatttaaccctcctctgttggtgggcagctaggctggttccataacttgttttttgtgattattgttgttgttgttgttgctgctgctgctgcaatcaacatgggtttgagggcatctctctcacaggctcccttggagtactttggaaatgtgcccaggagcaaggtacctgggatcatatggtagatctatttttagccttttgagaaacctccacattgatttctatagtgtctgcactcgtgagcattccccagacgtgtggacccctttcctttgtatttgttcttctttgaataagtgtctgcctcgagcctttcagacaagtggcacctgacttggacttttcattcactagacaggtttgtgtcctcaagtctgagctgcttgtctgctgcagttcaatcccatctgtggtcttgcgtagcactggttgagtcctaacaaaaactccttacttattttcacaccgtgctatggactctgacagcctaagactaataataagcctgcactagaactgacttctttgacaaggaaaaacataaatcagttgtcaaatcgacaaaaaaaaaaaaaaaaaagaaaagaaaacaaaacaaaaaaagcattaggaaaagcatttatgtaaatttatgaggctaaaagaatatatgagctagccttggctcacatccgatttcgggtaacagatggacagactgtccccctgagcctcacttacacttgtgttttcatggcttgctgggatatggccactttctgagagcatcttgaatcatgttaattaattaattaattaattactagttgtatgtgtgtgttcaagcatgtagcagtgtcatgtgacatgggcctggggtgacctttcaaaggaaaggtttccctctccttctgccaggtgagagcagggcaggaactcgggttgttgggtttggcaagtgccttgaccccactgagccaccttgctggcccattttctgaaagcctttgttcaagcaatgcttccctgtgtgcagggaaaaaaaaaaaaaaaaaaaaagcccatgtatttgcttgcattgaagcattagaaatagtttgtttcttcttcatcatcatcttcatcaccatcatcacctccaccatcatcaccaccattaatattttaaagccagcctaagtctgtttgtttaatttgacaatgcttatcttttggccacgttcagttttccttatccagcaccaacgttacaaagcctttgctggcctggaacttgctattgtatagaccagactggcctcagcctcccacagatccccttatctctgtctccctagtgctgggatttgaggggtgtgccactctactgagcagttgctcttttgttgttgttgttattgttgttgttgtcgttgtttttaaagttcagataaacagatgcttaatgttaggtctgactgacagtaattaccttcttcttgaatttatgttttgctggatgtagctttggtgactgtgttaactccattgtcaggagcagataaaataaataccgtcatcttctcacactcccgggattctggaccagctccatctctctctgttctcttattgtccatataattgaataaaatatctactctaacgcaataataaggtcacagatttaataatagagaatttgggaatacaaaatttacttttctcaggataaaaattatatatattttttcctgtgatgggccttatatccactcagctgtatttgaagcaatataatgaggtcaagggatgctatagactaccgaggtgtgttactttaagaatcctaatgtcttacatttcatcagcgtatgtttttgaggacaaagacagacatcacttgtcaatgtgctgagttaccagggtgcatacaagccataggactttaaaatgaaaaatctagtgtagtctgtaagaaccacttacttcaaggacatcatctcataggaagtaaaacacaacttgacctaagccattatagaaaaatctaaaggataacacatacagagttttccttgtatttggcagtgtgctgttagcacatccatcccctccaggaattacaaatcctccgaggacagggattgtgtgtagcatgactcattgcaccactcacttacacaccaaacctgggtgagcccttgccgggtttggcttctagtggtgtggacagatgagtaaacagtagcgtccccgtttgatggctgtgatggagcatgctcaggggctgtggaaagatggagagggaagctagcaatcagctgtcagtgggaatcagggaggacttcacagaagaggtgatgtttgggggaagtcagaagggagggatagggtttccaaaggccgagacaaaaatgggttagaaaactgggctttagatcatatatatatatatatcttaaatattatatataatatatatcttaaatattatatataatatatatcttaaatattaaagtatgttaaaataaagccaaatgctgagggaagaaaagtgcaagatatgaagggaaatgaagaaagaaaatggaactcccagaagagccatccaaatcctttactcaactgaccaattcaagtgagttgtgggaattcccgaaacattgccattagagagagttcattggaatctggagcagactgtcaaccccaggcagcaggcaggaacgttccagtgtggtgtggaggcagaacagctcatcccacagctctctgagagcattgcacagattgctaaatcctgttcctgccctgcttctcatccatcacctaccctcatctccgtgtggctcatagtacctcggtagggcctggctcataaatagacagtccacactcagttcaagttgttggaaagaatttgaaagagactacttgccctggggtgtttgtggtgtggctggcacaaaaagccgtggaccaggtaaaccatgagcaacactgcactcggctcctgtcttttacataggcgtgacgctgaaaaacggatcctaaaaaatgtagccttccttagcccaaaggaacttttcacacttccactaagttttgcagtcaaggcttctctctatctctgttcagagtcacaaaaaaataggtccaatgccagcccaagggaaagaaagctgtgctcataaagtttggggtccaggaaaacctggctccaattccaagggcattgagagaagatgcgaacgtacaaagttcaaaatgatgaatggcacaggtacttcagttttccagttgccagctccaggaacactgagagacatgtgtaatgagcaaacatacattacacattccttttaatgggttagggacttttcatcctaatggtgaccaaaggaaaggaaaagtgccattaacccatttcacatccaagaaagctgaagtttacagagatgaaacagctaggtcaaggccacactggtcactagcaggaagaatctgccagttgctagaatgcagactcttcgaaggtagcaaatcccaatatctacaggatgctcacacagcaagtgccccgaatacttattatcttaacccagaattccaaggcaatgtttatgaagtgctcagagtccagttggtctcagagatgataaacccttgtacctgctcccaggataaagaattgtcaagataggcaaacaggcagacattcaagtggaataaataaccaagcacagcgaagaccaatggagataaggaagacgcaaggttggagacagcgttgcttagatctttaccgcaaatatttttcatgatagcagcagaaaaatgttttccctgtcattaaaacaatggccaaggcagcgtgcagagtgtctggtttttgctgaagaactcctaaaagttgtgtgtgtgtgtgtgtgtttgtatgtgtatatgtgtgtgtatatgtgtgtgtgtgtggatgtaggtgccacatgacactgtgtgaccttacccagattttataggaggaaaacccatgaacataatttgttctacataaagtctgtaaccctgactgcactgcagcattggctggtgggagttctgtaattactggtaagatttttttttgcttttttttttttttttttttttttttttttttttttttggtggcgaccgctgaagatttctttcagggtttgacagttgccctcccgatatttatgcgtttcttgctaggagctctagattcacaactccggggcttgtaatgaggaaaagaacacaatacaaataacaggagaaggaccatgagtcggacctcaccagagagacagatcacatattctagctgctttaattggaaaacagccttttcatggggtttcctttcccttcagctgagataattaagccggggctgacactggtgaccagggcctgatgatatatagttagttactaacaatgcagcaatcagtaatccaaatttatatttcccaggttaccggagcatggtggaagagaaaggcagttttgataaggctgggagatggacttcctaaggcggtcttcacatgaccttcactcctctccattctgggagggttaattaggcctgctttctttcaaccctgtcagaagagaaagcacacctattgtctgtgtttacattaggaatactttgcaggcctcacgctgccaaagaagtttcttttctctgtggctccctgtaatttttaatggattaaattatatttgtaaagtggattggtgtgaagggtaggtggacacaaaacaaacttagatggttttaaagcctctccagcaagctggcccaagcacggggactttgaaacaagattaattatccctgcctgtgactggaagcttggcaggggaagggattgggattagaggttggaaaccctttgtgtctctgttagaaattcccaagctggatctttttactagtagaagcccctctggatcgactaaaatttctaaagcccaggacagacaaccccaagccagttaagttggcatctctgggtgtggttggtacgtagacagctttaatttgtgaagctctgccgtcgtcccaatgtgcaaggttgaaaggcacagaagtttaaactcacagtgttaaagatatttatatttggtgaaagacatggtagtgtatcgagcagtgggagagaaagaacagccacatctcggcgacatcccttgcctccatgtttgaagttagagttaaaagtggaattagagaacattttctaccccagtgagagaccttgaactcgtgagaaacagtggcccacccactggacaagagaatggacttcagagatgatgccatggaattaaccatgaagagaagagatgccaagaaaaggggaaggaggccttcctgctttctagagtccacttcagtgcctgtgaatgggacaagtgacaacaggcaaggtgtcctcttgcttcacacctccccaggtgaaggctagcatggaagatgctcttggttctcatatcccaacaccatgagtgtctctccacactgccatatttagctcagtagccctgggccaccccaggataaagactgtaccagagagaggatatccattcatcggctaagcagcaagtgtcccttgggtgtatttccaacgatggattggatcctcttcttgttttggcacagaaggtacgtgagaaagaagtagtgacattacaaagcatgggctgagggtctgtgcaggaacaggagatggaaaagcccaaataaagtagtgagaccttattttggggaaaaaacaattatacggagagcatttgccttaagcttactggttcttagatttcactgtgttccgcctttgtgagctggccacatttatacaggaagaccatatattgggcagccctccttgtagcacacacatggctgaacacactgggaaaggattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgagagagagagagagagagagagagagagagagagagagaagaaaaaggaaaaagaaagacagccaccccccaaattctataaaagaatgtaacataaaaagtatatttcattctccctgtgaccctttgtcctcctccctcagagacactgttactggatgcttacatattggaacaaatatgcacaacacattttttttcccctaaaactcagtcagtcttggcttgcatttccattttcattaacaaaaatagccccctttttacagctgttgtaggacttcatacactgaaatttaaaaatattcaaagatactcaagtcaacccaaaagttacttaacaatgtgtatgttctttttctttaaatctgtctaagccagctactctgagtgaggattttacacacatatttcacacttttaaaacaatcaactagcttacatttatattagcacaacacaggagaatagattatttcctccaaaccacaactgagagtttttccttccctggccaccaacttctcaacttttcatatattctctaactgaggtgcatatgtgaggccatcctggtcagggccctagctctctacagaaggactaggccagagatctacccctcccccttcccctccccccagataaaacttcctcaaactgtagaccaacaagagctccagtgttctgtttcacacttgtgtgctaaaggatgaaagtggtcaggcagaattgctcttcccacccacgtggggagaggaaactggctaacgccagggtccacagagagagtctgagaggacagcgtgaacgagagttcagagcccctggggctccagccagctacatctgtatatcttctctccagctggctggcccagctgttctgatgtcaggagaaagttatgagtcactgggaagggatttgagacaagagtgatgttaaatcagctcttggggtctgtttgtcattgacaattgagtctcagcatcaacttagtggttgacattcctagaaggccacacaccagccaccctctaggactgagctaccttagtgtgaaataaagtgggattatgtggatgctgtgggcctccaccctcagaaatgtctgggttttgctcatgctactaaatatatcattgccatctctctccttgcaagtatgcttagactgttgacccatatacatacatgttggccagatgggaaagctaagtgagtacacatacacttggccaaaggctgaggacttgggtccttggattctaggttcatcatttcatcaacagcagtagagcgaatcagctgctcagagagtctgagtccatagcaggattttgctggatcctctgtggtttcctgctctaaatagtgctttcccaggatgtgggaggaaggagtgccagtggatgtaagaaccacagacaagcaaagtctctccactctccacagagaccataaatgtgctccaagtttggctctaagtcttctctagagtcccctggatactatttcttctgttcttctattcacctggcccctctgtagcccagtgtggggcaactcctgttttgtttctgggacggtgggaaatccctctttattcccagcaaaagccgtttgctcacagtcgctactcattgctcttcgatccatctcataatggctgtcctcaaggtagctggacatgcctatccttgctcggacagctcttttttctttgttttaaactgaaggaagactaattcgatagctcctgtataaatctggatggtgagagggttgggttatagtaaggttatattaagaggactatagtttcagataaggaattggacaatggggcatgctgttgagacctacagaggatggcgcctctcagtctttttaacctttacagtatagttacagctgttaatatgccatctatctgctttggttgtcaggaggttttctaagagctcaatcctggcagagtccatgattagtcttccctactccccttcccttccagcagcatgtctgcgaatgggtaacggaagtgaattgctaccgaaggcagcttctatgctttattgaatattgagaatgacatcttcgtgcgttcagtgctcaaacacttgcacagtgcagttgtttgtctcacattttctctggaaactccccaaacactaagaggataatctatctataaggtacaaaatcactgttccctctggaataaaattactttcaaagaatggaactgtcactgataacaattctcattaccttggaaggagaggcagccttctgcccctcattctcagcaagatggaaatctcacacgagcttcatgtgatctctctctctctctctttgtgtgtgtgtgtgtctgtgtgtgtgtgtctgtgtgcgtgtgcacatgcgcacatgtgtctgtctctctgtctgcctctctgtctgtctgtctgtctgtctctgcattgaagatcctggagaatgcttagcctttctttcatgccttgttgcttctggaaagagctgatggagtaggcatgcgccaagcatgtctacctattcttgcatcacccttcaggatgacttgtcccatttgcctcccactctgtagagaaatgaggactctgttaacgaaacaggaagaatattgttacttgtaatcctctagttattctaagtgaacctgggccatctcctttctgaagtgctattcatgctttctttgcccccaagctgtggagtcccatctgtctgtcctgaccctctccagtccttaccagggcaagcccagacaacccaggtataccttcgcttcccagaaaccagggacaagaaactttcagagcccttatctgtgccctctgcaagccagtgcttgcttggatcttcctactgcaagagaggggcaggccgggactcctcagctgccatatgtcccccacacactttctctctggtccatcgtctctctttggtttgacccctagcacattaattcaggatctgcctgtcatgttcagacttacgaacaattttatttttcctcctattctgatctctctggcagagagattctaattacagtgattgcctgttgtgctattaattataagaattgtgattccccctttgatttaagggttaattggtgataaccacatgctatcttctctccaggtaatttgagctacagtaattaacctcatgtccaggttatataatattaaccatttgcctccattttcctacatttttaaaattgattaccttgtgccgaatactcagtgttttcttagaaagaacggaatgagctggtgagtagaagggcacatcagaaaaagaagggagattgctggcctgagtagcaagggcccccataagctcatatgtttgaatactgggtgccgagttggtagaactgtttaggaaggcttgggaggtgtggccttgttggagtaggtgtgtcactgggggtgggcgttgaggtttcaatagactgtcagctagtcccagcttctctctctctctcttgaatccaatgtatggatcatgatgtggaatctcagcttctcctgccgccatgactttgatccaccgtcacggactctaaccctttgaaactgttaagtctcaaacgcgttcctttgtaagttgtcttggttatggtggtttatcacagcaacaggaaaaacaaaacaaagcagaaaacctcaaaccaaacaaacaacaaaacacctaagagaagttggtaccagaaagtgggctgtgactattgtaggcatgcatgtctatgtatttgtggttttgtttttgtttttgttttaatttctgtttggttggaggaatttggaaagctttaggactttggaccagcaaagcagctgattgttgtacacaggtcttttttggtttttcaagacaacgtttctttgtatagctctggctggtcctggaactcactttgtagaccaggctggcctcgaactcagaaatccgcctacctctgcctcccaagtgctgggattaaaggtgtgtgccaccacgcccatgtacgcaggtcttatcaggccttcctaggagcctggaagtcagtgctgtgagccaggtagacatgggggaccagattaagacaaaagcaaggatttttagcagcaactgagaaagagatcattcttatgatattttggcaaagaacatggcctctttttgcctttatcctcgtcatttgcctgaagcttacttgaaaactagtgcctaatttctttggcagaagatattttttaaaacgcctactagaaaagtaacctagactgggagggagcatgcctgtcttctaagcccatgttgtccactggaaacatcctggaaatccaaaatttcccttttatttcctaatttgattaagttctggttttaccaagagaaggaggggatgggagagagaagagaaagaagacttactggtgttggaaaacgaactgcgtgaataagtaaataaagaagccgctgctggtgaagtcctgccattcagaggatggcctgcaactgggaaagccctttgcccctttgttccataggggaaagagattgctaatagctgaccttatgaatattacttgggagaaactactaccactaacacaaaacagcctgtggtgtgcaccccccattacaaaggaaggtcgagccgctcgtacttggggtcaagtgggagagcaagtgaagctcccccaagcagaggggtttcaagcctcgccaaacagcccgcttcccacagttcactttggactcctccctaccaagatgatatctgccttgtgagcctcattcgttttgtggaagccttcttcctgttggtgtcttgcagggagggggagtctgttaatctgttattaaaaatacagaatagaggaaattaggaaaagtcgactcactcagcaattcctaatcactgaattagccccgaaggataatgcgacactagaaaaataaatcagttaaaacgttcttttttttttttttttttttttttaattctctggagatttcaacaagagaccatgtgacggtcagagagtttcctgtctgagttggcagccctgtcctgtccctccatcctactgatcctgtttgcactcacttccaaggcaggcttctgtttttgcaaaccctggaaaacatgtgtctcaggatcaaaatgtagcaggtgaaagacaaggggcagagagacagataacccaaatcaggtctgcagtgatatgtagcaaaattaaacttactaatagttttgcggtgaaacatggaaatatttactctaaaggcagtcaacaaatggcctcatggtgcttcaagtctagctgtgatgccaaatgagtagggaaaactttctggctttcagggggtttgtttggtttgggctgtgtgcctgtgtttccagagcaagcaagccacatatgacagggcagtgtgaaacacatcttgttttcttttaaacttggggagagttgagacagttttaaaaacagtttgctacaccgcagtggtttgtccaggtgctgaccacctcatcgcactctgtgacttttctaataaacaggactgtgagtctggatctgggctctgacccttcagtcacctatgaagagaagcgcatcattagggagtggggacatttaaacaaagccccggcttcctggaacttatgttcactggccttgaggaagcatttaatccggatgtttgggaataatgattgatttttgaaggtaggacttcttatttataataataataataacaacaacaacaacaacaacaacaataataataataataataataataataataagtgatcgttttagggagtggtgtgaccagagttgactccaatttgggcaactaccaaatgcttttccctccacccgaaagcaaattgataactgcctttgggaaagtccttgaaaactttgctccagtcaataaagccaaacgcatgagtcactgtttttacgtgtaaagtacatgaacacagccaataaaaatggtattaacttaggcaaacttggcagtgtctacctgattcagtaatagttttaactgtgtgggcctgcgatttcacctcaatcattagcacacgaaccagacttttttataaaatagttaatgaagtaactattccaaacgaatgtaaggaaatttggggaatggtgcttctatctcatttgttctgtttgtgtgtgtgtgtagacattaaaaggctcttgcgagtgtcgagaggagagtgttctattagggagcagtcatgatattgtgtctctttttgtacaatcagaaaccattagtcaattataagttctatttttggctttctgcgtgcaaggaaagcatccgagagcagggaacagaaggcagggtggtgtaggcagctagcaccagaggacctgacagaccacaagagaaatgctctgccctctttctaatcccatgacttttttaacaaaggcaaacatttacaagcaggtttgtagaatttcagagcttcagttattcatgattggtagcttcatgggggacaggggtggagtggggtggggcacagggactgtttctcagttttgtttggatttcttctgagccatgtttgaagttgattccaaagtatggaaagattacctccccacagggagcccagcatgccagagaactgtggcacgggggagggggtggggggttctcttctctattaacagtatgaagagaaaacagatgatagattattagagagctatcctttccaaaccctgtgtactgatgagggcatgaaaagccccagtctttgaatttctgcagtttgctcttttggagtcattctgcagatactcttgtaagcacctgagcaaagtaccttacgcctaacgtgtgtcgattttaataaaatgtacagaaaattagggccactgatgtacaatgacccacctgcttagctctggccatccataaggacatcttgagtttgcaccttagagtacctctaccctttggtttctgtcccatccttagaagaaagtcatcagacacaatcttcatcctgagttacaatactttaaatgaaataaataaataaataaataaataaataaataaataaataaataaataaataagaaaagccatccattatattagacaaatgtttgactttcctttaagcaaaatttcttctggtacaagaataggaccaaagtgagtgtctcaaagtctaaccagcatgaagctgtctgtagctgcgccagtgtggtccttacatctgagctgtctgaacctgtagagcagtgatcttcacaaaccccgcctgggctctccccaagtttctgcaggtcttctcaccccacttacctcagcaacaacccagcccgaggtaaaatcttagccacttttgaaaaggtattgttgtacttgtgttctattttggtgtgaccccaagcgctgtcagacccagccactactcgagagaggtccagggcatattcacggggttccaatccccgcatcagcgcctccacatagtgcctggcttctagtagaaaacagtcagtgagatgaaaatcaagtgaacatcaggcaataagccaaggagaaatgaatgaattttggctccttttctgaaggcagcgtcatgtcggggagagcgccacgtaagagcagggagccctcaactgctgtttggctttgccacttgccttaagatccacatttggcaaatgaccccgcttctcggggtctcggttttcttaacagtgagatgaaaggagcgtttgttgctgcagctggagccgaaatttgagttcagcaatattttttaaagtttaaaagaggtggggatggcaaaaagctgggcatgccattgggcacgcagggttgggtcttgctgatttctgagatcaagatcgcttgcctctgttttgaggcctgcggagaaatcgtgactacagtggtggagaccgcatgagcctttagattctatctgaagcatctaagcgaagtccacagaaggcactggctcagaggcgcatgttcgggaatggtgggggtcgggaggagaaggtacattagatagaagaaccaaaaaaatcatgctatgccttcttccatctgaaagttcatagacatacaccagcctttatggaaaaataaaaaatacaaataagataaaacttctacaagttctgtcgaattcacaactgcccttgcgtgcctctgtgccagcggtttcaggcccgaaatagaccatctattatacatagtcgatatttattataaccctccattgaacgccatcattgctctccaaaatgtgttgaagttaggtctgtggcatttccctttcctctaaaacggacgcttttatgtctctgttaatggccgagaagaagagcgatgaggctgtattaagaggctgatgctttattaagaggctagagtgatttctcacattttctttgaacttagctcttaatgcaagcatcccaggacaggtggttctacctcctggtcctctgaagcctgtgcactgaccatttccaccacaatcaatgggcccaagttgtttctaatttcattcgggaagtgttctctcgctctcctccacatcctgtggacggcagcatccttctcacgcgggagtccttgaagcaggcctgtccaggtcagtgaaggacaccttctatttaagcgctcattaatgctttacattttcctctagtgtgagaataatcagcagtttctatctctggctggtctccagcattcagtgagctgggctttctgcacaaacaccctgctttcacacctccgtgtgggtgaaggttcctcgctggcttcagaggtatccgatctgtttatcagccacaggagcaggcagcctcgttcttagccttaacaaatgacactactctctacaagacatcttcaagggaggcaggaaggacgcaaatggtcccatttaacacagtggtgctctgacataaacgtaatccctcctaagtctggggttgagacacatttgcatctttgcatcaccttagacctgtgatcacaggcccataaaatggaacgagcctgagagcctacatgttttgaaagttactgtacactcggtttatggatttttatgactgaagccattagggactttcagtccctctagccacgtaagcaaagatgcagcaacctgtattcgattattatcttaagtgaagtttctacccgcagcctcgcttaccttttgccgttccccttccttgatgtcctaggaaggacataaactttgcaatcacacagatcgggggctgagagctcgctctcccctttgctgatcattgctgttgctgttccctaatgcgctgtaaatgtttactctgtgctacctagaaatgtgacttagccagctgcctgggcctcagtttccttatatgggcatgattaggcctgtctgtcggattgctgtaattatcagatgtatgcttgaccccgctgacctcgagatgaggtagcatagcatgctagtgttcttggcaccaacagatgaaatgtgcccagccttctatgctgggtccattggcatccactaggccgatggaaggtctttctccacatctcctgttcatcacgcacagtaccacacatgtgcacacagatggtctacacttcttcatccacagactgtgtcagaacaatcaggagaaactggagaaagaagggcctgttaacatgactgacttgaaaagcatgtttcccaggtgcttggaactttgtctgcctgacttgtcataatctcagaacctgacttctttttcccatcttagcacctcccctcagtctgggctcaaacttgctcctccgactcttctccctgctacctgatggttaccttagcctagaaaagcagggtggcctggctcagggtcactccctttgctgcaccacctagactcttttctctcttcttctccttttttttttcttctccggaacacatacagtctcagccttgggacttttatggattcatcccatttcctgtccttacattttacaggtgacaaaatggagaaccagccagcctgactgagctgcctagagtcacattattagcgtgtccttccttcttataacaaccatgtgaattattgactatcgttaaaacttcctatgatgtcagtagaagatgtgtttttaaagggattgctgaaacttcatagccccagcaataccattatttttctccctctattcaaggacatcactaggggtttcaggacatgttttcacatcactagcactcacgattaaaaccttctttgagtgtgaacattctggaagatttccattgtgtcgaccaaaacaatcaaaagttgtatctgtacagacaggtccacaagctaatggtatccatagctgaacttgcagacagtgagcggggcaaccccatgtggtctttaaatcaggcagcatctcatttatgtgtgtagatactggtcccgcaagatcaacttggcaaggcccgctaagtttgaccgctttcatccatgtgatgaacttattaaccgcccgatgatgggaagatagaggagaggatggaactattcccccctggtaaagagcccaactgtaaacctggagatgcatccatggcagtctgaattgtgatgttgtctctacagaagcattaagagaagccatggaattacagcacagatttctctacactgttcgtcctgccaacttcagggcttggggatttcgcctcatatcattgtaaggtgggaagagttaagatataattttttaaaagtgggacttcgtcttgagcttacgggacatttgtgcagaagtggatgcagctgtggcagggtagggactcattagtcatgtacagaaaaatatctttaaaatacatgttctgtatttcccaacattctaaggggatgtggctctgcttcctgcgtttcctttactgtgctccatgctgtgaactcaggctgtaattctgccctgggtaacgctgctgctgctgctggtgctgctgttccttgccacatgtttcctcacccaaaatgtgaccactgatgtgagctgtgtttgtgttttaggcactctgattactgattgcccctcccccccttaatgtcatactgaacagggctccagagaagcaatggggacctcagagtttctttccgttgtgttcacatgccccagattagggagtacaggcgaagaagggaatgaatggacctgttgttaaccatcctgtaaatacacgctatgtctcctcggaatggattgcctttgcgaacgagtaatcactcgaagttcaattttaatctgcacatcagagagagagagatatagaattgtttaggcttttttctcgacttcttccctgctttgatttgtctttgagataaagcaaattaatgaatgtgcactttcggttgaagaaatgattaagacccagctgtgtctgtgaaattataacctacaatgcacccgggacttgttaatgctttttttggcatgaagaaaagagacataggtatctaatatgaaatggtgttccagaaagcgtaagttagtagtttgtttgccaaattaactttcaaagacatttaggctactaggtttgacatttctaaacacaaatcttaaatgattgatggactactacagaatagctttgttcaaaaaaaaagataatctttggcaggctgcttcaaagactgcttctctgggaagatgaaacgatagcccattttacgttaatttccctgatacatcaatgcttatttgaaatcctcctgagagtgatgtggtatttactgtagcgtgaggctgtgttcactgtatccagcagctccctgggacttttctcttttttttttgagctgtagaaggatcctgctccacataaaagctgccttaacataatacagctgagcagagcagtattgttgcaaaaccaatgcacagagatacgattctcttttttaaaaatcagcaatgatgttccaagaggccagttctgattctcgtcacagaatcggaaatgttgttcttttaaaaagtagactgtgtacccccaggtgaagaaccataggcagctaacaattgatgagaaggtgaggattggccttctccaggatgagcctcctcatatggagtggtcggccttcagatcatataatacaagtaacacaaatcagactcagcaggttgtgtgtgtgtgtgtgtctctgtgtgtgtgtgtgtgtgtctgtgtgtgtgtgtgtgtgtgtgtgtctgtgtgtgtgtgtcaaagaaaagagagtttgatatagaataatgggcatgggaggtgattgaaggaggaaaagggatgacaacataattatattttaatacaaaatagattatataatttccatttaggtctgaagtcactgtgaagtgacaaacgaggtcaacatctcaactctactaagtaaggggttctattggaaataagaaaatggggtcagttgtgtgtggtgtgtgtgtgtgtgtgtgtctcacatgctagagacagaggtatgataccgtcatagtgcctctgggtcatagtatggcatgtgttctgacttatattgaagctgggagtctagatcattatcagttatccgcattcttcactactgaccatggtatcacatttctgagagattcttgattggccaaaacaaacaaacaaaacctgttaaagatggcaatttttgacctctgtaaacctctgtaaaggaaaaggagaaaaattgcttgcagttgttcatacttcttgaaatccagagttttataattgtgagattgcagctaccatggcctgtaatggtctggtcaaaggaagtgaggctttttgcaaaagtgtgtggtgccagggtgacattgggtccagtgggtaccgggcactgtctttatgtaatacagtatgaccaatgaattcactgtggacaaggcagggaacagaagccttttgtcttgaatcatcttcaagaccgttgcattttatagaactgaatgaagctgacttgcaaaaagagagaaaacgagaagtaagcaggctcttttgctctttggcagggtgaagtagagaagcaagtccccccgctgaacctactatgcggccagcagccttactgctgtgtctcacactgctacactgcgctggggctggtttcccagaagattccgagccaatcagtatttcgcatggcaactgtaagtatcatactctcactctcacttggcttttgagggcatcttagcctgcatcagcccagccaaaagttaaaaggaacccggagagacccagtcattttcaactgcatgtgtgacaaggataggtgatttcacagcaggttggtcggacggagctggatggatagggagactgttcatagcttcatcaagtgttgtagcaacaccagcaagcctttgaaatgtccctcgagcctcctgatgaaattttactctacacacagaggcatactcctgcctccacaccagctacaggagagaatattgctgacatttgaggactgagagtgttatgtttttaatttgtaacctttatgtataaaataatgggtgttttttacatacttaagaagaaaaaaataataactttttaaaaaagccttagaagcttgctactcttagcaagcggctggctttggagctatagaaaattcattccatttataactttattctgatacctggtttttgtcagaggtagatgctgacataactagaactactggtgactccctaaaagaggaaagtcttccctctgttttggaaagaatacctgattcctattttactgtctccctccaaaaggcaattgtgtcccagtaaaggtggacaacatttttgtcaagtaccatttcctatgtagttattcccaaacagtgagtggaccataccaaaagatgtccaggatattacacagaaagtacatacaccagtgctgagcttccagctgggatttctggagaaggagatgattttatatacaaagatgaggagccaagcctgaattatataacagtgggtgggcagaaggtcaaaggtcaatgctatcacttctgaagtagccatgttcccctcacataggatttggcatccaataaccatagatttatctccatctccatttctatctagatttctatctttgatgttccacttcaataggaatcctggcccaaatatgttattgacaatcattaatggtcacacattcccatgataaaggagatagaggcattgccatagcgaaccccaatgatgaccagatacaagaaattaaagaatcgtggaagaaaaagcttaagatgattgtatgacaagcttatttggaaataaagtatattgaagctctctagtaacacactgctgtgagaaagcccagataccatggggttaaagtacagtcatccaggcatgaatctgtgaatggttccccactcatagttacatccccataactccccagaaaacatagccttttgaatgtgactcatctttctttccactttttggagggttgccagtgctctggagactgtaggtttagaaacagagagatgttgagatgcaggtatttctaaaggtcagatattattacacatcacagactcagccaaagagcactagcagaaagaaatgtgctcatggagtctgcctgatcacccaactggctacactcactttgaccctgtcctgtcaaagcccacttctctgtgagattagccaattgcttagctccagtgtgcacttcccacagttcctagaatgccaaccaacctagcagggctgccctcaatggtagattattccacccggacgcctgtggagactgtatttttcttctggctcctggatgaaggctctcgcctccagaccacattgcctttgtggtgattgatggggaaggcagctttgaaatagttttgtccggagacaagatctttggcagcctgccccctcaggcttagcactccacagaagatgaaaagaaaactggagaagaaaagagcaccttcgtgctaaggggtcgaccagcaagtttaaccctcagaaactgtgatgcttagaaatgctaagaccgggcttattatcatctggaactgaagtgtaacttgatcatcctcaagaagtactctcagagtgtttcctgaagtaacagctctgctggagatgggaaatggtggcatggtctgaattaaaacatggttttgttctgtggccctcctcctcctcttcctcctcctcctcgaactggccccattgattcttggcttgatctgcatttccctctcttaccccgtctcctcctttttcacagatacaaaacagtatccggtgtttgtgggccacaagccaggacggaacaccacgcagaggcacaggctggacatccagatgatcatgatcatgaacagaaccctctacgttgctgctcggtaagagacattccttgcctgcaccagcagaggacctgaaggttcctgtccccacccacccacggtgcatctttctaagaacttgaggtcccttactatgttatttcagctaaaacctacttgtgtttgtcaagcaatccttctttcaagaatttttccatgtctgtttaaccttttggggatttttctatgtctgtttaaccttatgtggatttacggagaaataattgcatattttaaggcttacaactcaactaagccactgtgtttcttgaacatatatgcaaatatttacccaagtacacagtcgagtactccactacttgacagttgtttgttaaaccgacttggatgtattgacatgtactatatagtgggcagagatgtgtgtctattatagctatttgcacgtttgcattggatgtttgccaggtctttgaccgagtgatgatagtgagcagagaaagtacaatagtgtgtatgtttcttaagtgttctgtatttggcagtaatattaagctgcagtcctcctttgggaaatggcatctggacatactgctgtcctgaagcagagtgccatcataagaatgccacccaggctggggtcacgtggacttggacttttgtttgtttgtttgtttgttcttatgctgctgtgttcagttgctccatggcttctcgggcagtatgtggcctctgccaggtaagaggttaggtaggtatcttcatgaagcccgtgctgatgtgtggaactgtagagacgacaattcacaggaggtgtccaaatcagcctgtttctcacaattccagccaggtttgggttatgttgctcactcagggaggaccatcctgatctgttcctttggagacttacatggctccaaatagatgaatcttttcacatcaggaaaaagatgaatgatgttcatatgtggctgtgagccaaggaccagtacagctagaataacagcagtaccagcttccttggaagtgtcacaagtgtcgtgaatgcctccaagcccagcacacccttggctgcaagaaccaacaatcaacacttaaaaaacaaaaaacaaaaaaaacccccacactttataaatgaccctcatgctggtcatgtggtcataacttcataagtgtcaatttgccttccccacttcttgtagaaggatttcaagggacagagatgagaagtcagtgggcccaataaaagctgtcggatttgaacgaggatagactggctgtgaggaccacacagccactccctgtcctgtgctgcccactgcgaagtgaaactctttgtcccgtgttaataaccgtctaatagctgttgcctgagagcagcctttgtagctattcattatggaacattccagtgaggcctgagtacccacctctttggaagcatggaagctccttcctcagtatccttgttaatttcctaccatgtagcaaagcaagattacacttataatataatgtttaaaaaaatggctgagcaaaacaaatggttaaacatggaacccgtgaaaaataggttgactccagtattgcccatgaattgttcttttcacagtcgatgcactgggaacaaaaatgatggaaacagacagcccttgtagccagtgatttagcataggtgtgggttgcaggcccagggcaatagaaacattaggagccaggtgttgtgtctactaagaagcattcattattccagctcattaaaaccaagacagtttcatctgaactctccatctcaaggaaagggaaaaggaaacagaaaaggggggaaagaagtgccctcctttcaaaagcaatggaacagactggccattccctgaagctcaagtgtctgacaccttacatgttgcgttcataccatacccagccacctcccttcccaatacacttcaaaacaatctcaaaaggagttttatgcttgccacatgcagagcctctccttttgatttcacatttcccaaccctgccctgagacatccaggttccacgtttggcaacacaactcagtattgtagtcaatggattggaaaagaggaagtccttggattaagtcccgtttgtcctccaatggctacattcaagatgtcagagcgtcgtgtgcattctaggatgcacagaggcagcaaggaatgatcttttttcctggagtatagttgaccataaagcaccatttctgtccactggagccatgtgatctttgagatgttgaaaatgattgccactgtctagaagatttccctcgtggaattgtttttaaaaggtttcccagttctcccagacaaccggagtcagcgatccaaagccaagtcccatccagaactccagggactgatggggtttggtggcaagaacgccttccaattctttcctattattatccactttgtaaattcttctttctttttaatctctaaactactaattaacataaacagaccatgccaaaagggggcaatctgagagctttctgaggagctgccaatgcatattaatcagttgttaatttacaattcatatattcagcttctacttaagtttcgaagggaagaggggcaaggaaaagcttccagtcatttcaaacccaattccaatgtcataggcaactctagtctaataatgtgcctgaccacagcgccatcgtaaagccaaacaagtaataagggaatgcaataaacggcctcaaaattaaagggcagagtgatgctggtcccccacagaagctgggagaagcatcttagttctgcagtttggaaagcaggctcactcagtcctaccctgacacaagtgcacatctttcactgccaaaattacacactgacacacacatacacacagacaccagtgcacacacagttcaggagcaggcaaggaaacacccctgctttctccttttatttccatgtgaaaaaccattcatgagttttctgtctttttttttctctgaaagagaagtaaacagacttttcaagaattggatattcatgtgtatatgtacatatttgaacacacacatacatatatcatatatacatcttaaaaatagttgctttctcctctcccccagcccctgtgtctttttaactaacaaggaggtttgaaagtctacacaggagtcctgaggtcctggtttaaaactgtggataattttccagccccaggacttcctgcactttagaaaaatgtcaatgttatttcaagggaaaatgagctgtttggatttacccctgctagccccccctcctccactgagtgtgcctctcttcctccctttcttctcagttccagacaaaaagaccccttgtgttctgctcacacagaagggaggtttcaatagagccccacacctgagctgccgtttctgcatctccccttccaaggggagatcggcagcaaacggtaaagacagtcaaactcagggcagaacaggagaggaagcggaagcataaagtctcagccttagctcaagttcatttatacttgaattcaacgcggtcttgtggaggaaagggtcgcgtctggaaacaattttacctttctatcgtcttgcctatcaagttatcaaatgtaacacgttgaataccgagcagcttgttgtatgagtttaaagataccaagagcaatgtgaccctgtatcccagcttctgaactaggttagccttcagagtcttctaagctgagctctctatgtatggctcagtagtgctgagattaggagaatggttaccaaaagttttcatatgtcaactggacaccaggataaatcataaatgctaggtatggttcaagataatctcttacactgagttctttcctttttctagcatgtgggcagcctgtgtcttaacaaatagcgtcatggattgatctggcctgaacatgataacttactctgtagaaaatgaactgtcttaactcttgtgtctgactttctttcatagagaccatatttatactgttgatatagacacatcccacacagaagaaatttactgtagcaaagtaagttgtttttaaaatcatctttctaaaacgggatgcttaggggatccgtatttaaaagcagtgattgaagtggggtgggtgatggtagcataccttttgtgatgtctgatttagggtgagtgagggtttattacacatcccaaaagacatatttcatcagtgtgtgcatatacatttcagggtgttctataatttgtaaaataaaaaaaaaatcttttaataaaatattgccatgtctatcaaagaaactaccacttttcaaaaataagattctgtcccaaaaacatattaaaaactgtcccaatgttatggcttcaacatcatgcagcctgaatgttagttgatggatgaggggctggaatgtaattattacccagacatacataacgtctaacgtgcgctttcctcatgactccacacggggataatttagttaatgaaactttgcagtagaagagggagctttggcccacgaattgacacgaaggaacacgacctgagttaaacccctctccgcccggagtgaatgtctactttatgtttaagaaaatgacttccatattttaagagaaaggacttcgctacaaacactgattgattaactgaacgaaaagggtagccacacgcattttattaaaatgagcacaatttgcaagttgctttagatatggttatatgaagttcccgagcttctcctttatcatcatctcgaaaggaagaacatcctgtagtttaatgaacagaaagaatcctaaaattaagcaaaaaagtttctttctcttatatttttgttttcatggggaattgctcatggggaaggcgtgtagaaagctttcaataaatatatgttcagcctctacttgccccaagggaacccttacttctaaaatcaaatgcaacaacctctgggctctaattgatttctttcttgatccctgcagaaactgacatggaaatctagacaggctgacgtagacacatgcaggatgaaggggaaacataaggtaggcaattttcatttctcctgcggctgccactccgggttacgtttttgacggttatctcctgccgtagacgatgatttgaatgcttcttgctattcccttttcccccagtaattgctttttccctcaacttattgaaagctttaatttgcaaaaatagcctgctcttaatgtgatgaaacattccaacatctgctaggcctacatcaagaactcctagggcacagtagagattatggacgcagattgggtctcctgagtaccctagcccagtaacccacctcataggccagagcacacatccagtctgtgtaagcactcacgagtagcacagcaaactcacaggcttttgtgcctttggtcaacaaacagcatagaagtagtcttcaatcagaaactttgcacatcaaggaactctggaacatctggcattaaaattaatatgatcagaggttgctgtattcagctctctgttcttctgtaacataaaagaaacacatgttacctatctcttccgtgtttgtatttactgcagcaataatcattgacatcctttcttggttcacattagcaacagcttgaccatgtagctgggaaacccagctgtgtattgctccaggacagtcatcctgagaaggcttctaagcttcctgtttgttctaagctctccttacccgctgtactctctccacactgtaaccctgctgttggcggaccatggctggtggtgatgaatgggcttttgttctgagtggactccattcaaaaacagtttgaactctgtttcaggatgaatgtcacaacttcattaaagttcttctcaagaagaatgatgatacgctgtttgtctgtggaaccaatgccttcaacccttcctgcagaaactacagggtaactgtcatttgtctgtcgcaaccacactgctcggaggtatcccataatgtactgacatcatacggtgcagcaactgaagcggggtaacgctacaccacatgggttccccttacttacccagcttagtgtattgctccaggacagtcgtcctgagcaggcttctaagcttcctgtttgttcagaattgaccgacatctttaaagagcatttcttgtgaaggtgatttctagaagcttctattctttattgttacaaagactgcatacttaccacatataatgaatggcatgtggatttcctctctcctcctctttgtcccttccactcctgtattccctctctgaggacaaaaactcacttacttggtaaggaattttctattgtaaaagatgtgggcaaagcatgctgcttgaaactgcagactctccttgtaagatttgcaagagaggaatttaattccattttgtaccagcttgcttggccatgacattacttgctttgactttcatacatgaaaagaaagagtggagaagaaaaagaatgatgatgaagatgatgaagaagatgatgatgaggaggaggaggaggaggaggaaattggccacaaaaaacaggaaatccagtatcaggagtgaagggggacttacagctgaggatccaagagctcttgagctgctagaccagggtgccaatgctctaacatcttggcttcacctctgttagcttttctttggatcacaggttttctttagaaaacttccattgattttttttcctcctgtggccaagcactgaggctatcaaggcagagaagtgttggccattagggaggccaagccccaagagaaaagctacaggtctatggaattgctatgatgtgatgtgttagggaagcatagcacaaatgcttttaccttcaccagagataaagtcggtggaagctgcatgcagcaaggtggattagagccctctaaaagctcccacctgctggtctcatagctggaacgttaacaccacccagagagcttccagggcaaggaacacactcatgattactcaaaatctgaaatggtgcatcccaagccagtgcttggtggggaaaatcacgaacgagccagtctataccttttgtcacaaaggatagtaggacggcagacaaatgaagattgaggccattctggataggggaagtggcccaagcaaaaacacggcacaagaaatgatctactgagcagcagacattttatctagtactgaaatgttggaccctgaaatgacaagggacaagtcaagtgactgcagacgtatgttgccccaggattgaaggaaagagaagagtctttcagaaaacttaggtcgattttcttttgcggccaagcactgagaaatgcataggtaaaaacaaacaaacaaaacaaaaataacaacaaaaccccagggagattttataattgacagggaaagacgggtgacaacaagagctcctagactgtctcttaagagtaggtgatggggctgcctcctgtctagatggacaaggggattcacagggcactaagggatgggagttctgcagtgcaggttatgggttgtgttgtacaggcgtgttagcgctttcattgctctgatagaacaccatgaccaaaagcaatctgggaggaaagagtttattttggcttacagctccaggtaatgctatatcactgagggaggtcaaaacaggaacttaagtcaggaacttggtggtgccaccctaagcagaagccacagaggaaagctgcaaactggcttgctccctatggcttgctcagcctgcttgcatttttagtccacaacttcctgtccaggcttggcgccacgccacctacatcgccccctcccatcgcacattaattattaatgtagaaaatacttcaggagaccttcctacaccccatttcccacagtccctcgcctgtagtaatgctgaccccatagtactgtttttttgtttgtttggggttttgttttgttttttttttttttttgctcgttttgttttttttttaaatttgtttagtctccagaccattccaaagacacaaagcagcccatcagtttttgctgcttcctgctttgactcggctgtagctatagccaccctagagaaaggtctcagattcctcttgacttaggatttgagcacacaccacttggggtaggtcgttccaatagcatggtgtgcgcagggactgatagctaaatacctgccagaaccacagaccacagagtctgtgaagttcaacagaaagctctttttgggataatgtatctgaaaaagacccctgtaaagaatgttctggcgagggagactacattaaaggatgtctctgacttgattttctttcccccaaaacacagttacattttaaacacttctgtttcctgtgatttggatatgcagtttaccaacacaggataatttaaaataggggctacctcaaagtggttaccaacaggaaaggcctgtcccatccttgcgttggggacgttaggacagaaggtacagggacttcaagtgtcttgacttgggcagcttggttcactgcaggtgagtttttttttttttaggcttatcttctctcagtcttcagatcagtggtcaagctgtgcagctccaggatgagaacatagccttaagctaagagcaggattaggatagaagtgggtatgaaaacagaaatgttagcgagatcatttttggatttggtacagagctcttgcctactagcaagttgctaagaaacaatgataaattcaggagccggggcttcattggtgaaggtgggctaacctctgactcatgtgaagggtttactccatgtgcccctcacagtcaagtcacacgtggtcagggagatgatgggtctgttctatgaaggtattcaagagaccaggctctttcccaagaatacctttgccatctctgagggccctgccatcctctatagtgtgctgaagggaagcaggaaggaccaaggctgagaggtagcgtatactcactggtcactggccagagcataaacacatggctgcactggcgttcaagggacatgggggaatgtgctctggaggaatgagcagtggcatttagtgaacaactggggagatgtcctcacatccacaaatgcctatgggcctggcatgtgtgtgttacctgtaggataagtaatagccacaagtaagaaagacatgcatttgactttccttctgtccaaaagaaggaagaaatccagaaatacaaaagtatggaagtttaaaatttgtattaggtttcttctctttctcctctcttttctctttgcctctataactccatgctgattaaagccaaatataactcacaggcacatcagttctaacctcatattctttagtgtaaaggtacaaggcccagggtgggctctgggatcagcagatagcagcccctcccctcccctttagggcctccactttcagcagttcgttctgaggctggcttggtaggtgcggaagccatctaagttttgctgtcaagagtgtttttcatcttggctgatgccacactgctctgccaatgaactggaggaaaaaattccagtgtctcctactgggacttaatccacaaaggaaaggctcatcaggccaaacaaatccagaaaagaaactcattctcaatagagttcatgactcaggagataattggggcgggtagattttcccggtaactacctcagaaatgccttagtttaaaatgcttatttattgaccattccgctaggatatggaaatctgttggttgtaataagttaagagccaatcagacatactcaaattccacacttggctaattacggagtcttgatcaagtaacttaactctggaagcctccaattccttatctgaaaccagtagatgttctcagagggcatttgcaagaatgcatttgcaaggtgcctatgaatttactttgcatgctaatcacttttaaaatatcagtttccgttactattgtcggggaccggcggtaactcagacctgttacttcatttaggtcgataccttggaaacttttggggatgaatttagcggaatggccagatgcccttatgatgccaaacatgccaacatcgctctgtttgcaggtaaatgacctgatttcttctcattaagttgtttttgcatcttacagcccatggctgagaattcgcttggaaggatcggtagagtcacagttgtactcactctctgatgaacactgtagttaagaatgcctcttccatttgaaattaggaggggaaactaagtcttttttttttttctttctttctttctttaaagaatctctgccccacccccacaggcttttgagctttcaggaaagtttgatagcacagcactgcataagtgaaaacaactttgggctcagatactagaatactttatgtagaaccaccaatgcggatataacactggtggttgggttgacattagttggactctacagtagtctgcagtgtgtctctcctagccatttccctattctccgtttccttcttcatgagacagctgctctcagcaccgcagaggcttctcatggagcaaaagggagagaggtaaaaggaagtttctggaaacttctcccatagcagcacttctcaaatgccattgatttgattgggctacaagcctatctctgaccaaacggccacagtgtctgaaaagatggtgatgattgcctaggtgggcccaggttcctgctgaacagggtgtgaagaggtagctactcagccatcattttcgaatttaatggggtttttgtatatgagtaggctttaattgggaagtgtgtttaggaaatcattgccagatgtgcttgtggaagtgaatacagagagaagtgttggtgtgaagggatcgattgttccagcatgcaggcacgccattggctaccattcccacagaggcagcaaacacctggcctagcttaactgggaagggaactttgtcaacacgtgttttctctacgtgtatatttgtgcagcacatgcgtgcctggtgccttcagaggcctgaaaagggcatcagactccttgggactagtgttacagatggttgtgagctacaatgtgagtgctgggaatcaaagttgggtcctctggaaggacagcctatatttttcaccactgagtaaatctcactatccccacctcaaataaactgtctaaaattcgagtacactcgatttctgttcagttgacacaggtcttccttttcttaaccatctcatttggtttttggttgcagaatatttgctagtctagaaaagagccagaagttcagtgactcattttcagttttctttactgtctttccttttggacatgcccaaaagcaaacctgtctccccaaagggagaatttcaaaagacaggacgatttgcttccagctctctccaccccttgattctttgctttggccacttgcatagcacagggcttccattttgggactttggaaatccagaaccaacagtctgttatttaaacttgattggcagggcttcatgggtgacatgagtgacatgactgtgggactgtggctctcaggactaaagaagtcatctggttgaccatttagagcctttgaatcctccctcttccgttcatctcacaccaaatcagtcccagctccagctcaggtcatccatatttctgagtgagattaaaatctgtgttgattaaaaatcgctttcttatttctcagggctcccttctaagccagttgaccacagcttggttgcagtagcagcatcccagtgtccttggccttgagcttgcagtcaaggtccatctaatcaagtgaagcaaatagcatatttcatttgcccttttccctcagctgctgcggctgcccccgctacttagaaaaaaaaaattgccctgcaatttaaaaacgaaaaatgtttcaattcttatgatcctaattcaaaatagtgaggaatgggggccaagctttttcttaacgactcttggatttttcccagttgtccgatctcatttgcctgatacaggaaagcagaccgggggatgtctctactgtcactggtccctgccttgctcagtaccctgttcaactctttcctttttcttctaagatggaaaactctactcggctacagtgactgactttctggccattgatgcagtcatttacaggagcctcggagacagccctaccctcaggactgtcaagcatgattcaaagtggttgaaaggtgagcagttaaaggaagaaaggaagaaatcggggaggggatacatatctcataagagatgtagagtctggatggaccagactgtagattcactttagtaatggattctgacagtcaaaaccatgtaaattgcatcttttgcctcaactgatttatttacccctctttctcccctcccatgggcttctggaacactaacataactaccagtgctgcgacaatagactacaccacattcatctttccctgcctcaaattcatttcagagtccccaatgaaacgagctgaacagaacattcatggaaaggaaggggggtgggggggtggggggatcggagatggtgaggaacaggaaaggggctattcatagccctgagtgagccagcgtgatggagcaatgtgcaaaaactcctctaggcaatatggacattccattgtggaaaataaaactacagagatttgcaaaatgtacttattcttcactgccggtttgcaaagcttgtgaaagatgtaatttgtaggctcaagtgccttctgaaatcactagcgcttgcacttctgaagtcattagaaatggttagtgttaaccacatgtctaatagccctacacttccaattaataacacgtctttggctacacttgattaaaattcccttaacactatgtgacatatctccaattaaagtgcccgtttgtctgcagagccgtactttgtccaagccgtggattatggggactatatctacttcttcttcagagaaattgcagtagaatacaacactatggggaaggtaagatgggagactatccctggctccattggtgacattttcagaaacctacttttgaaccagcgttgctgtaagtgatctggaaatgcaaattgaacccgatgacaacagggatggccagaagtgacagactaagctgtctggaaacctgatccactttttcagagcagtaacaaattacagggaacctcttgaataatctctactgaagatctaaccaacagatgtttggttactttcctaccgaattcaaagtgttttgagatgtagctcccaggtataatttctcctcttaattgagttactccacagagacaatacatacccagtatctctaggcaaactgagtcttagttttattgcagatggttttattgcagaaagaaacagttacaggatgtttatttctgttactttattttatttatttttttttaccagacatctgatcaaggtcactaagtgagagggcacaaataaaataccagggtggcttgcatggtagagggactcacactccaagtatgagatttcaggccccagaggcagccagtagggatggcagagatggtgcatacaaagtgtgcttttgtctgaggaaataaaagctaagcagtctgtatggaaatgagtttatgtggctgggagctgatcccctgaaggatttatggctctgtattaaatgccactgccttatcttttaaaacattctggttctctgctgagtttttttttttttttcctttttcttcttcttcttctgttcctgatttttagaaactcaatattaaattaaacaccttgttgttctgattgcgtcattaagcagaggcaacttcttctaaggtcttccgcatttcagaaggaaatgactgcctttccctgtgtgcttttccctgtaggttgttttccctagggtggctcaggtctgtaagaatgacatgggagggtctcagagagtcctggagaagcagtggacatctttcctgaaggctcgcctgaactgctcggtgcctggagactctcatttttatttcaatatactccaggcagttacagatgtgattcgcattaatggccgtgatgttgtcttggcaaccttttccacaccttataacaggtaaccatgccctggctgggtgggccttcccagctccttttcccagggggtaggagtggtgggaggtttgtgactgatagaaaagcagctgtcactattcgtagataaaaagcactttgctctgagttttcatccatgaactaattagaatttataagcattattaaattaaggttttagggagagtaagttataacattatcttccatttatatgagtgacgtcgaaattgattaaaacattcctttgcctggaccaggtagtcagtgttagaaggcacaggttttgaaactaagagtttttctctgatctcttataggtcatgtgacattcctgtttcacttggtgtgtgtgtgtgtgtgtgtgtgtgtgtgtgtgtgtgtgtgtgtgtgtgaagattgggcattaattaaaatgttacagtgaggtatttggagcaaggtgccaagggttccacctaaatgtctagttatcatccaaattgagggtttaaatctcagtgacgtcaggaagttggttcatggctcagatcccaaccccagcacaattgcctccacaagagtctggtgagggtttctaggacctagaaatgctgtgtataacttcatttgtatttttgcatttagttcatcagaaaatgtagtcaactaaatgaggcattaataattgttcctcccccccaaaaaaaaaaatcgccgggtgtggtgttgcacgacgggcgtggtggcacacggctttaatccccagcactcgggaggcagaggcaggtggatttctgagtttgagtccagccttgtctacaaagggagttccaggacagccagagctatacaaagaaaccctgtcttgaacccccgcaaaaaattgtccccaaagtagtgaatatgcatagacatgacataacatagacatgacatagagaaacatctagtgtttacagtctttttctggcatccaggtctctataaagcccaatgtttcaaactctcaatgctgttgtgtgaaatgagcatagctctggcttgtaacccctggccatgagttttaaatgcatgcaccatgccctcctgtctgtgtagggatttagaggttctagatggaatgtcctcttgtaggagtacactttacattatcctttttacaagaactttcatgaacttcatgagtgccgaaaatgaagttgaggcatgaaaaatgatacgactggaggacagcatctcaaaagtcatgcctaggaactgggtagagccctgagcagagcgagttgagggatgaactcacacgcctcagttacagggagggcaagggtcaagcttttctcactgaagataaatgaaagcaaaagcttatattgcagcaagaagtatttaggtatgttttaatcatctatagggatttttagacttgaggatgcgaaagatataaaatatctcaaggcttgcatattcacatttaaggtcctatctatctaggattcttggaaaacatagtgctttgaaatataggaatgcaagggttagtagaatttaagactacatttctagttcaggttttattttattaaaagtgtgggttattttgtgattataataccgcagtgagtttttgtgtattatagttaatttgttttcttgagtggccctacaattatcttattatgcttatgcggtctcagaaatattatttgttcaatgagatcagacaacctaacttgttaatctacatatgtctttaagacttgattatgccagattgctgtcaatccttgagcggtgcctctttacctgagcaaaaagagcaagcaattgttctagcacaccagcccatcgtggtctggctccctttcagcctgtttcttcctgttttttggtcacacactccatactaccagcttaccagacctaaggtctttttctctgtaagatcctccaacctgaccaatgtctgtccattaaaatctggtagaggaatctcatgtcataagacttcgtgctaacaactctcatgtacagatctcactggcttgctctgaatttgcttatagttgtctccttcgtaaccagtgatctagctactaaagcaggacgttggttctgtggcattcatgaagcatctataaccagctcataattctccccccgccccaacaaaggagtttaaacagtaatgaagaatggtgggctttctccccttgtcttgagtttactgcaaccagccaatttttttttttaagactgttgatgcacatttgattggcagatacattctctttacacattatgatcccttcatttgtagtgctcagggtacttgacttgaaattctacctgtctgtaataagagtttctccagagtatgtttcctaaaggaatgtatcatagttccacaagtcacgccttgtgtgaaatgtcctttgcagcatcccaggttctgcagtctgtgcctatgacatgcttgacattgctaatgttttcactgggaggttcaaggaacagaaatcacctgactctacctggacacccgttccagacgaacgagtccctaagcccaggtacgtgcatatgtttatttattctgctattttctaactcagagatgatgaaactggcatctctgatagtgagcatcctgttgaccacatatgaatggcggcttccatcatgagccaggtagacagaggtccaagaatagcagaaagaccctcgtgatcatttgtattcaccttatcagaacccagagttatctttagttcctacagaccatgactttagtcttctggttaatatttgtaaatgtggttgcccactataataacaggtgataggagccatctgctttgctcctattgatgtataggtagagaatgaaggaccagagagtaaactgtattatacaaatttatttaactcgagagatacttctgttgtgcttccctctggtttttatataaactcttatctttaattccagtaaaatgtgaaatataaatgacattccatggatatttggggacaagtgggatcagagttgagtctagggctctgggtaaaggacaagaattatatagttggtacagtgggctgcttttctgcactcacctgcagtatagtgctagtctattttaagctgtgccctagactctctcacaaaagaaacccatgacccagcaacactgcagaaatttcttggccctgtaaaatctcttcatatcatgtaacagtgaaccctggaagaacagttctcccatcctgtccctgtattttccaattctgtagcacatcctccatacatccacctttgtggtctcagttacatggaaatttctcctttgagtttacgtggtgctggaagcaatcctaatgtcttcctgggtgctttgcttttcaatgttctcctttagcttcctatcctacttctcctgaaatacctacaagtacatttaattgaacaatttagatattagaaaccaaggaaggccaactggccaaccctttattatcagttgactttactggtgtattcattctctgttcaaagcagactctatgtaaaaggtaaacccagataaattacccacatgcttccatacgcttattttaccctcttgcaaatattaggctgatttggaagggctggctgtagctacatggtatagggagagattgtatcgtaagggcccaacttttcctctctagcaccagcaggtagctgggcatccggaccacagtctttagtattctctgatctgactttgctgagattttcatgtaaccctttcagcgacaaaatttcttgcaaaagttcacttttgccatctttgttcagttgcaaggaattggtcctttaggaaagaatcttcagtgtaactgtcttttcataacttccaaagcctcataaaagtcaaaaacaacaaatgaaaagtaaacttatataccccgagagcatataacattgaatcatgctggtgtgtaactcggtgactgaaaatcagttttctgtgcttataagaatatttagcgagagtcttgcccaacacccgcaagggcccacacgggactccccacgggaccctaagacctctggtgagtggaacacagcgcctgccccaatccaatcgcgcggaacctgagactgcggtacatagggaagcaggctacccgggcctgatctggggcacaagtcccttccgctcgactcgagccccgggctaccttgccagctgagtcgcctgacacccgcaagggcccacacaggattccacacgagaccctaagacctctagtgagtggaacacaacttctgccaggagtctggttcgaacaccagatatctgggtacctgccctgcaagaagagagcttgccggcagagaatactctgcccactgaaactaaggagagtgctaccctccacgtctgcttatagaggctaacagagtcacctgaagaacaagctcttaacagtgacaactaaaacagctagcttcagagattatcagatggcgaaaggcaaacgtaagaatcctactaacagaaatcaagaccactcaccatcatcagaacgcagcactcccaccccacctagtcctgggcaccccaacacaaccgaaaatctagacccagatttaaaaacatttctcatgatgatgatagaggacatcaagaaggactttcataagtcacttaaagaattacaggagagcactgctaaagagttacaggcccttaaagaaaagcaggaaaacacagccaaacaggtagaaatcattaaagaaaaacaggaaaacacatccaaacaggtgatggaaatgaacaaaaccatactagaactaaaaggggaagtagacacaataaagaaaacccaaagcgaggcaacgctggagatagaaaccctaggaaagagatctggaaccatagatgcgagcatcagcaacagaatacaagaaatggaagagagaatctcaggtgcagaagattccatagagaacatcgacacaacagtcaaagaaaatacaaaatgcaaaaggatcctaactcaaaacatccaggtaatgcaggacacaatgagaagaccaaacctacggataataggaattgatgagaatgaagattttcaacttaaagggccagctaatatcttcaacaaaataatagaagaaaacttcccaaacataaaaaaagagatgcccatgatcatacaagaagcctacagaactccaaatagactggaccagaaaagaaattcctcccgacacataataatcagaacaacaaatgcactaaataaagatagaatattaaaagcagtaagggagaaaggtcaagtaacatataaaggaaggcctatcagaattacaccagacttttcaccagagactatgaaagccagaagagcctggacagatgttatacagacactaagagaacacaaatgccagcccaggctactatacccggccaaactctcaattaccatagatggagaaaccaaagtattccacgacaaaaacaaattcacacaatatctttccacgaatccagcccttcaaaggataataacagaaaagaagcaatacaaggacggaagaatatttagcataatccccttctttgtagaacatatacctctagaatagagggtctcaaactgtaggtcactatccaaaaataggaccatccattagaagacacagatatttatattaagattcataccagtagcaaagttataattatgaagtagcaacaaaataattttatgtttgtgggggggtcacaataacataaagaactatattaaagggtcacagcattaggagggttaagaaccactgctctcaaacctctaacaagataccctagtttgctttccgttgttgtgataaacaccaagacaaaaaagcaacttacggagaatttattacagtttatcatcaggagaagctaaggtgggaacttgacccagaaaccacaaggcacactgcttcctggcttccctcttctaggtcgcttcctctagcttgctcagccacctctcttgtacaccccaggctcgctttccaggaggtggtaccacccacggtgggcagggctttcttacatcaattaaccattaagaacatggctcacagacaagcctgtgtgttagaggtatgtctagctttgtgtcaagttgacagatagtaacgcatccctgagaggcgtgtcctcacacactcatttccagttccatctctgttcactggggtttgtttgcgcgtctggaaggatgccaagttgcctggagatgcaactgagctgttctggctaaggctctctcatggaatgaggaggcagtccagaggaaatctcagcatgttgtacttggtggcattctgcattgttcaacatcctcttcttgtgcctgtggtatagtctccttcatgccagttacttagagaagcagttaattcaaagagtttgccagaaggcatgaacaactctatcccctccaccccttgttttcttttaggccaggctgttgtgctggatcatcctctttagaaaaatatgcaacctccaatgagtttcccgatgataccctgaacttcattaagacgcatccactcatggacgaggcagtgccttccatcatcaacagaccttggttcctgagaacaatggtcaggtgagagtgtcaaacaaactgcatccaaagtggatttccttgactttatcttgtgttcacggatcctgtcattggatggtgctttgaaatgccacaaacatcttctgctctcctgggcatggattcagctaggaaatgttgacaggctgggtagatgccaccaactccccattgccacattctcagtgagaagagtgccagtattttcaggctagttctacacatgccagcaattagaagatagaaaaaaaaatatttccttccagattagctcattaatccattctgcgagttacaagggagtcctgaagcaggacccgtcagaagtacttacctgtttggggtttacacatgactacattgctggcatgaaggggcacagcatttgtagtggcatgccaacatgaaggggttacgctttggtatttttttacctgaagtgatgccaacgtagaagcagtggccaactgcggagatctctgacagcattaaacatcctttgtgattgcaggtcattttcaaagaagatgatgttttttttctaaacagtggcagttgataacacaaaatgatttttatgccctggccttactgaacatatcatgaactctcttgactataacctagaaaccatgctctattacctgtgggaaggctggtgttctctagatcctgtcttggtacttagagcaaataggtatccaccaaaggtgaaacagacataaagttccatagaaagaggatgtccactaggccttacttatttaccactctggccccttcacagatatggtttggcttgcatgccctgattgtagtactgctctgagccctccacttttagggccctctttacccctttgtgtacaacctgaaagttttctaaacttgttgacagaggttttatgcctcctaggaaaagagtgaaggatggtgtccactattttccttttcaacgttaaaaagaaatgctaagtatattcccttcctacatctgctctctccattgaaaccatcagtctttccttattgctcatggaagggatcattgctgagtggtttcatatggttatggatatttatttattatagaacttggcctctgtacacatacttccttctcccgttggagaagttggagtcgtcatactaatgtctgcatatgaaaataagggaccagaccagcttgagaacattacttacatgcatatatatttttttcatgacattgttactagaaagccgtgccacacttgtttgaagtggaaagagaccctttaatgatagacttacaaagagatttttttgtttttcaaatgtgatcctctcatttttagataccgcctgaccaaaattgcagtagacaacgctgccgggccatatcagaatcacactgtggttttcctgggatcagaaaagggaatcatcctgaagttcttggccaggataggaagcagtggtttcctaaatggcagccttttcctggaggagatgaatgtttacaacccagaaaagtgagtggaacgttgggtcctttcttggtaactatttgttattctactgcgacctctcccattcatggaaaatcttggcagacaagttgtgtgatcacaccgtttcttaaaaaaaaaaaaatactgagcatataaagagcattggttttttgttttttgttttttgtttttttcccttgccaataatgtatggccctatagctgctcatatagggtgtccatataaggtcggtaaaagttcagttatatcagcccatgaagtcagcatgtcagtccagaagtgggggatgagggtaatggcagggaaaagaaaactgttccaaagaacctactaatggtctcctcctacctcatcaaactaggtgcagctatgatggtgtagaagacaaaaggatcatgggcatgcagctcgacagagcgagtggctcactctatgttgcattctctacttgtgtgatcaaggtgcctcttggccgctgtgagcgacatgggaagtgtaaaaagtatgtattcttttgccttactgacatttcgaaaatccattagcagatagaaagcagtcctggttagctgacggtcatccttcttctacagaacctgcatcgcctccagagacccgtattgtgggtgggtaagggaaagtggttcctgtgcccatctgtcaccccttagcaggtaaggagcctgaggtgtgggagggcaaaacgcctgggtcacatcttcatgctagatgtagacttgcctgtgttccctcaaaccatctgaactcatttctccatgtgagaaaatttcagccacggaagtgccaggtgcctcctccagccctaattcagttcatagacacacagtaggcttcaaaaggattccctagaaagtgggacatgaagatacccgccttgaacatcacagttcgaggatagcagagaaagaagccacggggaaccaattagattagtagatggtttgtccagccacaacaaaacgagtttgctaattgaccaaccatatgagcctgagaagaaacagcagagcatttgttaaaccatgtgatcctgcttcaagcatggtgttcatatccaataaagctttctcccctgctgaacaaaccccgaccttactgctcatccggcacacaatcaatgtttggcaatttcccaaagggtcccctagatcaagcccctgtgttcagccctgtgagtttttctttttcacttcagaggatgtgaaatctaaaataacatttggaaaaaatattcaaagcgcgtctctgagagattgtgcataatgcaagtgaggtgtccagggttctccttcaacaaaggagcttccctagttccatctgtaaaacagaactagtttcccatgctgggagcatctttcctgcttttaaaatagctagacaactagagagagacgatttagtgactaccacctacatcatttgagaaatattctcttgaacagagctaatgacaactgtaaaatatggcctggaaatctgagcgttgcaaagatgcccactctctgttagttatcagctgtggctttgcaggtggctctgttgacttttgatagagttggagccttatatcttttcatgaaattccttggggtggagcagaaagaatcagtgagagggggagctgaggaggggctcatcatttgtcaacaagtgggtaaagataacaagactttcataagctgttttcgagttactatcggaactcccagaggctccctctgagccctgcatttatatttcaatgccacaggcactgttcaacacatgcatagctctgctggctgagagggctttgggactggatggatactggctttcattacaagaaatccgtatccttggagaatgaaattaattttcattaccgcccaagatattagaggctaaacatggattattagatcaaggtgcgcctttcaaagcgggttcttacgtggttcatgatagactgggagccagccacaaatcagaattttccattacattttagaatcctaagcagagtggacaaatcggggtgcgcttgtttttaaaaattagggtgagtggtggtgacctataagatggaggaggatgagaagagagttgaggattgggcagggagaacacaagatcgttgccagagtctgcccactcagaggctgcacatgctcactggccagttttacctttaaacacttggttatatgtgcttggtaggcaaagagctaatgaggaacaaagggcctgggaaagaaagcagaaaagaatagacattttcatccaaacttcccttattgcttatacgaggagtgagctttagcacgaaaactttttaactgtttaagtaacgctcaggaagcagagtaaggacggcagaagagtagcccacaagccagcgaactcctgattctgctctgagctcactgctctcatagctagcttctcctcagagactcccatcacactcattgctataagctcccgctgagagctctttctctcttatacccaccactcagcttagctaaagggtcacttgtttaacgaaactaaagactcactcatggcactgaattttctttttttctctttcctcgtcctctcccctttttaaagactgacatttgagcaggacattgagcgtggcaatacggacggcctaggagactgtcacagtaagtatagttttaaaatctgtgcctgcctgtggataaagatgcttttctcaaatggtctcaacattggtggtgaccctttgtggtcacctaaggacctcagaaaacacatatttacattatcattcagaacagtagcaaaattacaggtgaagtagcgacaaaaatagctttatggttgggggtcaccacaacacgaggaactgaattaaaagttcacagccttcgcagggtggttttgaagcatcagatttgtgtaaaacaacgcatctgagtctggatataacagagagagaatggtgtatgtggagggcagcactgccagagttaactgctgtgaatgcaggcacctctcccatcattctaatgctgtggagtaaatgcatgtgaggggtattaattatagcgaagcagtaagttatgtcagtatttccattacaagaatgacagtctcgttgcttctcataatgtgctattacactacattttagccaaacaatcaaaagtttaatcattgtgctctggctttttaattgagtggggctgttttagtgttcttgaacatatttaccaatgaaagtaattatttttcaaaatgagactgtttgagataggaacaaacttaagaaataagacaggtgcacaaagcgattctaaatgacccctttgcagaaattaaccaagtgccattcttagagttcatatcacacacatttaagtggcaccactgcacttagatctttttagagacattcaggactctcttctgagctgatcaatatcaggaaccgcctgaaaaagctttagagttgtgaacttgaataatagtgttatgttcttagaaaacaacgttcagtttatgactttataaaaaatgagcatttagagtatctaacacaatctctaagcacttgagttgaaagaaaggcatttaggaatcaagtaagacaggtctgaggctctgagaatatggctgtgggcttctcaaaggagactcacctggtgtgtaaatttttttaatcttctgtgtatggaaattcataaaatttacattcaaaatggcactgcaagacagctcttaagggaacaaaattgggtgactctataataagatcatagatgcaattctaagtcttcaagtggtaagaactgagatctcagaccaggctgtaatctgactttctatcatatgcctttgtaagagatacagaacaatcaagtaaagagggtaactatcagaaacttcttgactcagacataagttggcttattaataaaatatacgaccaacattttcctttatcacatattcacatgaaatatttactcatcaatccgggtgcaggagatgtgtcatcagcaaaatggctgtgctgtgtgtgtgtgtgactattcatctgcatcagtaaaacaatttcaagttctatcatggcgggtcttaattatcttgtgccttgtagtctcagttttggagaaacgggtgtgttgaggggtggggggctgttatagatgtttaattaaattcagaaagcactgtcatttcatttgtgtggtctggtggtatgagtgcctgtaaataggaacagggatttggcttaaatcaggaaatgaacagagaagatgctgagggaatgctactgtgtgtttgagtgtctgtacacacctgtgttttgaggcagaggagcctaagagaacaaatgtatgtcaagtagaagcttccaatctagtgatttagtccttatggccagggtcagcagtaaaagcctgtttttctccagttccattctggaatccccactcaggacagaaggtgggactatgcctctctacctgtcccatcctgagagcttctcctgttctcatgctcccactagaacagaaactacttctatatgtgtcagtattcaggggcgatccttacagaattgcttcactgacaggatttttaggaaagtcaaagagagccggtatttggtgaaccaatgatgtaacatagacatcagcacacaaacctacatatgtggtttcccaagtatggggggtggggggttcaacttacaaactcaaactccccgctgagttcagaacattatggcttatgacactggacagttctctcagttcatccaaaaggatgaaactggatagaacatgaagacaagttcttatttacagatgtggcttggttacttcatccacagccatgccccaagccgtgcgtggcttcctgatgctcatagagttgttgcaatgactacttcctctgctaactcttgggttttcagtgccaggtggcagtggctttggagaaagtcactggtggaagagatctggagataggaaattggattgaggaggaagcaccttaggtgacaagcaggaagtgacaaagacctctgagtgttgggctcccacattgacccagctctcagggctcatcgctgctcagtgtgtaagtcacacgaagagtgtgcagccaagtaaccacatccccgcttttgtctttcagattccttcgtggcactgaatggtaaggacaatgttactgtcacaatttcacgttgatggaaatctgttgtactaatccacctgaatagtttaaagtcttaggtttctttttaattaatttttatcatttttttatagacatttcaactcctctaccagattatgaaatgtctttcaacagagtgtatggtcagtttattgctatatatatatatattaatacttaaagttactcatcctttggtagtttttagttttcattcttaatcatagaacagattctttgttacttcagggccccaattcactaaacttaattttagattttattatacttaaaaaaaatacattctgcttacatgagacagttaaggagaccaagtcttacatatttaatccatatactatgaaacatgccaaagttcaagtattgggtaaatctatctaatgaattttagaaggagaagaaatttcttcttgaatatgcctgtatatagagagatttaggataaaagaacagtgcttataacagataaactgtagcccctcggctgatagggaataccaaccccctaatccggcctgtcaggacaacctctccaacagggaaattcccatataacagcacagacgccggggttttgtgaggcaagcatgtgctgtgtagcatgaaaatggccaaaaacattcaagttcagaaagaatttgaatatttaaacatatttccagtaagacttcttcagaatgtatgcaaggaagcatgaggcagtgagtgtaagatccaaacaggattttgcccattgttctccacctgaaatacacaagcacagatccaagttcagggggttatccttacttcctcacgtgcaagccagaatgcagctgttttggttttggttttcctagcacttccaaacacctattaatttaaaggattgaatgtattttttaaaaaagaaagaaagaaagaaagaaagaaagaaagaaagaaagaaagaaagaaggaaagaaggaaagaaagaaagaaagaaagaaagaaagaaagaaagaaagaaagaaagaaagaaagaaaaagcatgatatgaaaccatctctgtagtatcaaagttaagcttttgccttttaatttggatggtgagttttgccatttatagttttttgtgtcctagatacaccacaaaggaatggtttaagaggcagtctttaaatgtaagcacaggcaaaaatggaggaaagacagaaagaagagaaaaaccacaaaatttaggaaacaagcaatacttcaaggtggctgcaaatgtgctcaattgttctatgtaaaatttcaggccctacgcctggttaacaaattaacataaaagacttattgaagtcttcaagactgtcttaaaacccagagctttgcaatgcagttccccacccagccccgccatgattcaacacagggtagaacagaaaagtttgcagaattcctccacctttgacatctgctcatctatgatgcaaacaggaatattgagcagcacagaccaggagagaattgctcagaaggcaaatgtcatctagcttaaccttacccttcaggaaggaaacccacttagcacctggtcttttgcaacgtcagaccttgcaatcatggcctgtaactgaataattcttatcagatgttgagaaattcaggccttgaaagtgaaccagcagccttccttgcatccatcaaatatccaagaccaatttgaactcccagggaattccttgaacatataattaaactccgggatgctctttctggacagaaatcactctgcaggcaagtttggagctttcatttcctcctcaaaggacaggcatttattaatttttccatacgttaatggggatatgttacaattaaagcttgaaaggacaatgcccagttcttgtgagctcttgatctggagtttctggaaggaaatcagagaagaatggggcttcccctttagctcataaccctgtccactgcaggtaggaactattcaacccgcagtagttagatggcaaaaatttaccatcaaaatcagtgatgggctaccacagaggtcaggaaattactaaagagccttagaaagatactttcaaaggagggaaaacataatatatttttaaggggaaaaagagagagagagatatgctgtagatagtacttatctagtacttggtatgaactaataaaatatttaattcattgagcatatacttgttgagtggctgctgtgggtcaggcatggtgtatgtgcaggatttgtatccctagagggaggaccaaattgctacgtttatgggtgtgaatacagatgagcaagacagtccagagtgcacctctgtgtcttctgtatgtcctgagctttgcagctattttaggcccacaaaacaaaccaccaaaatgggattacctttttttttttttttcagagaaaggcgtcattttagtctagcactgtgtaagctttgtgttggctaaagctgtaggcagcaccagtcacatctacaagaacgccttttagtgaattgggccctgattgtttttcctctctcttcctctctgtattgagttagtgtctcttatgtctaatcggctacaatcattgttaacagtaagaatagcgggaagggtctctaacctgtagactcacagtgtcttgtagatgtagagaaaccacacgatgcatgaaaattaactttttgaaaatatctatagtttttggatctgtgaagactataatagcatccattccactgttcaaaatgtgtccctattggacagcatgattgcagcaaacccatcaacatacaataccatgtcctcgagccattgcctattttcacgacatccttttggttacaaagtctcatagacaatgggcacatatcgtaaaatcacattgtgagaaagaatatctgtgattcctacctgtttaagaatgtttaagagtttaaggatggagcgtcaacagatgcttgccttgggggctgctgctcttctgaactctcacctctcacctggtggcttgacactttgaggctcacgtatttgctctctgtttacttcacatccaccctgtggctttccattttgaagcacaagtttaaaagattacaaagctttttttttcccccttttctgttgagtaaatcagatgcatagtttctctacatttacatatagaaaattgagacatggcgcgtattagactaacccttcagagataggaggaaggctgatttctcacatttgtggaaaacattttcctacctaactaccatctggtccacattaatttcctcccgtagccatagctttccttcaccgatgcgttttccatgtatctgtagcatatggtccaggaaatctttctacagaaaacgtgtcccttaggcatatatttcccctagattaccatattaagaaatgttctccctaaactacggttatggcattaccataaaattgccccttgaacacagttaaattggaagcgctcacaatgcctatccattcaggtagaagaaattcttgctacttgaaggggcaaccctcactccacacctccctatccacctacaaagctatttctaattcttttcttatgtcgggtgctgagttgtagttctggatggccataaattttttttaatgtagtcttgagttcaggaatggaaataaacatgtcttagacgtcaagggaagcaggaaggaacttcataacttctatttctcaggctgattttcttaccgcaattcttttatcagcattaggtgggatgtagaactcagaaatgcagcatctagagtcagacattccgtgaggcttaaatgagcatatcttcggcagtgggctgtagagcagagcattttcaacaaaacagatgttgaaagctgtgtgggaaccacccaggttctacagagggagggacttcttaaatgttaccaaagctttgtggtggctctccggaatagtgtttccaaagaaatctatattgcttatgtgaacttctgttggcttgcttttccctgacagcaaaattttaggatataatgctaataaacaaacaaacaaaaacaaacaaacaaaaatgtggctggagagatggttcagttgttcctagccacgctgactactcttccagaggtcctgagttcagttcccagcaactacatggtggctcacaaccatctgttatatgatctgatgccctcttctcttctcatgtatctaaagacagctacaggatatttacatacataaaataaataaatctttaaatatgaataaataaagacaccccccaaacaaaaagaaaacattgtttcttaatttgtaacgttaaagtctcctggaactcctacttctaatgaaaattgcaaattagatagagagaaagagagagagaatgaatacatctatcaatagaaccttgtacatttatcatgtataaggctatcaatcatattctgaggctagaactcttagaattactctgagcctattctcctctgtgccaatgacactgattgcacatatacaatagctgtcttactttctttcctaggcttatctggaactttatatatatatgtgtatatatatatatatatacatatatacatacacacacatacatatacatatatacatagccttggctggccccaagctcagagcaattctcctgcctcagcttcccaagtgctagcattataggcacaaggaatgacacccagtgttatcttttctaaagttcttaggatgttgctttaggcgagatggttaataatccacttgaaagccacagaaaagctatattttatttctacaagagtggactgctaatcaggctcctttaaatcatttgtgagagccgagatgaaagggtctgctacaatctgcatttaatcttgtgggatgatggagagcgagcatccaaatgtgttcctaggaaatgtctaacttatctgcgatgactccctgacccaccagtcttctggcaccacatccgggatcagaacctacctttttctagtttaattatctcagccagtgaggccacaaaaacaatgtctcataaatctgcgtcataaaacactgaacccagctttaaacaccgaaggtgtgtccctatagacaggtatcagaggaggctttcatgctagaggcaggaacggatccctcggcagagggaacatcccttggaatggagaatgcccacggggttagctgagactgaacactagacacactgtggagctttgatgggaaggactcagttatttctgatgggagagatcatccactgtcatggatgccctacccagtcacaaaccatgcttctggagtgtccctcatgctgccgtgggaagtgttctagggacagacactagtgtttcctgaccatcgggcactgtgaaatgtccatgattctgccactttatcttcccaaggctggcagggctcactgtccctacagtgtggcatggtgtggacagggtaagtgattacccaggctcagcccacttggagctgagacagtctgtgtcccttcatcctctgactacaagttgaaaggatcttgtgctgagcacggtatagatctctctctctctctctcacacacacacacacacacacacacacacacacacacacaccaatctccgtcagcaagtcctgtcattgccaaggcttgccctcggtctcaaggtcatcatgggtatcctacctcccgaccaaactgaccaaagggaatccagtctttggtgttgtttccctaactgtatttgtgatgaaaacagggcacgccagttccctctatcccagcaccactacgtcagattcggcatcccgagacgggtatgagtctaggggaggcatgctggactggaacgacctgctcgaggcacctggcagcacagaccctttgggggcagtgtcctctcataaccaccaggacaagaagggtaaggccttggaagtgccacttcctctggggaggggagaagggtggaggaaaggggaggactgtgtacctgcttccagctgaatcctagcagcgtgaggaacctcttgggcaccatcattgaaagcatctcagaaaagactgcaacccagcccttgagccaggcttgatccccgtttgctctctgacctaggagaaaccacacaacaaatgacatgtccctcagggcttcctctctccagaagagatagaggcttgggctgcttcaaagccaatgctagctcctcagatcctttcccactcctcagaactcctagtccgatgctgtgagttctcagcccctcttcctcctgccataatgagatggaatgctgtgcaggttttggcaagtaaaagcaatggaagtaaaagcctgctagtcagcgctggcccctctctcgtggtgctgaatctgaatagccctgtgctccacagaccactgtaatcacccttagaggaccagaggcgaaacaaaaatatgttattgaatccaggagaattgctatgcatttgccacgggaaggaagcttcgctaaatgaaagggactctactgtgaactgtcctaaattctcctttgctttctgtgctggcctccagacaggaaatgtcatgtctttttctcgctgtttgctgcttctggtaacacatcctacttcagccgcagctgcgagcagagaggcctctacttatcccgaaagcagtcttgtaaataaatcagtgcctcaaaggcccttatgttgctggggccatctcccccaatgcagaattgtttgcttctatatgttttcaagagttccatctaagctagggttggagttttgagggtcaggcatccacagggacccttggaggacaatgtaccatgccttctcttggaggtttgctttgttttgctttgtttttgtcttagatgaactcctttgtgcaccgatccccatgctaatctttccatatatatttttacgttgcttttgtcctgtgagcacgattcacagtcccttgccctagttcccatgcctaagcggtgaagatggcccctttgccccactctcttgtgtgccctctttgctgacttccttattctcctgtagacttctgtttctttgtatgtcctgcttcaaatctatttaaagaagaacaaagctggttttgtctcatcggcccctttaagttagaggcatatctgtccttaccagcttacaaaagtattcagtaaaggggaaacggcccggcaggctgcaggcctcagcatgtgacattgtgtgtggctccagaacacagattcctcatccctggctgtctccctttggttttgcctgttagaattttctgggggtggaagaaagtctttctagtcaagcctgggttgcagtcgttttctccgctcttcgctgagaaagggcggcatgcgtttcctccgttcatccgctcccgtaaggaacggaggctctcaaggagtcccattagaactttgacagattgttttaacattcagcattgttctgtttccccgggtcttcttatgagcgctgaggaagctggaagcagtgtgcatagcgtcagacaatggtggcagagttgactgcatgggtgtttaacatggttgctgttcttgtgctatgaccagcctccttgccttgccccatcaaatatgagtttgattttttttttaatttagacaagttctagtgtaccactggtggggcaatgccaatgagttgttatgccaaaatcgaaattgataagagcttaatgttccctgtaccgtgattttttttttatttatgatttctgatttcttcttttctctgaatgacctttctgttttgctgttcatgatttgtttccgacgtctgttttgtttcgcccggcactgtgtggtatgacatggtgatgacgtcactctgttggaaacatccctgctccttttccgaatcactatggtgtccctcaacccgacccaacctgtgctctctttcccggcttctttccatctcctgatgttggtgctttaatgacgtcgcatcctcgtgttccgcatctgctgggatgctggacttgtctgggtttccccgagggcctctgcgagtgttctctccactgggccgattgtctcatgggaatgtgacacatgtgtgttccagctctcggagccaaagatactctggaattgtttctgagatgcttcacgtttcttcactaagcagaaactgtgtccacggaccagcttcttaggaggagtcccgtgcccggtgccctttcgtttgagccattaaacaagtgtcagtgagcaacatgtccccagatgtccccagtgccttagctctgcatggctcctggctgaccctgggctgggcacattctttgttcactccacacttccaatatgcatctgcacttccagagtatgtttgctcattttctttcttttccttgtcatgtctttggtcttggtttaaccctctgcatcccgcacctctgtcacagcaccgtcctcaccttgcagtctaacccccttctgctaccattgctcttagcctcccctttcaaaatagtagacccaagccctcttccccccaccctgtggactgttccaaggctctttccttctgtactgtaagtagcattcagatgtcgtgcggatatactatcacactaacaaagagcgagaggagacctgcgaggcacaaaggagcattatcatagaaaatgaagtaattttctctctcagtaactagtcttgctcttcgttaccccactggccttgtctaatgcttcttttctttaaaaaagaaatgcccgatatcttccaagccctggattcattagttaaaaaaaacaaaaaaacaaaaaccacatactatacacacacacacagagccaaccactgtgttttatctctgggccctggatatctggagccttctaatcatctacttgataaattagatgcagcttgactacttctttcttggtttttgccacatctaaaaatatatattatgtattcatccaataaccattgggtagttataaaggggctctaattacatataaataaaagagaaaacccagtttatttttaggcctggcttagcctccaccatgcttccccacagcagaagaaagaagagctttcatttttgaattagacaaatttagggagtaaatggccactcttatacctttcttctcttattgaaaataggagtggtaagggctggagaggtggctcagtggttaagagtactgactgctcttccaggagtcctgagttcaagtcccagcaaccacatggtggctcacaaccatctgtaatgggatctgatgccatcttctggtgtgcctgaggaaagtgacaatatacattaaaggaaggaatgggggggggggggagagagacagagagagagacagagagaagaaaagaaagaaaatcttaatttaaaaaaatggtataaaacccgatcccccaagagggctgcaagttacaacagggagttgggcaggcacaaagctgccactactgtggagtggtacaaatatgaaccataaaccccaagcctgctgtggggatagatgcgtgaactccgagcaggagaataatccccctcttcagacttcattgcatagctctctcacgagtcctcggaaagcagacaaaatggtaactagaaaagtagatgttctcgtttggtgagaaatgacagaattgtatgcttatccattttaggaaagtgatagactgagacgttgtcgtctggccacacttagtcaaaaggatatggtcattatagccaagggaaggaagtagcatttaaattaaaataaaatgaagagtaactgtcggcagtgttttaatcagtgtgtaattatgtttgggaaagaagcgtctggtaagacgtgggaagtctactggggatggcacgtggatggctcatgttttcatgctcttcctgaatacaactctgtgaaatagaatttgtcagtcatcctcttcattgccaattgcttattctcttaatgcaccacagcctgtggcagtgttgcctctgagagggatgtgtagcatcttacacgggatggggatgctctgggtgatgcaggggcgttgtgcgcttcaggaaacgcaagtggtatgggggggactttatcccccccaccctcacccccaaacctcatcattatgtcaggagatactctccatcactgctgtgtccgcctcagctccctaaactcgctgctgtccctgtgtaaccacgaggggacatcaggcttcagaatggagccttgtcttgcagccagacccaactagactgaacattgtcttactctccgttaaacttaaagttagctttctgcccttggaaaatcagtttgtgtgttatggttcctgtaaattctccatgtcagatgcattaagttgagtaaattagagtttatttaaagcagctattaaggagtaatactggaggccatagagatatactattgagcaaatcaggcggtgagggttgttgtgttactacagctgtagaaatagttcctggcttattaaagtttgggccatgggagacttttgggatagcattggaaatgtaattgaggaaaatatgtaataaaaaaattaaaaaaaatagtttgggccatgatggcttagatggatcaccaaagtccaggaaagatgaaactgctaccaagaacaccacccttagttctcagaagaaggtgtgatagcttgcaagccctgggctgtctgggccctgtaaggccaagtgaccgggagtcagcgttgaaactgtcagtcctgtgtcctacccatttgtgtcccagcaaccaagctttggaattgggcaaaagaattttagtcaagtatgagtttaaagacagtagatataaactataatgaagttagcctccgtagtcttatatatccatcacaggtttttgtttgcttgcttgcttgttgttttgagaggcatttttgtttgttagggtggtttggtttttttctctctatcagtagtgagttccctaggtaggatgcagctagcgtgtgaccacagtatggcctgaggaggagtttagctccagcacctctgcttctgtgggctgtcacatgttcccatgtcctgaaaacacacacacactgaccctttgtcccttcccttccattcactcaagagttccaggctttcagagccaagtcctctgtacagacggactgaggaatctacacactgaaccacagagcccatgcctaactattcttgcattttaatagttgccaatgcttaaaacctacctgatttggtattttaaagtattcgagttttcccaaaaagaaaaaagtaatttcttggctcttctcaaacttaatagccacatggtttagaaaatgttattcttcatgatagtatatgaagaaaaacagacctcttgcttttttgacttaggccagatgttttgtgctcttttttttttttcagtgacatactgtaacaaaaaatattttctgaagtctcaggcaaaactcatcactgattccatagtgcattttaggataccactgaggagctaattgtgtgagacagacacgcccacttgctgtcagggcgtatccagccacaaggcacatgatgcacaagtagaaatgaaagtgacaaaggtttatctatgaaccaggtcaagacacataagaacagatacaggccctcgctgcaatatcacgggtgtggtaccttgggtggatggatggatggatggatggatggatggatggatagatgctgcatcccagcccatcttaccagtcctttcctttggtaccaatatcacagcagtaataggtcaccaactggcaggagtggaaaacgagtgtgttggatacaggatttctatctaaaattttgcaaacactgacttattgaatagctggtgctttctctaaaaaggtttaaaagcaaaccacgctgattacatagcttttaggtagcatcagagtcgtctttagatcagactatggagcaggactggtctccaggaaacacctagggaaaaggctgctgtcaaacatgcatggtcagaggcaaggtggctgagaaggactggccttactgagggagggaggactagctttgctgagagaggaggactggtcttgcagagggagggaggactggccttgcagagggaaggaggacagcctcaatcagaggtcctttatttctgtttggggggagaggacggatggaaggtatcctgtactatacatagaaaaatggtatacaagcccgtgctgttggtaaggaaaatgccaacatctctaagtgtatgttatacaaggtgcacaccataaagatttaatatcacttttataactcttctcatgctgttctaacctccaaaactttcaagtctatacaaaaactgtctgtggactggagaaatggcacagaggataaaatcctgagggcatgagttcgatatctgggatcttcatgatggagacaaagaaaactgatgatcacaagttgtcctttgacttacacatgcacaccataacacacacacacacacacacacacacacacacacacacacacacacacacaaatattcctctgcttctttgttcatttaagaagcatccatgtacaaatgtctttgctggatgttgaaaaagatgaaggatttgataggaacctgcagaagcagcttacattcagtggatgagatgcacagctaacttctggtgggaccaaggaaagtccacgcaagagaactaactctctctctctctccctccctccctnnnnnnnnnnnnnnnnnnnnctgagtttgactgtctttaccgtttgctgccgatctccccttggaaggggagatgcagaaacggcagctcaggtgtggggctctattgaaacctcccttctgtgtgagcagaacacaaggggttccctccctctccctctcctctctcccctctccctctccctctctctctcttacacacacacacacacacacacacacacacacacacacacactaacttaaacagtttttaaatgattgtctgagagttagagtcatggaaccacgttgttggaagtagaaaaggaggattgattacatggtaaaatacaacaaactcagatgaaattaaacttcagatacatttaaataggacttttcaaatatttagataaaactgaatgttttgcagtgtaagcatataccaaacattgcatgagatttttttttcttaaagcactactgtttgtccaagcttctaggtagccttgcatcaagtattttttgttacttgacccctattgatttatcccagatgaatacatccctcatgggacgtagttcctccaaagtattatgtacctgaagtttaacagtagcagtgtcctggtttgctttgtgccgctgtgataaacaccatgagcaaaagcagcttagggagggaagaacttacttggctcacacttctcagcaacagcccattgttgagggaagtcaagggacgagctgatgcaggagcagaggcaggaacggtacaagagtggtgcttactggctttctctccgtggctgccattcttagataagccagaaccgcctgccatgagatggaattgcccatgaactaacccagttcctacttgagcttccctcttcccaagcgaatctagcttatgtcacaaggccaaaaagctaaagtagcatatgttgcccactatagagcagtgctggagactttactcaatgaggttctgggagtctgcctcacagctggacggcacttggaatttgacaataatccaaactagaagaactcaagttaaaaaacttcttctgtagctgggcagtggtggcacacacctttgactccagcactcaagaggcaagcgttccaggccagctttgtctacagagcaagctctaggaaagccagggctacacagaaaaaccttgtcttaaaatacataaatacatacacacatacacacacacacacacacacacacacacacacaccacatccttctgtgatagttttatcacatttgatttcagaaaaataatcactagcatttgcatattggcctgaaacataggattggtatttggagccactaagagcaggcttcaaatgacacaggtacctcaagaaagctcataaatagaattgtttccaagcaagaccattaatacacctggttgttgtcaagtttatttaataggaagttcttagcaactgtcaaatgatctagattcgtgtttggtgtcattctgatgcttgtttgtttgtgggcactggaactgagaaagcactggaaaatcatagttcaattgtggtgtgacaagagcattagcgtcaaagaaagaccaagagcaaactttcttgaggctgtgcacacagccccctcagtagagtgtgttgtggacaagcattgaacctggattctaatccttaccatccacctaaacaccttgtgcctgcagtcctagcattgcacatttgtgtgtttatacctgtgcacaaacacatacacacacataaaagatggtattctgaggaatgccactcaaggttgtcctctggcctgcacaagcatcatacacacatacacacacacacacacacacacacacacacacattcctttttctgtttctttgttcatttaacaaacatccaggtagaaatgtaagttttcttctgagtgttaaagaagatacagattttgataagaacccacagtatccatttagagttaatgggcgagatacatagctagcttctggtgggatgaaatgaggtccatgcaagagaagcaaagaagagcagacagagcactgagggggtaaaagcaggccataactggttggttccaagtggggttgactaggaggaggtctggaaaggcatccatcgaaaagttgaatgtcaggagttgcttggggggagtcagatttgtggagacacattgcaaggagaacaaatcgagtggacaaggtacaaaacagaggcatttcgtgtggggtgactaatgtgatgatcaaggctatgtagggctagaatggagctgagctcaaaatgggagcacggtgccctaagtgtggtgctaaggtgtcttagcatttcaggttggggggggggggtgagagacagcagaagagagagaccaggggaaagaaaagcccaaggtggattaactgacctaggctgccggtttgcccacatgcatttatggatgacatagattctatgaatttgggggagggaatcttgtgtcagttttggttctaacatgtatcactgcctactgtgacagttttccaataaatgtttcttgcatccaaaccagacccttgattccagataaagagatggcaaaccgaaccccaaagtggggcttctctgtcccgttacttaagtactgaactacgtggtctggaacctggtgtgtgcgacttaaagtcacagagtctgagacaagagtgctttagcttcaggatattgtttaggtcactgcccagaagcagaatcgacatgggctctctgaccttaggaaagggcctaggagaatggtcgtgtggacagttcaagagtgggccttggggtggagactatgggaactttctatgcacacgtctcagagaggaggctcaggcagagatgcccatgcagccactacagttgttcctttggttgtgcaggcaaggatgtagatctgatctaattaaatttctatcctcttgacagccagctgaattcatctaaggtcttgatgagattattgtggaaagggtagaaagggaaaaaaaaaaaaagctaaatgtcagccatgcaaaagctatcttctccctgcctgcccgagtcagtcagtacatccacattggaattttctagagataaacacctggagccctccccgcttttatacatagcagccatttttctccccaaatgaaagtcctaaattatgactaggaaagctgaagcttttacttttaaaacaccagatttaatttaaaaaaagaaaaaagaaaagaaaagaaaaaatcagctgggcgtggtggcgcacgcctttaatcccagcactcgggaggcagaggcaggtggatttctgagttcgaggccagcctggtctacagagtgagttccaggacagccagggctatacagagaaaccctgtctcggaaaaaacaaaacaaaacaaaacaaaacaaaaacataaaacaagaaaaggaaacaaaatcaccatccagttgtgctgctccctttgtagccatgttctcaggccctgtcgttcctgacagtacgcttcacccacctttcccctcagtctctctctttgtttttttccactctctcccatcttttgaagaaacacacacacacacacacacacacacacacacacacacacaatgacaaagttttctgacagcttaatggaactttcaaggactcgggggactaggctaggcgtgatcttattaacagaacatctggagcagttacacacttgctctttaattgatccaactgcactgtgttccctctagattctgttgagtcttcataatgaaattgtgaagagtcaatttaagggcttgggtcccatgtaagaatggaaaaacaatattagctttctctcagagcccactcggcgcctagttctgtgtgatttgttagttttaagacttctgagccagctcgctttgcagccctccttgttccgcaggcagactggtctacagacagcgaaataaaatgggtaatttcctaagaatagctgctctttttctaacattacaagtgagagtggcctccggctctgtagggcttatccaaaacatataacaaacatcactgtaccagagagaaggggcacgaaaagctatgctctgttggtagtaccagggcaatagaggctgcttaaagtgataagcaacaccctgcacagtgcacagaccactgaatggactgtcagccgtcccatgaacctcatcagacataagtctctttagcgctttaaatctcactaaagccctgaagcaaagtactgaagcatagttggccgtactcagatatgctgggcacatgttagatgggatcttagtcaatgtcagagagcccattatagacaacgtagaggtttgtcatctccagttaccatttcctaatctcttccaattctgaagcttggaactgtctgggtgatgcgattcacttttaatggaagaactggaattctcccaccctggttacttttaaagttcatatttttacaaggatccatttcttttcaaacacgcatccgccattccttccatggagtcagaggcggccattatgaatggtatagaaataatagaacttccatatggacagccactgacaatgctttatttgaagggggaaatggtgtaaagacatttatagggctgtaaactatattatgcctaacctttcaggcatattaaagcgtgtcatttgcagtcctctagccttgttattcataaataatagataaccctggacacaatcatctgacatttgttaaggtaataaatacatcctaagtgctgattggccttgcactctgtgatttaaaagcacacaacagaaatttaatgtaacttaaaatgtcatgcacttcgatggactttccaattccgttctccttaacagagcccaagagccaagttccatggagggcactgccctgctgggtttttcgttaccataaagcagtgccttaatatgagactgatctcagtttcctcctttcagttggaaaaaatataaagagagagaggaccttcctgggttcttttccttgtgtctagtcatgcagaagtagggggagagatttttacatgccccaagcaattatcagccgtcatgagtggagattaagaagctgatgtagatgtagtccaataaagaaggtgagtttacccaaggctgggtacccagaagctttctgcgttgtcttcccctgagatccaggcatacctgggctgatccaatcagggacacatctgagttaaaaaatccaaccagtagccagtggccactattacagaagtgggaatgtgccctcacattagggccactagagaccgcatgcatcttctcaggagctacgggactaacaagtcggggtggtttggtttggcgttgtgagtgtagtagcatattttaggggatatataatagtttgtcaggtactcggtgcacatgccccaacacagtcacagatacatgagtaaaaataagaaaagtaaatctttaaaaagacaaaagaaagaaatttgcgcaaggaagaaatgtgatggatttgggtgttttctaataaaataacactgcttcggtgttctttgtccaaaagttagtgttaatcagagtaaagaaatcacacatataacctgaagatgggcactttgaacaccaaggcacacttggttcaattacttcttatgtttttcataaaacgttttgaaaacctgattatccatcacctcagttgtgtctgatgtaaatcatataggtttgttctcttaaaaaaataataatgccaataacatttaaggcgaggttcaaaaatgttagtgagcacaaaaatctcagtgtctgagcccagctaggctttgatgcacaggaggggttttggggctggacctgaagagctgtgtctttaacacgctcaaggtgttgctgatgctggtgagcactgaatcatggccattcaagttgctcatggggcatctttttgaagctcatgtcagtatgttttgatcctttttctccaatcttaactaacacagcatcttgggttctattcaaggcttttctgatttttctgaggttttagaaatactgctgttgctgttttagaaaaacaggtcaggtgctcgccatattggcccacttcatgcttctaataaccctcattttatagcccgtgttgctcaggctgatagagaaacatgcccatacatcacagagtgggttaactatagaaccacatctcaaatccaggtctttataacctcaaagtttatgttcataaccaacatctcccagtgccgtcttcgaagtgaaatattattaaactcaaagatttgtctgaatctcccaattttagccagctccccagtttacagtttgatatctcattataaagcaaaggaagaagacaggatgaggaagttggtttgatttcagagatcggatagatgttaaaatcttggtcttatctgaaaagaaaacattgggccttggaagtttcacaaatggtgctgaagatatggctcagcagttaagagtaaattcagctcttcagaggaccaaaggtcattcccaacacccatatcaatcagcttaaaactatcgataatggagaagttgagacctttgccctttactgacaccagatgagtgaatacatctctctccccgcaacattcacacacagttaaaaataataaaataaaatttgtgcaaaaccacaaaaataatcactaaacttatgcggacagtaacagttctaaagaatgggcccacagaccaacattccaaggcatggctttaaaaattatcataccatgactcctaatccaacagggacactaatctacctcctgaatatccagttccactgtcaaggtcgtgtctaagccagtggagcctccgaggatgaggcaacagagcccagggggaattggaggcagtgttctaaaagaaaatcgcacgaacttcaggcttgcccacctttctcttcacataaaggcatcccaaacaaaattgtcaccatctcagaggtgacagatctggcagcagtgagctgccacagtgagctttatttcaatgtgtgagtcctaacctcgggttgttaactggccagggtagggaactgcctatccttggacatggcgagtcacgtcctttagacatctcgaagactgggactcctcccaatgcttaatctatataatgccagggggtaaaaaaataacaaaataaaaaggaaagtttgagttatgaattcgagcccacttccaaggctgctggcattttccgtctcttccaaaccatctggataacgttagtccctaacacaaagagactgctgtttcctgccgaagtaaccgcagaaagctaccacttcgttttcagtgtggctgtccctgcgggctggggtgtggccccgaggacagacagactgcagctgaggctttcccgatgcttgctttcttctcttcctagggattacagtgagctctatgtggttagccctggtgctcactggctctcggttgcttcattcattctgattgccttggaggactcggagcctggcagtttgttgcaataagattttttcaaacaagaaaaattgggttgttagattctattcactcaagttgttatgaggatttcaaggaaattgcaggcttgtcttactatacagcagaatcgagaatctatttttaggggatctgactcccggggcttttcttggggttttgccatcgttcttagttctcagacccaacacaaaccccctctggctcaacgatggaggaaatgtccgtcctcctttctgcctttgcatatttctctaaaggacacagagtagctttgttgtctttgtggtcaccgggtccgctctgcatagatgcctattaatcagttcactatggagacagacacatccatcataccaccgcagtcccgaaacaggcagcccactgatcgagggtgagaggctaaagtacacacttaaccatttcgagtttcctggccgcctgcgtcttagaccaggagagaaggttcactggaggggttggggatggcttgggtttttagattactaagcagaactgattttatctaagtttgtccactttgataggtcatttagcatctcccaggtctctgtgtaaatggcaggtaatgggtacgcttggagactgagagttctaattgtcaaaaagagtgttgatgataatagctgtgcttttgatgcaagggtacttggctctggtttttttgtaagctagtagtttttcagtcctgaatttaatatagaacaaagcaatcttagcatcatcttcccatgacaagacgaaaaaactttgcttctaaatcagccaggtcttccacacaccttttttggtcattcaaggctgtccaaatctttctcccaaaggctcatggcttccatttttcttagttttcctccagctgtattcattcacccaagtgtttatttacagctgctttaagagatatctgctgaacatcttcctgggactgattggtgagttcatttctcttagactagcctcaccaaggaagacaaatataaagtatgcatcttgtcaatgatgattcttggagagaggatcagggccccagaatagaggtagaaagtaggcctggcccagagtaaagcagtcttctcttaggttagactctaataatcgagccacatttgtgagaaggtgggagatagtcccagacaaagggggcaaagtgtgtgaaactccagtatcaaaggacagtgcagcaggatgggtcacactaaagtgtaagggaccagaaaggagttagatgctttcttactggtgtggatacagcaaccctacacgtctttaaaactcagctcaatttcatctccttgttaaagcattgtttggccttggaatgggaagggtgcatcctactcttatttctatactttggctggagttcattgcaaggtctgccttccttccccatcctggcttgtgcctccctcactaccaacccccacctctcaactccgtgctttagtgtgctcagttaatatctgtctggcaagggcagcctcaaagatgctaatatcaggagaatgcaaagaatgcaaagaaagacaccgagagaatctcagtctaacccagagttcatagatagcatcctgtccaagtatgctatcctacaggccagatctggctcctgtatacaggcaaggcaggcgcggagaaagctgtttcctacttaccaaagccacatttctaaacagaggattgggtttctgacattttagaattcatttgcaaggtcatcatgggaaaactcagaactgtatcagggctccttttgattttactatctataattgctcttatttttgaatcgtgggctgcagagcccggggggcagtatcattcataatcttttcattgctctggcctccaaagagcttcaaattccctcattgaggcctctaggcaacctgaaaattctcacttcaaaaaggaaaaaaaaaaagtacagagtatctacccttcttagttctgccaatttaaggcatgatttcagagaaatctctgtgtcattgcgctcctcgcctcctgcaataggggagtggaaatgaagatccatttagcaccttatgactggtgagaaatagctggtggttaatgaatcaatccgatgcatttttttttgatactgtttttgttccaaacgccccaatttcaactggtgagaacagaagtcctggggactgatagaaagcatgtcaacagcccagggtggaaaaggctattcttttccttctgcatcgtgtgtgggtacttggacaggtgagaatgttccatccccaggatccacacagcatctgaagcaatgcatgttcattctggccccagcctatggtcctttgctctttgcagagatacatttgtttcaaattaagcaatctcactggagcatcagttatcataaatagccctttcaccctcaggggcttctttccaattatcacaaagctacgtctttttacttataagacagttgctcctcttactgttttgagcaaatacccgggtacctttatagatttttatttgtctgatagcaaaattctatcaagaccataattgaagagcatgtctttctgagacttccaaaccaaggttttatggtcaatccaaagatgactcacagggtttagaaatgtgttttaaagtgtccctacaatgtactgaaaccccgcatgttcaatagtcatagttattcaatagttattaagctacataactctggatcctggggaaagccagaatgacaagttcaagtagtgtggcaactgcttcaaggagctgaatatggaattattagtccactgggcatcttaactggttttgctggggtgtgctcaatatatttcaagcttcgttttaattatttcaaagttcaggacctacaagctgtcctgaaataaaaacattctcataggttaccttgagtatcctctcatctctctggccacatttggcaccgtaagaagcagtaaggatgcatctggctgcctctctgggaagatggataactggcagactcaaccagagatgctgtgacttcccatcctaagagctactaacctaccatttaccttttgtgcagtcttctgacctttagctctgtcccccaaactggcatttcaactctttctgggccttcatttgatcatcctatcctcctgaaggcagcacgagctgtgttgagcccaggttatagatgaaaaatctgaggtccagtgctgttaagcaactctccaaaatgtcaccagtctgtaggtgaggacccaagactccagatcctacttgaatcagcctccctgatcaacctcttagagctttgtgttcaaaccttcaccatggctacactacaaaattaatttcattgttgccctgaacactgcattgctaatttttcacatctttaagcttggaaggcatttccaaaataaaagcccctttccaagcttcccttagcacttactctctgctctgtttttcacaaggcgctgaggctttctgaatttgtcttgttgaaacagataagcaaagcccccttgcttttctcacctaaggtatgaagagatgcaggaaggctttatgtggtccttgtttgtaaagcactacttacctagcaaaatgagactggagaaaatagtgacaccattttcctgaaaagtcagatcctacttgacttgttaacaacaagaaacctgaactcaaatgtcatcatcagctagaaaagtctttgctggtattaaaaaaaaaaaaaaaaaaaaaaagtggtttctaggagtcttcagacagctaaagatctttgcacatgaaagaaggctatttaggagctagaattacgggtaaggaggagcagtggataaatgtggtcattacacagagctctcaaggaagtaaatggattgttccagccatattgtactgaagtcacactctgctcactgtacacagctgttgggaggtgggagaacacacaacaggacaggtcaactggcaaggggctgacaggggaggaactcgatcacatgagcaaactcatgttaagatttaggaccagcttcttatgaaagggaagcccgcaggaggagggcctgacttggtggtgctctgtataggagatgggagttgcagaccgattggtggtattctttctgcagtgggtcaatgtgtgtgagcatatgacatacagcgagttaggatactctgatgaatagatggctttcagatttgcaagacttcagaacaaagaacattactctctgggactggccttctaacttatgggtatcaatacatacccaaaggacaggaagaagggactgtcttgagttcctgttagtcatcaacaagcttgctgtatgaaagaaaacacactacacctggttattatgttagctagagcaagatatgggggttaaatgtggagtacttatgatatctagtctcaatgctcttctttggtctacccatttaagctctagaatgccaaagttcactataggcagctttctctaagaatttaacttttcttggtaagacagtccccactaaatatgagtgcctaaagccataccgtgagatgcttgttgtggtgagaacttctgtccactaccctctatggatgcaagtcttgccatggttagaaccacggaactcgccaaatcaatgagaaaaatgaaaccattttattcacaggtgtacacatttgtttgtgcaattatgtgtaggaagcttgagaatgtgtgcaatagaattccatacacaaccagaactgaaggaaaatcagttgctatcttaacacaacaaaaaggaaatgtaaattttaggaagaaatcttcattagcacgttttctttcaggcataggtactaaaacatatttgaatgcaagacaccctagggagcaccacacatataatgtgtgagttagaaccacatttccctgctgggtttttttggttttctttcttcttctctttggttttgtagcccttaaaaagctcatgaagataagtctggaaatctttgaaaagtgtcacattgagaaattagtcagtagcttaccatctccactgtttcctggggttcatgatctgttcctccccccatcaccaagcatatttgtttaatcataaaatcttgcaacttaaaaggtgtttgctactcctgtctattcccactggaagtcacaattctttgtcacaggaaagtcacccccacctccccagcaagcacatgtaatgatgtcacaatataaaagagtccttgagagagaagagtgtgatcttccagctaggtcctctgggtttgggtacattcactttaataatcaaaatattttcatcagaaatagccctccccccgatgacagagctatgtttcttctaggtctaggctgtgacatttaaaatgtaacagtgacaatcagaggaatgttaagggttgaatatggcagaagtttaggagtaaatagagatttttttttcttatttcatctcattctaattcagggcccctcacagttgccagtaaagcacattaaacatattccagaaagagttgatttagcaggtgagaaatgtgtctccagggaccagacaaggtacattttctgtcttgccatctttccataataggaacaatgtttacactccctcatgcagtgcctctaatgcattcatgctccctcactctccagaggcagagatgcaagtatttgagactttatgtttttttagctaccggcatcaagcacttaggatctgagggttgtgatggctgttcacgcttggtattagaaaataaaagctccagtgtttgcatttgagtagaggagctcagtttggtggctgattaagcaggttagaaaaggaaacttttttttttccttcagatacgaagcttcttggttaatgtagtggaagataatagacaggggtagccacgtaatttttattaaatcgaagagatcagctctgctgaggactttcatggtgacagcaagccctgagagtaataatgggacctgacatgttacaagcccataacggggccctgatttaaatattctctcacttctgatgcatatttacctgaaattgagtgtgggttttcctttttccatgcaaaataaatgtaaatgctgtaacctgtgagcttcggctatttttcattgtggtgacataaaccccctctatcctcgtgtagattcaaaagcaaacatgcctttctccagacagaggtctccttgtcagaaggcagtcatcaagaaaagactgagtggaaagccctggattgttgtgtgatttgttcgattaacatgcataaaattgttgccacttcctccaaatagctcatttattctaattctatagaaggtgggaaagatcaaaaggaaaagacagataaataaaatttgaccctgccagccatcgtccttagaaagaagttgaaaaaatatgtaccagagaggacagccacaaaagaaggcaacaaataaaatcgatttacatacacatcccagggctggctggggtggggtgggggcagggaggattaattagttaatgtttggcaagctgtgccctgaagatgagctatgcagaggtgctatcatcacttattactgttattaattaacagtgtgattgccaaacaccagaacaccccccacacacacacccagtgtgtggttcgtttcttaatgccatgtgcgatctctattccaggagtgattcgggaaagttacctcaaaagcaacgaccagcttgttcctgtcaccctcctggccattgcagtcattctggcttttgtcatgggggccgtcttctcgggcatcatcgtgtattgtgtgtgcgatcaccggcgcaaagacgtggcagtagtgcagcgcaaggagaaagagctcactcactcgcgtcggggatctatgagcagtgtcaccaagctcagtggcctctttggggacacccagtccaaggacccaaagcctgaggccatcctcacaccactcatgcacaacggcaagctggccacgcctagcaacaccgccaagatgctcatcaaggctgaccagcatcacctagacctcaccgccctgcccaccccagagtccaccccgacactgcagcagaaacggaaacccaaccgcggcagtcgcgagtgggagaggaaccagaacatcatcaatgcctgcaccaaggacatgcctcccatgggttcccctgtgattcccacggacctgcccctccgggcctccccaagccacatccccagcgtggtggtcctgcccatcacgcagcagggctaccagcacgagtacgtagatcagcccaaaatgagcgaggtggtggctcagatggcactggaggaccaggctgccaccctggagtataagaccatcaaagagcacctgagtagcaagagtcccaaccatggggtgaaccttgtggagaacctggacagcctgccccctaaagttccacagcgcgaggcctccctaggtcccccgggaacctcactgtcacagaccggcctgagcaagaggctggagatgcaacactcctcctcctatgggctcgaatataagaggagctaccccacgaactcgctcacaagaagccaccagaccaccactctcaaaagaaacaatactaactcctccaattcctcccacctctccaggaaccagagctttggccggggagacaacccaccccccgccccgcagcgggtggactctatccaggtgcacagctcccagccctctggccaggccgtgactgtttcgaggcagcccagcctcaatgcctacaactcactgacgaggtcggggctgaagcgcaccccctcgctaaagccagatgtaccccccaaaccttcctttgctcccctttccacatccatgaagcccaatgatgcatgtacataatcccaggggttggggggccaggagttgaagcatccgatgaggcgaggcacccacccagctgagcaaggtctccattgcctcgagtatccacccgaccaagatggccctggaggagctgaggacgctgggtcctcctccctgggacatagggatactcttcaaaattgggccgtgtggtctggtgaaggtttagcaatccacctctgcgttctcttccttcacatccacgtcatacagcaggtcggactcacgaaagacttcagtatcatcacaaacatgagccaaaagcacatctccaccccatcctcacatgaacacaggccacagtcacattcgtgcactacatacacatacacacacacacacacacacacacacaccacaccacaccacaccacaccacaccacaccacatcacaccacaccacacacgcaatggtaaacgacaaccacattttgtccctgactatacaggacgttaccaaacttggctaagcatcagaaactttaaaacacacacacacacacaaccattttttttttaaaaaaaatcatgaaaattaaaaaaaaataataaaggattcattgataattctaactcagactttaacaatggcagaagtttactatgcgcagatactgtgaaatgcccaccagtgttacagctttgttatagcaggtaaatgccatgttgggcaacgatgtcatagatttctgctcctcttcgcttttaatgaataacgtgaccgttaacgcaagtaactcttatttattgtccaccccttttctttttcctcaaggaaaagactcttccaaatgccaccacatgaacagctctgcggaagcccgtggaaagttaaactatttaacgtgaaatccattaactggaataattgagtttctttatttttacaataaattcactgagtaaataatttggagctggaattctgagctttgtgtttggactatcggatcagtagctaaaggacagtgctaggaaggaatatttatttaaatctagttaatttgtcagttgggtttctcgccaagaggaaaaaaaaatgtttaaaaatccttccagagtctaacttccagccaggacagaaatgtttagaatggtgcctaagccccattgccgtaaacatggctttgtctgaggaccccaccatcaggaaggcattagcttgtgaaacctgcccctaccccctacccccgatccccgacccccaccatctcatttcaccttgcatgtgagacagcaaaacaaagatccacaaactgtgtgaactaattaatatgctggctgctaccttgcataaattaatgatttgatcacacgggtgtttcatgaggttacatctgtgaatagcctgttttccacatgtaaatttgtgccttacactctgagttgtatacacttgtaaactgtcgttatgatcaactttcttttcctacttgaaataaaggcagatatttatttaaaccctgccctccattcagccctctggaagactggagacaagcaaatggaacagacacggtagcgatggttgtaatgctgaaggctgggtgatacccttcagttctccctgccttcccttgtgccaacgccagccaccctttggccatgctgcagagcatggacctccagtgttgtgggtggaaaaaacccctttcccttatattcccagatcatttcaatttggtgacatcttcctgagccagccgagaaaggactgtgttcactgactggagaatcttgctgcggtggttagggaggcaactgggaggcgtctccgagctgtgccttcagcacacccaggcgatacacagagaatcaaccagaaaatagaccaggcaggctggtccctgctgtgattaatgggtaccccaaagtacaaactaacgacaatggatgctgaaaaatccatttctggggcaaaagtatttttttgtttatttgtttctgtttttttttttttaattcttttatctgtttgttgtttgtagagggttgggaggggtagtgtgtggttttgttttttgctttttttgtttttcccctcccttggttttcatttgctaaagcacacagaaggcacctttgtttactctatcatgaacaaaagaattgtctgcacactgtaatccgtgagcactgtttccatataaacagtttatttggtggtctcttggtctcttttctttttccagtttgatctaggttttgttttgtctttaaaataaaacaacaataataataataataaaactttcagaaaaaaaaagattggcaagaacaaattcgaattggttatttaaaatttctatgttgcacccgccgtccgagcagtcctgcagagcccacggtgtacagccgagaacaggtgtatagccctttgttccaagacttgcctcggaccagctagactgttgtttgagatacataagatatcactggttttgttttgctctttagaggagtcattgttcatggtctgtaaccattgcaccctgaagccagaaaggcttttctagaaacagatggtgtcttctctatttccttttcttcacaaatacaaaaatgaaaaggaaggtgcctgtcagccaccccataccctctcctcccttttgactcccaagagtattaccccaacctcatgcccatgttaatgggcatcattgcctcagttgtgttacggagacccatgtcaaaacccacattcctacaccccacaccccgctcctttcggtgtcccacatgtattgagctggtcttctgcttttccctgtccctctccctttctgccctgaccttgcattcgggggtagggaggagattgcccatgaacctgagcgtgccttcgctttccaccctggctagacagtgtcgatgcaacaaacgcagacttacattggttgtaaagttgtaaaaatattgtgatgtcaccaattttccttccgtctccacacatcctaacatctgattcacagtttaatgtatgtagtttaaaagaaaaggagagagaggatgaaaaagaaagggggaagagcggaaaaatcaagggatatggctctattacttaagagtaataaaatcagactgttctacgttatcttttgtgtcctgaatgcttttgtttatgtctttagttttcattctttagccactctcctgcccaccccctctcaggataggattctcttccttctctctttctctctttctctctctctctctctctctctctctctctctctctctctctctctctcgtttcctcataaataaccatatagttagacgtatttgtttgcagcctcctcgccctgccccctccacccaacttattgatgtgtttttttctggctgcacccagcctggagcaggattttagtagaagcctctgtaattaaaaggcagagcacgcgttgactccctctattcatttcttgtgctttccttttatgggcttgttcatcatcaaacatttatggtaggcttgatagtttaagagatcaaggctaggattttagtatggagggtccactaaaaatagatccttgcccagatgtgacttcagccttcttacatattgataaggtggaggagtctggaagtgctctctgttagcgtttctttcctgtaactgggaagattgctgagttataatagtaggatgaagagctttgtttttttcccccttccctccttcaggatagcattatgaaatgcctgcgtcaggttttcccctctggaggctttttaaaaaaacaattatttaaacaagtctttggctaaggtatttcacttgtgacctttagtcgtagaaacatgctgtgagccattgagtgtgagaggctgcagggtgggggttcagttcacatccagagtggtacctcggtgtggcccaatcatcttgtcgtaaatgacttctaatagtgttctctcgtacacgtttgtattggtatatagaagttgtacctgtgaatgagtaacataacgacatagtcttctaagcatatcacgtaattggccatattcactagctgtgtttcttgaagtacattcattcatagcgaggacacattaggcacagatttgactggcctgtctcctcatttgcatggagaaactagcataggcccttgaaccaccatttaaaggtaaggatcaaacgccgaacaaagtttcccagaacctaggacacatgaccacctttgaactggttcttaaaggaagtgttctctggccagctagctcagaaaggaactagcttatgaaggggcaggcagcttggggtctctgagaaaggaaaagtttggttcaatttgaacagcgcttgtgagaacctggactggagagcctgactcctatatgctaggattttatctgctgtgcaccagaacctttccttgcatggagaatatagagcaacacatgtatctattcttttaaaaagcaaccagacagcaatgtagaaactagctggtcccagggcagggttgcaggcagctagaaaggtgccaagtgatgtgcctcactgataagaacatcttaaggctcaagccctcatccagttccacatctagagaacagaaagccactctgaaatcgtccttccaaagccagacaagaacttccttcttacgagtttgtcctgcccagttgtccccaagtgtcctcgggtagaactgaaaggatggcccacagctggttcatttaaaaaaataataataatgggggaagataagacccagggaagaatttccgagtgatcccaacactgatacagaagtgctgagcggagcacaagtcccttgtctcctatcagacacactcagatccttagagcaagatttgatagaaaggcctgataccctccctcacctcggtcctaattcacaagctaagcatactggaaacctttatctctgccaaggcaaggggtgggcgggaactctaggtttcaaagtaaaccatcctaccaagccaacattgtatttatctggtgccgtctgccaccgtcagctggcactggtctttcaaggaggcaactgaggcagaacaggtgcatcaagtattttatctggagcctcagggatgtccccacgtagatggagggaaaataaacacctcagacaacctgatttttaattgctgtgtttgcttgcttgggtgtttgttaaggagactgagggtttctgcagggtgtctttaaactgttgtgtctaaggagtgactgtttccctggtccagagaggacgtgtgggacctgacttctttccttaggtttcgtgtcaggtaaactcaggtttcatgtcaggtaaacgttggcagacgccaatcatgatgtcacaaacctcaatgcgtgggttttgctatctttacaaagactctttcaaaacaaagtcctccagcaagtgaaagtgtaggaaaggcagctctgatttcacacactgctccatttggctggagggaaagggacaggaggaatttaaaagaagcccatagaaatgaagtaatgtgattaagaacataatcccttccctggctcagccctgtgacagctgggcgtttggaccagtaaccctcagaaaccccatctcacgcttgtcttaaaaccaggcggtgacatgtctctcctacagaagcaggatggaagggctcacatttattgatcgggactaccagacagatggggatcttcaatattccatttagagtattgtatatcccctgagatggaggaggttgacctcaatgaagggttagggcggaattgatgtgcattaaatgtggctgggcagaaaaaaatatacagatgtcctggtagtaatggaaacgaaatttgagcaaatcaagggaggcagctgatttgcacagggttgcccagccccctcagaaaacacgtgtgtgcatgtacacacacataaattctatgctgtggccttttttttttccttgaaccaaaactgtcacacagagttaaaaccacagaaccagtgtcatctgaaggttgtcccgtcaagagcactttctcctctttgctgggtaaatcagggttcaacctaagcccttttcaggggagtcgtgatgaactacaaattcagaaatgtgaatggaggaggttacccaagagcttcatgtaggtgccttactgtcagtgacactggctgaggtggcaacaacttcttcattctccctaatcaccttcagaaagaagactctctggagattcattagcatcatccccaaagcaagtcctccatcctgctagcctgctgtaataatggtccaaataagggaagctaatgaaagaggaaaattggtacccacaaaatcagaagcggttgtcattgatggtttccaacaacaataaaaacagatgaaggtgaccttgatacagggacaccaactgcaaagacttttgggccagagctcctaggttcctttggatagggacaatgatgacaacccagctgggagcacatcacttcttgggtgtcatgacaacttcctgtacatacataagggaggtgagaaagtgcctgctatgcccactctctgatgtggacactgaatgttttgcatagttggtgtcctgttagagaaaaagtataaaaaatatgaattttaagagtagggctacctttttttttaaataaataaataaaagaggaatggtcctgctacccagaaagggtcattgtttccaattactaaaaagcatgatttgcatattttagcatatttagcatnnnnnnnnnnnnnnnnnnnncttggtcttagccaagtgtgatggacagtaggcacaagatcatccccattttacagaaagtggaattcagggaagggcctcttaggacagcacttagcgtggaaatgtagtcatgtttcacactctagagttgacatcatcccgcagctctctcagggacacctcgagttacacaattacccagtctcagcgaaagggaagagactcctacagggtttcccaagagggatgatcacaacaataaagtccccaaaataagggctcagtgcacatgttctattttaagaccattgtgctctgatatttttccataattaaagagcacaactcttccttcctgcgtctacagagccctttggccagcctcattattaagagccatcaacaaagcagagaaaggaaaagccatagccaaacatggtgactacccttataagggtggaccccatcacttcagacatggtgacagcctgaatccatttgaggaaaaggacaaaagactcaggctttggtggttgcttcctcccatgccatgcctgtcacacaagtcacaaaagaagtttcagaagcttaaaaggaataaggctgcatgaggaggaaaccaaaagcatcccatgcctggcagcttggagaaatttcccaaccttctccttaaaaaggacagaggtagctgggaaaagaaaggtgtgcaaggaatgtcgactgtcacctctctggtcccacaggatgatgtgaagttaagttgcttacgcgcctgcctagaacaacatctcaagacacagaagtcaacatctgttctccaccgcacatttcactcctccgcatccgggccccaagctctgtgctgtaacagccacagtctggacctcccagagggaataacctaaagcaacgaactctatggggtagacgggactgtccttcctgttgtctgcaggccatgcagctggacagtcatgaggctagatttctccacagcactctgaagaagctgggctcctccagccctgggctggtgacctaagatcccgttggcaggaagatgaaggtggacgtccttcggatcccactctttttctttacactgattattcagtgtcttgtttactactgttagacaattaaaggcctgtttctaatctatgtaagcttttctctatatacaaatgtgcatggtggtgaataaggagccttgattgtgatcagctacaaccacaggaactgggcataaaacatgtatgtaatcccacctgcactgccatgctgtttacttaattatgtgctcattaaggggaacaactttggaagcagtttactttccctgatctgaagggtcagagtcaatagccagttagcattgaaaaggaagttctatatttcagagtgtggatcaccatggctgaatgcctgcctcctcctttcttggaaatgtgtgtgtgtgtgtgtgtgtgtgtgtgtgtgtgtgtgtgtgtgtgtgagagagagagagagagagagagagagagagagagagagagagagaacctgtctgttgaaggttagtgtagatgtcagctgatttgaattcttattggtgtttaactttacttaagaactaaagattcattctcctttctttccagggtgaagagaaagcctgtgatcacatttcttgcttcaggagaacagataatgtgttagacatatatgtatgaatagaaacaggtatatagtcatatttcctctgtgtaatttaaacagtgtaagtcagtagggaagggctgtaattgcagccaaagtaagtgaggtgaaaattactaggtgccagagcatctgcatctcattttaattaggtgactataatagcaagatcaaaaacttttccttgtcactcaatctgttgggtgttctaatcaagaagccaaaaggattattttgtcttcagaaaatagttaccccaaaacaatcctctcttgatatgggcccagaagcatagctcagcatttgtgggggcgtgggttgtgtagagtgagtgtggtgagtgtgtgttgtgtgtctgtgtttgtatgtgtatgtttgtgtatgtatgtatatgtgattatgcatttgtgagtctatgtgtatgtatatttatgtgtataatgtatgtttgcatatgtgtgtctatgtttgtttgtgtggggggggtgagaggcttagggaatactgtgggaaagaaatgctccaagccctacttgcaaaagcttaagtacaatcattcctaattgagtagcttggcactttcccttcacagagtaagacagctgagaagagggccaaacctgctgcctgtgggtcactgtttgggacagttggtcgccatggtgggacagtagtccaaatttctggcttgttctttttctcacttgaaaaatagacttagtgacacctccctgtccaccctcaggagtgtgcagaagtcaaaccaagtgaaggtttaaaagtcaaaatcctacttcatctccattttccagtgccctctacattgccaaattaagtgactgcattcccacctgactgataatgaacccaccccccacccctttctctcttttccctcactccaacttcttctctaaaaacaaaatcaaccagtggttcctggctaagcaagccatgctgtcctccttagaaggctaagcagttctgtttctgtttcattgtggtatccctaccatgtgtgtcaatatggtggctaggggc

SEQ ID NO: 91 - DNA, 2675 bp, Mus musculus
agccgcggccgcctgcccgtcgatgcaccgaaaagggtgaagtagagaagcaagtccccccgctgaacctactatgcggccagcagccttactgctgtgtctcacactgctacactgcgctggggctggtttcccagaagattccgagccaatcagtatttcgcatggcaactatacaaaacagtatccggtgtttgtgggccacaagccaggacggaacaccacgcagaggcacaggctggacatccagatgatcatgatcatgaacagaaccctctacgttgctgctcgagaccatatttatactgttgatatagacacatcccacacagaagaaatttactgtagcaaaaaactgacatggaaatctagacaggctgacgtagacacatgcaggatgaaggggaaacataaggatgaatgtcacaacttcattaaagttcttctcaagaagaatgatgatacgctgtttgtctgtggaaccaatgccttcaacccttcctgcagaaactacagggtcgataccttggaaacttttggggatgaatttagcggaatggccagatgcccttatgatgccaaacatgccaacatcgctctgtttgcagatggaaaactctactcggctacagtgactgactttctggccattgatgcagtcatttacaggagcctcggagacagccctaccctcaggactgtcaagcatgattcaaagtggttgaaagagccgtactttgtccaagccgtggattatggggactatatctacttcttcttcagagaaattgcagtagaatacaacactatggggaaggttgttttccctagggtggctcaggtctgtaagaatgacatgggagggtctcagagagtcctggagaagcagtggacatctttcctgaaggctcgcctgaactgctcggtgcctggagactctcatttttatttcaatatactccaggcagttacagatgtgattcgcattaatggccgtgatgttgtcttggcaaccttttccacaccttataacagcatcccaggttctgcagtctgtgcctatgacatgcttgacattgctaatgttttcactgggaggttcaaggaacagaaatcacctgactctacctggacacccgttccagacgaacgagtccctaagcccaggccaggctgttgtgctggatcatcctctttagaaaaatatgcaacctccaatgagtttcccgatgataccctgaacttcattaagacgcatccactcatggacgaggcagtgccttccatcatcaacagaccttggttcctgagaacaatggtcagataccgcctgaccaaaattgcagtagacaacgctgccgggccatatcagaatcacactgtggttttcctgggatcagaaaagggaatcatcctgaagttcttggccaggataggaagcagtggtttcctaaatggcagccttttcctggaggagatgaatgtttacaacccagaaaagtgcagctatgatggtgtagaagacaaaaggatcatgggcatgcagctcgacagagcgagtggctcactctatgttgcattctctacttgtgtgatcaaggtgcctcttggccgctgtgagcgacatgggaagtgtaaaaaaacctgcatcgcctccagagacccgtattgtgggtgggtaagggaaagtggttcctgtgcccatctgtcaccccttagcagactgacatttgagcaggacattgagcgtggcaatacggacggcctaggagactgtcacaattccttcgtggcactgaatgggcacgccagttccctctatcccagcaccactacgtcagattcggcatcccgagacgggtatgagtctaggggaggcatgctggactggaacgacctgctcgaggcacctggcagcacagaccctttgggggcagtgtcctctcataaccaccaggacaagaagggagtgattcgggaaagttacctcaaaagcaacgaccagcttgttcctgtcaccctcctggccattgcagtcattctggcttttgtcatgggggccgtcttctcgggcatcatcgtgtattgtgtgtgcgatcaccggcgcaaagacgtggcagtagtgcagcgcaaggagaaagagctcactcactcgcgtcggggatctatgagcagtgtcaccaagctcagtggcctctttggggacacccagtccaaggacccaaagcctgaggccatcctcacaccactcatgcacaacggcaagctggccacgcctagcaacaccgccaagatgctcatcaaggctgaccagcatcacctagacctcaccgccctgcccaccccagagtccaccccgacactgcagcagaaacggaaacccaaccgcggcagtcgcgagtgggagaggaaccagaacatcatcaatgcctgcaccaaggacatgcctcccatgggttcccctgtgattcccacggacctgcccctccgggcctccccaagccacatccccagcgtggtggtcctgcccatcacgcagcagggctaccagcacgagtacgtagatcagcccaaaatgagcgaggtggtggctcagatggcactggaggaccaggctgccaccctggagtataagaccatcaaagagcacctgagtagcaagagtcccaaccatg

SEQ ID NO: 92 - protein, 871 aa, Mus musculus
  VARIANT (1)...(871): Xaa = Any Amino Acid
SREDPAEPTMRPAALLLCLTLLHCAGAGFPEDSEPISISHGNYTKQYPVFVGHKPGRNTTQRHRLDIQMIMIMNRTLYVAARDHIYTVDIDTSHTEEIYCSKKLTWKSRQADVDTCRMKGKHKDECHNFIKVLLKKNDDTLFVCGTNAFNPSCRNYRVDTLETFGDEFSGMARCPYDAKHANIALFADGKKATVTDFLAIDAVIYRSLGDSPTLRTVKHDSKWLKEPYFVQAVDYGDYIYFFFREIAVEYNTMGKVVFPRVAQVCKNDMGGSQRVLEKQWTSFLKARLNCSVPGDSHFYFNILQAVTDVIRINGRDVVLATFSTPYNSIPGSAVCAYDMLDIANVFTGRFKEQKSPDSTWTPVPDERVPKPRPGCCAGSSSLEKYATSNEFPDDTLNFIKTHPLMDEAVPSIINRPWFLRTMVRYRLTKIAVDNAAGPYQNHTVVFLGSEKGIILKFLARIGSSGFLNGSLFLEEMNVYNPEKCSYDGVEDKRIMGMQLDRASGSLYVAFSTCVIKVPLGRCERHGKCKKTCIASRDPYCGWVRESGSCAHLSPLSRLTFEQDIERGNTDGLGDCHNSFVNGHASSLYPSTTTSDSASRDGYESRGGMLDWNDLLEAPGSTDPLGAVSSHNHQDKKGVIRESYLKSNDQLVPVTLLAIAVILAFVMGAVFSGIIVYCVCDHRRKDVAVVQRKEKELTHSRRGSMSSVTKLSGLFGDTQSKDPKPEAILTPLMHNGKLATPSNTAKMLIKADQHHLDLTALPTPESTPTLQQKRKPNRGSREWERNQNIINACTKDMPPMGSPVIPTDLPLRDSHIPSVVVLPITQQGYQHEYVDQPKMSEVVAQMALEDQAATLEYKTIKEHLSSKSPNHX

SEQ ID NO: 93 - DNA, 149062 bp, Homo sapiens
caccaaatattgactgcaggtataggatgtgccaggtgctgttctaattgctggggttatggtggctaatgaaggagtccatttctgccccgatgcagcttaccactaagtggtaggacacaggcattaaacaaacaggtaaatacatacaaggtcagatagcaataagtgctatgaagaaaagtagaatagggtaaggggagtaggaagaagtatggggagttgctatttatgtggtcagggaaggcctggctgagacactgacgctggatcaaggacctgcaggagatgatggagtgagccctatggatatctgaggaaatggttttgcaggaagagggagaaacaagagtctgaggtgggaatgggcaggaggcagggtggccagagtagagtgagcgagggggaaaagtggagaagacaaagcctgagagctgcaaaagtggccaggtggtatgggttttggcttttacactgattgtgaccagaggatggacatgattttaatgaatgaattaaaggattattctggctgctatttgggattagattctagtgaggtaagttcagaagcagggagaccagttttaaagctattgcacaaccccagatgaaaatgatggtggtgtggaccagcgagataatggtgaaacggagaagtgatcagactctggatatattttgaaggtaggctaacaggatttgctgatgaattggatgtgacaaatgggaaaaaaggaggagtcaaggacagctcaagattgtgaggtctgagcagacggaaggaggatgttgttacatgatcaggagaagcaatgttcataagtatcactccatcttgagtcaccttcatcaacaatgcactgaaaggaacatgagagtctaaggctaattcttgatccatagttagtgaattaacactgtcatacaccatcttattaaagtttatttgctgtgttttgtaagaaaaactgctaactagattacaaaaaaaaaaaaaacctaaaaaagtaatgtattgactaaggaattaaacaaaaagaggaaattccctaaagcaagggaatctagccaaaaaaaaaagtcaaacattggactgtaataacttaaaaatccaagtctgcaatcttgttcagaaagcagagaatagaagggaacagtaacagtgaggaggagtaaaggtttagggactttcaaaagtttgcttcaacagaagtaaaggctttaaaaggtgactgggagaaaggaaatgactcaattgctttgaggcatgcaaagaaagggagaggaattatgaggaaatcaacatgtatgtttttataagagtcttaataatacaattaaattacacaatacagtagtttttaagaaaacaggtgtgtaggttttcagttcaaatattaaaatgtaacattctagtttatgttaataagtacttggttatgaataaagatatatttaagaggtttcacaaagaaactgacatcagttgttccacttgtcttatatttagtgaagtacaaatcaggcactggtaactagtgactgaataatctgaaacctttggaaagtactgtattatatataacttattttgaaatgtatcatttaagctcattccagacaaaaagttatatctgaaaacactcttaaatctagctgtttagtcagtattttataggacaattaactagagacttgtcccaggcacaaaatccaaaattcaagatcaagttaagatattgggaaaccatccttgtattttataattatatatacaggggagttttcagatgataaatttatattcaacaatgtagttttttatacttcattaagaacgtactttagatccaagcatatcacttttttaagaacattcattgttcccaattatccagcctaagtttagatgtttaaaacagctgtcttctgttttaaagtttcaatgttaaagcaaacaaaacatccttagttgtcttcatttctctggttataaaattactcttaaatacacattcattataataaacagcctggaaaaatctttcagttgatatcagtacagagttttctcacataatctaaaaactagaattggaacaaattgaagcatagttttatatttaagcatgtgccagaacaatcttctcttctagtagggctttcactacctggaagcaaaggccttgaaaggcagttctcaaaaacaagtatattttaattttcatcattcttttggccaaatagcaaattccaaagtggtacttaatcaaccagtttatctggttatgaaaagtataaattacatttaggtaactgcatttttaaacaaactcacatcccagtagatatctttaagtctaaatattagtaggtggggcaattaaaagaagttattttgcaacagaaagaagaaaacagggccaaacacagtctttactctgtgttacataactagagatttcaactaaatgtaaagagcttttgtggaggaaaaaaatggacttctggtttacttaacatgtattgttcattcattaccttatttctcatctaacattctcttaatttcccaaacaataatttgatatcagaagtgaatggagacaaactccactgtggtacagtggaatgattgttatacacagggtggggtcccaccatgaagctattcatggaggggcagacagtaaatcactgttagcaaactctagcttgctgggagagctggtccttggagatgctctgacattgttcccagtgaattcaaattgcagtttatctccttccacaagccttctagagttctatttatattcttattgcatcttatttttaagcatcttgtttttgaaattgttatatttactcgtcactttcatccataaatctttttctccccattcaaaaagcaaattagacacgttatagtcgaaattctgtgttgggagaaagcctagattttgtttatccttagaactggaatctcaaaatctgaagagcatgatatatgtctagagttttttttttccccttttcctttttaaatggtcctattccatccaaggatctattccttatcctactgaatccttgaaaaggaactaattgctttcactaactcatgccctcacttatgtacccttactctcagttaagtgctggagatacaagataaatgacagagatatagtccgaagacttgagaaacttgtgatctaacaggaaagagaagcattcaacaaataattgcaccaaatattaatactagctgtaatgtctgatatgcactatgaggtaaattcacagggtactttgagaatacataatggagaatatgatctattctagactatcagggaagtcttgttggaggcagggacattgaaggatgagtagaggttagtctggtaaacagggagaggggaagttccagtattccaggcaggagcacaagggcaggcctgtagttacaaacaagaaacatggagctttccaggaactgaaacaccagtgatgctgcaagaaagggagacagtgatgggagcacggcagaaatgagaccagagaggtaggcaagaaactaatcatgcacaatgttaaggctgtattagggtttaggggtgtctatggatgcctctgaggtgttttaagagaggcttgatgtgatcagatgtgcatctctcaaagatcacttagactacaatctggagaatgaataagaggacaagagagaatagaatttaatgttaatttgggagaaaaagcaaccaaaaatattactatatattggttacagatacatatggtatatgtgaaagtacagaaacaaaatgtaaggatgcacagaaaactcataatatcattacttataaaaaaagaaaatgagagtaagaaagagatgttgatgatgaggaagttaagttttatccaccatgttttatttcttaaaatacagacagtaaacaaaaatgacaaaatattaacagtcattaattctgagtaatgaaaattgggatgttggttatattattctttgacaatgtttcaatttcctcaaaagaaaaactaagttaaaaaaaaagtgagaggagtaccaagagagagtagtgtgtcatcaaagccaagagcagagagtatgtcacaagaaacaattgttgctgataattcaaataaaatgaaaacgttaaaatacccactgtatttactgtcatgaatgtcactgaagactagcaaaaggggattgagtagatgaaagaggacgaagtggcagcactggttatcaacaatctctggggctgtctggctttggaagagaggagagaagagagtagcttgaaagaaatgggatccaaggtgggctgtttctttatctttttctttttctttctgagacggagtctcgctccgtcgcccaggctggagtgcagtggtgcaatctcggctcactgcaacctccacctcccaagttcacgccattctcctgcctcagcctcctgagtagctgggactataggcgcctgccaccatgcccggctaatttttttgtatttttagtagagatgggatttcaccgtgttagccaggatggtcttgatttcctgacctcgtgatccgtctgcctcggcctcccaaagtgctgggtttacaggcgtgagccaccacacccggcgaccaaggcggactgtttctaagatgggaaagaccgaagcttgcttacatgctgatgggcagatgcaggagagggtctggagacaataggacagaatttctgagaacctgtgaattattgggaacataaggagggactggcctcctactggaggagggacactgcctccttcataagaagagacacttagaaaataatgagtacaggccgggcacagtggctaacgcctgtaagcccagcattttgggaggtcaagacgagtggatcacctgcagtcaggagttcgagaccagcctggccaaagtggtgaaaccccgtctctactaaaaatacaaaaattagccgggcatggtggcaggtgcctgcaatcccagctacttgggaggctgaggcaggagaatcgcttgaaccaggaggcagaggttgcagtgagccaagattgtgccattgcactccagcctgggcaacaagagttaaactccatctagaaagaaaagaaaagagaagagaaggaaaagaaaagaaaagaaaagaaagaaaggaaaagaaaaagaaaggaaagaaaagaaagtaaagagagaaagaaagaaagaaagaaagaaagaaagaaaaaataatgagtacagaagcaaaaatgttcccttctgatggactgcgtttttttcagggaagtacgaggtatgaagtgtgagatatctgattacggggagaaagttagaaacgaactgagataaggcggtgctttggatgagattgaggttgataacaatctatctacatttttttttccagcaggcttcagctgcccagttcagaagcagagacggctgatgtttacatacttcagaactagcttttagtcagatagatgttgaccaaagatagaggagcaacagaattgaaagtatttgcaagagagagggactgatactatgaagctatgctagacatagagaggaatgaaataaggagggaataggtgatcgagagagaagcaaaactcaaaatctggaggtcctcaagaaatcagtgaatgcaggggggtgcatgagcaaggaagattgaaggagaagaagtgattggaaagcaggatgtcagaattagtgatttggaagatggggcatttttgataataaggcccagaatgaagcctggagtaggtggaggaggggagtagaaagacagcatagatgaggaaggcaagaaatggaaaagccagagggtcagtggttatatggatgttaacactaccatgagtcatgacaggtggagggacacataggaggacaataagtctttgaagaatcggataaaatgagaccacaaatgtatttgtagagtttagctaccaaagtcagccagaggtttttagaggaggagaaatggcctgaaagcagcatgaggagcaaggatacggacctttctttgtgaagaggaataaacggacaagaagaagaaacagcccccacaagaaaaaggctagggaaaagtaattggtctagaatacagccaggatttattgtggcagtggttctcatccctggctgcaaatgagaatcatctatggagttttaaaacctacccatgccgaggtcccagtccttactgatgaatgagaatcttgagcttggggatttgcatcactgaagagctcccctggtcatctaatgtgcaagtggattttaaaaccactgacttaaggcaaagaggtggagggaactttggagaaggggctgagggtacagatagatttcttgattataaattataatggcctgaatgtacaaactgtgctccccaagtgtgcccccatgaaccctcaaggaactgtgagtagcagcagccccttcttctcccaagttcattactcctttttgtctcaaagcagagattctgatcaaacagctagatgtggtctttgcagagaacctgagtttatctttctgctttattttaatcttccgccacacttttccaggtgatctgaggaaagcgggaactgtcatgtagttaagaagggcagggggtggctgggcgcggtggctcacgcctgtaatcccagcactttgggaggctgaggcgggcggatcacgaggtcaggacatcgagaccatcctggctaacacggtgaaaccccatctctactaaaaatacaaaaaaattagccaggcgtggtggcaggcacctgtggtcccagctactcgggaggctgaggagagagaatggcgtgaacccgggaagcggagcttgcagtgagctgagattgcgccactgcactccagcctgggcaacagagcaagactccgtctcaaaaattgaaaaaaaaaaaaagaagaagaaggggagggggagttgttacaggtagctcccagccctgacccaatcgctgacacaggtcaagccacttctgtccgctgtgcttccatgtgactcctgtaaaatgtgatggtaggactgatgtggaggatggcaaggatgacaatgtgacacttaatctttataaagcagtgtcagccttagactccgaatttacgaagatcatctaatgtaatccacgagctcctcgggaagtgagtagaataagaatccccatttacaggtgaatccactgggacttcacagagataagtgacttgcccaagatcaccagctaagttacattaaccgcagatggcctccagagaccagggcctcaaacactccattttacgtcactttaaaaaaaaccactgaagtcaccttctcatcactctgtgattctttaactctttggctttcttttcctgaagggacagggtataaattgcagacttcaaaggctttgaaggggcagtggttttactgaaaacttactgcaggcttctggaagtgagtctgaggcgcacttatggggaaatgacatcatgaggtttcatagcctggcttccccacaggtgctcccctgggggtttcgggagcctgacaatagctggcttttcttccagctccgggagcatcttttctggcaggtggaaatgtaatatcacgtggtcagaaggaagggctcctacttggatggtgagactaggatctagtaattgccaggaagattctgggtggtatttcttcactgtgaaaagtagactccaattctttaactctcgtattctataattttaaattaggtaaatttaatcgctcgcttcttggctcagcgttactacaaattaaacatgcaagtattaatattgaatataatgtccctttaaacaatatcctgaaactcgttgtggggcatttccaatatatccataaagcaaataaaacaacttaattgtttgtttctctaagggaaggagctaaacccgaaattaatttagttcggcctgtgaaacaattcgtttgctctgcctaattctgccaatttaagaacttttcccagacacaattagcatgtaaatcggcggcggggagcgaagaaggagcctcggcgaccccggttgggtggagcgcgggacaaaaaaccccggaggccgaagggtccggagcttcgaaggggctgcagtaccgcgcctggggcgcacggacgagccaggggaccagctcacactgaccctgcagtcatcagccaaaatctgggtgttaaatagcgcagccggggatccagccgtcttggccgccagatccttctcctaaccccgcgggattctgaggagacgtcctggagccggcccccacccaacccgcgggaaagcgcaatcctacccaccgccccacactccccaaccccctcccgaggctggctcttgaagccgcgggggctgcgcgcgcacctagggccgcgccccccactaccccaggtctatagaggcctttgcccgagaaaggtggggatagcggcccctgctgacagctctggagaacagcaggggtactgattttttctttttttcctaccattctccctaccttttccaggtggtggtagtggtgcggggggaatgggtgttgacccatgtgcatttattcttcgtgaagcctcttaagcagatgtctgtacttagagaagcgaccaaagagggaacgtggacttattagtggtcttagtcccaattagggaacaggtacagtttccaatataaagaaactcggcctaagtgggactgagaccccgatctccgcacttgcttttctcagccaactccatgactagtaaatatctctccgagaactgctgggccgcccgatgttactttgtttaaaggttgcgactaggatccgtaccatctgcgaagcccccttggggagcaagagccgcggcgcgcagttgatttcggggcgcagcggcagggggaggggaacgtggtgtggcccgacgagttggcacaagcctgtaactgcaagactttgtagctattgaaagttcaagtggtgaaagaaggctgtgcctgccattcttcatgtgatcataacaatagcgccttggaagtggttgcgattttcttcttccataaaccttttgggttctcactggaattgtatgcgtgttatttctgaagtttacttatttctaagaccagtccacaaaatgtgaacttcattaagttttaaaatagatcgccgtcgttaaaaacgccattctctgcactgtagtttatttgcttacttcacatgctttattaacgtgtgtatgtgcgtaattaatagctgtgttcttatcttccaagtgtatttttaaccgcaccggcttctatccaattcatctaactacgtagagcgtccatcgcttctggaatctacctcttgataacagtaatcagaatcagaaaagctcgccgttcacttaccctcatcctttaaaacttttccatttaagaaaatcgatgaacaaaacctttcttgtaactcgctcctgcactacgtctatttttatttatttttctgatttggcaggactcagcaatgctgtccgggattttttttttctttttttttttcctagctagagcagatgtgggggtgggggaggtgagggctgggctccagccagagtcgcccccgctgagcctccgcctagcgcgcggtggggccaggaatcctggtggaaggaagcggcgctggccagttggtccaaggctccacctgcagccacaccgcgtagtttctccgcctctgcctcgctcactcgcactcacatacaccacagctctcctttgggtcggaggagacgccagccaaagtaggcggagttgcggaaggagagtccgatctgcgcaatccagtccgggacttggctccgcccgggagcggcggcctctccggtgacagaggagtagtgagcggcacggggtgaggctgcagccaactccgctccccgcgcactcggctgcccaggcgctcggaacccagcagcggcgctcctccgcggtgccggtcgcccgcgatgcccgcttagcagcgtgtagcagcggccagcatcaccacacccgcggcaccgcgctgccggccgcagagccgggccagagccttgcacccctgccccagcccccaccccgccccccgccctgaaatgacttgttaatcggcgcagacaccaccaaggggactcaccgaagtggaatccaagtggaatttggatttggagaagagtttcttgaacatttaccctcttccttgttggttttctttttctttttcttctttttttttttggcttcttttttcctctccccttctccgctcgtcattggagatgaacacatcgcgtttgcatcccagaaagtagtcgccgcgactatttcccccaaagagacaagcacacatgtaggaatgacaaaggcttgcgaaggagagagcgcagcccgcggcccggagagatcccctcgataatggattactaaatgggatacacgctgtaccagttcgctccgagccccggccgcctgtccgtcgatgcaccgaaaaggtacgccccgggcgcccgggcgcgccccacctcccgggcagctggactccagcctgagggtcccggggccgtggctagcgcgtgctgtcggctttgtggtgcctgcgttttattttgtcttgtgtctctgtttcccgagccttgcccggtcctgggggagcagccgtgagccctgcctgcctttcctctctgccctgcgccccagagtgcgtccggctccacgtcgagagctttcccacccgcgttgcgcacacgcccggcgccgccccgggccgcgacggcgcgtatggctgttcctcctgggggtgtgtgtgcgagacccaaggctcatcctcccgcgtgcccagcagggagcagagcgggccctaaatggtgggattctcggaagctccctggcccggtgtgtcgaaggcaggggaaggggttctgccctcgagggctggagggggttgggtataacagcgctgttttcgtccagtgccaggtgggagaaggggttccgcggagacggtgtggaagcggagagaatcttttgttgtcagtgtggggtctgggctgggctccgtggagtgcaagaaacttgtaatggctctaggcacccgcgcgccctgtctctcggtgagatcctggctcctgtggccgctgccaccagaggttccgggctttgtttgctcgaataagtgtccgggagcagccgttcgggtgacgcggcgcccccgccatgggtcctgtcccccgccgcagctcccaacccgagcggcaaggatatagcccgtcgcggctgcgtccctcctgaagcaccgagccctttgcaccgggctggcgcacggtacgccctcctcccagatcagcgcggtctcgctctggaaagatgacccaggagggggaagggtgagagacctggcagaagatggccctgggtttgaaacccagactagggctctgttccgactcctcactgtgtcctagggcgctaccatgggggcaatggggcgctggagagtaagccgggcagtgcccacccaccctgcctgatccttctggggcgggaagtgtctcttgtcccgattctccgcgttttgctcagctcctcgctgtgggagatggtgcaaaacaggatcctgaggtctcctccctcctcgcaagacccgagcggcacggggggagccagggagcggtcccgggcttgtggacgtcgggaaaggaaacagaattccgctgtttttcccgctccctcgccgcccctccgcccagcgcctcctcccactttacagcggcggggtcactagaccaggcgctcctggaaagtttccctgaaagccaggggcggcaggcacgaccggactggggctcagcatgtgcagtctgagggaagccggacctggagggaatcatgcggacagctcgggatgcagctaggagctagatcccggccctttggagagtggaacctcctggcccgcggtacttgctcgacaagtcggggaagggatgaatggggaagcaggaccccggaggcaggtgcggccactgtggacagaggctgtggggaaggtgcgtgtggacacaggccggggctcagtggcttgcaagtaggcagcttcaggtgcagaatcccgagccatctgctccctgcgcacgatttcccagcgtggctatccagggagggaggaagcagagccaggtgtgcgtggagcgggagaggaatgggagactggaggcgctgtcttcacagccggggcaagcacttccagggagtctccggcctgtatcgcactggggagccctgcaggctttttcgcgtcggtctttgggagaaaggtggctgctttggaactgcggtggccaggcacagccacagtgggatcgctcctttttttacgctcagcttttttacgctactgaatgcgatctgtgaaaggtttaaaacacaggcgtgcatggacacacacacgcacacactcgcccttgtacgcacaactttctttacctcagatctgaaaagccgtttaacccacttgcagtgttgtgccagcaggtctcagaaaagctatttaatgccccccagcgctggtttttaagtcttgccaggatgggaaggtcgagtgcctttgccttgtctttctttagtcctgaaattgttcgtcgtccttcccctggtggacacatcttgggcatcaagtctgtggtatgctacagtgatggcggggaggactggtggtttaattaattatttaattatgttttctccccaaagtaaagatgcctatgtttaattctgactaaaaatactctacacttttttataccgtacccaaatggctaccagcggtcaagattgcaagaattttgtatgactttttaatgctgtgtttagtctacatggagcagttttatgatttacagtaagctttgattaaactactccaggcaccaaagttaattattaacctaaccttaaatacagtggcagaactatgtctccacctattaacctaaactatctattaaaaaataattgcactagctatttgaatttggtttacccatgcttgtttgtatggtaacttttatttgaatcttgagtaacccttactccctgttattattttggttttgggacgttcttgaatgaggcactttgcaaaccagtttaaagcagaaaagaacgaacatcaaatttaaaatcttacttttggttatgagtcatttttcaacttgatgtaaagaagcattctactttatgtttctgatgtacagtgtttgtgggtgacaaccttccccatatgttaggttttgcagctatcaccttttagagatgtgctacattttcaataacgcatataatccacatatgtaaatgttaagcagataccgaaaatcatttctgaggagccatcagctgaatatacttattggacataacaactaagcttaaataggtaaaaattttataagaaccagtatagaacactcaagtaaatgtcgaatgaatgaaataaatagtcacacatggttcatgtttgtccacttaaagtggacttctttattttccctacagtgaaaaaaaaaatatatgccttcaagtgagtggttatgataaggcggcaataagtgcacctttttatttacacacaacacacacccctcaagttcttccaaaatctagtaaatgctttttccaacattaaacacatatagcagttgtattttgagtaggcgggtaacattgcactagtgaagtctaatgtgttgaatcagaagtgtagcaagaattaggaagactgttatcttcaccaaataaaaatgaggcatccaaattaagaacttgtattaaattcaaaataagtagttatgctttaaaagtaaatgggtagttgcactcctatatgaaatggaaggaaaaatactattttgaaccaggagttaagtcagatagtttattctgtgtacattgtggttcagcgcttttcagaacaggacaaaagagtgatgatgggatgaaagtttttttagaactagattgccaagagctaatatagtctctccatcttatttgtttgcaggaaggaatcacagaacaagctaagctaattgcaaatgctttaattaagcatctgccatttgtgtaaggcaatgcctaggaaagcctatctctgcactgcccctctccacacccttctttaggtttagacaattttctgtcctcctagagtagaggagtgctccttgacatatttatatagaagctttgtgttatggcagccacatttgtgcatgttgaggaaggtgatgccttgaggcgttctgctgggccctcccatatcaggaaccccccccactctcttggggtgccttggagccaagttttctctgagatatttctatttcagcgtgaaggcttttctcatctgctttaaaatgtgctgcaagagcaactgagctattctctgctggcgaccacatggttgcctcttggggatatggtaagatagagaaaggagggaggcatttaatcccttcgaaatgggcaaatgagatgtcataccacacaaacctcaaggggaggagttcaggacaacttctcaccatgggactactgcatatagtctatacacaagggtatcttgctttgtgaaacagatgagctcttgcaaaactttattacaataattccatttacaccaatagagggtatcatataaaaccataatacacagatgattcccaaataacctcttcagcttagacctctctcctggacctcacaaataaccaatgcttagtgggtaggtagctcctcctgaatagacatctcaaacttaggtttaaaaaacctaattctgtatctttctcccccatatctgcctttctcatagtcttctccatcatagtaaatggcaactccattctttgagttgccggcccccaaatttagttctccttgaagcttctctgtcacacctacatccattgtggctgcaatgctgttggctccacctttggaatacctgcaggcttccttcaggtgttcctcctctgtggccctcaaattggccaagccatggtcctctcctgctaggttttcatgccagcttccccactagcattcctgcctctgcccatttctcaacacagcagccaaaacacagcagtgattttttttttaaactaaaccagatcagatcactactttgctcagatgttttcccatcttcttccaataaaagccaaagtccttcctatggcctttgcagccccacatgatctgcactcaggttccaacctctctgacctccaccccttgggcttgcttgaatctgtcaagcatggcatatacttggggtcctttgcaaggacttactctttcatgccttgggatggttctttccccagatagctacatgatttgcttctcatattcttcaggtctctgttcaaatgtcactttctcagtgaagccttttgatccccttatttactttactctttcccacagcactccccacctcttggcagtccttatttttttcttagcatttttcacagtctgacaaactatatgttgtccttgttgattttctgtcttccactagaacataatgccataaggatagacatttttaggctttattcactctggcacctaaagctgtgcctggcacatcatgggccatccataacaagtgtttgctgaatgaataaacagtgaatcatttttgcaaacaactagtctttattttatctattttgtctgcctttgtttttctatatcatgtttttatcaaatgagatacttcatgcatgcatgtgtgtgtgtgtacttcatgcatgaatgtgtgtgtgtgtgtgtgtgtgtgtacaatcttccaagcacataggtggtatggctcatgcatcattagtggaacattcactgtgttgtttttccagtggtagtgatggattggagcctgttcattcccacattctcacccagtcccctcctgtgtccaagagcacacatctgtgagacacctggttgtagctggagggagtctgagttaggtaaaatcaacttgccaagaaacagagctaagaagacagccagcatttgtggggattgagcttttgaccctggcctcatttgttctgcattctaaccactggccatagaacgttcatgtttttttggagtttgctaatagtagttttaaaattcaactttctatcaggagaatacagcatactttattaacccatgtttctgccctgtacccgtacagtatatctgctgttgaggatcctgcacttggagacaagaagacctgagttccagactctcactaccttggacaagtcacttaacttctctgtggctgcattattttaattgaaaattataaatagtaaacctattcttcctaacttataggattactgggaaaataatacgaaatcatgaatgtgaatgtatttagtgaaatattacacgcattgtggaaatttgggaagtttgatgttaaccccctctttcccactctggaccctggatataacagagatcctacttcatcttctaaattatttttggtagaatatacactgttcatgtagttttaatgtaaatcacattatgcaactaaataatatgttcaaattcattgaaattgtacagttcacctagagcatggatagcaactttattaattagaacacctaccatgtcaaggaaacattgctttcaacattatcattaaatcaggcaaggtcataggagtaccattctgccaggaattagtttaaaagtaagataattgtttttgctcagttaaattctgaaatagttcaaatcagtgtaacgattaatatgtcagggtgaaccaggactagtagaagtttccatctttgtcataacaaggccgaattcgttagatcttgtggcgtgaggttaataaatgtgaagggaccgttggagggaaggtagtggacaactctagaggcattgcggaggtcatgcttttttgacagacaatgcacgtggatttgttttgccatttaccaacagtgtgactttatgccagtttcctttctccttcagttttcatttgcaaagtgctagtatgatgataatgttatggttttgagaagaataaatgtgctaacatctgtaaaatgcatgtcacaatgccgggcacacaacaagcagtcattcaacataaggtattatttttacttgagtaacagtagttacgaaaaatgtcctaggaatggattttgaaaaagcagatagtacttttattctggggggcaggggaaatagtagaaaaggaaatggctacgaatctgtaatataaagagatgatgcaaaagaaaacaacctttggactagaaacaaacattcataccataaacaggccataatgtcatgggttttaagttgagaagcatgtgaatacatcacttgcagggaaacaggaaacagggaaactttggaatttgaaatatcacacccaaaacatggaaggaaaaaaccactatatataaaaaataataataataacaagcagagccttatatcaaataggagcccaagggatagtttttgaaaaatgatagctatcacttattaacattttaataataaaatgtacactctgcacctacatttagaatctgaaagcaactcataatgacaattttagggatgagttgaattcccaaggaccacacctgtcttaggagagaaactcggctgctgattggaacccttgaggaggttgtggctaggacttctgcaagagggtcttcaggttgggcatgcatctgccaggtcactcttccctggccaagcttgaaatcaatttgggagcaaaagcaaactactgccttccacaccaaaggtaggaaataattggctgaccccagtagagatagcagttattctgctgacagacacactactacaaaacctgaaatttgattcaaatgatagtcatacaagttcttatcagtgagaaaaatctgacttctaaaaggcacagcagaaggggaaataaattgatgttatcaccacaattccctgctaccattatgttttccaggaatgcctccatggcttagagttacagttattttcaactaggaaataaaatgttctcaaactctgtaagtggaaacagaatggaaagagtgtgagataaatcagtaattaacatgctgcaaggaccgaagtttcagatccttcttagcagccagtatggtgacttttgcttagaaagcattgttagtaatagatacttcctcatgcagcctttagacttgaagctttcttttaatattcctaggtgctttctaggaatttccaactaacctataattgtcatctgtagaacattaaattcaaagaatccatgccaattaaaaaaatttagcagaagaagctctaaagttggtgctgtttacgcctttcttagcccttctgcccctctacgcttcaaagaccagcctttggccatgatttgattagaagcatttatagaacagaacaggatctggcattaaatacaatgaaaacatgccattggaaaataaacattgttagagactacgaagaaataaagattgtattaattatgttttaatgttctatgagggttttacagacaagctgtgatagatccattcttctttccctgttcctattcctgattcgttttttaaagaaaagtattcagtcttttcattaatattgcagcgacttcagcacttccccgcccctcccccagactcctactgtccttgaatgaggaaactgagagaatactgattgagctggtgaatggaaacgttcctttcctgaaaatggaatgctttacaaaaaattgcattccacaaaaaaacactcaaaacaattcaacaactgtccctcctcctttctacccagagagccacttgatttcattcacatattttggtttttcaatgtatttgttcttaggcctaaaatacccaggtggaaaaccattctattaagcctttcactattttaaaaacatgagcatctgagtttctaagaacattctcattcctgcatagtgagcgataaatagaaaccaaattgtttgtagcattctaaactcaagtatattggcagaatggcagtggagttgatttttataagaatacttgttaatggttttcgagacggattctgtgctaattcttcttgtatcatgaatgatggccctagctagacactgtcgctgggatcttcatctgttaatcatggaggctgctttcttattcggttgccatagtttcagtgcctcacatagtgttggggtgtcttgggaaaggtttgagatatactagggcttgcaagccttgcagttattttgacagttgtgctctgaaagactgaaaaccgcttctcgtataattcagtgttggattaaaagaggcaacttctgagagtgtctccctggaccttgttatgtgcacatccagctggtatttaatccaggatttgcctcttgctcagtcttgctggcaaaaaaaataaataaataaaaatacagtacagaggctgatgtcactttcatatttcaacaagaaagcaaagggacgcaaactcttcattaagactattcacaaatgtggaggtaaatgaggccattcatgactttgcttaaaatttctgctccataatttggctttggctttgcagattactaaataaataaaatgacatcatgattgctgtgtgccgtgtgttattttggcaatggaaacatgtagagctttacttcaggtttaacctttccttttttacacttgacactcattgctaaggagctagagaccattttactgtattttgcaacaaaaggctcatacattttggactgtaggtctactgctttgtcaactcgtgaatagtatatgaacatttttcaattatttaataatttcaatattttgctatttttttttaggtttgtgactttagagttgattagagaatgttctccagtggtgtatatattgtgtgacttggtcaagaaaggatttggggagtaaattgctgtaagagggtgatacacatacacacattctggcgatttatgtgcttcacgtgtgatgcagaacacagcttgcttctggttggcaaatttggccttgtgcaacggatagtggtacacttcatgtttcagtttccatttctcaagtggactttcaaggactcctaccagtctaagccaagcaatttaattcctttgtagattaaaacataaaataatctcacactggaagcaaacagtgttgaattcaagacatgcaaagcataagtgaaaatctaggctgatttagaagaagaaactttgaattccttacaaatgggactaatctagaaaatcagtcatttttttcctttttactagaaaatgactagtttttatttcagaatgagcttcaaggcagcgttttaaatttctccagatccagcctgccaacatttttgtgtaagatcaacaagcatttttaatgcacgtgcctattttgttgacccatccgttacccaaccacattaaaggattgattttagaggccaataatgtgaagtaaattaaaaggataacatggccttaattgctactggtttcaccgggcttctaggcaccggaatttcttgtggagaaacataagtgtcacagcagtttttgatcatgtggtctggctcacccagaggcttcaattatctcccagcccttctccacctcccctcagatatctctgagaagcaaagaaaatgtgcatttgtaaattcagtattatggacccctgattatttggcagggtaagaaaataggttctgttcattttacagtattcgcataggctagatgtttaaacaacaacaaaagacatggaatggaggagaacagtgggagtaagatcaaagcttttttcattaaaaagaattttgttgaattgagttcattctctcaaatgataacaagattgtgattactcttgggtgtcgggttagacacaacattgcacacgtagcttaagaaaagtaaaaagtactttttgtgtagatgtcagtcaaatacaatgtggactttaattaaccttaattaatgatttctgattacagattttcttttgtgtgccttggaggctgtatttaggtagagtattttcagccagtagtgacatgaacttgcttcctttgtcttgccatgcaaaccacactagattctcattacaaggaaaaatgtgattctgcatcatttcagaatggtcatacaaagaatgaaatatcacttggggaacaactgaaatttgtaagtggtgtggagtatttgaatcttcagaggaaccattcctaattttaaaggaatttacctatcaaaattgctgatatttactggcttctggctggattcgaggccattccttccaaagattgaatgggattttgagtggtgccccagttctttcaaataaaagcatactgcagaagtgctggacctagcagcatttcctttgcccaagtgtaccctttataaagtactaaacatagcaactagggaatattgtagacactgtagagaattgggcctttgtttttcatgaagggaatttattaacaaaatattttgaggagtcttgtcttgttcacagatggcgaccacggcgaccccccttcctgcgggtgctgtcagagaggatgggggggacgtcctctatccaccccatcttcatacccgagggggcaagggctcgagggccgactgggccccaggtccaggagtctttgtcctatttcctcctgtggcccggtgtttgatgtgtaaggcagtaatacccagttccttgcacctctgagccatatcctgggcagccaacatagcagcatatggcaaagattcatctcggtctgccttcaccttcatcccaccagtcacacggcagagggtttctttgccagaaagatcagtgacatggacaaaagtgtcattgaagggtgcaacgatatggcggacaccaaatatgttttctccgtcagccacctgaggtcagaggctgatgacctgttcttccttttccttcccctttcgaggtgccatttctgcacgttgtctccagactccacaccggaaagagtgggccttatttttgattaaaagtactttttcctgtgtcatgagttttagaacaaatatcaaaaacctgaattaggatgttaatgtgctatttacattcaacttttaactagagggtctgataaaggttagatatgatatattaatgccaatttatgaattatatttctctgtgaacaattattttgtagcttatacaaaaccctaatagcatataacccatctagtttagtgtaattatgcttatgaattataaatgcttagcttttacaattagacttactgatctgtaggcaccttaatgagaaattactgaaattaaattgattcgtaatatttgatgtactgtgttccagggtagtggttgtctaaaataatttttagagtatgtgtctgactgcatagcagtatggctttatttttaatagaaaaaagtcctccctgttgcatgatcccacctttgtccaaggaggagatgtcaaaagttagaaagagcagagtagattcacatgtagccaagagaaaaggtaacacatcttttggatactttttttttttaaattataaagggatgttcagagtacagggaaaggtttctattaaaaagtcaacttttatctacaaggtgtttcctctcagttgtgatgaggggaagttcaacatgttgaatatgctggttaattaattctccagggatatctccgagggtgatgctttcgttttcatattttgttgtgtcaaaaacacaaaacctgttaatattgcccaaacacatccgttcccaagaattaaaaggacaatgtaattgcctttgctgctagaaaacagctacatccagttctctagcagatcttccaacatgccaggtgtgcaagacaagcctttgaaatgttgtgaataacttgacattatcacattgttattgaaatgcaaattctgcgtagaacatgaaagagttttaaatgtacgaataggacaatgcatgtcatcaaccatacctagtcttaacttgcttgttctgtggaaagtaaccataatgtatttgcatcttttattgtttttccttggccatgtttaaagtgctcaacacaccttcctgggtggcaccttgttggggagagaatagattggctcccagctttgaggtgtttagatagggctgttttgcccagtaaggagataacgtttccccaaatgagtcttgctgagttctacattagaattagaagtcagcttactgactgtatttaatggtgttattattaataataaagactatttatatagtgcttgtatttttcaaaatgtgtttataaacattgccttatttcatcttatcacaaccctctaggttaggcaggataggtattattatgcccaatttaaagatgagataacaggttcaaagaggtcaagtaatttgcctaagagcacacctctggtaagggaagggtgtggacaaggtcccaaaccatatgaatctgagttttgtgctcctccatatagctgtgttgtgtactcaatatttaaaattaaaaaaatattaaaattgtccaatcatagttctcacatttttcctattacatagaagtgagtcctgacatagaacaagtttagaagtagctttttgaggatttcgtctgaggctttagtgcaactgggacctaaattcctacttctcagtgaaataccattgctaggaggggacactcactgtctctggaggttcttagagtgtcttgagtcaaaatcaccctaagaaatatcaaatggcaaatggtaggtgattttatttgggattctagtcctattttatggtcgggataaaaataaatagttacataagggtggcagttttgaccctggcgcagggtagaactggagggacagaaggttgaattagatactctgtcaggaatatcctcctggggcttgcaactcttacctataaaacagaaacacgtttttagcaaggaatgaaatagactgcatggcacaacctaagtggatcttccctctgacaaaagtcattgtactctggttcaggctactagatctagtgaaagcagcagttcaatttaattcaatagataatttatttagcacctactcttggcaaggaaaagttctacacactgcagagatgcagcgatgaactagttcagaatttactggctgtgtacctactgtcggcccacatttcagtgaagaaggtagagatgtgaaaagtctttctagtctaaggcctgactattctctgtcccaaatgcagaatgcagaagatgctaagaaggccaaaagtggctctgtccagctgggaggtcaggctgggctccattgaaggaggaagcatttcaattgcggagtgaggtctccgtatttgggaggcaagggggaggaggagcagtggggtgaagggaaaagcaggagcaaagcccagaggtggggaatgtaggacttggccccagaacagcaaggggcctcctggtgactgacgcacagggacaaggtgatgtggtgaagccctgaagacagaggaggcattgaggcagcttgtggagggctctgcccagggtgctgcaggtggctgaagcttttcagcaagaggatgatgtcaccagatccgtgttttagaagtataaatctgctaggactgtgagttgaaaaaggaaacagattctgggtatgttggcatggtacagccaacaggatttgaggccagttggatgtgtggggtaagggaggggaaggagtaaaaaatggttccaaggtatcacctctggggagctgagtggatggttgtggcattggccaggacaggaacccaggtttacagacaaaatatttaattaactgctgtcataaaccgtatttaagtgacacataataagcaaaacaccaaagtccaacacctagttgcaaggctcttgtattggtccgaaccccgagagcgcaccaacaaacaacacaaggcggtgtggagtaacgcgctgttgtaatgagcccaggcgggctgaggcctaaaatggcgtcagccccaagtgaggatggggcaggggttttatagtcttctgtaaacaggaagtgtcccagtctgactgtaactgctacgtggtaccctgacggcccctctcaatctccagggggtacctgtcttccggccagctgtcttcctgcttctgctatctgggcgacgcaccaggccttgcggactgggcctgaggagggaggagttattcatccccccaagcttccaggctgggggagagaatctttcactagtcctattgtgctcaccctcagctcttcacaaagactgctgaaatgtttgagtatgtttaaactgtagcatttggtcttgcagttgggaccactcttcaactttagggaggttcataccataatatgaggtggctaataggaggaagacggaagcacattcattgcatctataaaaaccactgttaaaaatgggcaggaggaccaagcgctaaatgatctgttcatgtaaaaatcggggcatatatggagccacctagttcctgtttatttcattccaaacaattttactttatgaaagtttttaaattctgaaattagatatacatgtgttctccctctccccccggctcaatgttgggcatatttatatgagtgtttgtctcttaaattgccatgtgcaactgaggtgttgcagacgatgtaattcacaaaacaaataacgcttaaattgtgttgtttttatactatttaaaagaatccttggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaagaatccttaaatgatgggtattctctaaagcatgcggggcttaaaacctagatgatggattgataggtgcagcaaaccaccgtggcacatatatacctatgtaacaaacctgcacattcagcacatgtatcccaagacttaaagtaaaagtaaaaattaaaaaagatgggtattctatatttatctttcatgttacatttttctttgtggggtttctaaataaaacttgtaacatgaatgttttattctcattctgtattttaaaaagaagctgagtaacaaaaggaaaacaaaacaggattggaaaatcaactattttcagggggctttaacaaactgaatatctagaaaggttctagagaacctttatgaaactgtttgtttggatgtcttattttaaaggcatattagaagtaaacattaaggaacgatttgatttttaaaaaatgttgggacaccatatttgagttggtatcataatgccgagaaaccaaattatagattatttatctattacgtgccacattattgcatagttgtgctatcgcttgtttctaactttacttggaggctgccctctagtgttactgaatctcagcacaaccacttttgtttagatccccggaaaggtgacaaaacacacagaatgctaccatctagtcagcagctagagtgttaagtttatgatacatagtttgaaagattttgaataaattaaaatgtgcacatcaccagtgctcttgatggcatagaagacagcactggaaaaaacacacaccagtgactgtgaattgaagccatatccggaataccaagtctaacacaggttttaggactaccttaaccaattaacttcacttttattttctattttgtatgtgcaaaaaagctacatgtgataaaataagctctctctaaataaggctataagaacttctttagtttaaataaaaattataagtattaagaaaagcactttgcgaggccaaagcaggccaatggcttgaggccgggagtttgagacaagcctgggcaacatggcaaaaccccgtctctactaaaaatacaaaaattagccaggagtggtgtctcatgcctgtaatcccagctacttgggagactgaggcacgagaatcgcttgagcccaggaggtggagattggaccactgcactgcagcctgggagacagaatgagactctgtctcaaaaaacaaaaagaaaagtatttcaaccaccattgggtgggatgtgtttgaccagacagcctcaaaatttatgatataattagtcctcagagaagagttctcaaacttcaacacatttttctattacaaaccttcaaagagtagatccaagcactttaaagattattctctaaagatattaagaagagaagcacaccctacaacctaaatggtggtgttaagtacttttctcacagtagtgccaactctgctttttcttggatgaagaataagcatactccagagtctgcagaaagtggggagagtaaatttcagacacagtagctattttttgcatgtataatgatggcattctcagtggattatgaaggtaacgttgcaacactccaagtacatccagcttacagcagcagagtgactgacatgttttctataaaaatggttactggtaacagtggttttccaaagttctgaaactcagatcaggaagaacaactaaaatcatattagcgctacacacacacaaaatgaagctgaacaccaaaatgacacttggaagtcagcttttcttctagaggggtgttatgatagagtagttaaaagtatgggctctggaggttgctattctattggctgtgagatcttgggaacattacttaacatctctgtgcctcatattcatcatctgtaaaggggaaatactaatggtaccttcctcataaagggagtctgatgattaaatgaaacaatatgcaccagaatgatgtctggtacataaacactcaataaaaattagctattaatatttgacaccaaaccctcctaatataatgagctaaattcaatgtttttgtcaccagcaggatatgggttcttgacaagtaaaactaaaaagatgatgaggagatgatagtgtccagatgaatctttctgccagtttctgtctctttatgttcttttgtgtgtcagagcatggtttaaaataactaagtaagtaatcattatttcattttatgtaggaaatatagtacatgcctactatgtgcagagtgctaaattagatcttattggatatttctaaaatattaaataaggcattaggagttaggtgactatgttttgctacagttgttatttgcctttgttgggtccagtgcccagttaggagcctatgtttatcaggcccatggtgccttgagctatagccttcctgtcttctgttctcagaggaagaaactccgaggtcataatatcaagtatttcctcactgggtgagttttctgaatgcagtgtttagattgtaggtaatgtagattgtgtatttggaaacacaatactcagggattttcactaacaaagagggcccaaagatctctgtcaattaattagattttttaaaaatatgtatttatcttttagagactggtctcctgttgcccaagctgaagtgtagtagcatggcatgatcatagcttactgcagcctcgagctcctgggctcaagtgatcctcctgagtagctgggattacaggtgcacaccgagcctggataatttttacaattttttttttttgagggggggtcttgccatgttgctcaggctactccagaactcctggcttcaaatggtcctcctgcctcagcctcccaagtagctaggattacaggcatgagccactgcacctggctctgttaacttaatgtctgactcaaaaccaatgtatagatacaaacaagtttattttatataataaaactttgttatatgtggcattaactactcgtaccaataaactgaattttcagattgagtcatggggtttaaacagttgtctttcacaaaaccaaacagctgaactgctaaacagcaaagtggatagattggaaagtaaacccctattctgagcctgccttcacccctacttcactgaggtgtaatgaggagatagaaaagaagttgggtgagtcaagaagagaaacaagggctgatcattagctctcaagcaaacaagagttaattttggctttatccattctagtttactcaggtgggcacagcctgattcacaaaaataaggaacttgttggtcaggggttagggaatgtgctaacaaaagcttggagactgggtgtctctggagctggataatgggaactggggcccctccttcccggtggcagagaggattgtgttcatttggtatttacccaaagtcagaaccatctgacagctgtttggtgtttcttgtgaaatggacttggaccctgaccagatgctagtggacagatgttcacaacacaaaaggcttcatcaaaataggcactaattggcaccctcctgacaatctcaacaaataaggcaggaatgggctgtatctgctgttgaccatctcaacgcccaagcctgcctttcctggcttagggaggaggccctgttggggaactgagctttctccatagccagagatttttggttccagggcttcttgacatgaaactcccaaaaggtactgaatatttgttttatatgtatatatgcttgtatgtatatacttaattgaaaccttttaagaaggtaggccaaggaaggatcatttggacttcaccacccacctctcaccaaagcaagtcttaaaatgcagaattttctccacaaagttggtttctatgcagtagtttttgaacaaatactttatacaaattgttacgtattatcttaatatgaacccctccaaataaatgtgtgtattttattttatctgtgatgtagttttgtgcaaatatttttgctagatggattttaaaaacctaaagctgttttaaagtggatatttcaggggcaaactggtttgactatgccccataaatcattagatagggcttgctcctacttgtacaggatacaattaagtttgatttcaacagttcaactgtctttttagtgctagagacactttttgagtaagcattctctcctctttttttcctctgaattttgcaagttgggaacaaactctaactcctggcttattattaatactattggaatctgttcccatctatgtgccggcaaataataattctttctaaggcaggatgtagttttacaatgcatggtttaaaacacttttactgatgttactgtttattactgtttattacagtggaaagccctttcctactatagggctctctgtggccctcctcccatcattacctattgaagtctcctttttcccactcctctccaggaatacagatttaagaacgatccatgctccactacagatatttccaaaacacaattggtattaacccaggctggacacattttatcagtcatttctataattacttattttaaaaaatggtatacatggttgctgtatcgtatggagtgtgagaagctatcttatcatggtactattcatcctggttgaaaggatgttggttttttcccccctaacatctcactctcaggatttctctggaccaggaatccaccccctctttcccattctctagtgtggctcctgctcctttgaatgaaaggctgctctgactaaaggagctagaatatgcccagcaaccaaggccgggtactattgagtccattgtttgctcccagcactgtggagccaaatctcattttatagcacagtgtgttctaggaattccacttcatcagtacaacagaccttctctaatgccttcctattttccccatttgctgctgtcacaggcagcgccacacagtcctgtggcaggcaattataattcacttttctccaaggctctgctctcccccttttgcaagggaccacaaggcatcagctgccatattaaatagacgctaatgacaccaagtgtgagccgccagagctgtggttgtgatggtgtgtttaagatttaatccctttgagggactgaacctggagttcagaggtggtttcactgaggtttataagaaatttggctaagattatacttaatggattttcaagtactgaaaggtatttgtgtttaaagtgaatatgttaataaaactttccaaacacagtcacaaaaaatagatctgatacaaaattatgtaacgtattattcaaagtaatatagttgtctaataataatatattgtatgtgcatatgtgctgtatgtactcattttccctctatagttttctaagcggtttgcttttttctaaatggagaagtgtcctttggtgactcacaaagattcacaatgagcgaatgctccctagagcagggccaactcctcttgggcccttgtcttgctagaagatgcttttctcctggagacaggatcgccatcattagtaacttatccctacacccaatccacaaaagattttactctttaaaattttccagcatattttggcaatggtggaatgacaacgtattcatttttgtcccatctggcaacattttggcacctcttatgaaattattttctattggatttgtaaaagtgccccattagtaacacttcctgtaagtgtaaataggcttttccatagctgtcccttcaccgaaatagatcggttttgaaccttcctgccagtacagaggatgtggcctgatgctccctcacaagacggtggctgtctcaccttcatactgcccgggccgcttaactaaattgctccatggccttgtgtagctatgctgaaggatggagaagagcgtccctttaatgaacccggagtatttcatttattagcagatcatcagttgacccagaaagtggccaggtaattagtgtaaagttttgcagagcttttttatatgcaccatctcatttcattcccatagacctctgtggcacctgcctttaccctggcttggaaaaatagaacttctccccttgactaaaaagacttagtctgtgtaaagttatgtgttttatcactttacccaaatattgttctttgtaattttcaacttaacacgctaaaacatactgaaaaaaaaatgattgactacaaaatccttttttaaaggaaatgtgtacatcagaggaagcgttaggccgtaaatagtgttattttagacactctaggacattttaaagagcaagaacaagcctatagctcaccttgcagtgctctccaggttaatcagtgattctttggtgtcagtgacatttggtgggtagtgattggcatgcctgtattttcctttgtcaccatttcttcaggttcatgtagaaaactgcagtcagaatctacagacaagatcctgtgactggttctcaggagaatccttgtgacaaacatctggcagatatgttttaaagtcctacgatagctgtcagaaagttgatggctcctgatacgttacattgtcagtccagacacactaattctttagtgggattattgatgttgttgtagcacatctgtgtttaattgcagacaggaagctgaaagagaaagcttgttgtgattacgacctctgagatacctattatatctgaacttaacaatcaggtcaaaacttagtggtgggtgggaatgaaaagatgtccgcaaatgaaactatgtgcatgggagaagagactgcatgtcactgacctgcagagaagccagtgcctgggttcaaatccatcactctctagctgtgtgacatcaggcaagctccttaacctccttgggcctcagtttcctcctttgtaagatggagtagtaatagcatctgccttatagggttgctgtgaggattaaattagtccatatgtatacattcccttgagttcccattacatcataagcactagataagtgtttcctatttttatatttccccccaaatcttctgctttgtaaaggtaaatcttctgctgatagaggatgagctgcaaagagaatgtgtgtgtgtgtgtgtgtgtgtgtgtgtgtgtgtgtgtgtgtgtatgctaagactatcatgcagaattgattctacacttgtaacacgggcatatttggctgttattgcctacgttatccattttgacacctcccctactctcaaagcccctgcatgtcactcgcttcctctgcttttccccttcagattatttcacccatgttctatttggtcatgacctgtatgtgtacctcatctaagtgatgctttatgaattccataaagccactcatctttgaggtctccaagaacagagactattccctaatgatccttttgtgcagtgttagttgttaaatgtgctaacggatgccagcgtttgaaaatggtgctgatccatgacctcttctgacaatgttagattcctatccttcagagtgagaattttaggcatgaggctgcttgaggtactgggttgcccaagacaaacctgatctccagggctgaagtatgggcatctatgaatcaatgcccatcaggtgattgtgatgatcagtcaatattggcagcctctgatttaattaatcatcctgagaataatgttccttatgtgtaagattattagaaagccaagttttctctcagagttttggtgcagatcaaatgatgtcctgtttttacaaagcctgaagcccaggtaaacctaaagcactgttattactgttattactgcagagaacctgtgtgctgtggaaggtccccaggctacagggtgcagagatgtccactgggcacatgctgacagatccttcaaaaaatggtacttaaagaagattagatcaacatttctgagaaaagcatctcttttgccttctcattggttcagtaaacccagttaaaggcaaagtttccagccctcagagcctgccatgggattcctgtatcattagatattgttaacattagcacttttggagtattatttcacagacatggtttcaatgttcagaaccaaaaggtggagaaatggtgtcagataaccttagagaggatcattttcttggtaatctctcctttcttaaaataaactagatattgctgacaatgtgaaatttgtgactaaccttcagtagatatgttgattttgcttttaaaataaaaaccaaggatgcttagaagtagccataagaggaaatattttgaaaatgaatgacctaaagtaatcaatggatatgtataacatttatattttaaaatgacaatgactgtgatttaaagtgcctctaaaaaaattaactctttaaccatcagtccctttccactcaaatcctaaagcaatgcagtttcatattttctgcttgtacaaggttaggatccatcactgactcaaacatgatcatttagacgaccatttagaaggcccaagagcaatgtaactggcatttctgggtcacagctaattgaatggaatgtgtgccgtgaccgatcgtacaggtagcacttgggcaaagaggtgtttgtgaaagtgcataagtatcgtttgtgtgttctgactattgtttgtatactactaaatgctctgaaaagtgttataatttgtacatagtatgaatgatttggtggagggaaactcccttgtgaattttgtataaagagtatactgcattcctgttgtcaccagaaaagtactgatatggcacattctgttaacagtaattggatatgtatgccttgttagaagagaagagggtaatttcccacttattataaataaaattattcttatttcatgtcttctgtttccacctgtttatattttgttttgtctgggcaatgttggtggagatgaaaagaaaattagcctcctaacctgcagtcagaggatagacaaccatgggtccctggggttttagcttgagctacctccataccagctccccattcttgtttccccttccaaatccatgagggctttatggtagtctggtcttctccaggagataagcatgatcaagatcctcctgcttctaatctctcctctccaggcttcagtgcttctgttctagtgccgagctctccatacgctatgggagggtatggaatgggggaacttattccattatgaatgctcacctctctgactccaagagaaatttttatttctagattcaggccctcaaatggtagaggcttataaagacttgtaaagtatgcttttagtaggtccctggcgatattaagggaatttagcatgtgatgttttttccatctaggttttaagagatgatttatcaggtccattttgttgtttgcttacagtgatttttatttgtatttttcgttgattcatcagagagcctgaaaagtgcttatttggtctttccatcagctagcactgagaacctttaaatcagtggtttagagtactctatctacaagatcatgctttacttgttgtatacttctttctagaagtagaaattgcagatagagaaggccaggcctgtcctattattcttttagtttccaaggcagcattcatttaagcatagcgtttaaaatgatattggataatgccattggataaaactcttttgcagaacagaactgtgcaaagcaatactgttttaaggtgaattgaagccatccaggcagagagaataaggttgtcttcttatctcttctgttgacttggtctaatctgtgggcagttgttccttggcctcaattttcccattggaaaggggatttttggaaacatatcttaaaactcttgagctgaagaagctatatcaatgaaaaatgtgttgtttaaacacaacaataacttttccgtggtatgcagcattatatttatacaccataagttgagaaaagccttgaaagtaacacaaataccatgaagcctgttttataattcctgactcccagaaaccctgagatgtattcacagcctgtagtcaccctccagaacccaagcaggaccttggaacttcactccatataccactccaaagcaagttttctgctccagtgtgatgagaaatgtgatgttcactgaaatgcaccgtgagtctggagaactactgttcagccaccttgggcatggcatctaaatgtacagtatcgagagtgtgatagccttccctggaaacaagaactaaggtccataaatcaaatctcaagtcaagagaagaaagccgtcaaggaaggcgaaggcattataactggcctgtagtgtccagctgtattgataccacagagctttggagccaattcaagactggtcaaccccaaagtgggaaattaagtttcagggctgccagacatccctgtttgcagatgtaaatgtaagtgataggataggtggtcttcaaaataaccatgctaccatgaaggtcagagtccccagcacaaatgtgaggccggggataaggttcagcacttttggagatggcattaatttgtagcccctaaaagcactttagctcctctcaaagtgtagcttacatattgcaaggatctgagtataatataccttaattaacagtgctgatcatgttccttccttatttgcagaacactttacattcacgggtgttgactcaggggatcatttggcttttttttttttttttttttttttttaagtatcagatacatagcagtttacatcattggattttatcccctggtttagatccaaagacattattggccagtcttaatgcttgcttgttagtaatactgttatgaaataaaagcttctgttgcagaagcttccttaatagataaaacaaaggcctttaaccagtacgttacttagagaatattaatgaaatagttaaaaaatgaggggaaaatgatgaatgctttaaaaatactggccttttcaccttaataatgtgtcagaaccacttattttctacaacacatgtctcaaatttgctggcatttcaaattcttaggagttaattttctatgtttgaatctttaaaaagaaacatacaaatgtaggatgaatacattcagagggtttagtgcatgctttggctagcaattcaataaagatgacttggaaggatcaaagcaaagatttccataaaattgaatatgagatatttcagcaacatcaatgctatacctcttcaggacacttgtatgcatgtccacagtactacctagcatttacttaatgccactagaacaaaaaagataaattttgttgaggctaatagatttttaaaaaattgttttaaagtccttttagagtaccaggaaaatctgactcaaaggcaaacagcaaacagaaatgacttaatggaaatcagacaataagcctaaggaaaaaaaatagggttggaacctaaaataaattcaatatataacacctttccattttgttccctttcctttttgtttttcatgagaatctatatggaaaagtcagttgattgcttatcaggctgaagcctgtgtttgctcagactagcgataatgagcaataaaaaggtggtaatggttaaagtgagaggagagggaatcagggaaaatgggtgggctcagtatagtttgcaggctctgagttttggaagccctgtaattctcccttgtgctgttatgttcattggaggggagttaagatcaggatctgtaatgagtgtgggggctttccaggcagtggtctgatggctgcacaaaagaactcccagtgattacctagttacatccctacagtcagcttggcaagtaatcttaaagccttgctcctgaaccagcagcatgagcatcacccaaaagcttattagaaatgtagatgctcaggcctgataccagagtgcctggatatgaatctgcattttaacaagatcttcaggtgattggcatacacattcatatttgagagacactgactgaaggaacacatggacacaagatgtgaggacacatacagtgtggggtgcagtagtagggttatcctaggaaaagaaggagcagactttttagctagtgagctaactcattataggcatgtacagatgtttgttagtagtttatctttcaagttgtaaagcaatcagagtgtctcagggaagtcattacatggacctttacaagcctgtgactctgagcttgtgactctgtgtcataggaagccagtacttgcgtaagagccccaaggccatgtgggcaaatggagctgagataagaaagcctgataatatgaagagtgatcctaatctcagtggcctttgggattatggttatcaccaggttttagagctttgactctggtaaacaaagattctgcccttggtttccaacacatacttattattgaaatgatttattattttactgaagcatcttgtttccaaaatgaaccaccttagcctcctgaaatagctctactgtgtcccttgactttaaaaggcaaatgaggacttatgccattaaccctgcagagttatgatgaatggcagaactagatagggccatgaagatggcaggataaaaagatgcctgtcttcggagcacctcttttgaatggcatctccaagtcttcatccaaagactagattggttcttgtctccattttcccatttggagctgccatttttccatagcagccaagcccactaggtggtattagaaatgtcaaatgcttgttccctggtgccacaaagaaatagcacttgaacattaattttctcagtaaggcaatttttactttctgcagaaagggtgctcctcgcagatggaacacggccagagcacacctgaacaaaggagggaagcaattttttttttaagatgaagtttcgctcttgtcccccaggctggagtgcaatggcgcaatctcggctcactacaacctccacctcccaggttcaagcaattctcctgactcagcctcccaagtagctgggattacaggtgcctgccaccacgcctgggtaatttttgtatttttagtagagacgggatttgaccatgttggccaggcttgtctcgaactcctgacctcaggtgatccgcccacctcagcctcccaaagtgctgggattacaggcatgacccacgtgcctggccgagggaagcaatttttatcccttacgcagcttgtccctgctactgtgtcctgtctccattggctggagccagaccgcacaatctaagctaaacccgactggctatttcaaagagagcagggatatgagccagagtggtggggtgagtagtttggcaggaaggacagttaggaacaggtaactaagggtgacttaggtcagagcaggtgactaggatgagtcaggatggagcaggtgaccagaggtgactcaggtcaaagctggtgtcggggaagagtcaggatggagcaggtgaccaggggaacagatgtgagctagtgattaggactggaaggaaagttgtttactgaaactagaagcaagaaggcaaagagaaccaggaagttaaactttaaatggagaatcaaagaataagacagctgaacatactgacatattgattctttgaagagaagcttggggttcactatatttaacagtggtatgtaaataaactgttttccccctggcatagttgcctctatcagtggagggtgaggctgcagataaatcctctgccacttcaccttttatgccaaagtctaaaggcaataaataccaagttagagaaacattgactagaaatggtgatatcacagtaatcacaaatctgttcttgtccttgcaactttttgacataatgatctcagttggccaggtacaatggctcatgcctgtaatcccagcactttggtaagctgagacgggaggatcacttgagcccaggaacttgagaccagcctaggcaacataatgagacccccatctctaaaaaaaaaaaatattcaaaaatttcgctgggcatggtggcacatgcctgtcatctcagctactcgggaggctgaggtgggaggattgcttgagcccaggatgtcgaggctgcagtgaaccatgatcatgctatactacactctagtctaggtgacagagtaagaccatgtctccaaaacaaacaaacaaacaaaaaacctcaatcctgtgtggcagatgggagacctcaggagacctctgtaaactgcatccatgccgtagaccccgcatccaagcagtgctgcatccaccagccttaggaaagtggatcagaaaggaaatgtctcagtgatcctagacactaactttgacaaggaaagaccacccatagtggaagtggttggaaggtgagccttcaaattcaagtaccccagttatttcattaggggccaaagagaattcttttttcctattttctactagggtgcatttaatctgtattagtaatgccacagagaacatttactgtcatataagcaaagaccttgcaaatgtattttaacagcagttcagaagactaaagaacttaacagagaagtagagaagagagagcctgcaaagtctactgtaaaagtaaaacgtgctagttttggcatcaatttaaccacattggagacttggtcaggagcactgaggcttgaccacattatccaaacacatctgcttgccttatcatattgtcccatttacttttctttttcttctgccagcacaaacttgtgtcagcatgtggaagtggtatttctgctacctaatctgtgttaaaacagccctgaagggtcatgcaactagtcggattgtaaacctttggagaagattaaacagtcatcatgtattaatcagtcttgaccacgttgtgaattaaaaggtgaaattcttggccttattctaaaagatgacaggtctagatgttagagataagcattgtttttatattagtcagtatttctatgtagccagttatgtttccagagtagtgagaattattctaagaagaaaaaagtattttcagtataaactaaacaagagaaaaatggaagtttaatacacatctgcagtgaacatgaacataggaaaacgtgaaaacgtgagcatagtgaagtttgaagtgggagagaaccttttctgaactgggttgctttgctcacaggccaggtaggagagagcaggggaggaggttttactggacccaagcgccttgtaagaattttccaaaaacattaagtaaaatttagttagttgtgaagtagaaagttagcacttctatgtcttcaaggaatccggttatagtcataacacagaaaaaccaatcatccctcccatagtagttgaaagataaaattgacatcttcttgaaagagaaaagctactattttatgagcttagaagaaaaaaaattcttcaactttatgatatgctatttgagctctgtgagtattcaaatatatgtacttacagaatctcagtgttgcaaatggaaaataatgatgctgtcttcaaaatgaccccccaaaaaaaatcagagaaagggttcaagtgctgctgaagtagcagcctctggaattaaaggaagtgattgccaggccggggaagtgaagcaaacagaatagtcctgaacagaagacagccgctgccctcacttccttatgcactgtgctgttcagcccaggcacttactgtttctctaagtgtgatgcagaaactagcttgaccagggtttaagataatggtaaccctcacaggttttgcggtgctccactttctgcaaatgatcaaacttcactgtcaaagaaatccagattctcttagaatcctagcagagtgtgatatttgacttttttgggtttctaaattttgttttcatttctttgatgcagtagatgtatggcccatggtgcttttaaattctctgcagtctaaagtaaatgacagggaagaaaacaaatattctctggaccccattaatgaaagacaaagggacagcgagggtcctttagaaaagggtattaaaaatgatatatgcctgtaaaaggtcggggagggatctcatgggaagaaataaagtgcaatagagtaatgaagaagaaaaacggtaatgctgaatgtcctttaaaagatactttatttttcaaagaagtgtccagaattctaacttatataaacactagaatattgatcagttatggtagcagactttggtgcacaattctcagactgacacatgatttggttagcaggtaacagctgtaaaggatgtaagaaataattatctgagattccctatgcaaagtcttaaaaaaaattctacaccaatttctgtatctcaaatgaagagggcatacaaagagacaaaatgcctgatggttccccaggatactgtcccagcagcagggacagagtccttagataacatggagaagaaaatgaatgggcactaccaatgtatttgccaagatatgacatgtgcttctgcacatgagacttcataactggataaataaagcatcttaaagaacttacgttctttttcttccctagatacccattcatgtgtaaaatgttaccgagttcacgctattttttgtttgtttgtttgtttgtttgttttgagatggagtcccattctgtcgcccaggctggagtgcagtggcgtgatctcagctcactgcaacctccacctcccaggttcaaatgattctcctgcctcagcctcctgagtagctgggattacaggtgcacgccaccacgcccagctaatttttgtatctttagtagagatggggttgcgccatgttggccaggctggtctcgatctcctgacctcaggtgatcagctcacctcagcttcccaaagtgctgggattacaggtgtgagccactgcacccggcctgctctaactattaattagtctttgaacttgtaatgacaataatgcgaacttagtactgacagaatgaacttgtgtgagtgacctcttagtataggaacatgtacagtgtttaacactttattatgtcatgttagtatgtggttgcttcctttcagaacattgctttcaagtgttattgaatgttagtaaacatgaaaaaaataaataagaattttggtgattcttacccctcttacctctagggtttctgaaaactgacacagtaggtttagataaagatgtgtggtgttaatttgaatctgccatactttgaatttagaatgcactggacacgttgatatcaccaattagcattctgtgtagccaggctagcatgtgattcaactgttgtgtttaccctccaccccaacacccatcaccgctgatctacatgaatgttatcaagcatttgcagcctgaaaaagacatgatgtagatttgactcctgtagtttcttccaaatagtatcaagtgcggcagaacaatatcccccgtaagtcacttacattgtcatcttaatattatcatgattgtgaattctgttgtcttgagatggatcgagaactttgacatcagttcagtattgctaatggaatatattatttacacaagactttttcctgtctgcattcagccatgtagaaatatactaccatcttaagtgccagaagatgctgatccgaagtagaagttgttggcaggtattggtgccagttagatgagaataaactgccaaggaagacactggagtgaaaaaagatagtttgggccaagtttttttccctctctctctcactcttgaaataggtatctaacatgcatatacacaacatcagtctataggaaatatgagggatgcttgattacaagcaaacagggacatgtggggccaaactctgcccccagcccctatcttgccatatatgtttctagtagagatgaaagtgacatgtgggaatgatggggggattcatgtcttctagacttcacagtatgaaagggaccaggccttcccaggaggaatggccagaaactgaagctatagccagaaatcaagggatcttttgtgaacacctaaagcaggagtttatccagggatagagatctccaaatggtggaagcaacatacaggcaggggacagaaaacagcctccatgctgtgcaagcataagtttgtactgatggcagagcctagtttggtttgcatttaccgtaatttttactcatctacttttaaagtggtatttgaagtgattgtgaatcaaaggcatgataatgcatacttttcccaatttaaaatatactgttttatatatgtaactacatgccttgaaaataatgagtatttgaatcctatcacattttttggaaaaaatatcagactgagcatataaagatcaatcttttacataaccaaccagtggaagaaaaggggttttgtaaaacgtatgcagtttagcgcaagaaaataagaaaaaaagaacttgcaatgaaaggaaaacgaacagaaaatagtgagatgagaaaattcccaagtacatttactcaataaactaaaactttactttaaccagacaaaagcaaaatgcattctatatctcctgtgagtttaagatacactgggaagaaaaattggcatgactcatgacttaaataattaaaattttatataaaaaccaagaggttaacaaaaagttcaggccagaagtaaaataataattaaatgtaaagtatctgaactgcaaaaatcctgaaaaataatttccaccactgatggaaatggttttaaccattctagtggtgaagatcaagttgttgaaggaaatccatcagttattatgtatattttagtgtgatttgaaggggattacaggagtaaaattaaagaaagtacacacacacacacacacacacacacacgcacagaattattaaaatgtattgcactgaaggacaagttaaccatactagaatctagggagccatttctcaggagtacaacctaagaagcaggatggaagctctgcacactgcccagtacagctgcagaggcaagaggattcttacaagtcatgactatcaatgatttgttttgttctcagattgcaaaacaaggaaaatgctttcatagcacgtcagattatgtgcctactcaatagtctatagatctttagcaaccttagaattaggaatatgtgacatatacttcagaaggaaagctacaaaaacaaaaattacagaatcaaaccaggattgcctccaactttaggaagcaggaccaccgtataaagcttgcccagatcgtcacagctaaaagcctgttgagaaaagttgtctagggccaaagaaataaatattgtctaggcttgaactctagcactgccattttggggacattgggttgtggtagataagaagaatagggtgtagatgtctgaaattatcttctatataatggagaaaaatttgcttgattgcaaacacacaattgaaaatattttcttagttgctatgaattacttccagtgaaaaatatgccaactccaataatttatttacaaaaaaaggatatttgtaacaaacaagcaaaggcaaagaaggaaaagaaaactctagaaaatacataggaaacagcatggtaatagggtgcccctgttgtggaataggccaggggtattgcagggtgaaaggttcaagatgatgatggtgatggtgacaaggtgatggtcaagcaggactttagttttgtctaaaatgtttattttatttatttattttatcattagaaggttgccatgtattatttgtatatttaatataagtacacaaagagtagctactaagaagtacattctaacaaatgtataatgagtttaaggacagataaaaaaatttcaaacttttgttgaaggcaaaaacacatctaattgaaattctgttcctctgagcagaacgatcttcaagacatatgtaaaataatagggctagaagtaccttggaaaacatggacctgaaaataattcattatcccagcacactgaggtggctccacgtgagtctgtcatctcaggacagaaagtggtgttgtgtcctggcagtccaagttgaggacacccactgctcataaaaaaaatatgaaattaaatattcagcaataaattgttttgaggaagacaaaatgcttttaaaggatcaacaaatacctatcattgcaaaaaaaactcaaaccaatgagcccatacagatggatcagaggcataatattcatgtgtaaagtatttggtccaagttttttttgtgtgttttgttttgttttgttttgttttgctttgtttttgagatggagtcttgctctgtagccaggctggagtgcagtggcgtgatctcagcttactgcaacctccgcctcccgggttcaagcgattcccctgcctcagcctcccaagtagctgagattacaggcatgcgccaccacacccagctaattttttgtattttagtagagacgaggtttcaccatgttggccaagatggtcttgatctcctgacctcatgatccgcccgcctcggcctcccaaagtgctgggattataggcatgagacaccgcacctggcctgttccaagtttttaggagcagatgaagctgttaaactttttgtttgtgccacctgtctatattaattctctgtattttccccatatgcttacttgcatacttatatggttattctctgtgtatttcctgtttcttttctctctttttttctaaatgtattgaaatttctgagaagatgaaaataccacctttatggctactcctaatggcaataagcgtagtcaccaacatttatttaatgttggctctttgttcaattaatctttgtggcaactgtaaaggcacaagttactttatctccatttgggggttaaatctgttgaaactctgaagaagaaaggaatttgtctctaggtcatgcaactggaaaccctggacttgaacccctagcactgatatatcctaggggttctagttcagattagactgatgctagaacccctgacctggtctccacagacccctcaacactgcttcacgtgcagagcaggaagcaccaggacatccttcctaagtggtgttaagaacttgatctgatgaagtatccatgtgtctttgagtaagtcatttaacttctctggaagaacagcttctttacaaagtaaggtcacatgcctcttagttcacacatccttcccagttctaacttttctgtgattgtattttcttttactgccctattctcaagaaatgtatttattatgaacacatgctgcagtttccctgttggtgggtctctatgtgtgcatgcatgtgtgcatgtgtgtgtaactgttgcgaacacttaccttctaactgctgttggagctgcttccagctaagtaggtgttccaaataccaggctgctcttattatggacttggtttaaaggaacgcctattctttttttcacacatgctaatacaatgtccatctttcctctcctaatagcccatgagtcttgaacttggagtcagcaaagtgctgcctttgtacagcacaaaagaacaccagttttgcttttttttttttttttttttttttttttaagaaatcacacggggactgaataaaaagcttttcgaccattcagaggctgcttgcattgtgcagctgttccttgactgctgagaacatctcccgcggacaatgcagtacctgaagagaacacggcacatggagctattcaagagttgcaggacctgggactggtgccagtgtcctctgtggaagatcgggggcctttcttcttggtcagaccctgataagcatattgcagtttgtggcagttgttgttttttgttgtttgcctgccagcattagtttcacaattttattgcaatgatgcattcccaacatgctggcacttaggggattttgttctttcctcttttggtcccacctccgtgaaatgtacagtgagactttgattggtcatagtccacttacagttcgcaatgcgttactgtgtggactgagttcccatgactcgggctccccaggacaatgtctctttcttcaccaagctgatggtaaatatctggttagcttcatctatttaaaaccagccaagcaggaatcctagtgctggagagaggattctttttttttttgtttgtaagtaaacaatggactcagttcttcctaactaaaattaaattccaatcactcttaaaataataccagaaggctaatccaattccaacagggggtgggaatggggttgagggtggcggtgggcggttaataatggcaaatttactgatgctggctgctgcttcacctctgtgcccaacatctgttttcatgactgatgattctaagaactttcctatgcaaaggaaattattatgttacttgtagttagaaagaactggctgaactaaaagccatgtgggcatctttatctgaaaccatttccttttgagtcagtagaattgagttgactgagttatttgggggttggtatttaattttttaagcattttaaaaatgcctaaaaactaaaaggctacgcaaaatgaccagcatatcttcttgctttagaatggcataaaagacttctgctttaagcagtctcagtatatgaaaatctgaattgttgaaaaatcaagagagtaggtgtaatctgttttacaaaatcatttataggagcagtctctggagcagaagctccacacctgcagttataacatgacctatataatagctggacatttgttgaaagtgctgcctctttcaacatccccctcagctcagtcttagcctgtttttcaaggtgtgtcaggaccgcatggaattagtaggacatctattataaatggtgattctttgtgggtccccttgaaccttagctgataggataggacagttagcataactgtggtattaccttgatcacagtttctaatcattcaaactccaaagatcacatacttattaggaactcctgctgcttactcatacatgcttactgcaacctcctcatgccaccatgcattttgctcatcactgcagtttctatttatctccacccaaatcctttctgtcctcttcccctaaccagctgcaaacacaattttgtgttgtgcaggacttgcagttctgcatcccactttctacccagcttctctgtttctcccgcaggtcagtgaccttattagttggtctaactttggcctccccatctgggtaaaactctccccaccatcactccacttccttctccttccaggcttttgtgctgtgtgctcctctcactgagctagcagcagtccattgccaggctgccctccttccttccttcaggccatcctagtcactgctcccaacacaatgtttgtgtatttcctgcaaaaggatatgtatttgtattatgctaaatgcttttcttccccaggctgagaggcctgatttatgtatatgcaaggatgagttagcatcttttctgacatttcaaatgctacaaaacctaaaatttgaatttcttcaggtactcttttttgagttacttgtctggtcagatttctgtagtccttctagacagtccttctgcagaaaagtataaagtcttcatctgttcattcattcattcagtaataacgtgcccattcctgggctaagcagcgggtgtccagtgaaaaaagggacatgatccaaggactcaaggaactcatagcctagcggggacaaaagatcaaccatccagtaaacatacaagctcatttcccactacagcttctggtcactagtatgaaaggagagaacggggtacattaaaaagagcagtgtggtgaggaggggctatcaggaacccacatagatgatgatttggtcaaagaagctctgtcctaggcagtaacatttaagctaagacctgaaggtggagaagccagccaggagcagtgaggggaagacttcactggggagagggagcggagtgtgctccaggatatttgaggactcaaaagacaggctggaatgtggtggagaaggaggcatgagctctccggagctgagcatcagagttgtgagccatgtagatgtggagtctgtgtgttgttataagtgcagtgggaagcactgaaggtgagtgacatggtctgatttatgctgcacacatgtgaatttcagcaaaacaaaatggtggcagcaaagacagggaagggaaggaattctagttaaatttaggaagaatcaataaggcttgctgagataaagccataggatccagtagatagtctgattgcctttttgaaagtagttttggtgaagttacagaaggaagaaaaagatagttttagaatgaataagaggttaggaagtaaatgtaggttgtgcccacccttggaaggtgtttggcaatgaaggaaaggacttttccctcaagggaagaaaaggtggagagaaaggttcgtttggaatagggagacaggcatatttagggagtatcagtgaattgggagagaatgaaactaccagagaaagggcatagagatggctgccttgtggaggctggagagaatgaattcccagcataggtgaaggagaggcagccatggacctaagtggagactggagggagtgaagcctggaggtgtgagggatgaaaggtgagggctgctggccccaggacctttgtttgtcccctgataaagatccaggcttctgcttaaagggcaaaataaattttgaagagagtagtagggtttagctacctcaggatactgagaggtgctgctttccagctagagaaaggagtgataagcagttagcagctttgctaaatttgtttcacagtccttccaaacagctacatactgtacaatttttctctgacagtgccgcctcgctccagagaaaagtatgctgatatactttggaaagattttcaataaaaagggctttctaaataacttttagtttaaccaggaaatcattcaaccagaacccccttcccccaagtattctagttagtcaaagttttactgaaacatgtcagcattgaaaaatgcaaaaggcagctaagtaggtctgactaaaaaggtgtaagaaatcccacatctgtgcacagagcagcagtgtcgagtctcttcaactgttaggcatttcaaacctgccatctccaatgcacgactagtggaaaaaaaaaaaaaaaggaaaaacaaagaaggaaatctatgacatagagtagaaagcccattcagagggttccagggcacatgtgtgtatttagttgtacagagcattttgaaatgttgacttagcaattaactcaaagctttgcatagtttgaattaacagtaaaagatcaaaaggccaaaactttaccaaatagatgtgtgataggatttattttcaaacagtcctgtaagaatttctgccatgcctacacagggccaagttaagatgtgtttgtgatctcttggcagagggggtggagaaacctgatcctgcactttgtaaattataaactgtttacacctgtcatctctgtctgtgtccctgttaatgataccttaacaattggctaagtgtgacaaaatgctaagagctggcactttcagagcaaccacatccagagggatgttattaatgtccactggagtttgagagaataacaaagcaccgtgacatacagaggacttttttttttcttttccagtaccgataagtctttactgattcattgattttcctagggaaaagagaagggaagggaaaagagtcagcatgtgttacaagatggttagaaaatgggaaagggagtgtccagcacagcaaaatcaaccatcaaataaacacaccccagtgatggggtcaccgaagcccagaggggctccatctcctgcagttcaggactgggggggagggatcagaaaaagaacaggcaggttacaggctaccctctctccctccccataaattcaagatttcacacaaaactttggtttctagcagtaaacatggagttacatttgtctgtctcctattaaacagtcttgtggccactttgacataaatttcttgcacctgcataaaagtatctcagtgacttggatatacattcatattccctttgttggccgcctgaccccactttctataccgaaggcccccagttgcttctttctactttaggattaaagattaagtaggcttgatccatccaaaatacagcagtgtcttaagtgtttggcataaatcacatcaagaaatggtgttgactcaggaggttgggaatgttagaaatgcttgttcctcggtgccacaaagaaatagcactcgaacataaatttaatttcctcagcaaggcaatttttacttctatagaagcgtttgacttgtaaatacagtaatggtgagagcacacttgaacaagggaggggaaggggttcttattcctgatgcaggtggtccctacctctgtgttgttcccctattggctagggttggactgcacagtctcagctaattccagttggctcttttaaagagagcaggggtatgagccagagtggcagggtgagtggcttggtgggaaggacagttaggaacaagtaactaaaggtgacttaggttacagcaggtgaccagaggtgactcaggtcaaagcaggtgactgggatgagtcaggacagagcaggtgaccaggggaacagatgtgaactactgattaaaactggtggaaaaggtttactgaaactagaagcaagggggcaaacagaaccaggacgttaaactttaaaatggagaatcaaagaataagagggctgaacatactgaaataattcaacaagaacccccttcccccaagtattctttgaagagaaacttgggaatcactatatctaacaggagcaagggatggaggacacctagcgtcaaaattttacacaaggactttcaccaccagattttgaatgtttttaggaaggtcctgggaaatgtctccagtcgaacaggagggcctttacacaaggtagattgggcccgggtgaaacatccagagggctccacgtgcctcagagacactgcactacaggtcctacaattcccaaaagctggagggaccaatctgcaaagtgcagcgtttactttgtgttgtagtcattgagtcatgtccatctgacctgcagaactgtgtagagattgcatttttaaaaaaaactttattgaccccttttctctactctggatccccccaatccccaccgcctcccccaaccccacactcaactctagtatagtgccctgcacatagattaattggcacttattaaatgtttagtgaaggtaagattagggaaatgactatgatcagaggggcaatacacatagtacttaagaatgtgagcttcagagccagtttgtcccaggttcaaatccctgttccccaacttactagttagcaggtgaccttgggaagtctccttatctgtcaaatggggataataatggcatatatctaaagctattgtgaggattaagtgagtcattacacatcaagagctaggtctgtgtctgtcatacagtaaacacacaataaaatattactttgcaaaaataaattcctcttgggcagagagagcttttttgaaaatataccacctaaagaaaaggcaagcatgtatttttggtcactgattaagaaaggtaatacaacttctgcattttcattggcctgtttttaaaggtaaaaattttagataaatgtggggttttacccatcagaagtccaaacagttttaaataaaactgtatacagttttatcttaaaagcacccatgaacgcaatatgagtctactttaaaaataagcttctaaaatatttttttctcttaaaaaaagcttaccagattctgtttcattttggaaacaaattcacatctgggatgccagatttcaatcttaatacggtatggaacagctgagttataattttttaacctcccagaacacacagacctctgatgggaacatgggaaaggacatttatcttttcagctgcattaatatgaaatccgtgatattttagtgagctaagagaaaatacatattaaaaattaagaccatgcataacagggagtgcctacataactacaagactggaatttgcacaattactctccgtacagattataatgtcttttactaattactggaagcaatagtgcctttttatgttggcatgaaagtaatgtaaacactgagatatttctcttctaagatatttaacatttacaacatttagttcaaatgagtatatcttcaaggatattgaattatagccactttctgattgggaaaacaaaatacaactctgaaagaaaagagggaaatgttgattataaaatcgttcaattaatgcctaatttttgttgttgttgttgtcattatttttattttttcttctacttttattttaggttccgagggtatacatgcaggcttgttacatgggtaaattgtgtgtcattgaggcttggtatatgaatgatcccgtcacccaggtagtgagcatagtacccaataggtaaccttccaacctatgctccttcccccaacccgccctcaagcagcctcccgtgtttattgtttccatctttgtgtccatgtgtactcagtgtctggctcctgcttataagtgagaacatgcagtatttggttttctgttcctgtgttagtttgccttcagctaatgcctagttttaaaccataaaacaactctttctttctctttcttttttgaaacagtgtggatttgtggaaattcttcatggttttggaaccattgaaaactgagttttaatcctgcttctgatgttctccagctgcgtggtcttcttttttccctcctttattattattttaaattgtcacataaaaattgtacatatttatgggatactgtgtgaaattttgatacatgtatacaacgtgtaaggatcaaatcagggtaattagcatttccatcacctcaaacatttactgtgtttttgtgttaggaacattcaaaatctgcttttctagctgtttgaaaatatacaataggttgttgttgttcattatagtcaccctacagtgctatagaacactaggattaattcctcctatctagctgtacttttgtatctgttaaccaacctctagcaagctctccttcttcccatccttcctcacctctagtaattcaacactctcttatagctgtgtctcaaaatactaaaataactggttggaatataaaatatttggttaatccctattcacactaaacagactctttattcacactggccagattcttttttggtgtttgtgttttgttttcatgcatgaggttaataacacccttagagactgtctgaatgtccacccagtaccagcagagccttggcttattattatgccagtttcacaacttgaatccgttagttaatttaacatggtcagagaaaaactcatttgtctttttcatgtgtttcacagtcaaagtgacacagggtcaggcattatctgctggaaggggatggcgaaattaaagtcccagggtacagccattcacagcggtagaacggatgattatcaggctggatataattatagagccacagcagtcccccacaatacactggctatctgcctagcacaaaggtttagatccctaatttgttgcaggctagaatatctgtgaagtagccatgtatttttgtgtaccatcaatcacaacttaggcaactgctgctgtttgcattttggaagcttggcggctgttaagcttctgcctgcttttcagacaggaagataggatgcagggctgcagaaaggcttttagtggcagaatgatgacacctctgccagggtcctatcgcaagctcattagctgagtggatatttgagcgcctagtcagtttcaatacatacaaagtcatctgtttcattaagttaatttacctgagctggctctcctgacaatcaactgcttctgcagtatcagcttgatattgtaaaggcgaatgaggatggggctgggcaggaggcattggtcagcaaggtactggggtctgtgggattgtacttccctttaactgggcacttccagaaatccacattatatttgtaagcaagaaacctggctggaagtttactaaggcttgctatttacttttagtttcaatgaatgaaattgggaaatgagaagcaaatcgggtactatattaataatttaagaatatttttccaattgttaaggaagcgaagaaaggaaaaggaagcaaaagaaaagactgcacatttgttggttagttatttaaactctactgttcctggagagttctaaattgctttacaactagattcacctaaatgatatgacctacaggaaattgtatctgcaacttatgtcttgcaaaagttgttaattaaggaaaaacctgtattgttttccttcctttgtttggttctctaattcgcatctttgttcttcttttaatatgcatttgctttatgctttttagatttgagtgttattaaaatagtaacacctgagttggacttctgcctttagattagttggaagctgttaaaatttaatcttatccaaggttttgtgcatcacagggttgacttttaactgaaagtcgttactaactgtcacgttatactgttaactctgactacgaagactaatcattagactcattagaaccaactggtttgacaagaaaaaataaaagaattgttgaaccacaaagaatatgttagaaaaacatttgtatacatttgaggttaaacgtacacattaccgacttctttctcccagcacacaggacatcagctcttaggaagaaggtggataagaatttcttcctcaacctcccttatactttcaacttttcatggcttattgggtataaaagatcattgttttgaaagtgcttatgtgagaaatacttccatgcaagtagaaaaaagcgcatgtatttcctcgtattgaagcattaggaatagtttattttattttgcaaaccccaaatccatttgtttaatttggcaatattcgtcttttggccatgtttaattttctttttccaacattttgaaagatccaactctatccattttttagggcagaaatattcaattgcttctttttttttagttcagaaaaaaatatataatgttaagtatgactgtgaagaattaacttgtgtttgaattgatattttgctggagctttaagtaacagtttaaactttattgtcgggagtagacacaataaatatcatcttttcacacccaggagattcggggccagctatatctttctcagttcttatttcattgtccatataattgaataaaatatctaatgtaatattaaggtcacagatttaaaaatacagaacttggggaatgcaaaatttacttttctcaagataacagttttttcctcatgctgggcattatatgcacttaagctgtgccctcagcaatgtaactaggtcagggatttcatagaatgtgaaactgctgtgttactgtaagaataccagcatcttacatttcatgtatatttcaagacctgtatttgcaagtagaaaggcaaatgctgggtgtcagtctgatgtgcgttacctgggcgtgtatatagaacaggagttttgagctagcactaaggcctttaaaaaagaaagcctagtgcaatctatagtaacttcttcaagggcgacagttcattataaagtgagctaagtaagtaatataagccccttggaaaagttaaaacttaaaatctatagcgtttttctttcttatacgacgtatgtgtttatactttattttgcagctttttattggtatacctgtctaccccataatttgtaaatcctctgaggacagggattgtattttagatcattcattgatccgtttgtttaccaatcaaacattcatttgcccttgccaggttcactaatggtgtggatagattagtaaacaaataatgtcaatttgattgctatgatagagctcactcaagtatttcgaaagaaaaaagagagacattagtggttagttgtcagtgggaatcaggggagacttcacagagaaggtgatgtttgaagagtgtcttaagaaaagggtagaaattcacaaggcagaaaagggaaaggatagaaaagtggagtggggaggggctgttaataggaaaatgattgaaaagaaaaaccatagtcatgggaagagtagttcaagacacaaaggataaaaaagaaggggggaaaaggcaaaggaagatccaataagagccatccctccaaagccctcacccacccacccaagtcaatcgaagagtgaaaaattcttaaaactttctgttaggggcagtttattgaaattctggtatatattcttaacctagggcagctggctgctaggtgaaaagattccagagaggtttttaaatgctgcttccttcagccagccttcatctttgtactggccacagcacctgaaacagttccttgctcatatagacaataaatgcttaatttgaattgctgaaagtaaatagaagtaaaacggcccctccctttgaggtgtttgtaatgcagttgggaagagaactacaagccaagtagataatgacttaccaccaatgactataggctattcctcctttttacattggcacggtactgaaaaatgtgccctctttttcccaaaggaataatttaagtttccacaaaattttggttaaacaccaaactgccgttaccatcttctaagaaatataggcagctccagtgcaagacacagaaggctgtgggtgggaagttttgaggacagggggaaattggaactacagtaggaaaatgtttttaggaaacaagggatggtatataggtataggaaacaagtatacaaaattcaaaatgctgaaaggtgaggatactttgagtttccagtgaaactcaaaggatacaggagactgagaagaaaatggaagcttacattaattaaataactcttcatgggccaggagctctttatcctaataacagctgtacgaagggaaaacatcattatcccactttagagcacagaaacctgagccttacacagattaaataacccaaggccactcagccactaatggaaggactagggtggaagcccactagaatataagctccatgaaagcagagacctcttctgttcatggggaatactcagtgtcgggaacatgcctggcacacagtaggtgctgaataaatattttcttaaacaacccagacttcaaaggccatgtttacaaagtgatcagggttgagttagtcacagagaagataaacttttgtccttgctccaggaataaagaattgtctagataggcaaatgggcagacatgcaaaataaatatcaaactaatggcaaaaacaagataagaaaaatgaagagttcagagatgccattgtctagatctttacctaaaatacttgtgctagtagaaaaatggtttccttgtttccttgtcattgacccaatagctataacacagcatagagcatctgatcctaacccctaaagaataagctctaaaaattgtgtgtgtgtgtgtgtctgtgtgtgtgtgtctgtgtgtgtgtgtgtctgtgtgtgtgtgtgtgtatacatacccatgtaattatacacacattctataggaggttaggaacctatgaaaataaatggttatgttgaaagatgtctttaaccctaagtgtagcatttgctagtggaaactctgtaattactgtaatgtttttggtggtgactgttcatgattttttttttttaaaggtctgacagctgccctcttgatatttatgtgtttcttgctagggaacctaagattcacaacccgagcttgtaatgaggaaaagaagacaatacaaataacttgaaaaggagtatgaactggatatggtcagagagacaaatcacatgttccatgctgctttaattggaaaacaattctttcatggggttactttcccttcagctgagataattaagtctggactgacactggtgaccagctactgatgataaatagtcagttactaacaatgcagcaatcagtaatcaaaatttatatttcccaggttaccagggcacagttgaagagaaaagtgggtttgataaggctgggagataggcttcctcgtgcagtattcacatggcttcttctccacagcatctgggtgggatcattaggtctgctttatttcaaccttgtcataaaagaaaacatacctattgtctgtgtttgcattagaaatactttgcacgccccatgctggaaaagaagtttctgtatgcctccctgtaatttttaatggattaaattatattctgtaagtgggttggcatgagggtaggtttcaatgtccagttgttattggacatgaaataaacttagatatttttaaagccactccatgcagctggcacaagtaaaggtttttgaatcatggctaattatccctggctgtggctgaaggcattgaaatgaaagggattaggattgtaatatggatgccatttgtatttgtatcagcggctccgatatttgtctactcactagaatcacctggggttctactaaaatttttcacagcccaggtcacacccaagccacttaagtcaaaatctctgggtatggaacacagacatctttaatttttgaagctctctaggtgattccaatgtgcaggcaagtttggaaagcactggtctatactcagttttatgcatatttttgcataaaaatatgaaactgctgtctaggccgggtgcagtggctcatgcatgtaatcccaacactttgggagactgaggcgggtggatcacttgagcccaggagttcgagaccggcctcggcaacatgatgaaatcccgtctctacaaaaaatacaaaaattagctgggcatggtggcgcgtgcctgtagtctcagactcgggaggctgaggcaggagaatcgcttgaacccgagaggtggaggttgcagtgagcagagattgcatcactgcacttcagcctgggcagcagagcaagaccctgtctcaaaaagaaaagaaactgctgtctcccaccccagtaagaccttaaaccccaagagaaaaagcataatgtgacccacccggtgagaaaagcaacctcaaagtggtcaaaatagactcagctctgaggagaaggagaaccaaaaaaggaggaaacatgcctttgctcctttcttagtgcttagctcagtgttagttgaataaatgaataaaaagagaaaagaggaggtggtcatgtgcagctcagttcccagaaagggtactgggatgggatggaggaaactcattgaccacatccttgcacagtgggcacctctccacactgccctcctcgctctcctgatgaattctttcttttctctctagtttagtcaatctcctgtcttctctgggagcagtcattctgagatggtcgaagatgactgtctcaggggaggacactcattcagcttttaaaatgtcaggtgtcctttggggatgcttcaaaagcagcatttgggcttcctttgccataggaaatgaacaggaagaaaggccagtgaagacagagaacaagggggcaggtgcctgcccagaaatcaacgtgcagatagagaagggagaaaaaaaaaagttcccatctgcagtactggaatcccacttatggagcataaaataaaaaatatgaaggttatttgctttgagctcatctgattctttgtgttagactgcactgtggcctgcctttctgagtttgctacatttttatttgaaagctaataaattagccattcatatggcacgcaggcgggtttatagtgctgtgtaaaccaccagccaccatatacatccatctgcatcacagatcgactagaattatcactactgacaccacaatgcctataaattccctcacccgcatcctgtattccagaatatttctattggctgaccatactgcgaagagacgggatcctgggaaaaatccttttttctttctagtttagtgggaactggcaggttatcagtaggtctaagctctaggtttgcctctagagacaaagagtttaaaaaatagtaactagttttattttgttctaaaaaaacacatgcacaagaaaaatattgtcaataaaacataaaaatgtacaacataaaaagtgagtttcttacccaaatctgacctcctacacctcctccctcagagacactgttactagttgcttatatatgagaactgcaatattcacgacactttaaaaaatcagtcaatcttggcttgtatttcaagtttcattaacaaaaaacagccccctttacaatcactggggtactgaatgcactgatatttaaaaatacccaaagctatttggatcaaaatcaacaaatatttaataagtaccttcaatgtgcacaatgttgcctaaacaagccatttctaatgaggattttacacatatatgtttcatactttttttctggtgtataacaactaatctaaaattatgttagtgaaagggtagtcagtctttgttttaaatgtttttctcagaaacaaaaattatctctttctctccctcacccctctaacttctcagcctttcacacattctctcatttgagttctgttttacgccgagacatctgggtaggtggtatgttctggccagagtactctctctcataccttccccagatggattggctcaaggatctaatattccccaaagaaataaaacatcccccaactggccattgaagaagagctgcagtgctttctattctaaacacacatgtgttgaaggatgagagacggtcatgacagagccagtgtccccacccatgacttgtctgcagagggggagacttccagtctgtagcccactgcaggatactaggctgactgcacagccccgttacccctcaaactccagccagctacatctgtatgtcttctctccagctggctggcccagctgttctggtgtcaaagaaagttatgagtcactgggaagggctttgagacaagagtagagttaaaccatctcctggggtctgtgtgtcattggcaatcgagccttagtaacaagccagtgcttgacagtcccaggaaggccacacaaccagagcttcactttgtattccacaatccacacctctgggctttgtagtgaaaaagaggtagagctgtatagatgctggatgtctccatccctagagactttctgtcattggccatgatgttcattaggttcttgccatctgtctccttgcaaatgctttttggctgtagatctatatcctatacaatctggtcaaactgggagacaatgaatgaggattggccaaagcctgaggactttcttttggtcttttgattccagggacattattacaacagagccctaggagcagctgccagcaagagtttgagtccacagcaggatccttctggaccatctgtggcttcctgctctgaacagtacttcctcactacgtgggaggaaagacttgtcagaggatccaagaaccataggcagtcaggttctccatggggaccctaaatgttgtctggtctagccctgcatcctgcgtctaaattcctggagaatattccttctgtcctagcactcatctggcctccccatccccttaggtaggctagtccatgtgtgtgttacaggggctgctagaaagttcctccctattttgagcagaaatcatctttatagtttctacccattgatcttaggtctaccctcacaactgtcctctaggtttctcttcagatatctgaaaaatgccagtctctgccccttgcatctccccttttccttgttttagtactgatttttcagaaattgtcctgatactctttttttagagcttcattcactatttaatgaatatttgttaagagtttactgtacattagactttgttcttgaatgggagggatacagtgattaataagaccaatttacccacatagagcttacattctagtggaggggaggaacagacaaaagcaagtgaaaatctcaattaggaacaaatccattgcagaaatgtagaataaagtgatgaaaaaaaaaaaaaaaagcatcaggctgctttgggggctcagggaaggcctgtctgaggaagtgacattttatgatcttggaagaaagatcattccaaggtgagagagcagaaagtccatgaggcaggaatgagagcttgtgcatttgaggaaagcaaggcacaggggctggaacagagtgggaatggaacatgatggggtcaaccagttgggtggtgccttttgtgcccagaatagagggtttaattttgttgttaatacattaagaagccactggaaggctttatggaagggaggacataacatgatctatgtttctaaaagaccattgattgctgtgtggagattaaactgaaggagggccaagtggaagtagaaagactaagtagatagcaattgtcatgaggcaggagctgaggttaggttagattaagaggattgtaggtagaacatagggaagtgggcagatttggcatgtactttggaaatagaatccatacttggatattacgtctcttggtcctcttaactcacagtgttttatgtaagtctgtattatatgtataatgtatgtgtgtgcgtgtgtgtgtgtgtgtgtgtgtgtgtgtacacacagcatcgttatagccacttatgtatagtctgcagtggtctggagacttcccaagggcagaacccatgggtgagcccatgaccccaatatccgcactgttcccgcacagtgccttgcctgcacatattagaaactcagccatttctaaagtgactgaattcgatgagtgaatgaatgagtacaggaaaattactaacaaaagctgtttctgggtttaattgaacagtcaaaggaacatcctttcaatgcctacacacttgtacgatattttctcacatctcatgttcttgcttgtacctcccaaaacactaaaaaagtaccctgtggtgtacaaaagcagtgttcctttggaatagaattactttcaaaaaattggaaaaattattgataatgactcctcaaatgtaccttttgtgtgagaatggaggaggtgcccttagctcccttacttccaaatagtggagcagtgttccagcttggggaatcttgcaagactggagctcaacacagcactttgctctcttctcattgaggattctggacgacactcaacctttctttcatgtcttagtgctgctggaaagagctgattaaatagatatgtgaagaacacatctgcctattcttgcataacattttagaatgacttttttttttttaactcttaggagagataaagactatgttaacccagtaggaaaataccgtgtttgagaaaaaagtcattctgccttagtcttttagttattcaaagtgaacgtggggaatctcctctttgaaagacgttcatgtgttgttactctccatgtgttccataggtgtgtattttccttctcattgctcagaacttgaaatccttactagtgaaagcctggatgatgcaggttgacctctctgcttcccagtaaccagggctaagtagcttctagagacgtttatccattttctgtgcctccatttcctcccaaagaaaggcaagcacacacgtgcagggatccttgtgctatgctagagtgacacgcctaggcatgcctgcagggctgggtgtgtgtctcacactcactttctctctgatttatcacctctcttttgtctgaccctcagcactttagtttggtttcttcttgtcacactcaaacttattggataatttcacttttcctccttattctggtctggcagagatggtaattaaagtgattgctgtgctattaattatgggaatggtgatttttaaatttgatttaggggttaattggtgatattcatgtgctgtcttccctcctgataattggattgcagtaattaaccttgtatccaagttatctgatattaaccatttgcctccattttatttcagacttaaaattgattacgttgttgtctgacgcccagtgtccactttgggagaaagaaaggtgagggacagccagtggagggcacctcagagaggaataggagagtctgtcttccttctctaccacccctacctgttgtccaagataacagttgtcctccccaaatattccagaaatccaaattcttaattttagtaactagttcctaaacttctggggttattcatcaaaagaaaattacagatatttgaaaattaaaggcaggtacctgtaacaaagcagagggcagatactgccagttgacaattgcttctgatgccagggattggaaaatgccgtgaccaggcatattccattggggagaaaatgattacaggctctgacatcatggaatctcctttggagacaccatcaccaagtgcacaaaaagcctgtgaagtctgtccattttctacagagagaggaaggagtgctgactcccttgtagttggccatcagatgggaagaaatgcagctcactcaggtggaggggttgctgagcctggggaggcagtcacttctgctgcttctggatgatatcacttacttaggagaggctttgggaccttgctaccaagattacatctgctctgggaacatcacttattttgtggaagtctgttcttgtcggtcctttgtctggagaggggcctggaaaactgtcattataagcccagaacataggaaatgaaaaataagtaactcagtcagcaattcctcatctctgaattattcttgcaagtatgatacgacatacacttttaaaaatatgtgaaatcagattacttttttttttaaattctgtgagaatttcacaacacactgtggaataattaagagacgttctcattttagcaaaaccagtgttgggaatttactctcaaggatttcctttctccatcactttatatcctgtttttaatctctttaggaacgaaggcatgtagtgtcccaatcttttttttttttgaaattttttagattttggaaaagtaacatgggaaacatacaccagtggagtctggagcaatttttaataatcatacctgttcataatttgcagcaaaatgcataaatattcatcctaagagggataaataaggactacaaatggtctcatgccaactcaagcttgtcacacaatgagtagaaaaaacattttggttttcagggtttgtttttgttttgtttgtaattgcagataagaaattgtgtacctatactcctgaaatgaacttggcctcatccagatctagagaaacaggggatagcaaatcgtatttttctttaaacttaaggagcctcagggcagacttcaaaaacaatgaacaccaaaatgattcctccagatgctgccaaagaacaggactgttctgtttgtgcggtgaccctgaagtcacctgtttaaggagtcaagtcatcaagtggtagagacattcaaacaaacctataatttcgtagaatttattttcattcgctctaaggaagcatattttcaggatgtttggggataattattaattccaaagataagatttcacattaaaagcaaatgaacattttatgcggtggtatcctagagttgactctggtttgggaagaggcacctagtgaatcgtcttctctccaccacaattcaaactgataaactgcctttggaaaacacctacgttattttgctaagtaaatcaagccaggctaatgagtcactttttacataaaagtaaatgagcaaagccaataaagatattagtaattttcagaaaaaaaaacctgaaatatctatcaaatttaataataggttaaaatgtgtgggtttgcagttttcactgagctcactgagacataaagcaggcttttttcggataaacgaaatgaatttccccaaaaatgtgggaaaattatagaaattcaagatataattcttccatatcatgtctgttctcgatgtgtctggacatacacagatgaacagaaaatgtactgtgtatatagatactttactgatgataagcaccagtcagcatcaatatcatgcttggttatggagcagatcctgaaatgatattatgcctctttttgtataatcagaagcttgtaatcaaatagaaactctatttttggctttcagggttctgggaaagcatcagagctcatcgaaagaggcaggaaatacaatgagggctgacacaggcagcaaacaccaaaggacctgatgccaacattttagttcaaggaaatgttttcactttcttcctgatcttgagactgtcttaccaaaaatgttgacaaacaacaagaaaacagtaaggatttatagggttaggtcaaagtttaaatcattcgtgactgatgacattgttatttggggctgttattcagagctcaacggagcgacttgcaggttgttattaattctgtaggagccaggtttgaagttgacttctactctaaaactggggaaagaacacatccctgcagccgtttaggcctgagcaatcccaggcagagtggagatcaggaaggttcaagttgtgactgggagattgtatttctattaactatactgagagtaaacagaggagaaattattagggagagtcgtcctgtcaaagttcagcaattgctttattttagtttaaatcctctaaggactttgacaaaggtatgtggaaaactctaggtgctaaaatatctctggtttgctcctttaaagtcactctccagatatctttttactggctaggaaaaatgcttggattcaggcatactattttttgcagtttgcttcatttttaataaaattacaaagaaaaagttagggagagcaacgcaaaaataacccatatactcaacacctcaagcaaataaataccaatattctgagcttatacttcagagcttcccccaccccttcttctctgtcatattcttagaaaaaatagtaatcagacacaatctttattctcagctgtaatattttaaaccaaactttcagttaaaggaaaacatccatccattacttcagacaaatgcttgaaattccttaagcaaagaatgaactagtctaatttgagtgtctacaaatccaataagcatggagttgtctgttttaacacgctgctgtcttggcctggcccttctacctgaaatgtcttagttcccacctgccccctccacagtgaacagtcatgcaaccctctaaggctttctccaaccagaagcctttgccagtcatcccaccttacatgcctctgcaacatcttcactttccaggtggtattcttggcaacagagtaataatttctttttggaagattattgttaatttgtgtatgtgttctattttggaataatgagcaaaagctatggggcccatccactgaatagtgaggtcctgggggtgatgcaaggggaggggctgtttccatctctatctgcatcagcatcttagcacagagcctcccagtagaaaacagggagttggtaagatggaaatcaggcagtggtagtaatgaacatcaggcagcaagccaaggagaagtgaatgaattttggctcccttctgaaagtagcataaggcagggaaagagctcactaagagaagtcaggagttctcagctgctgctcatctttgccacttttgagctgtcctacattcggcaagtgacctttttggacctcagttttcttaacagcaaattataggaggcatttgtttctgcatctgaagcagatgtccgagttcagcaatattgtaaacagtttacacaagtttacaagaaaaaaacaaacaaccccattaaaaagtgggtaaaggacatgaacagacacttctcaaagaagacatacatgtggccagcaacatggaagaaagctcaaaatcactgatcattagagaaatgcaaatcaaaaccacaatcagataccatctcacaccaggctattattaaaaagtaaaaaaacgacagatactagcaaggttgtggagcaaaaggaacgcttttacactgttggtgggagtgtaaattagttcaaccattctggaagacagtgtagtgattgctcaaagacagaggcagaaataccattcgacccagcaatctcgttactgggtatatacccaaaggaatataaattgttctgatataaagacacatgcacgtatatgttcagtgcagcactgctattgttcacaatagcaaagacatggaatcaacctaaatgcccatcagtgatagactagataaagaaagtggtacatatacatgatggaatactatgcagccattaaaagaaacaaggtcatgtcctttgcagggacatggatggagctggaggccattatccttagcaaactaacacaagaacagaaaaccaaataccgcatgttcttacttacaagtgggagctaaatgatgagaacaaatggacacacggggaagaacagcacacactcaggcctgtcagagggcagggcatggaaggagggagagcatcgggaagaatagctcgtggatgctgggcttaatacttgggcgatgggatgacctgtgccgcaaaccaccatgacacacgcttacctatgtaacaaacctgagcatcctgcccatgtatccctgaacttaaaataaaagttggaaattaaaaaaaaaaaaaaagaaaatcaagaggaaggtttgggaatgaaggtaatgattacagtctggggacatactgtgtgagttttacaagtaagccatacatgtaagtagagttttccagaggaattgtacaaaatcaggtctggaattctaaaactaaaggtttagattaagaggtaaaaattagctgccttgccgggtacggtggctcacacctgtactcctagcactttgggaggctgaggcgggcagatcacctgaggttgggagtttgagaccagcctgaccaacatggagaaaccccgtctctactaaaaatacaaaattagctgagcatggtgatgtatgcctataatcccagctactcaggaggctggagcaggagaatcacttgaacctgggaggcagaggttgtggtgagccgagatcgcgccattacactccaggctggacaacaagagcgaaactccgtcgcgggggaaaaaaaaaaagatagctgcctttataatggatagccccatttaccctgatgtgattattatgcattgcatgtctgtatcaaaacatctcatgtaccccgtaaatatatacacctaccttgtacccacaaaaagtaaaaataaaattcaaaacaaagtagccacctttaagccaacaacaaacaaacaaagaacgtttacaaagatggtgatggcaaaaagctagagcataccacaggtaagcctggttgagactgttgcagacttttgagataaagacagagtttgccacaatactttcaggcctactaaggtcgtgactatagcagcagagtcccagtgggccatgagactgtatctgaaacatccaagtaaagtgcaataaatgtgcaataaacatccaagtaaactgcattggctcagggctgtgtgtttggggtgggggtggtgggtagagagaaagaaaacgaacataacagaatcatctgaaagaaaagacttgccttctccctcaaaagataatacgtatacaaccaacctttattttttgaaaagatatttttttctagaagtacttacgaattcagtttttctacgtttttgtgatagtggtttcagatctaaaatggaacatctattacacccagtcgatatttattattatcctccattgaatgccatcatcactctccaaaatgtgttgaagttaggtctgtggcatttccctttcctccaaaatgggtgcttttatgtctctcttaatggctgagagaaggaggaaagaaagaccagatgctttattaagaggctggagctatttttctcatttgcccgaaccttatatcttaatgcaaatatcactgaacaggcggccctcgtggttcctgcaaactgggtacaataaaggtttcaaacaggatcaatgggcccaggttgtttctaattacgatgggatgtgttctttgacccagctctgcatcttgtggacagcagcaccctcttaatgctgcggtccttgaaacagagctgtccaggtcagtgaaggatacctactatttaaacactcattacttctttaaattttcctctggtgcaagaatgatcagcagttccagcctctgtgaagcaggtctccagctggatattcagcaaaaacacctgctttcccatctctctctggacagaggttccttactcacttgagatatgtccacatctgtttatcctatcagctactgaagcaggcaacttctttcttaccctttgcaaatgacactgttctctatgatgtgttgatgttaaaacatcacggttgagggaggctgcaagcaggcaagtggctccacttaacacagtggtgttcatgagagaatcaatttctcctaaaactggttgagaagcatttgcatctttctatcaccttaaggctgcaatcacagggccataaagtggaatgaggctttgcatgcctacatgtttgggagcaactgtgtactccctttatagatttttatcaccgaagccattagggactttcagccacttcgtccacataagcatagatgcatcagcctatatatgaacttaagtgcagtttccttttatgccatcacctttctctttccaacctttcttctgttcctttttctttaatgccttgggaaggacataaactttggcattatacagacctggctttgagttttgtctttaccctttgactactgtgctgtaaatatagttggccctctctatccgtgggttccacagcagtggattcaaccaaccgctgatagaaatttttttttaaaaaattgcatctgtactggacatctacagacttctttttcttgttgcttttccctaagcaatacagtgaaacaatgatttacatagcatttacattgtattatgtattataaataatctagagatgatttaagtatacaggaggatgtgtataggttacatacaaaaactatatcattttattcaagggacttgagcatccccagattttggaatctttgggaggtcctgggaccaatccctcacagatactgaaggacgactgtatttactatgtgctgcctagacatgttacttaacctccctgaattgcagtttactcttgtgtttacaacacagataataaggcctgtctctctgggttgctgtgctgtttcaataaagtaataggcatatgtaccttgcacacagaagatactcagtagacccccacttccacccagtcctttctttattttccacatcattatatttctttgcattagtgtgagtgccatgatttacattttttaaaaaccacaccatgtttgtgtgactcccaagacaaactttccagcctctccaagtgaccacctccagagataagaagcttagtgacttgaagtgggtgggggagagagaaggagggagggagagaaggagacttctctcactgaagcagtagaacactagaagctaatctaggacctccccgagaattttgtaaggagtccaagaaaagctattaaaaagtaatttttagtgtctcagctgaagaataaataaacatttattgaggactatggagagtctccaagacactattttacccatatgaagaaggggaaactgaggctcatagagcttaagcatcttgctagaggtcccagctagtaagggggcagagggtttcaaagcccaggtttcaccccctgctcttttctgctctcctatgttattgcaatagtttgatgtcacgtaggagtttttaaatcaatttcaattcacttttggaggcagtcacactgtacagacaaagatgatgaggtccaaaaatttgagttaataaaaatgaaaattttagatttagtgtaaaactcaactgaagtctaaataagattacatggtaacaacagtgttctctgtggtcagattagaactgcttatctacttgaactgggtcctgaagttgagactaggcagtatagcatgctgggatttctttgctctcgcttgatgaacttttcaccacttttcatgatgtgcctattgcagtccagtgagagctacatggaagagagttcgttctacccctcatgcttgccacaaacagtaccacacattgacacgctgattatccctagagtttccaaaccacatgctgcttaggagcaaccaggaaagagtgtagagggaaaaatgagccctgttccccagtttgttttggaaaggtcacttgccccactgcatagaactttctctgcctgccctctgtggtgatctcagagagtggctgacacaacaacaagagcccaactacatttccagtgcctttaggacaaagaggaaagctgtgtggaggtccagcacctcaccccacctcagcctgggtccccttattccccctgccgcccctacctcatctctccaggtgatgttcctggctttggaatgtgttacatgacccagaggcaggccactccctgtaccatccttcctaatcgcatgctctctctctctctctcacacacacagagacacccttcttcactggggcagaatcccttagaacagtaccatcacagagccggaggaatcttatagactattacatttcatatcctttcattttacaggtgaggagactaggagctagtgaggctgactaacttgcccaaggtcaacgccattaatgtgctcttccctctgttaatgacagcatgaattgttggttatctttaaaacttcatatgatattagaaaatgagctttttaaaagaattactgaaacatggtagtaagtgactttgctcagggaaaaatagtgccactattatcatttcctttttatttcaagcccacacttggagttgttaaaagcattttgtatttgcaaatccagatatattatttttcacgtcactatcacttattattaaaatgttccttgtgtgccaacattctggaagatgctgccatgtctaccaaatcagacacaaattgtattcatacagtcaagtcctccatgcaacttgatgcaccaagcatttatgcaccgtttgctgcaaccggacatgtagacagttggtggggcagcccagccgggtctctaaaacaagcagtgttcattaatttgtgtgtatagacagtgggttccacatggtccacttgctaaggctgctcagccacttgcagatgatggtcaagaggaacagaatacctcacgcagcaacgttgatgtcctgtacctgggtagtataaaggttccctcagaaccttcaagggcaggcaggtgaggttaatgggtaaggaaggcctcctaagagagtgggaaggagtgggaatgtttccgtctggagagagccctatttggggcagccaatgctcaactccagagttttgtcaggtggggtcttggactagcaaagccaaacctctgattttttttaagaagtcaaaaatctggagtttgttaaatctcctatttttccctcaatattgctaatttagttgttttcttctctctgagtcagcttctgccaggtactacgagtttgtgagcccccgtagaattttccagggcaggatttggaggaatagttgggcagaggattagaactagtgtcaggggtgagcctgcgtggtactctggctgggtccacttgtcatggcttcccagtcctcgtggcttgttaaactgactcattagaagtaagatgtggcaattgatggactcattctctgactttgtaatcatttccagctccgctgccatcccttttgcttcatgcttggctgacacaatgacccgctgtacatcaagggtgtgggaggtaagggtgcgcataaatggaagctctagtaattgaaaagaatttattatttttaaaaaatttatcagcgtgaatgcattcacacggttttcagacagtccttttggtctcctttgtttcgtcttcaatctggagtacctgaaagctggtttcctgcccaattagcattctgcatggttcatttggctcatggcaaccaataatcacaacaccatttgtacatcacagttctgtgatccaatttgggcttaaaaactgtagggaaaaattattgtgaaaaaaaatttgggtgtagaaagtcaatacaaattagtttcagatgaacctaaatagacctgacaaattcaccaagcagatgcctattaaaatgaagaatgttcttaaggttttctgtgaatttgggggtttggggcaaattaggattataactttgtagtaatggtatgttttacaaaggccatttcacttcaggctaaggagagtgaaaggctgagacaagtagatggaaaattcagatataataggcttacttatgaagtaaatgttttcatttagaatccttatattgacagtcttcctttatctaattttctgaatagctgcttaagtctaagttatatttagcctatataagcacagtcacagacagggaaatcgacaaatgtttgcagatacctataaatatgctacatgtgggtagcacttttcaaagttttgaaagtgacttaaacagcctcttaaattgcagcaacactgctcactcaaggtttataaactcagtgttaagttctggtttttgttctcctgggctggtgcaagtctgtattgcatcatcttaggaatcctgagactcaagcctgtgttctttggatgagaaatgacaatgttatggaattgggatccctccgcaaagtaatcatttcaacaagaaaatttattgtctacatatttacaagggttagggcccaaaattgagtagaaagggaataatacatcaaaacttcaactgaagaaaattttaaagtgttcatgtggactgaccaagattaaccaatacttccagagcactttcacccgtatgatgtacatgttaactacctgatgatataatgatagaaagacatataaaacagctatttttcctggcagagagccctgctgtaaacctggagatacttaaatgatgctggctgcagggatagccagaatagccactgacttgcataacagatttcttctgcatgcattgctcttcctgccagcttctggggttgagaattttgcatttgacacatgcaatcttaagatggaaaaaattaaaattgggggatataataaagtagcaggacattgtcttgttagcttataggacatttgtacaaagatgaatgcagttgttgaaggatggagactcgtttgtcatgtcaagaaaaattaagccttaaaagcatacatacatctctaaacatttctaaaggaatgagaattagccttttgagtttcctttctttcattatatgctgcaaattctctgaggcaatatgcttctttataatactattcttgagctcctggtaaaagttgccagttctccctgacccctccccctccccctcccgccagatgctttctctcctaaaatctaacagctgactggtgtcttgtttatgttttacttttgttatttatttctgccctttaatgctgtactgaacaggagccatgagaagcaaatcagggcacttcagagcttctttcctttgagttcagattttctaggataggaagaactggcaaataaatgaatgagtagactcttgcttttcacctgtctaataaatacatgtttatgtctcttcataatggttcacccttatgaacaagtaatcatttaaagtttaattttaatgtacacatcagagatggagacatggaattgtttaggcttttctctcaatctgtctccctctttgattttcaagataaagcaaattaattaatgtgcacttttcaattgaagaaatgattaagacccagctgtgtgtgtgaaattataagttacagtgcaacacttgggactgattaatactttcttggcatgaagaaaagagacataggtatataatcaaaatggtgttccaaaaagcgtaagttagcagtttgccaaattaactttcaaagacatctaggttactaagtttgacatttctacacacaaatcttaaatgattgatggattactgtaaaatagctttgttcaaaaaagataatctttggcaggtacttcaaagagtttactgctctggaaagatgaaaagaaatcctcattttacattaattttcatgatagagcaatgcttatttgcaatatgcctgagaattaagtgatatttactgtattatgagtcttttttttttttcactgtatccagcagtcccacatgggattgtttttatttccaagatttaggagaatttttctgcacataaagagcttcgtcaagaaaatacagatgggtagaacagtatatctgacatttttattcactacgatttcactgcaaggaagtattgagaccaaaatatatagagatatgactttttaaatcaacaataccgtttcagaatgcagtttcagattctccttgtagtaatcttcagagtgtgaaaggatctgcctacttctctttatagattgtgtgattttatttatttatgcctaagtcactgtagaatgacataagtcaggggtgaatatctcaattaagaagtcaagcaggtaatggaaattagtaaacaggatgagttatagatgtgtgtgtgtgtgtgtgtgtgtgtgtgcgtgcgtgtgtctgtgtacctgtgtgttggaagtggtgccaaagggaaactgtcatttaggtcagtatggcaggtattttgatttttacaaagaagctgaaaaatctagattaatatcagaaatctcctatttttcaatattggcagtcacctcaaatttctgagtgattttgaaggcagagtttcatgactgtgaaatagccatctataaaagcctaaagatggctcaggataaaggaactaaagctctttgttccatattggagaaactttgcaaaagggctcagatgcgtggggaaggaggtagcagtaggtaacgggtacaagttccaaacacaaaaatcaacgaatttaccatgtagaagatgtaaagcagaagcctttttttctctcgaatttatctttcagggtatttcattttatggcattgaacaaagctgacttggaaaaaaatctgttctttactttttggcagggtgaagtagagaaataaagtctccccgctgaactactatgaggtcagaagccttgctgctatatttcacactgctacactttgctggggctggtttcccagaagattctgagccaatcagtatttcgcatggcaactgtaagtacccatggtctcactcagtgtctccctttgagaacattttagcctgaatcagcctagcaaaaaataaaactgaaaaatgaaatagaataggtgacttattagtcctctgtatgtggcaaaggtggctaattcaagtctagtcaaattgataggatgatttttctataactccatcagatgttgttgtggggacacgtgtgaggatttgaaacgcccctcgtaaccctgatgaagtctcagctactacatcgaggctgccgtgttcatgccttaaaatcagctctgtgggagaatatcgctatgatctgggtattggcagtattactcacttttatatataattcatatatccggactgttgcaaaatatgaacaaaaagtaatgaccattttggagtacttcagagaaaaattttttttggacttagaagttacatagttaatagactttggtaaagagaaattaatttatagaggacccattttaactgtttataactttcctttggtctctgcttcattgtcaggagtagatactaacatgattaagaattcagctgtctcctcaaaagaggagagtcctgcctatgtgttggatggaacattcaatttaccacttttttttcatgcccttcaaaaggcttaagtattttattacagtaaaaatgtaagagagcatttttttcctaaatatctcttttcatagtaatgaccccaaaacaaacactgagtgagccatacaaaggtgtctaacattaatatgcaatactaaggagatccaaatatgcccagtgttcagctgttctttctgggttggaagaaaatgaggtagcaaaactgacacacaaaacaattagagtccagagtcaaagggcattattaagaccaaatgtgtagttcaagttcatcattcctgaaatagcagagtccacctaactcaaggttccaaacttaataaacatttatttatttccatttgaggtaagttttctgtcttggatgcccgagtatagaagggactccagggcagggcgcggtggcttacgcctgtaatcccagcactttgggaggccgaggtgggcggatcatgaggtcagaggatggagaccatcctggccaacatggtgaaacctgtctctactaaaatacaaaagaaaaaaaaatcagctgggcatggtggtgcatgcctgtagttccagctacaggaggctgaggcagcggaataccttgaactggggaggcggagagtgtagtaagccgagatcacaccactgcactccagccttatgacagagcgagactctgtctcaaaaaaaaaaaagaagggactccagcccaaatggactactgtaagccacccttcagtgatcactcaaatccatgatcgtagagacatttgagttgttttagcaatctccttgatgaatgggtacatgaaatttcaaagcagtggaagggaaagcacaagattgtcttataccaagctcccttgtaaataaaatatagtaaggctcctgataagatacccactgtgagtaatggtcagatactacaagggtgtaaagtgagggtcgaagcataaatctgtgaatggttttctagtcatcatttacacccccacccctctccagaaaacaagtgccttttaaatgtggctcatctttctttcctcctgagtttgtctggaggctcgccagtgctctggagatcgtaggtgtaaaggcagagatgttgagatgtaggtatttttaaaggccagatctcaatacagattggccactctcagccaaagagaagtgtaggaaaagagaaatatgctcattgactcaccaagtcagggaaaatttcagatcacctgactggctacactcagtttgaccctgtcctgtcaaagcccacatctctgtgaaattgttagccaattgcttaactcaagggtgaacttcccacagttcctagaatgccaaccaacctctcaggggctgccttcaatagtggattattccaactggacgcctgtggagactgtatttttcttctggctcctggacaagggctctcgcctccagaccacattgcatttgtggtgattgatgggaaggctgctttgaaatagttttgtcccgagacaagatctttggcagactgccccctcaggcttagctctacagaagatgaaaagaaaactgtggaagaaaagagcaccttcatgcaaagggttcactagcgagttgagccctgagaaagagagacaaatcaaaaattgtgacacttagaaatataaatccaggcttataattatctagaaatgaaagtgtaacttgatgaaccttaaggagcactcttctatcatatttcctaaaataacagactcatatggaaatggaaaatggtggcatggtctgacttaaacacgggtttcttttgtgacctgtctccctcccctccctaccctgtcaattcctggcttgatttgcttttcctttcttgccccatctcctcttttcacagatacaaaacagtatccggtgtttgtgggccacaagccaggacggaacaccacacagaggcacaggctggacatccagatgattatgatcatgaacggaaccctctacattgctgctaggtaaggggccttttccccatgtctgccttgagagtgtccaaaagcccaaggtcctaaatttaccagctatgcattatttttaagatcttgaggtttctaaatagagtgttatttaacttaaagcctcctttaatttatcaagcaatcattatttcaaaattgtctgtgtctgtttaaccctatgtggatttaaatagaaataatagcatatttgggcacttacactcaaataatccactgtttatcttgaacatatatgcaaatatttattcaagcacccattagaatgctctgctccttaatactctgtttgtttgtttgagatggagttttcgttctttgttgcccaggctggagtgcagtggtgtaatctcagctcactgaagcctccctctcctgggttcaagcaattctcttgcctcagcctcccaagtagctgttgtaacaggcatgcaccaccacgcctggctaatttggtatttttagtagagacagggtttcactatgttggtcaggctggtcttgaactcctgacctcaggtgattcacccacctcggcctcccaaagtgctgggattacaggcatgaaccacttcatctggcctaatacttatttgttaaattaaggtgaatgtgtaaacatgtattatatagtgtgaatgtaggtgtgtgcattaaacctatttgtatttttgcagttaacatatatatcattgataatctatatcatcactttgaaagaacggcaatgacaaccaaagaaagcattatatatatttcagaaggtttttatttggttttagtaaaaaaaaaatactcatccattggggaaatgttatttagacagacaggctgatgtcttaaggctgaatggcatggtaagaatacggctcaaacagggatcacataaatttaggcttttgttataattctgctcttaatttagccggaccacaagttgtctggccataagtatcctctgccaaatgagatgttgtatttgattaccttaatgaagtccctaaggagtccaacaatatatgatcctccattttgggagtgtgtagctattcaaaataattccaaatgaacagcaacatggagcactatcttgtagtgtcccctgtggtctttcctggctctacactgtttaatcatttcacactggggagaagaaatgaagattatgcttttttttgagacagggtttcactcccatcgtccaggctggagtgcagtggcgcgatctcagctcactgcaacctcctcccccgcaccagggttaaagcaattctcctgcctcagcctcctgagtagctgggactacaggtgcccgccaccacgcccagctaatttttgtatttttagtagagatggggttccaccatgttagccaggctggtctcaaactcctgaccttcaagtggtccacccgcctcgacctctcaaagtgccggaattacaggtgtgagccaccatgcccggtctagaattggagatcgtttctatctggcataaggaaagaacaagtaaataacagtggttgattcttctaaagcacttagatgttctgaggtgataagctgtgcaacataaagttaaaaaaaaaaggggctagactaaaacatcctgaaactgcccctaacttggctacaggaagcaatgtccaaatactttcctaaagttttactttacaaatacttatacagtatatacaactagtatgctctgcacatacaattcacaaacatagctgtagattctttatgaatgtcaattcatccaatcctggaaacaaccctacaagaaggagctattattattcccatgtcttataggaggaatccaagggacagataggtgaaatgatggggccaaaatgacagaggcaggatttgaaccaggatggtctcgctctagagtccatgctgtcattccctgtactatgctgcatactgaggaatagagctggtactgtttgtcctgagaatacccttgtaatagctgttgcccaagaacatggtcattatgagtagccattataaagcatttccataagatgctcagtagtcacctctctgatagaataccagctccttcttagatgtcatttttattttcctaaacgtaatagggttggaaaatgacatactcaattatctaagggctgatcaaaacaaatgataaaacattgaatctgtgagaaataggttgacttaagaatctcttgtgaattgttcactttccagttgagtttccgggggaaaaaatggtataacagactgcccttgtactcgatgatttagcagggcgtggaccataggtcccagggctacatgagtgttaggagcaaggtactatgcagacttaaaagtgaccattagtctagctcattaaaaccaagacagttttattctaactcctcaccccaaggaaggaaaggaaaagaaggataaaaagaagaaacacactaatatttgaaactatcaaataagctcatctttactaaaggtcaagtttgtatcactgtagcattgacatgtttgttttcacaccatacgcagccacttcctctcaacagacaaccttagaaaaattcttaaaggagttccatgcccaccatatttaggacctcttctctccttttaattttacactttatttttacacttccaactttaattcactttaattttacacttctcaacattgctctgagagatctaggtttctaggcagcaagtaacacgatttaaagctaaatccctccccgcaccccaccccccggccaacccccgcccgcccaggttcaagccatggcaacacaattcagtggtgcttgctggagggggaagaggaagtcctaggattaagtcagtttatgttcaaataacttaattcaggaagaacagcatatgagacctgggatgtacactaagatggttgggaatgacccctgaccctggtctgtggtttaccataaagcaccatttttatttgctagggccatgtgagcttttggatattgaaaaagattgtcattgtccaaaagaagatttcattcacagaattctgtgtttaaaaggcttcccagttcttctagacaattgctgtcagcaatcgcaagccaagtcccatccagaacccgggggactgagtgagggttggtggcaagaacccctttcaattctgctttattattatccactttgtaaattcctcttcttttttaatctctaaactgctaattaacataaacaggccatgccaaaagggggcaatctgagagctttctgaggagctgccaatgcatattaatcagttgttcatttacaattcatatgttcagctcaaacttaagttctgaggggaggcaggcaaggaaaagcctcgagtcatctcaaacctgatagcaaagtaataggcaattccattccaataatgagtctgaccacagcaccaccaataaagtgaagcaagtaataaacaaatgcaataaaactgccttgaaattaaagggcagggtgattctggcagcctactgaagtttgaagaaacttgcctattcagcaatttacaaaacaggcccctactcctccaccccttaccacgcccttccacccccttccaccccctccccccatgcacactcacagtagctggcaagggaattttctaagccaactgcccttcccgctcgttttatattcacgtgagtcggcctgttatctttctctgttgtatttttcctaaaacaaaaagcaaacagatttcccatgaactgaaaaaaattatatatatgtatatgtgaatcctgcaaataattcctttcttatcacctccccgctctttcttttaagtaacgaggggacttaaaagtctgtatgggagacgaggtcctggtttaaagctgtgggtaatttttcagccccaggacttcctgcattttagagaaagtcaatgttatttcaagggaaaatgagctgttttgctttccctcagtagccccccatctcctctgttgagtgtagttcttttcttttctttcttacaaattccagacaaaaacgcccttgtactcagctcacacagaaggggatgtttaaatatagccccacacctgagctgctgattctctttctccccttccaaggctagattggcagcaaattgtaaagacaacccaattctcagcaaaacaggaaggtgaacagaagcaagaaatgtaaactttagcttaagtacattttagactttaattgaccatcattatgagggaaaagagtggcttctggaaataattttacctttgtcgtcatccatcctgtcgatcaaatagtcacagttaagatggaaatatattttcaaaagagagagggcgatggagatcattttttttgttagccctcttgatgaacagatgtggcatgttgaataccaagtatttggtacgtgtatttgaagataatgaaagggcacacgaatccatctgtgttctagtctttgggccaatttaactttcagagccctcccttctgagctacatatatgcagatgctatagttctagtgtcagagagaagagctaatacaggaaagttttcataaacggtgttccttggagcacaatgccatgatttatcagaaggtgctaaatgggatccggagacatctcttgaaggctgcgctcttttcttcttgcatgtggatatcatgaacatggatatgggcttatctgccctgataagacataactcattaagcagaaaatgaactgttttgactctgtgtttgaccttgtattaatttttctttgcctatagggaccatatttatactgttgatatagacacatcacacacggaagaaatttattgtagcaaagtaagttgttttaaaactatatttgtaaaatgaaggacctttggatagttcttgaacagaatatgtattttaagtgcattaagatgatgtagctaatcataatttagagatgccaacatgcattttgtgaaatcctaattagggaataggttaggatttgatacatgttcagaaacagttatgtacttcatattttattcatcaaatatatgtgtacatatacattttgaagttttacataatttctacatttcttttataaaaatattgcctcatttatccaggaaaacatcagttttcataagtaaaattttgttccacaaatgtattctacaaaggtttcaatgttatatttccatgtcttgcagtattaagtttgatttgactgctgtggttcaggaacttgatcgttacccatttcagacagacataaagtataacctaagctttcctcataactccacatggggatattttagttaataaaacctgtgccataggagtagaagatcccttcagtccattaatctatgtgaaggagtataacctgaattaaatctttgtccacctagagtgaatgtcctctttatgtttaagaaaatgacttctgtattttaagaaaaaagccttctttataaaaattgatttatcaactgaaaggaaagggcaaggacatatattttatccaaatgagcataatttggcaaattaatttggatagtttatgaaaaatttccacactcttgtttattcttctttcttttctccttcatctttatctcaaacagaagaagaccattttgtggtttaatgaatagataggagttcaaaattaaacggacgttttcatctggaatcttttgttgttacggtgaattaatcatggagaaagggtgcagaaagctttcaataaatatatgttcagcctttagtctccccaagggaactcttacttctaaaatcaaacgcaacaacctctgggctctaattgatttctttcttgatccctgcagaaactgacatggaaatctagacaggccgatgtagacacatgcagaatgaagggaaaacataaggtaggcaattttcatttctcctgcagctgccactttgggttaagtttttgactgttatctccagccatagaccgtgatgtagaatggattgtgctttttcctttttccctcagtaattgcttttttcatcaacttactgaaggctttaatttgcaaaaatagtttgcttttaatgtgatgaaacattacaacagctgctaggcctgcatcatgaactacttaggcgcacacaggattatggacacaaagccggctgcccagagtcttgtcttctgagtgtacgccgatgcccacctccgcagtccaaggcccacagggagtctgtggaagagctcataaaaggctgccgcagacatgcagggttttgtgcctgtggtcatataacaacataaaaacacacttcaaccagcagctttgtacatcagggaacgctggagcatctggcattaaaattaatatgatgggaggttggcatttccaggcttgccttccttttgtgacataaaataaacacacaatcttccattctatgctttgtttttatttacgttgaaagagtaatcgttgatgtcggcatcatcttgtggttaacatcaggaagaacttgaacttttaatgggagaagtcctcagccacctccactttaaccttactgtcagccaaccatggcatacagtgaagaatcagtttctgtactgaatggacatgatacaaaacagtttgaattatttttcaggatgagtgccacaactttattaaagttcttctaaagaaaaacgatgatgcattgtttgtctgtggaactaatgccttcaacccttcctgcagaaactataaggtaaatgctatttgtcagttggaaccacactgccaggaggcatttcataatttactgtgattgtacctgcagcaacctaagaggggtaattcaacaccacctgagttcctctcacttgttcaacttaatgtattgctccacatgagtgatcctaagcaggcttctaagcttcctgtttgttcaggattgattgacacatctttaaagagcctgcctagcaaagttagtttctgtaagacccttttctctattgttcagaagactgacatacttaccacgtacaccatgtggatttcctctattttttttctccctcccaccccactatctaacctctgagcacaaaagcacacttatatggtgagtgatttctattctaaaaggtatctcaaaagcacggcatttgaaaccgtagactttcctacaagaacacaggaatttaattccattgagcactcagctttcttgaccatcggccttgcttactttggctttatgcaagggctggaaaaagccctcttaaagagttagtaaatctagctggttttgatgcagctaacagaggtgctgatgaaggagcagggacctcgccaggcctggaagcagaggtggcagtgatctgaggtcttggctgcaccactgttagccttccttgtacatctttctgccagcctttgtctcaggaaacatgtactgtgtttctactgtggcccatcgctgaggttgtaaagacagacaggaggcctcaacccttagggaagccaggcagggagaagaaaacaacaatttcatggggttgctgccatggtgacatcatgcaatggattatggaagcacaacacaaaagttcctgccatgcatgaggtgaggagtctgggaaagcttcagaggatgaccccgtgtcttcaaactttcctacctgttgttctcacatcgggaacacaaataccaccgcccttaagaaacacaggctctacaagggcagggatcacatctgtgattctccagaacctaacatagtgcctcccaaacaggcgtttaattaatttttgtaaagcattgaatgaggcaatgcctaacctttgtcttaaagggtaaggagaagttagccaaatgaaggaagaaaagcattccagttagcagggaacagcatgaacaaaggcatggagtaagaaatggcctattgagcttgagaaatctcatttgattctgaattgtgtgactgtgaaatgacaagtgttaacagaaaaaactggagatgtagatagccccagggatgaagggaagagaatagataaaaccaaaccggtaggatttaataatagataagcacaggataaagagagagagaggtgagtcaagaatgactgctaggccatctcttggcgagtagatggatggggctgccaccaattcagacaggaaataaaggaagagttgtgagattggggttgggggttgggggagtgtgaaggtatgggctccattttgcacagtatgagaatgccaagcactgtgaacggcactgcctataggacatgaatagagctatctagcaagaagatggatcagtaagctttggtttagagacagatgtggagagaaatatagatttgggtttcatcatcataaagtgaaaccctaggagtgggaagaatgagaaaagcaatgataggctggaatcagcaccaacaagctcaccagaaaaaccccctgtctttttttggcatgtacagtgaagggagggtctgtttgaccctcatacttatcttccatcttacacttggaaatgggcaccaacagggccaggattagggtggagcaagtgaggcatgtggctcaggcacaaaatagaagggttcaccaaaaaattccgtaattaagatgttagatttttaatgcaatattttttaaaaatcaaaattaattaatacatacaggtctgtcataaaccaaagatcaagtttttaagtataaagacaagattcatcagtttataatagaggtagccagtctagcccagcatttactctagctagtgacagcatacagataaggtttcaactttaatttaccacttaatattccatccctgtttgtcattgtttaggactcattaagattaatgcttctaacaaatcccaaggaattccctagatggaaagctatcttttatgacaaagtacaggttttcttggcacagtaatatacaggccatgaatggtctggcttattcttcctgtacatgttccatttcccatgattctacacttataataatgccgtcacctcttgcttgttcttgccacacctgctgagacatgctccagtagcccaggcctctcagaagccacagatgggatgttgctcatgctcagttcccaacaatatgcctagcgctgtgaatggtagtaagaacccttggcattgctcagaaaagtgtatttttagactcaggggacagtgtgacattgctgatgatatgggacataatgtatttggctgcagggaaaacgacagcttctgtcttaagtgctttttatcaacagatcaggacaaaggttcaaagtgaaaacaatgaccagtcttccagtgaaaaacccaagtcttatcatagcacacaagcatcaagttgattagagtgacatgaagcaagagagtgacaaattttcagtatctgcctctctaccatgccctgatctatattaatttttataacacaagtaagctgaatgtgttagaaaggttatagccccaaattagattatcaagattatctaggggagagctttgaaggctacccactataaatctaaaactgcactccctgcctttttcctcctattctctaaaccttttgaacttctgcaaaaatcaggctgggtctttgtataattatctgtacctgatagctgtttaacttcccaggagctgctgctgtgaagtctaagatttgatgactgcttcaagggttagttttcacttcttggaaagaggaagtcaccatggcttttgcctctggacctttccaacctcacaaaccgaaacatttgtacttcactacttcttgcctttgaccagctataggtatagccactttttttttttttttaggttagttacattataaagaaaaccatataccccttgtctattgtttcctcattgctaggattagagcgtgcacagcttaggataagggcatttccgttgcatcactgtgtgctaagcatcatttttgaatacatgccagacccacagaccacagagtctgtcagagttcaacaaaaagctcttggttggtataaaatatctgaaaaggactttcataaaaaaatgtgctgggtggaagagtacactgcttgaaagaatgtctgatttgaccatctttcccctaaaaatatgtttttaacacagctattttatgtgattctcaactacagtttaaaagtggcttcaacagggtccatctcaaagtgattacagattacaaaaggcctgtcacatcctggaaattatttctgagggtttagggcaaaagaaaaggttgttgtttgtaattaagtctgattatttcatttagatggatacattggaaccattcggggatgaattcagcggaatggccagatgcccatatgatgccaaacatgccaacgttgcactgtttgcaggtaagcgacctgatttctcctcgttgcatttgcttttgcttgtttcatcctgtcactgtgaatctgctctagaggattcatggagtcacagttgtgctttgattctctggtgaatactgtaattaagaatgcctttctgtttgaaattagtatgaaaattgtacttttgcaagtctttgcttcacttacccatgtgtttgtgccttcaggaaaggataacagcatagcgctgaacatgtgatggatcagttagggaatgtttgggctcaaataatagaaaatcccacctcaaaccaccaatgtaaaaaaaaaaattaaatttaaaatcccctactgatgtgcctttattgtttaaggtaggatggactttgggattggctaggttcaacaactcaacagtgtcatccgggaggcagctccttttcattcccatgctctatgtcgacctcatgatgagactggtggttctcacagtcagaggatgactgccagccccaattagggctacatgtcttcctgtccacatatagaaaagaaagggaaagaaacaaaaggaagcctctggaagctctctcagagcaatgaggccacatacccccaagcttccaacaaacatcttctcaaatatcattgacctgattaggttacacacccatctctgaccaaaagactatggtgggtgaggggagggtgctaattgcttaggctgacctctactccccaacactactccttctttccactgcaaaagatataaagaaatagcaaacagaccatcattttcagatgtagtgggatttttgtgtatgagtttgtgtgctttaattagaaatttatttaggaattcattaccagctgtgtatgtggaggtgggtgtaagagaagtgttggtataatagtgattcttatagcttgtaataaagcagttagctataatttccatcacaacagctaaaaactggcacatactagctggatgagggaccctagggctttgattatgaaacaagattagttcctggcttcctgaacctctccctcagtgtcattcatttgtgggcctggatctgcagtgatagattgtcaagttaagaagggcaggttcctcgggttctccccctaaatgagagcacaggattactgagaagcagttccgtcaagaatacaaagtcttgtagacctatttgtaaggtatgagcaaggctagtggaaagagtacttgagcatactcccaagtacatgactactgctggaggtcctcactgacacttggaacctgcattagttggggccttggagaatgtgggctgcaggggagaatttaaatttaactgtagggccaggagtggtagctctcacctgtaatcccagcactgtaggaggccaaggcggggctataggaatatagaatacatattctatagtcttatataaagaatgtctttatgacctggggctcaaaatccataagaaaagttatgattcgtagatattttttgggccaatttaaaggtttgctctctgcagtttaaatctaccaaaacttattgatatatagctgttaatattgcagatattaagacatctctaaattgaacctggacaaattttaattattttaagaccaaagacagacatcgagatctttgtttaaatatatttggatatgagtttttttaaaacaaacaaaacaataaaccattatgtttacactacatataaaagagcttgaacagtactatgttgtatgtaagtcactttgacatacaactaatgaatatctgcaatccactaaaagtgaatcacggaagtaatttttttattttgaatataattcttgtttccatgtaatcaacatagattttgctattctagaacaccccttttgattatttgttggcagagtgtttgctgagccaggaaggaaccaaaaaggtctagagactaatcttcagtctgctttattctcttatgcctgggatctaccctcaatcgtatctcccccaaagcatgaattactaaagaaagacctatttgaactcagcgtaaccccttcccctttcttcttggctttagccaagctgtgtttcggaatgtttttagtttgtgactttggagatgcggaagcaaatacctgttattgaaaccagattgcgagggtttagtgaactgtcaagcctgaggtcaagaggagctgttactctcaggacagtagcaatttagtcagcccgtttttgcttatgaaccctctctcttcaacttctctcacctgatcaggctgaggacttctttacttatgcatgtgcctaaaatttctggggacacaatcagcatctatctttccctgggctctcacctaatccagtttaccatggtgtggtggcagtagtagtgtccaaggatccttggccttgaggtttcagtcaaggtccagctaatcaagtgaagcagacatctttcatctaccctgttccctgagctgctgctgctgctgccgcttaaaaaaaattgccatgcaattttaaaatgaaaaatgtttcatctctcatgatcccaatttaaaatggttaggaatgtgggccaagagttttcccagcgactcttggatttttcccagttgtgctatctcatttgcctgatgttggaaagcaatctaggggatgtctttattattcctccacccccactgacttgctcccaccctgttcacctcttttctttttcttctaagatggaaaactatactcagccacagtgactgacttccttgccattgacgcagtcatttaccggagtcttggagaaagccctaccctgcggaccgtcaagcacgattcaaaatggttgaaaggtgaacaaacaattaaaagaaggagggtcggaggggaggggaatacacatcttgtgggagatttagagtctggagggaccagactgtatcttcatttgagtaatggcttctgacagacagaaacatgtaaattgcatctttggcttcaactgatttatttacctcccttttttccttcccctgagtttctggagtattaacaaaactaccaatgccacaacaatagaatacattacattcatgttttcttgcttcaagctctcatttctgagttctgcatgaaaagaactgaacaatgtattcatggaaggggacaggggcttggaggtggtggagaagaggagaaaagctattcacaaccctgtatgagtcagggtgacaaggcaatgtatacaaaatcttctctgtaataggggcattccattgtggaaaataaaattacagagatatgcaaaattccatatttcttcattgttgattgcaaagcttctgaaagagataatgtgtaagtgtgaatgccttgtgaaatcaccagcacttgcatgtgtgaagtcatttgaaatggttagtgttaaccaaatgtctaatggtgctacacttttaattaataacatgtctttggctacacttgattgaaattctgttaactctgtttgacatgttcccaattaaagtgcctgtttgtctacagaaccatactttgttcaagccgtggattacggagattatatctacttcttcttcagggaaatagcagtggagtataacaccatgggaaaggtaagaggggatgctgtccttggctcagtttgtaacattttcagaaacccacacctttggtcaaatgttgttataaatgatcttgaaatgagagccataaatctaataacagagtgcggtctggaggccctatctgctgtttcagaacagtaacgaaatcgcaggaaatttcttaagtatttctatggaaaatttatgtttggttggtttcatgctgagattcaagtatcttttttttctttttgagacggagtcttactcagttgcccaggctggagtgcagtggtacaatctcggctctctgcaacctctacctcccgggttcaagtgattctcctgcctcagcctcccgagtagctgggattacaggcatgcgccaccgtgcccagctaatttttttatttttagtagagacagggtttcgccatgttggcagggtggtctcgaactcctgacctcaagtaatttcacctgctgcagcctcccaaaatgctgggattacagacatgagcctccgcacctggcccgagattcaagtgtcttgagatgtggtttccaggtatactcaacagttttgttttttttttcttaattgagttgctccacagagactgtaactatgcagtatctttaatcaaattgagttttgatttttgtctttattgcaaaaagcaatatacaacacttaggggatgtccattttagttctttttaccagagagtagatcaaggtccctaagttggagggtaacatagaatgccagggtggcttgcacagattcagggcccagaggcagctagtgaggatggcagagattgtgcatacaaagtgtgcttttgtttgaggaaataaaaagctaagcagtctgtatggaaatgactttatgtggctcggagctgattccctgaaggatttatgactctgtattaaatgccacagccttatcttttaaaacatgctactctaatgctgagttttcctctttttttcttttctttcttttttttttttgttactgattttagaaacagtattaagcaccttgttgttttgtttctgttttcaaggaatgcagattctactaagatctccttgcaaaatgaatgcatttaattttccctatgtgtttttcctctgcaggtagttttcccaagagtggctcaggtttgtaagaatgatatgggaggatctcaaagagtcctggagaaacagtggacgtcgttcctgaaggcgcgcttgaactgctcagttcctggagactctcatttttatttcaacattctccaggcagttacagatgtgattcgtatcaacgggcgtgatgttgtcctggcaacgttttctacaccttataacaggtaatcatgccctagctgtgttgacctcatcaattcttcctggcttccttctcccagggggttctcttctaataaaccatatttgcaactgactgaaaattgcattcattgtgtgtagctaagaagcacttaacacttagttttcatcaacaaattaaaagtagtttataagcactattaagttaggttttaggggaagtaattagataaattatgacaatatcttctatttatataagcctggtatataaacactttttatgtgttatttataaatccttctagtaatcctagaaactagataatattgtcttctttttccacttaaggaaagtgagctcgacatattatactacctggtctaagtagtcagtagatggaagaggcagtttggaactcaagaatgttcgtcctgtctcttctaggtcatctaataatttgcagtatttgacttttaatattctcatgacgggatcagtaccttttgaagttaaaacattggaaatgtattaaattgctacagggtgaaatctaggattcaagataaaggactttggttattaacctgtccaacaaagccacccttgggcaagctcactcaccaagttgggccacaacccagaccccaaccacagcaccagaatctgactctggaaggctctagtgagaatttataaatcatcaaacattgtacctacaaattatgagtgtcagcctagtcactcctatttttgtatttacttaaaactaagactttgagcaactaaatgatgcactggtaattgttcctagagcagtgaaaatgtgtatagaacagaaggaagataagcattagtgtttttccttagtactcagctctctgttaagccaacaagatttcagagtcctcgtattgttgtgtgaaaatgatcctaacagtgtgcatggtcgtgaaatctaaattcatgcactgtgttctcatttctgtgcagaattttgggtgttctgtattgagtatgttcctctagtaatactgttttgctttgaattataaaactttttacaaaaacttttaagaacttgatgagtgcctaaatgacaggcaccaaaatgataaaactaaaggataacatctagaaagaaatgcttaagaacagagcaaacttcatgaaggatgaaatcatgttcctcaattatacagcggatgagagtcaagctccccactgaaaataatatgaaaatacgaacccgtattgcaccaagaagtattcagttagatataagtaagctttaaacatctgtagggatttttagacttgtggataaaaacgatatttaaaaattcaggcttttattgctcatacatcagagcctatctctctaggattttgaaaaagtatactgtcttggcacatggaaatgcaggggctaccggaatctaagaccagttctagttttctagtttctgttttgttttgtttgttttgtcttgttttttaagggtgtgggttactttgtgattacaatatagtagtaagcccttaaatattatagataactccatttacagtattttcttaaacggcccctaagaaatatccacttagtgcatgattatgcagtctcagaaatcatatttgtttggtaatctgtacccacctaaaaatatacatacccattgtcatctataaattatagtccctctgttttcactttctctggtttcatccctctacttcatgctttacacatgcaaacttggtcatgtcaaattgtttcaaatccatttgccctgaggataaagccctagctctctggcatgacacacaagcccccacagggtctggccccatttccttctctagttcatcccctcccatcctctgccatgcagcctgtgccatgggctgatcggagcaaagatctgctccttgaatgtgccatgctttgctcattcattgctttctgcgagatttgcccacctgaccaacatctgcccactaaaaccctgcgggtacttcaaatgtcagctagtcacctcctatgggaccttgtgcatacttctttcatactctgctcttaccagaccgtcctgaagatgttgttgttatgatttttgttattattattattattttttttttcctgagacggagtctcgctctgtcacccaggctggagtgcaatgagccatctctactcgctgcaacctccgcctccttgttcaagcaattctccttatttttgtcattattcttatatttgcctccacactgaagtgtgagccaactgagggcaagaccctatgttgtttgtggtgcacttactgccttaagtaggggttctataaacatatgttgaatgaacggaagatgggaaggaatgaaggaaaattgaaaggaaagaaaggaacgaaggagagaaatgtaaggaaggaggaagaaaggatttcacaactgattctaacctcaggaagactacgaaaccctaggatatctttagttattacgaggtgcatcagaaaatacttcaaatagtatttatcctatttttcttaatatataaagaaaatactatatgtaaatgtgttactttccgaaaaggaatatgtgatgagagtgttacgaaatcaaataaataatgcaaaggttctgaaattccaaaacaaatgagaatcactgtcttttttttttttttttttttcttcagacagagtctcactctgtcgcccaggctggagtgcagtggcttagtctcagctcactgcaacctccacttcccaggttcaagcaattctcctgcttcagcctccggagtagctgggattacaggtgcccaccatcatgcctggctaatttttgtatttttagtagagacggggtttcaccatgttggccactctggtcttgaactcatgatctcaagttatccacccacctcagcctcccaaagtgccaggattataggcgtgagccacttcgcccggcctatcactgtcttatacacttaattctgtgaacaacatatgtacatgtataaatttataagcatttaaaatttattttgccaccttattttaaataagcattttaagcttctccctatttcttgctttaagcaattattattaagcaattattattcaataattttcttatgaaattaaagatggaataaattctcctaatcatttatgaagttatttttatatctgttcaacatttgcaaaattcaagacaaaatcattctctctggatgatattccctgccctggatgatgttcccacactgcagggcacccgtgtctcttgtcctgggcgctcttgccatgtaatgacccactatctcaaagcctgattaaaactcttggccagctggtgcctgtaatttatttgatcaaaatcaaggagcaactctagtcaaaaacaaatgtgggtccaaatgtaaactgtgcacccagatgaatgaataattcattccttcccatcattgattaaaaaaagaagcctaagtccttccaggggtgccaggcaaggatataattataggtggagctgatggccattattgttatttatcactttataaagtactttatttgcaaagtgatggcattttagaaacttaaattgtttagtcttacgtaagtaatcaggaaggtaaaaatttaaatgtacagagactaacataaaatttgtgtgggtttccccacaaacatattctcacaccctaagttcttggctcgaaaaaccaaattcaaagaagcaatatgtggacaatgggagagcatttttgtttcaaattttcaccaatattagtgacacagaacgctctccagagacttcagagaggtcattaactgataattagtaccagggaattcatgaaacttctatcactagctcaacaattcttcttttataaataaaatcagttcaagaagcaatgtagacatgaagagtttttttcctctctgtgagcttcctataactaccccattctttaaggcaactgatgcaaatttgattgagagaaatattttctttgtgtactaagatcccttatatttatagtgtccaaggtatgaactttaaatttcatttgctgtaccaggaaagtttctctggagtatgttccaaaccacatgcataaccattgcatgagtaacacttgatgtgaaatatcatgttgtagcatccctgggtctgcagtctgtgcctatgacatgcttgacattgccagtgtttttactgggagattcaaggaacagaagtctcctgattccacctggacaccagttcctgatgaacgagttcctaagcccaggtatgtgcaaatattcatatggctattttaaactttagaaatggcaaagcttgcacctctgataatgaacatcctatgaactgcgcaccagtgccttccatgccagccaagcagattgccttcatctcattaaccaaaacccaaagttaccttctcatatactcaaaccaatgttcctctagtcttctgcttaacctccatatatgttatttatccaacgtaacactacaatggtggaaaccatctgaggtgtcactggcttatagttgggaaaactgaggcctggagaggtaaagggtattgtacaagttcaatagcgggggttgggggtggtgatttccgctgcttctttatgcttcctttcaattttatagagacccatgtctttaaacccaaataaaatatgaaatataaatagtgttttccggatttgtgaccaagctggatcagagctcagtctaggactctagaccgagggtgagaagaatccagcgggtacagtggaccattaagatgtctctggtctgccaggttttggtctgttttgggtccaaatacagtgcagtgtcctcctccccaaatcatggcttagaattcttttcatgggatactatggtccagaggcaacccagagacctctcagtcctatgtagtctcttcccaaacaggctaattcatcctaactgggacaggagggaagtccccgctaagccctttgcgtgcctctcttctgtggcacgcactcacacctccattgcagcatttgcactccaagtttcatagaaacaacccatggtgtctgtcttccccaggagttgtgtgcctctggaaggaagcccaatgtcttactaatttttttgtttttcaactctcttccgcaacctccagtcctccccacaacatacctagccaagtacacttacatgaactaacttagataatacgaaccacttaaacccagaggagaaactcatccatcttcattacctgaattatctggcatgttgatattctgttacttatggagagcagactaggtgtgaaaagcacaccccagcaacctcagacagatagtcttaagtcattgcctgggattgttaactaccttctagatagttctagatagttccttctagcaggaaggggagttcagcctgagggatcaggtttcagtaagttcttatgtaataccctctccttggtatgtaaagatggtgtcactcaaccaatactagcacacatactttaagtgattttctactaatggcagtgagtttaattaaacatccttccacatgcctgcctcgtccctcttgcagcagtcaggatgctctacggggctggctgggttagtgccttgagacagtgtggacataggagtggttcatgctggtgtcgtgagggtccaatctcctcttctgcaccacccaggcaaaccaggtgtctggacaagatgggtttcagtgtttccctaatctgactttgctgggatgacccttgactcctgaaaccatagaatttcttgtagaagcaaatttttatggtcgtcattcaatgacaagaaatgacctttcaggaaagaatctgatataattggcttttcatacctgccaaaatcaaacaaaaataaaaacaacaataagaaacaaaaccaaaatgttctctgagcgagccccaggtaatgaaacatgattacacggagtcttgctggcacataccctggtgagttttggagagtcttttctttctacacttgcgaaaacgtcaacctaattctttccctctgtagagtaaatgcatgaggaatctctagcagcctttttggataagtaaaaccatccccgagatatgtgcaaaccacactcactcacttgtttcaagctccatcactgtttactgaggtttgtttgtgcttctgggaggaagccagcctgcccccagctgaggctgaactgtgctggctgaggctcctcagaaatgaggaggcggctcagaggaaatctcagcatattgtgcttggtggcattctgcattgttcaacttcctcctctcaggctgcagtacattctcctccattccagatgcttagagaagcagttcattcaaagaatttgccataaggcagaaaataagctccctccttcctcaccctttgtttcattttaggccaggttgctgtgctggctcatcctccttagaaagatatgcaacctccaatgagttccctgatgataccctgaacttcatcaagacgcacccgctcatggatgaggcagtgccctccatcttcaacaggccatggttcctgagaacaatggtcaggtgggtgtcaaacaaaccgtgtcctgatggatttcctaacttcatctcatgtcggagaaccaatcagtggatcatgctttgaaatgccacaaacatcttctgctatcctgggcattcattcagctgtgaaatggtggccgattggttggataccactaaacccctatacacacattcccagggagaagagttccaatattttcaggctagttggacacatgccagcaattagaggaaggaaatacctttccttctggattagcccattgatccaatctgtgcaaaaatagaggagcagtgaaggagaaccagtgaatggatgtggatacctgattggttggaaatgattacaaaacttgcagcagattccacctgagcatggctcatggattgtttgctgtcacacagagcacagataccacatttgctggtgtgaaggattcatagtttaatattctttttctgaactggtggccaacagcaaagggacagccaattagagatctgtggtagtattaaaaaactcttccttgtatttattcagagcttatttccaagcagttcaacaggctttcccaagtaccatcccactgtggtagccatcaaacaaaatgttaattaactttaccactatttttatactatgactttattaaaacatattaaagcactgtaatagctctggcacacaaaatggaaaccatggtatataacttgcaggagggtctatgttttctggttccagctatggtgcttaggacaactaggtccccatggagtgtcaaatgtccaagggatttcagagaaagcaaattgctagtaggacttatcccaggtatgcccttcacctttagctttaaatggatattgtttggcttgcaggtccttacagtttttagtagtgccattagcaccctacctcctcatccttcagaaagctttccaatcaaacattttgttgatgaaggccttgtatctcagaggaagagtatggagaaatcgcagtcattgcttttcaatgttaaattaaaggttaaatgaatttcttattacttcttaccctcctcataggagacattagtcttttccttgttcatgaaggggattattgctaagtggtttcaggtggttttggctattatagtacttggcctgcaaacacacacacacacacacacacacacacactctctcacacctccttcctcccctttggagccacactagtgctctgcaaatggaaataaagggccagaaccacttgagaacattatttatatgcatatatttttcttgaggttattactagaaggctatctcgcagctgtttgaagtggaacagggaacactttaatgatagaccaacaaagagataagaaatgtggtcctgtcattttagataccgccttaccaaaattgcagtggacacagctgctgggccatatcagaatcacactgtggtttttctgggatcagagaagggaatcatcttgaagtttttggccagaataggaaatagtggttttctaaatgacagccttttcctggaggagatgagtgtttacaactctgaaaagtaagtggaatatttggttctttcttagtaattatttgttatgctattatggcccctttcattcagagaaaatcatgaccgactgaggttttatgcatttttagatgactttttagtgctgtttgtaaaaatttaacacctaaaaagcattattttctccttgccaatgtgtgtgtgtgtgtttatatagatacatatatgtgtgtgtgtttatatagatacatatacatgtgtgtgtttacgtgtgtgcaagagcagaagggtttgtttgtttcaccgccagttagattaagagattgccttgtgggctgggaagtgggatgtgagggtggggccgagaaaaagagaagagtctattaatgatattatcttgcctgatgaaattagatgcagctatgatggagtcgaagacaaaaggatcatgggcatgcagctggacagagcaagcagctctctgtatgttgcgttctctacctgtgtgataaaggttccccttggccggtgtgaacgacatgggaagtgtaaaaagtatgtattttgcctcattgacaattagaaagtccatggtggctaggaaacagtcctaggtagctcatggtcatcctcttcctgcagaacctgtattgcctccagagacccatattgtggatggataaaggaaggtggtgcctgcagccatttatcacccaacagcaggtaggcagcctgaggtgtgggagagggtgaagtggcttccagccaaggtgtattctagatgtaagatttgctctgctcacacacaccaccacacagctttctgtgcaaactccagcaacgggactgtcagcctttctcctaccctttcccatttcatagagcctcaccacatcacatgtggcagatttccaattgattaatcatcctcggactgattaaaaacacagaatggaaacacagtgggcttcaatgtattccctggagagagagacaagaaggtgcctgccttgatcatcatggtgggagaaaagcagagaaaaggagcaataggataccaattagattagtgagtggtttgtccagccatagcaaaaccggcttttgtaattgactgtgcagggctgagaagaaattgcagaacatttgttaagcaatgtaattgtactgcaagcatggtgtatacatccaataaaccttttcctgcgctgaagaacagttgaccctattactcatcaggccgtcaatcaattcttggcagttctccaacagatcagctagatgaggccagtccaccatgcctatgattttggtgtttaaaattgttaccctggctttaaatgcttagatggcattagctaagaggtttctttttatgcttttacttcagtggatgtgaaatccaaaataaatttgcagaagtattcaatgtttatctttgatgggttgtggcaggcagtttaggaggttagacagcacagatctttcttcaacacagccatatcttcaacctcctcagatccaaagggggaacagaaccatctttaaatcactgtgagcctcccttcctatttcagaatagctaaacaaacagatcaagggcatatctgatgaccactacctgcataatttgaggacaagtactctcgtaaacagagctgatgataactataaaatctgacctagaaatttgactaatgcaaaaggttgagtctctgtatattattagaacagctttgcaagtagcattattgacatgctataatcttagagctttgtacctttgcatgggaaccctcaaggtggaggagaaaggatcacaaagcatggtgaggggagctatgagatgacctatgtcctttctatgttcaacatgtgaccgaaggctataagactgaattttaaaaaattattgttaagtcaatataagaaccccaaaatagtttccttaaggtttgcattcatatttcaatgatgctggcattgcttaaaacatggggcgttccctttggagagtgggctccagggcatgatgaatattggctgtcattaccactagaaatcttcatcttttgagggatttgatttttaatgtggcaaaaaagattagaaaccaaacacggtggattattagatcaagctgtgactttcaaaatagttttcctatacggctcataaataaactctgaaagcagttgcaaaataagagtttcaattatattatgggaatatgtacaaagtgcccccaaaggaaggtgactctggtgtgcttattttaaaaatcaaaatagcttttattaaaattggttttgttaatgtcatgttgcttgtacagcccaatggtgacctagtagacttggaagaaacatgagcatgtcaaagagaatgagagtaatactcccaaggactggggcagggctgggagtgaacaaataaccaagcagtctccacaaaatgcaccaccggctcctgtcccctcacttggacctttgaacactttatcgtccaagtttttggctagataaatgtctaggcaaaaaaccttgcctaggaaggcaagggtaggagtgaaaaagagaatagagaaaaaaagatttttctttttaatttatagacttccatattgtttctatgaggcgtgtattttaacatctaaacttcttaaatgtttaagaaatgctcagagaattagagtaaagaaggatgtaaataatctgcaagctaattatctccctgaataatatctgaattcactgcttaaaccatggcttctctttggagagtcacctaagactcgtttctataaacttcagagataaattttaaagctgttatgtatttcttttttgcacctgccactcaatttatcaaactgtgttactgtctttagtgaagcttgactcatttctgaagactcacgttattgtattcatttctgtctctctttcccttccttttttaaaagactgacttttgagcaggacatagagcgtggcaatacagatggtctgggggactgtcacagtaagtacagtcttttatccatttttatctttgggcaaagatgctttcagtgaatggcctagaaacatcagctcacatgtggaactgagtgcagctgacactaaagcatgcgtaaatgacggaaatcatcttctaaataccaaacaaagaaagcagtgcgttctaaagccagtgttgtcaatgttgtcactataaatgctggcacctatttcattaattctaatgcaggggaaaaaattcaccctagaggatattaattgtagcaaagcagtaagttaaatcagcatttccattacaaaatgacagttttgctgtttttaaaaacatgcttttatactgtcattttccgccaaataataataagattgatcattgtactctagctttttaattgagtgggcctgttttattcttgaacatatcgactaacaaaagcaattatgtttttaaattagatttgtgtctattaccatatgtaataggaaaaaaaatttcagaaataacccacaagtacaaggcaattcaaaataatctttttataggaattggcctactatgtaaatctcagagatagttattaaatggtaacattttagttagaactttacgtaaaggatctggctcaaatttctgcccagttgtcatgtgacccgattaatatcaatattctcctgaaaatgctttattaatgctaatttaaagaataataccatactcttggaaaatatgtttagtttgtgctgtttcgaatgttatatatgctgaatttcaagaagcttgcattcaaaatggcaccaaataatagcttctaagggaatgaagctatattatcctgatatttgattctataacggaagtcacggacataactctaaatctttcagtcatgagtactgaaatttcagactctaaagtgtcattcaactttctaccttatcttttttagagattagttataatcaaataaagagggctaaaggcagacttatctccaaatctttgccatatacatatttttcatttacaaatattatatattggcaaaaattcttattatgtcttacacacaaaattgatgagttaataaataagcataggagaagtgtcatcactaaaagatgtatgttacgtgtgtgcgttcatccgtatcagggaaatagtttgatgtttgatcagtggaccttaatcatcttggtgcattatagctttatttgcaaggaaacaggttttaagatgtgtgtgtgtgtgtgtgtgtgtgtgtgtgtgcatgcgtgcacgctttattaacagcttagttagctgatgttaatgagctattttcatcatatttatattacttgcaatagtggtgtctgtagaaaaataggggtgtagatttggatcaaatcagaaaatacgtgaaacatgtaaagatggttggtactgtgtctataaaatgtccactataccagtaggctcacacccttatctgtgttctcaggcagaagaacctaaggaagcctctgtatgtagcataggggacgctctcaggtcccaaccctgtgctttactctttatttccagagtaatcttagtggtcaagcaagcccctggatctgccttcgtgctttgtagtgtgcctttgacctttaaccccactcttgcggaggcacttgccaagggtgcttgctcggggcaggaggtaaggctgcccctctgcctgcctgcctttgctcatggcttctcctctccccgtgttcctgctgaagcatgaactacctctattagacagacctatccccacataggtattcagggaggatttctctaactggtacaatcattataactggtacaaaattaacaggattttaaagggaaatgaggaaatcacaaagagccagtgttagaggctgagtgaaccagagatctgaccccaacacacagcacacacccagatatgttgcctaatatgtgtaagggtttgttttttgttttaacttccaaactaaaacccctgatgatttcagaacactgtaacactggacagtttctcacagcatggttgtgaggatgaagtaaaaagagaatgtaaagaataagtgttttctttgtaagtgtggtccaggtatcacttatgcatatgcatgtccctctgtataaagaagggtttaaactctcgaagtcacctataattgcagttaccatttcatctgccaactcttgcattttctctgcctcttggcaaaggcagtgacttggaggaaattcacttggtggaagagatatggaggtgagaaatcggactgagtagaaggcatcttacattacacgcagaaattaaaaagcacttacttagtatcggggaccatacgctggcatagttctgtgttagctcattcccacttatgtaagtcgccccaagcagagcgtaaaacattaagtaaccttctcctcccttttgtctttcagattcctttgtggcactgaatggtaaggaagatattactctcataattccatactggtggaaacctatctgagaatgtctatttcattaatcctcttgagtatgttcaaatcttaagtttctttttaattaattttttatcctcatcatttttttatagacatttcaactcctctaccagataatgaaatgtcttacaacacagtgtatggtcagtttacggattttttttttttttttaaattcgtgaagtcattcatccagcagtagtttatagttttcattcctaaacatcatggaccagattctttgttactttagggccccaattcactaaaattatttattaatttcaccgtccttcaaaaattactctgcctatgtgagacaattgatgtgggagactgagtcctaaatttttaatccagataacatgaaatatgccaaccttagggaatttggtgaatacatttaatgagttcttgagggagaagaaattgcttttgaacataagtatatccaagacaaaggaataatgctcctaactgatagactatagctcctcagctgatacagttcaccatcccccaaaatgctggcactcaggacaataccctctgctggcgaaaatctatacaggatacacaggtcaggctcttattagacaaaactttccaatatagtatgaaattggccactgaaatttaagctcaaaaagagtatgaatatttagatatgttttcagtgcgatttcttcagaatgtagacaaggaagagtgacgcagtggaaatgatgtgcaaacaggatttatctcattgttcttggtctgaaatacacaatcactatattaaacaaagctactaagcccataaacagaatattctgaactctttatatgagaagttgaaatggagctgttccatttacatttctcaaggtacccccaaatatttattagggtaaactatccatgtgtttttttaaagtatgatatgaaaaacatccatgtgatggcaaatttaagcctctgcattataatgcaagctgtgagtttcatgtatacacagccattttatagtttgtgtgtttaagatatataatcaagcaacagatccaggacagtctttaagtacagaaataggtaaataagggagggagaaaaataaattttaaaaaagggaaaagaaaagaaacaaaggggaaggaaaagaaagcaatgcaggtttatgatccaaagaaatagttcctgatggctacaaatgtgtttaatagctctttgtaaactctcactccctgtgtcaaattagcatacataaatagcctttttgaatatcttaaagactggcttatacattggagctgtgtaggtatggaaaacagtgcttggtttctcctgactggcctccttgtgaagtaaggcagtgtggagtagataagcccacagaattcatccaactttaatgttccctcatctatgattgaaaccagaatattgaacaccaaagactagaagaaaaattgctcagaaggcaaatgtcacctagttgagactgccttgaggaaaaaaccgcacttagcatctgcttttttccaatatgatactttgcgatcatttcctataattgaatagtcttcatcagattttgagaaattaagatcttgaaacgaattgaaccagcaacctccccagcattcatcaatcataccaagaccaattttaactcccaggtaatttcttaaatagacagaataattaaactatgagatactcttatgaacaaaaatcactacctaagctatgttctctcttatttcctttacaaaaggaaaggtacttacttattaatgcttccgtgttaacactttaagggatgatgctcattcattttcaggtcttgaggcaactaaagaagaggtggaatttttctttcagctaatgatcctatccatttcaggctaaatctattcagtgtgaagcagttagatgattaattgaccatcaaaatgagagctggttcagacagtacttacaaaaatattggcaactttttaaaataaaccattgcaagggatgttaattttggagttaataaacccagaatagatttcactaattcattcggcaaatacttgttgagcaactactgtgtcctaggcactgtactgggcactgtatttgtagcatcgaaagaagaaacaaattgctaattgtatgagcatggatatagacaagaaagccaattccaaagtaaaaagtgcatgcacactgtttctagctgtatcctctgcatgtcctgcactctgtggctgagtgtaggctcatagagccaactacaaaaccagaactgcccaacccaggaaaagggatcatttcaataaacgatgcagagtttctgcttgtcaaaagctctgtatcacaccagttacatatgcaagaatcccttttagtgaattgggccctgattattttccttctctcttcctctcttgtattgatttagtgtctctgttttgtgtctaattgtctacaaacattgttaataggttagagtagtatgaagggtatctaacctctggaattacaatgacttgtagatatagagaaacaatatgatgcattaacgttaactttcaaaatatacctatttatttgtattttatgagaatgataaagcataagctccattgattaaaaggtgacctttcttattggactgataagacaaaaatatagattccaaatctattgacatatgatatcacatccacaaatgtttgcctatttttgtagcattattttggttgcaaagtctcttagggaatgcacaaaaataatacaaccttaaaaatcagactagaagatggaatataagtggtttccttgtaatttttttttaagcttggagaggtaataacacatctttgaattcaaactgaggactgctgcttaatggtgcttttacagggtggttctaaaatttttgagagtcaggtattgctttctctgactgtttaattcaccactggcacgtgtttcctatcctcaagcataagtttaaaagattacaaacctcatgctgctcagttttttctttccagtaaatcagatgcatggtttctctagatttacatatagaaaatcgagatgtggtgggtattagactaacacttcagtgataggaagaagagactgatttctcatatttgtgtaaaacattctcttacctaactaccatctggtccacattaatttcctctcatagccatagctttccattaccaatgagttttccatgtattcacagcatatgggccaggaaatctttctacagagaatgtgtcccttaggcatatatttcccctagattaccgtattaagaaatgttctccctaaaccatacttatggcattaccataaaattgcctcttgaacacagttaaattgaaagtgctcaaaatgcatatcaattcaggtaaaagaaatcttgctacttggaggggaggtattttttattcttccccactttctctttctaactccctacaaagctatttctaattatttgcttatgctgggcactgaattttctcttaggctgaccatatattttattaaagtagtcttgaattcaggagtggaaaaaaaaaagttatgttttagacctcaatgtaagctgaaaggaaataaaggaacttctatatttccatttctcaggctgattttccttcccctgttctcttatctgtatcatgacatgagatgtgaacctcagaaatgtaaaaacaaaaagtctagaataaagcattccttgaattttaaatgaacatgcttttagcagctggatacgaagcagactattttcaacaaattgaatgtttcccacttgtgtgagagccaaacaagtgccatacagaaagggacctcttcaatgttaccaaagctttgtggcagcatttaagtgtggtggctccatagaagtcactatagcatggacgagccacttggcttgctttttcctgctaatcaaagttttaagaagataaaaagctatctttgttatatatgttttgtctaatttgcaatattacagtctcctggggggaaatccaacttccaataataattgtaaaaaaaaaaaagaatgcactgtacttattcttttaatctgtctttctagaggccaatattttatttatcatgtgcatggtgatcatacttcaaggctggagcttttggagttgttgtgagtctgccctactttccaccaaaggcaccaattatacatgcacagtagttgcccttgtatcttttaaaaattgttcaagaggttgttctgtgtaagccaataactccacttgaaaatcacgaggaggtcatattttatttctgccagagagaacaggtatcattgtgccagcttggatcaaagcacctgatacaatctgtatttaaccttgtggaatgatggagggagagcttacaaacgaattcacaggaaatggctagagtttctgctgtaactctcaacctagccattcttctcatattatcctatggtagcttatctgaacctcagaaatctatccttttctaatttgaatcattttagtcaacgcagcctcagaaacggaaaccatctattgaaataatacacaaaagggacagccgtaatagcgtgtagccgttgaagcctccattccaatgaaaagacagtgggaatagatccctttggaaaccactaactaatcccagaaagaggaatgcctgtgaagttgagttgaacctgaagactagacacactgtagaacctccataggaagggtgcagagtaactgagttacttgtgatagggacaagacttacccactaccagaaacctgccccatcggtcacaaatgggattcccagagtggacactttctgtgtttagtgctgccatgggaatatcaaagaaggacactggcctttcttgagcacctatgtgtcagacactgtgcaagatgctttcaccattatgtcactatcctcccaacaccgagaggtatctttatccccactgggtgcacaggaagaggttaagtgattccctgaggcccacccagcaagtatgagagataggatctggcccttcattttctaactacaagttcaatgggctttctgctgaacacaccccacaccaccaccaccaccaccaccaccaccaccactaagccgtgtcatttctagggccatctcctctcagtcttacagccagcttgggtgtcccacctccaggcctctgcgcaaagggaatgtgggtctctctggtgatgttttcctaactgtatttgtgatgaaaacagggcattccagttccctcttgcccagcacaaccacatcagattcgacggctcaagaggggtatgagtctaggggaggaatgctggactggaagcatctgcttgactcacctgacagcacagaccctttgggggcagtgtcttcccataatcaccaagacaagaagggtaaggccttggaaatgcctcttcctctcgggggagagggagggaaaagtggggaggactgtgtaactgcttccagctgaattttggcagcatttaaggaacctccaatgcgctatgattgaaagtttctcgaaaaagactgcaaccccatcctctatgtgaggcttgatcctaaattattctctgaccaaggaaaaaccacacaaaacaaataatatgtcctctgagcttcctctacccgaaaaaggtgtggcttggcccgaagcagatgctggcttctgacatcccttgccactcttcttagtctcattctgtgatttttggaccgtcttttcccaccataatgtgatggaatgcagttcgggctttggcaagtgaatgcaattgaagtaaaggccctgttaatcagtgaattgagaaatagcaggacaaagtcttttctggctggtagcatctctcactgttgcatggtgctgaatttgaatagagccatgttcctcagacgtactgtaattgcccttagaggatagtagctaagacaaaaatatgttatttaatcaagcagaattgctatgcatttacaacggaaaggaagccacactaaatgaaagggactctactgtgaactgtcctaaattctcctttgctttctttgcttagctgcagacaggaaatgtcatctcttttcttgccatttgctgcttctggtaacacatcctactttagttgcagctgcaaccaaagaggcctttacttgtccaaaaaacagtcttgtaaatcagagactgaaaagcccagttatgttgctgagctgtttctccccattcagaattgtttacttctatatgttttcaagagtttcatccaagcgggagtttgagtttcaagggcagagcagccactgtgacccttggaagacagtcgctattgcaccctcccccagagtgttctgcatacatatctccatcttcacttttagacaatgctttccggtcagactctcaggctacattttcatctgcttttttgcttctcatctcctgagagtgctgggcactctgctgctctatttgccaagtcaaaatataaagatggagccccttttgtcttgttcttgagcgtgtcctcttaactgattttattttcttctatagacttcctcttagtaataagccctgactcaaatctttttttttttttttttgagatggagtcttactctgttgcctacgctggagtgcagtggtgcgatctcagctcactgcaacctccgcctcccaagttgaagagattctccctgcctcagcttcccaagtagctgggattataggtgcccgccaccatgcccggctaatttttgtatttttttttttagtagtgacagggttttgccatgttggccaggctggtcttgaactcctgacctcaggtgatccacccgcctcggcttcccaaagtgctgggattacaggcttgagctgctgctcccggccaaatcttttttttttttttttttttttaagctggttttgtctcatctccttctttcagtttgagggattccctgctcttttcatcccgagaaagctccaggtagaagagaaactgtccggacagattacaagccttagcatatgccattatttgttatgtgtggctcctgacctcagatgtgctagtcctgactgtattctcaagaagagaaaactcagtagaaatcactttgtttttgcccactgcgttttttctgaaacaaaataaaacagcctttccaataaagcattaaatatgccaactaaatatctagctgttggttgcagtaattttcttttcatttcactgagaggggtagcgtgaattttctctaatcgttaactccccccaaggaatggaggttctcaaaaagtccatttaacactttgacacatcattttaaaattcggcattgttcattctcttgggtcttattatactgacaaagctggaagcagtctacatattgtcaaacaatggtggcagaggtgactgcatgggtgtttaacatgatcactgttcttgtgctagtaactccttgccttgccctgtcaaatttgagtttcttttctgtgattggttgtatgtttgatggggcaatgccaatgagttgttgtgcagaaattttaaagaaaagatgtagcttaatgttccttttatcatagtttttatgattttaatttccattttgctccaaattgttttttgtttaatgttcatgatttattttcaacttttgtttcattttgccaagcactgtgttatgacttagtgatggcattactccgttggaaaagtcttgttccttttctgactcatgatggcgtcccttaacttgaacgaatctgtgatgccctcgcttcttttcattccctgatgtcggtgccttaatgatgtcacatccgtgtatgcagcatctcccgggatgcaagagtttcatgggttttctaagggcctgtgacgggtgctctttctactgggtcgattgtctcatgagaatgtgacatttgtgtgccccagctttaggagctaaatatactctggaattgtttctaaaatccatcacatttcctcactaagcagaaaatgtgcccgctgaccagctcactgaggagtcaagtgtccattgcccattttattttggccactggtaaaaatgccagtgagcaaggcatgcccatggctctactctgcagatatgctgactgccagtgagctggtcccattctttgtccacttcatcctccaaacaattctccatttccagagtatgtttgctgcgtttttctttcttttccttgctatgtctttcgtcttgatttaatcctgtgcgtccctcacattctgtcgaaacacccttcctcaccttgcagcctaacccccttctgctaccattgttcttagcctccccctttcaaaataacagacccaaaccctctgcccctctgtggaatgttccaaggctctttccttctacaccgtgagtagcattctgatgctgtatgtatatacagtcatactaacaaagcgtgagaagagacctgcacagcacgcggaagcattatcatagaaaatgaagtaattttctctctcagtaactggccttgcccttcattaccctactggccttgtctaatgtctcttgtccttgctgcttttctttaaaattgcctgatatctttcaagccctggattcattagtaaaaacacagccaactgctctgttttatctctggttctctagatgtctggagcctctagagcgagccctttaatcaccaagttgataaatgagatgcagccctgactacttctgtcttggttttgccacattaaaaaatacatattatttattcctcctataactattgaggtcgtaatgggtagttacaaaggggctctaatcacatataaataagaaagaaaatccagtttatttttagatctggcttattctccaccaccgcttcccacagcaaaagaaataagagctttcttttttaggttaaacaatactgagaacaaatagctattcttgtgcctcttattccttaccaaaagtaacaatactttaaagctgatttccaagaagtctatgaggtatgtaaggaaatcagccacatccagagcagccaagagagctgtgtagcatacacataaaatgtaaatgctgaccactgctatgaggacacaagaatatatcctgaatagaataaaaatcccctacttcagactttattttataataaagagttcttgtgagctctcagaaaacagacaaaatagtaaatatagagcagttcccatttaatcagaaatgccagagttgtagtatgcttctatcttttgggaaatctttaaagtgagatattatcacattattacatttagtccagaaaatatgcacattaaagacaagaataagatgtattacagaaacagaatttaaattagagattaagtgaataagctaaaatggatagcaaatgttgaatatattttaatcaatgtacaagctatttgtataagcagtttttagtttgggaaataatattccggtaagattcataagatctataaagatgattagtattgtccacatctcacaatcctaaatggaattttataaatcacagatgttatcaataattctctttatagttaattatttattctttaaatttgcagtagcctacagcagtatttcctccgagggagatgagtagcaccttacatggcatgatttaggtggcagggatgtgatggccttcaagagtattgagtcatgtggtggaaatttatgcccttttcaatgctctttcagtcttctgcgttatcttcttgattatgtgaaaggaaaagtctcagtttggtgttttctcattaacaactccctaaacttgctactatctctttttgacaaagagagaatagggtttacactggggctttgtcttccaactggatctagctggaattaacattgttttgctttaagttaatttttgttttactggttacattttatcgttgaaaagtgacactttttttttatttgtgataatgatatcaagtttccctttgaaatacattttaaaggtaatttaaatagaatattaagtaaataatgcaggagttatgagggatataaaaatactaagtaaataatatggtaggtgagattcattgttatgactaaaattgtagtattggtagttgaatgaccaaagtttaggtgactatgtactgtagcaattgaaggagtccagtgaagattaaactattaccaagaactttgttctgacatttggaagaatgaggtttgatgaccactataccctctcctggctgggcttgcaaaaccaagtgaatacatgcgtcactccaagtgttgtaattatacaatccagtgcccttctgatttctttgctacctactgagctttgtgtttggggatggaaagtttcatgaaatagaaatttaaagtaacatggatttagactaataagaaattagccactctaggcttgttaagcatctggcaagttttttctccacaccagcagcaagcaccctagtgtggtctgccgctagttattactcaaattgtagcctagggaaagttgatgaaaagcctttccacttttcatctattttgctgatatccagaaggactcttgtgctacacagtgttgcccggcctggcaatagcttacccttgacccttctccttttctcccgttcaaactttacctattctaagttccaagccttcagtgtcagctgtctttattaacagactgagaaatctcattttaggtgagtatagttaatcatagatcctaccccctggttactcttacattttaacactctcccatgcttaaaatctaatggatttgggattttaaagcaccctggttctcccaacacagaaggtaattttttggctcctatcaagtcatatgtaagtgattttatggacagagaaaattattcctgatgacagtaataaaggaagaaaaataggcctctcctcttttcctgactcttaaacttgggcttaattttctctgccatttcttcagtaatattaccgttaacaaaaacattttctgaggtgtctcaagcagaatttatcactggctctgtggtgcaatttggatgccaataaagagtaagaggctgtattagagatagacgtagttcctgtccaagaaatatcaaacaccagacagatggaacacaggtagacacaaaagcacaccaaaaggcctttatgaccaacattctctttgtgaaatgccaaaaccacacaccacagactttaaaaaaatatattagacaagtaaagacaacttggctgaacacatcaaggacatagaactgtgaaacagtttttcagctcctttccttcagttctttccctcagtaccaatattgtagcaataacacatcacctgacaaggaagacgaggaaagtgatggatgtttggtaaaagactcatatttaaaatttttgtgggagtgttggcaaactcaggcttttatttaagcctaagctttatttcaagaaaaaaaaaactcatactaatttgcattccttttattagtaaaaatgatcctattgcagtcgtttttaaatgtgagagtagagcaaggcagtttcaaggagacttcagaaaaagggctcctgtcttggggagtactaataatgggagggtaagggttttcacttccactcaacaatggaaaattaactgagtcaggtagaacgtgcatggtcagaggcaaggaacgcgaagagatagtgaattgattgtgacagttccaaaaactcttttgaattagagatcacttatttctgattttgaaggttagaggaaaggcatcttcaaagttcgtaagaaatttggtacataagctggtattgttgctgactatgaaaaatacagttcttaatatttagttcatcagtattttatttataaattgtgctatacacgccccataaagatttatcataatttttattgctctaaacttttagagattaaaaagtttaatttttagagagtaaagatttagcatcatttttattactctaaactgcctgtaatctcagctacttgggaagctgaggcaagggaattacttgaaccagggaggtggaggttgcagtcagccgagatcgtgccactgcattccagcctgggtgacagagggagactttgtctcaaaaaaaaaaaaaaaaagagattaacaattttaatctctgaaagtttgggtgggtttaaagaatatttgtgggagtcatttaaagcacactgtttgggaaaagaagagtagggttgctaggcaaaatacaggatgctcagtttatttgaattgcagatacacctgaataatatttttaatattgaaacaaaactaaataattgttagtgtaaatataccgcaaatattgcataggacatacttttaactaaaacatttttgtttatccgaattaactgagagtacttaaactttttgctacctgacaattctatagaagatgtcactgataacttactcagtgaatatataagatctaatttatatattacatttggcctttaactcttagaagtctagaataatccatattctgatatgtttaagaaaaaatcttattccacgaaaaatattcttagcatacttgagttcagagaatgtctatgaaatattatatatgtgtttgaaatgtgataaagagtaatttaaagattattattgaaaacaggctttcaaatgccactttcaagtaaggaaggctcagaaatcaaattgttcttaaagaggagcatggttaaaactattggttcttttatgttttacttaacctcaaaattttaacagctgttatgttaaccatatgtattcctttttccttcctaaattatatggctgccctcctttttatttttatttttatttttttatcattttcatggctttggaggggtagaactggaattccgaaagcactaaaaaataatagtttaataatgctgacaatctcatctcaaagaaaggcaagacagcaacctttcctttgtttcttttttcctgcattcaacagaaattgaacaaacatgtgctatatgtaaaccttatgctgagtgttacagaagatactaatttgaatttcacataaacctgatattcagacagcttacagtttagtgagggatacccaaaggtgatctaaatgctggggcagagtgaagtctgacagtaagggaagtcaaggaaagagggggagggagagtactaagggagtctaaggggtggcacaactaattccaagtgggggacacaggaaagaccttgcaaagtcttgaaggaaaagttagatttcacaggaggaagggcattccaagctgaataaagtccatgaccaagataccacactgtgaaattacagagtgtaataataaagaggcaaggagtgtgtggtgactaagtgtatggacgactagaatgggaaatgagattgaaatcatagcctggaaccttaaatgccatgccaaggagttttggctttagcaacaggaagtggaggatgggaaggtagacgttgggaagaaaaggaccacaggagggtagaagtggggaaagacaaagatagcaagattgacaggtgatacatatataataaattgttcatttaatcatattaggttattaattacatgtacacaataagtttgggaaatggaattttgcatcaattttggatctgaagtgtctgttactacacatcgctggcattttcctggtagatgcttcttgcctatctagctctatcctaggtaaaaccccaggcaagctgaactccaaacttggacttcttcctctctttagttaaaacagtggggttcagctgagcacggtggcttaattaataatataatccaggatgccactgtttatttttactatattaatatttcttggtcacctacgagaaaaggaatctatatgtagtctccgtcttttctttgagggactgaggaaaatgatattgtgagcaagtcaggtgctgggctctcaaatggatgatgtgggtttccatgtttgaacgtgtgcagggggagagggtccagagccgagaagcccaagtggcaggctgtaattgttctttcagtagtgtgggcatagatgtagatttgatataattaattttgtatccttttgacaacttgctgaatttatctaaggtcttgatgagattattgtggaaagggtagcaggaaaaaaaaagttaaatgtcagccatgtagaaagctgtttcatctctctgcctgcctgaatttgcacacccgtatttgagttttcttttctagggataccactaaccttttattttttaacctaacattcattttctcaaaaaatgaaggacttaaattatgattatggagacttgaacttttgcttttaaaacgccaacttaaaccttagggtattaaaaaaatcaattcaccttctagaggtgcttctcacctttaatctctagccactttttcaagctgcatctacttgacatgacactttacccccacccttttccctcagtctctttttccattctctcccatcttttctacaaaaacacacacaatgacaaagttttctgacagcttaatggaactttcaaggactacggggactaggttaagtgtgatcttattaacagaacatctggagtggttaaaaatttgctctttaattggttcaacggcactgtgttcatctagattttgttttgtcctaacgataaaattgtgaagaatcaattagtagtttgcattatgtggaaaagtgggaaaataatatccgctttgtctcagacctttctttctgatagcctagtttcaccaagttttttttaaaaggcttgttagaagttttactttgcaaacttcactgctccatagacaaactagtccacagagggcaaaacagtggaaatcaggtaatttcctgagaatagcttctcttttcttgacattatacctgagactggcctcaaactacgtagggcttgctcaaactaactacatcacgcatgccattatcctggaaagacagaggatgaaaaaggtgtgttcatttgttggttccagggagatacaggttatgcaagtaatagataaactcttgcaaagtgtatgggcttctctagggactgaaaggagccatgtgaacctcatcatatgtaaatctcttagcactttaaattgtggaaacgccctgaagtatactaccgaaatgtagtggatatattaaaatatactgggtgcacagtagatgggatcttaattggtgtcagaaagccaattacaggcaatgtgaaggtttgtcacccttaattaatatttcttaagctcttataagtctacagcctgacaactatctttgtaaagagattcatttttaatggggtaataaatttttttccactccaattatttttaaatttcatattttttaaaaggatgcattccttttcaaacagatatctgcaattacttcttttttactgaaatcagaggcagtcattatgaacagtatagaaataatggaagttcggtatagtcaaccactgacaatgctttattagaaaggaaaatggtgtcgagaaatttatagggcagcaaactgcattatgcctaaccttttggacgtattaaagcatgtcatttccagtcttacagcctcttgttattcataaataatagatagcactggacacaatcatctgacatttgttaaggtaataaatataccctaagtgctgatgggtctcgcactccatgatttaaaagcacacagcagaaatttaatgtaacttaaaatgtctcatgtaattctatggatttgcagattcagttcaactcagcagatcaataagcacagagctctgttgagtgaactgttgtgctaggcatcttttattattataaagcaggaccttactttggtgaatgacacatgaactcaagtccctcttttcaccccgggaatataaaggagaagaaccttcgtgagtttcttttctctcgtctagtcatgcagagatgaaggtaaagattttggcatcccctaaaccattctcaaacgttgcttaatagctgtaagttgagttgagggagtgggttttgagatgatattagatgcaggcctttaaaggaagccactctgtccaatggtgggctccatcaagcattctgcttcttctgcacttgagaaccagttatgcctgggctgacccaatctaggacatacgtgagctctgtggtaccaaccactatctgatggccacagttacagagatgaggagtattagaaattctcctccaagtcttcctaccagagcaaatagagaccacaagcattgtttcagcagttttggtgcaagcaaattgggttgattcttttgcaggagtagcagcccagtattttgagctatatgccatgcttttgacagatactaagggaaagtgtttgttaggaatttgattgtctttccaataaaacaaggtcgatttctattctttgtcagagcatgatacccacagtaaagaaattatccaatgagaccttagatatgttttctggaatattatttatgttatttcaggacagcatgtctcaagctttagagaacttaagaatcatctggagttctggtttctgggcctaacccagagattctgaggctgaaactttgggcaggacttgaggatttctgtctctaattagttccaggtgatgttaatgctgagtggcactgattcagacattttccacgttgctgatgggctgtcttatttaagttcactagtcaaggttttgttgtagttgtaaatccttatttttacacttttggctaacacagttgaaccctaccaaagtgttgccttaaaatagtctaatcttggaccctgtacaagacaggcaacttgtcaaacattctagaaatactgtccttacattattaattgagcattaacacgttttctgcacaatgccaactgctttgtgttcatttattcaacctatttagtccttccaacaatgctcatcttatagccaacactactggggcctggagaccgagtgacatacccaaagtcacacagttagctatttgtagagccaacacgcaaacccaggtctttatgagctcaaagtgtatgttcttaaccagtaacacccagtctcatctttaacccagatctcaagaactacatttctagaaaattcaagttggaagatttagcagtattgaaacagacctgtttcttcatatctgttttatctttgctttatagagaaaattcaaagcaagtaatcaaataatccaagcaaagacttgcccaaatttcacaattttttaaggaggtccacttctccattttgtggctttgatgccttttgagagagtaaaggaaaaagatgggaccaggaagttggaaaatagaaatgctttgtctggttttagaaatcacttagatgttgtgtttctcgtcttatttaagaaagctgatgaaagaaaacttcaaaaagcaggaaaatacgccttgcagactctgctaaaactttgccaatgtaaaagaatcattacctttacggggacagtaacagttctaacacatgaaaccacaaaccagcattccagggcatggcttttaaaaattatcttatcatgactcttagtctagacatcagcccgtgctctggctgtagcactcccattggcaatgccatttctaaagcagtagagcagtggaggaacagtgaactgagcgttcccagcacacagggaaaaatgaagctgtttcttctctaaaaaaatgaaacagaatgaattccaggctcattctcccttctatccctgtgatgacatcccaaccaaaaatgcatcacttttaaaggtgatcgaagtggaagtgggttcatctacagtcaaccactccaagcattatttcaatatgtgagttttaaaatagcttctgaattcaggacattaaacagccaggccaggaagctacctccactttggcatggtcagtcattaactttatatatcttgaagaccatggcccctcctggtacctaatctgtagcctgccaggaaaaacacatacatacacacacacgcgcacacacacatgcacacacacacacacacacacacttaaaggaaaaggaaactttaagttataaactccaagcctatttccatggctgctggcatgtcagtttattcctaagccatctggttcacattatgccgtaagacaagaagaaggctgcttcctgcccagataaccacagagagttcccatttcactttcagcgtggtcacctcgactggctggggtgtggctttgagaataaattgtctccagttagggtttttcccttgtttgttttcttctcttcttaatagggattacagcgggccctgtgtggttagcggggcgatgcttggctagtgattagttcattcatttatactgtcttgcaggaccgtgagcctggaattttgttgcagtaagatttgcaaacaagaaaaattgggctgttagattccattcactcaagttgttatgaggatttcaaggaaattgtaggcttgtcttactataaagcagaatcaagaatctatttttaggggatgctactccggggcttttcttggtgttttgccatctttcttagctctcagacccaacacaaaccctctctggctcagtgatggaggaaatgtccatcctcctttttgcctttgcatatttctctaaaggacacagagaggctttgttgtctttgtggtcaccgggtccactttacacagatgcctattaatcacttcactatggagacagacacatccatcatatcacagcagctcagaaacgggccgtccagtgaaagggggtgagaggggaaagtgcacacttaaccatttcgagttaggttactggttgcctgtgtcttacacgcttagggtggtaattggggtgggggtgagtagagctcttcctttgtatttagcttaataggtgtgattaattttacgtatttttgcttgtctgtttgcttcacattttgataggacagataacatctcccagctatttgtgtaaggtgcagggcattagtatactttaagattgagagttttaattttaaaaacagtaataataaatgcaggtagactagctgtgcttttgatgcaatgatactgactctttgaagccaagagttttgcgataatggattcaatgtggaacagagcaagccgaaagttagctttctcaggcaagagaaactgcagataaattaaccaagaactttccttctatgagtggcagatcttctaaacctcttttttaatcattcaaggctgtccacagccttccaaatggtatttctagctcttgctcttgtattttctctacaagtgctcattcatgtatgcattcctttactatttatttaaaagatatttactgagcacctttctgcctgaagattcagtggtgagttttagcagtctaggtgagaaaaacaagtatcatactagtgatgattttagaataaagggaatgcagagctctggggacactttagaaggaagaacttaactggcctaaggagtcagagaaggcttccccatttaagctgagccctaaagatagggtctgatgagtgggaaaatgagtagggacattccaggcagagagaacagcctgtatgagagccatgaagcaagcttgagtatggaagggtggctcatgcctccagcctaacagactagaagggagttagaccatttgctattactcactacggccttccctttccttccctccaaggctcagttcttgttgctctctctgctccagctaagatcctgtgcatctttaaggcttagctcaaatgccatttccaatgtaaagcttttgcccactgttgaagcagaagtgatgtaactcatgacatagccacactttggacagagttgtatgcaagcacttgccttcttccctgctggtttatgcctcattcatcattgtccttccccgacacctagtgcagtgcttggtaaatgtttgctgaaggcagccacaaagatgcttggagccaaaaccttgttatactaggagagtgataataaagaaacaacccaaccctaagttaggggaaaacatcatttctaaagcaaattgtctcagagcctggtgctaggttccctttgcacggaatagtatccatgagcaggactactagaaaacattttttaaaataaggaatgtagtgtttgatatttcaaaatttattaacatggtcatcataggaaaagtcagaattgtattgggcttcctcttagttttcagtttacaattgttcttattttgaatcacatgttgcagggtctaggggcagggtccttcataatcttttcattgctttggactctaaagaacttcaaatttcctctctgaggtctccctccagcatctgaaaactctcacctcaggaaaaaaaaaaaaaaacagtggagattctgttctttctcagttctgccaatttaagacatgatttcagagaaatctctaagccagggtgtgccttgcttcctgcaataggaaggtggaaagactaaccatttagcaccttatgactggtgagaaatagctggtggttaatgaatcaatgcaaaggatttttcaaatactgttttcattactaatgccccattttcaattggtaagagcagaagaggatgcaggggttggcagaggaaggaatttcaagaccctagggtagagaagccaactctgattgttctctctgcagtgggaggatacctgcggaggggagtacaccaccctccaagggccctttacttgcccagggcttccaggcagcatctgaagcaagggatactcagctctagcctgttgccctttgccctttgccctttgcagagatgcattttttttttttctaattattcagttccactggggcactctgttgttgtaaataacccatttatcgtcatcgactcttttggatttttcccagaactaatttcatttttgaaatagtttctcttcttattgttttgagcaaatactgagcaccattatagatttatttttgtttgtctgatagatgctactattaaaattcttttatatgattggagatagatttccatgacttcaaaagcaagggtgatagtcactctaaagattacctcccaagtttagaagttcatttaaaaatagctctacaatgtattgaaaacccatttattcagccatcatttattgagttacccaactaagagctctgtggatggcaagggttataaatgccgaaaaaatgtggtacttgcccaggatttgcactccactgagaatccaactataattgccaacattttccacttctgttgttttaattatttcaaaattcagtaactataggcatcctgaaacagtatgcattcccttatattgcttcgaaatctcatatcacctttttgactacatttagaaggcacgaagtttggacctggaagcacaggtctactcctctcccatgggagaccaatagcaaatggaatccaatggagcagctgcgactatcacttggaagccctctgtgagccactaacccaccacttctcctttgtggcttcttttgagctttagatttgtccagcaaactacagcatttaagctctttcctattttttatttcctttgattcttgtaacaatccagtaaggcagtaagattaggtgtgttcacctcatgctacagataaaaaaactgaggcccagagatgttaagtcacttgccaaaaggtcacccagccagtaagtgggagcctgcaattccaagcccactgagatcttctctagctgcttttatcaccactactgacaagtctgctgtttccaagccttcacaatggctattccacaaagttgacttgatcatttctgtgaatgcttctttggcctttttcatgatataagcagaaagctttaagtttgaaaggcatttccaaaaataacgtttaccttatcttcttcaactgcactttcaacttactctctgatctgtttccatctttggacgtttctgaatttacacaagcagatgaggaaagccctctgcctccccatggatagatgaagacatgcaaaaatgtttttaaggccactctttatataacaaaatgagacgggggaaaaaatctgtctgagataccattttcctgaaaggtcagatcctacttaacttgttaacaaccaaaaacctgaactcaaatatcatccactaaaaaagagttcttcccagtgaaagaataagtagctttcatgagtctaaaatagccaaggaccttcagacatgaaagaagaatgatatttgggagctaaaagtaaggctaagaagcaatggatacatgtgaaaaatttgcagttttcccagtgaaaccaatgaattgctctagctttactctttccacgttccttttaaactgagagggcagtttaaattgtagaatgccaaagtcaattgtaaatagcttcctattataatacacatttattgggaatatccagtccccctaaatttggtagcctggaagggtttcatgaaatactcattgccatgaaaaaaacacctaatacacccccaccccattactggggccgtctagcctgtgttcaactcccactgaaatcaccaagtcaatgagagaaattaaaaccattttatccacaggtgtacatttttgtgcaattatatgtagggggttaaaaacggtgttcggtagaaccccatacataatcaaaattgaagaaaaatcagtagctattttagcataataaggaaatgcaaatttaagaaagaaaattttcattagcacatttccttggtgaataggtactaaaatatatttgaatgcaggacaccccactgtttggggagcttcacacataaaaggtgtgagttacagccaaatttccggctgttttttgcttctcagtttctaccccttaaaagctgatggagataaatctggaaatatttgaaaagtatcacatttgaaaattatttgatatcttaccgtcttgtacactctttccttatggtgaattgccttgactgccttttattaccaagggtatttgttggatcacagaatctttatttcttaagagatatttgctgcttctacttaagtcacaatcctttgtcacaggacaatcatttccacagcaaccaactgtgatgtcacaattgaagggaggaggacccttaggaaggaaagaaaaagagaatgtacttttcaggctaaggtttctgggttttaaaaccatcacttcagaaatcaaaatattttagcagaaaaacccccatgagaaagcttcaaggtctcggctgtgacaaagacaacatttcagtagaagtttaaggttgcgtgttgtgggcttgggaaggggtagagatctttatttcctttcattctaattctgtgccactgatacctgccagtaaaatacatgaaacatattccagaaagagttgatttagtagatgaaaaatgcgtctcccgagaccagagaaggtaccttttctgtcttgctatcatttccataataggaacaatgtttacatttcctcagcccatgcagtgcctctaatgtattcatgttctttcactctccagaggcaggaattgaggtattagagattttattttttagcgactgcatcaagcacttaagatctgacaactgtgatgtgtattctcacttggtattaaaaaataaaagcttctgtgtttgcatttgattagagtcactcagctgggtggctgattaagcaggaatagcgaaagcaccttccttcagaaacactgaatcctggttaatgtagtgtaagattacggatgggtgtagtcacataatttttattaaattgaagagattagctctgctgaaaaatcccactgtgacagcaaactctaggtgcaataatggtacctaacacttctcaaacccactacagggccccaaatggtcttatttctgaatcttctttcagttccagtgagaaagcttcattcaaatattcaggatagttacctgaaattgagtttgcactgtttttttttttttttttttttttgagaggtgatgcaaaatcagcacaaacatttgtagtctgtgaactttagctatattctctcagtgtaaataaaaatgacacacactctctttcctctagttgcttaaaaggcaaacacttttccccagacggaggctccggtggccacaagggggtcgtcggaaaagatcccaactggaagcccagagtgtgtgatttgtttgtctaacatgcataaaattgttgcctcttcctccagactcaggataacttggttatcccagttctaggaagggaaggttaaaaagccataaagaaggaaagaaagataacttttgaaagccaaaacctcccatattccctggagtgaagcagagtagaaagtgcaggtactggaaagagtgaacagcacttttctttctttctttttttgaaacggagtctcgctctgtcacccaggctggagtacagtggcctgatctcccttcactgcaacctccacctcccaggttcaaacaattctctacctcagcctccggagtacctaggatcacaagcccccgccaccgcgcctggctaatttttttttttttttttttagtagagacgggggtttcaccatcttggccaggctggtcttcaactcctgacctcgtgatccacccgcctcggcctcccaaagtgctgggattacaggcgtgagtcaccgtgcccggcctgaacagcacttttttagacaacaaagaaggctacaaatggagtccatttacatactgcacacgaggggcttggggaggattaattggttaatgtttggcaagctgagcttggaagacaagttgtgcagaggtgctgttgtcacttactactgttattaattaacaaggtgaatgccaagcaaaaacaagcctcggggtgtgctttcatttcttaacgccatatgcgatgtctattgcaggagtgattcgggaaagttacctcaaaggccacgaccagctggttcccgtcaccctcttggccattgcagtcatcctggctttcgtcatgggggccgtcttctcgggcatcaccgtctactgcgtctgtgatcatcggcgcaaagacgtggctgtggtgcagcgcaaggagaaggagctcacccactcgcgccggggctccatgagcagcgtcaccaagctcagcggcctctttggggacactcaatccaaagacccaaagccggaggccatcctcacgccactcatgcacaacggcaagctcgccactcccggcaacacggccaagatgctcattaaagcagaccagcaccacctggacctgacggccctccccaccccagagtcaaccccaacgctgcagcagaagcggaagcccagccgcggcagccgcgagtgggagaggaaccagaacctcatcaatgcctgcacaaaggacatgccccccatgggctcccctgtgattcccacggacctgcccctgcgggcctcccccagccacatccccagcgtggtggtcctgcccatcacgcagcagggctaccagcatgagtacgtggaccagcccaaaatgagcgaggtggcccagatggcgctggaggaccaggccgccacactggagtataagaccatcaaggaacatctcagcagcaagagtcccaaccatggggtgaaccttgtggagaacctggacagcctgccccccaaagttccacagcgggaggcctccctgggtcccccgggagcctccctgtctcagaccggtctaagcaagcggctggaaatgcaccactcctcttcctacggggttgactataagaggagctaccccacgaactcgctcacgagaagccaccaggccaccactctcaaaagaaacaacactaactcctccaattcctctcacctctccagaaaccagagctttggcaggggagacaacccgccgcccgccccgcagagggtggactccatccaggtgcacagctcccagccatctggccaggccgtgactgtctcgaggcagcccagcctcaacgcctacaactcactgacaaggtcggggctgaagcgtacgccctcgctaaagccggacgtaccccccaaaccatcctttgctcccctttccacatccatgaagcccaatgatgcgtgtacataatcccagggggagggggtcaggtgtcgaaccagcaggcaaggcgaggtgcccgctcagctcagcaaggttctcaactgcctcgagtacccaccagaccaagaaggcctgcggcagagccgaggacgctgggtcctcctctctgggacacaggggtactcacgaaaactgggccgcgtggtttggtgaaggtttgcaacggcggggactcaccttcattctcttccttcactttcccccacaccctacaacaggtcggacccacaaaagacttcagttatcatcacaaacatgagccaaaagcacatacctaccccatcccccacccccacacacacacacacatgcacacaacacatacacacacacgcacagaggtgaacagaaactgaaacattttgtccacaacttcacgggacgtggccagactgggtttgcgttccaacctgcaaaacacaaatacattttttaaaatcaagaaaatttaaaaagacaaaaaaaaaagaattcattgataattctaactcagactttaacaatggcagaagtttactatgcgcaaatactgtgaaatgcccgccagtgttacagctttctgttgcagcagataaatgccatgttgggcaactatgtcatagatttctgctcctcctctcttttaatgaaataacgtgaccgttaacgcaagtaactctttatttattgttcaccctttttttccttaaggaaaggactcttccaaatatcatcctatgaacagctcttcagaaagcccattgaaagttaaactatttaacgtgaaatccattaactggaataattgagtttctttatttttacaataaattcactgagtaaataagttggagctggaattctgagctttgtgtttggactgtctggtctgtagctaaaggaaaaagttaggaggggaatatttatttaaatctatcagttcattgcctggtcaggtctctggcctataaacatgcaaaaaaactaattcatgttaaagtccttccagatcctaatttctaaagcaatcaggagagaaagcttttagaatggcacatcatatctcattgatgccaacatggttttgtccatggttctgactttctgtgaaggcaccagcttgcaatatgccatcccatttcaccttgcatgtgagacagcaaacaaaatccacaaatggtgtgaactaatatgctggctgctaccttgcataaattaatgatttgatcacacgggttcttcgtggggttacatctgtgaatagcctgttttccacatgtaaatttgtgccttacaccttgagttgtgtacacttgtaaactctttatgatcaactgttcccccttttgaaataagtgcagatatttatttaaccctcccttccccaccctctgccccacttccagccctctgaaagattggagtcaagcagatggaagaatgcagtggtgatagttgtcatgcgacagcctgagaacgctgggcagcaccacaccctccaattcacactgccttctagttgtgccaactggaaccaccctttggctgtgctgcgaagcatggaccccagtgttgttgtgggtgtgtcaaatcccctttcatcctcaagagctccctgcttcccttagattatttcaatacggtgatatccttatttgctagcagaaaagggactaacgtcccattcctcttttctgctgcgtccactggctagagagcaggcggtgcgcggttgggcagacacctgggaggagtctccaagccatgtgcacagcacacacgtgcagtgcacacaaagaaatgacatggaaatagatgcaggcaggctggtccctgctgtgattaacgagtaactccaagtacaaggccgaccacaatggatgctgcaaaaacgttgactggggcaaaggattttttattttattttttattttgttaattatgtttttaggggatgggaggtggtgtgtgtttttctcctcttggttttcatttgctcaagcacacaaaagggacttttgtttactctatcatgaacaaaggaactgtccacatactgtaaaccatgagcagtgttgttgttgtttttttaaacagtatatttggtggtctctttgtctgcttttatttccagttcgatcttctgggtttagttttgtctttaaaaagaattcaaaaaaagactgacaatgacagttttgagttggatagtgaaaaagtggagcctccataatcagtgtggttgccttcagacctgagtacttagctgagggtgggtgagagccctttgttccaaaagtccattagttttgctgttgtttaggagtaggtggttgttgttgtttttactttttttttttttggcttttgtaatggaatccatgttcacatcctgtgaactctgtctcctgaaaccctgaagtatttcctagaacctgaaatattgttttcttccttgaattttctctagaaatgcagaaattaggaaggtgatgggtctgtatccccctgcccccttctttcccatgcttgactcccgagagtactggcagtgcagcacccatcattgacgtaagcggctgtcttgtccagtgtttgtaggcatcactgcctcagctgttaaggagacctgtgtcaaaacttacatccacattcctacacccccacaacccatcacttctggtgttaaccctaaaatacccacatgtattgagctggtcttctgcatttaagtatttctccccagtttttttccccactgtgtgtggggggagggtccataaacccgagtgtgcctttgctttccacccttgctagacactggtagatgcaacaaactcagatttatatttgttgtaaagttgtaaaaatattgtgatgtcaccaattttccttccatctccacatcccctaacatctgattcacgacttaatgtatgttgtaagaaaagaaaaaagaaaagaaaaaaagggaaaaaagaaaagcaaggaaaaggctctttattacttaaaagtaataaaacctgactgttctatattatcttttgtgtcctgaatgcttttatttatctcttaatttttcctttttaagctgctctcctccccaccctttgtgggtatgatgctactctttcctccatttgtatctggcttccaaagcatacataacggtatagtttgatgtatttgtttgcagtgtccacacccagccacccccacccaaattattgacgtgtttctctgctcaaacccagcctggagcaggattttagcagaagccaccggtaattaaaaagcagagcatgcattggctccttctattcattttatgcattttctttttatgggcttgttcatcatcaaacatttatggtaggcttgatagtttaagagatcaaggctaggattttagtatgtagggtccactaaaaatagatccttgcacagatgtgacttcagtcttcttacatattaataaggtggagggggctggattttactccttgttagcatttatcttttgtaacacagagggtatattggaggtatattgggacacagcctttgatttttctttggcaaaaagagcattattttgcaaaaagagcattatttcttttgcaaaagagcattatgaaatgcctaggtcaggttttcctctaggggtgtttttaaaacaattatttaaataagtcttcagctacagtattttacttttgaccctctgaaattttttttttttttttttttgatgctttaagtcagttgagtgtgggaagctgcaggttgaggcctcagttcatacctatagtggcccagtaacctttagattgccatctccaattgtgtttcttgaattacatccatagcgcctggcacaaagttgactagaatatagtttctacctcctcatttgcaaagagagaccgacatggcccttgtagttgccatttggaggtacgaacaaagtactgatgaagctccctagaggttagggtaacaatatttgtgctggttcttaaagaacaagttttctgaacaactagctcaggcagaggggacatcctttgcaaaggcaccaagtgtgctctttgggaaacaaaaggttcagcaggccttgtgcaggatctgtgagagcttggcagggcaagtctgggaaaggggggttggagacaggccaggagggacctggttcccatatgctaggaatttagctgaagcagtggagtgctcccttgctttggagtaaataaaacaacagacaccgtttgtgcttgggaaagctacctggccataatgtgggaagtgaattggcctagagagggactgcaggccagctgggcagtgtgccagatggcatgccaagtgggtgagagcaacacaagtgaaaaccgcacatccaatttcagatgcaaaaaggaacagtcacagagctgagtcctttttgccagaaagaacttccactgtatgtaattgacaggttagccctgcccggttatacccaaatgtcttatctagaactgacagaatggccaacctctagtatgaccctttcattttaaaaatgggggaagctttgcgaggccgaggtgggcggatcacgaggtcaggagatcgagaccatcctggccaacatggtgaaaccccgcctctactaaaaggcaaaatttagccaggcgtggtagcgtgtgcctggagtcccagctactcaggagactgaggcaggggactcacttgaaccctgcaggcggaggctgcagtgagccaagatcgtgccactgcactccagcctggcaacagagcagactccatctcaaaaaaaacaaaaaaacaaaaaactgggggaagttgaggtccactgagtgaaaggatttgctcatgctccaaaactagtggtagagcagctattctgaagacaaattcatggtctctttccccaattcattcagatcagtagagcaatactagctagaaagacttgatcctgctcacccatctagacagcatctgcatctttctcagtcatcctttctcacaggaagcccttcatacacacccacccttcacaagctgggcttcctagatcccctcatttgggtcaaggcatggggttggaaaaaagcttggatcacatgggcttgaggtataaagtccctgcagtgcaacctgatacttgatctggtggcttttgctgcagtcagctttgttctgggctgctgaagaggtgaaagaggctgaacaggtgcagccagtattttagctggggccccccggatgtccctgctcagacacgaaaactgcctcagacaaccctgatttttaattgtgtttgcttgctagcttgattgttacaaggtttttagactgtttctccaaagcagtggctgtcctgatgcagctaccaggctaggtgtttcatggaatcagagatgacatcttggacctgaatgttttcctaaaggcccatgtcagataaacacaaactggtctcattgttcagccttgtaatttggcagaagccaaataagatgctcctggaccccagcacctaggttttactgcctgaacaaaagctctttcaacaaaaagtcattcagcaagtaaaagtgtcagaaaagcacctctaatttcagacactggtacattttgcttgaggggaagtggtgaggggaatttaaaagaacgctttagtaacaaaataacatgattaagagcataatccttttcctggctcagccctgtgacagctgggtgcttggactcagtaactcttagaaacccgcatctctcccttgtcttgaaaccaggtgatgacttgtctcttgtacagaagtgggaaggaagggctcacatttattgattgggactgccagacagatggggatcttcaatattccatttagagtattgtgtatccctcactctaacccccccggggatgcctggagttagggggcggttgacctctgcagagggttagggctgaactgatgtgcattaaatgtggctggcagggaaacgtgcagatgtccctctagcaaatggaaatgaaatttgagcaaatcaagagaggcagctgaatggtggggggtttcccattcccctctgcaaacacatccatgcacacatgtgcatgcacaaatgtcacggggctttttcctcttggtgtctagtatcaaaaatgtcacagaggttggaacccatgtctactgaccaagtggtccttttgggagggctttctaccctttctctggtaaaacatgggtcccacctaagcactttctggtcaaaggtgagtgttataaactatggtttaagaaatgggacccaggacgtttgcagaggagacgagacacaggtccctgccagcccattggcactggctgaggcagctaacaactttttcattcttcctaatcaccttcagataaaagactctcttgagaatcattaacgtcattcccaaagcaagtcatccgtcctgctaacggactgcaataatggtccaaataaggggaagctaatgaagggggaaagtgagtaaccatgaaatcagaagcacttttcattgatggatttcaagaggaaaaaaaaaaaaaacagatgagggtgacattggataaaatatcaaatgccaggacactaacatgaaagaaactcatgcagattcctaggggtttcccaggatgagaaagatgatgaacaaccatttcatgagccaactactctcttttttcctgtgcatcacaacaactgtccttaccacacacattatggggtgctgagaaagtgggctgctcttagcaaaacttcgtatcagttctctggcatgaatactgaacattttgcacatctagtcccatgtcaaagcagaagtgtgaatttcagtaatatggctaaggtttatttaataaaaaatgaaaagtggaagggtaccccccaccccctagaagggggcagggcttccaattgccagcaatgacattttgcatttgtagcactttacagcttgcagatacaatctcgtccattatattgcttaatcctaataacagcctagtggggtgggcagcatatatatgattgtccccacttcaaagaaacaggagtttagagagaagggatctattgagcactgatcaacataataatgtagtcatatttcaaaaacctgtgtgtcgacatcaccccccctcagctgtcttggggacaccttaggttacacaattactccgcttgagtgaaggggaaaagtctcctacagcatttcccaggagagaccgttacaacaataaagtccccaaaataaaggctaggcacacacattctattttgagagcattgtgctctaatatttttccatcgttaaagaacacatctcttccttcctgcgtctgcagagccctgatgccagcagtgttattaggaactgtcaacaaagcaggaaaagagggagctggagcctaagtcaggacctcccttctgggggcgcaccctgacactttaggggctgcaacaccaactgcctctgtgaaagaaaaaggatgaaaggctcagcttttgtagctgcttcatcctgcccaggccacagataatcacaaaaaaacttttaagaagcttctaaggacccaggatgaatcaaagcagagaagaagaaatgccctgtacccagaagggtgaagaacttgtccagcctccccgtcacagaacacggaggtaaagttagtttgaaagtaagaggcatgtaagaaatatccactgttgtcatttcacttcagcttcatggtcactttggcacaatgggtaccaaagcaaccatccgactttacccctgatatcgacgattgaatgatttggttgagtgcctagaaaaatcttccagtaggagacagaaggcagagctcagctctgcttaggaacctgtcttcctcctccatgttgctacccctcattccacattgctactgacacagacaagccttccttgacttagtgagctgtaagtgcacacggtgcaagagaggcagcaccatcttcttgaatttgggtgcccagccttcctcctgcccttggggcagcagtccctggctggtcatcatacagacctatgctacagcactctgaataagccagcatcttccactcacccctttgacagatgacctcagacagattccactcagagggaggagaaaatgggcattcttcttagaactcccactgttctctttgtgtttgcttgttgctgtttgtttgtgagacaattgaagccctgtttgtagtaaacaaagccttttctcagaacacaaatatgctttttagtgaatagggaggcttggttgcaatcaattatggcagctctggtataaaatatatatgtaattccaactgccttgcaatgattacttaattatgtactcaataaaggtaactactctggaaacaattaactttccctgatcagaagggtcagagtccatagccagtcaactttagaaaggaaattatatattccaaagtggtgtgtgtgtgtgtgtgtgttgtgtgaaacaaagttgtctcttgaagactgatgtaggtgttggctgatttgaattcttatttgtgtttaactttatttaagaaccaaagatttattcccctcatttccagggtgaagagaaggcctgtgatcacatttcatgcttggggagaaaagataatgtgttagacttatatgtatgaatagaaacaggtaaatagtcatatttccttctaactttgtaatttaaacagtgtaagtcagtagggaagggctgtaattgaagccaaagtaagtgaggtgaaaattactaggtgttggagcatctgcatctcattttaattaggtgactgtaatagcaagatcaaaaacttttccttgtcactcaatctgttgggctttctaatcgagaaaccaaagggattgttttgtcttcaggaaagggtgacctaaaacaatcctctctaattacctaggcagagcagcagacagatttgggctcagggatgagtgcggctcggggaaggtgtgttgtgaggccaaggtactccaagaccagccccacaaaggccagcccctaaagcccttagggacagtgattcttaatttggcagcttggagttttcccttcccacaaggcaaagtagcttagaagaaaacgcatcacgtcatgagtcttgtgggcctgggttctagtctgagccggcctcaccatttgtgggtcatcatttggggcagtcattcaaattcttggcacctcattttcctcatctgtgcaatggacttaatgatggctgccctgcctacctcacaggagtgtgtaaaagtcaaatgaggtgaatgttccaccgcttctccaacaggatatgcccctcttctacaatgtggtgtataaaatgagatcccagccttctatatcttcaaattaaatgactatgagttcccatcctgctgataatgaaaatgtcttttttctcttccgtaaatactccttatctgtcaacaaaagcagccagagggaccagttaaacaaaagccctgcctagcctgataaagagttctggctccttttcacagatgaagccatctcagccacgtgatgcccacatcaaggcctggggggctccacacactgtaatgctgtcttccttgtccattcccagatgaagagtccagggagagctggttgtgctcttgatgcggggcaggcgagccaaaagtggagcttagcccacgagggtgcttggctttgcccaggaaagaattcaagggcaagccagaggtagaagcaaacagcttaattgaagaggcagtgttacagctccatgactgctcctgcagtgcaggactaccccttaggcagagggtagcagttcaggggtttccagtcatatttatacccacttgtaattgcatggagattaaggggtggtttatgcagaaatttctagggcagaggtagtaactttggggtcattggttcattgccatggaaagggatggtcacttcaggtgttgccatggcaatgacaaatggatgtggctactggtgggtgtgtaagattgaaagctgcttctgcttaggctctcttttagctagtcatcaatctggtcccatgctaagcccccgcctctggagtggagctccccctactacctcattctcactgacttctgcctccctttaccacctggtgctcttcctgactgctcagcccaaactcttgcctccagccaggacactgaggcctagagaatgaggcccacggtgcactgcaggaagcacaattgtaaacactccttgtgttcggtccatgaggcttacactcatggacatgagtacatgaaacctggtggccttggcttgcctgtctactttggtgccatgctctttgaactggtacactcacagccattttccctaagcacatctgtggtgctgccctgtccaggccccaggtgtttccattctgagctacagatggtctggatagaagtagcagttactcagtcctaaacttatccctgtctcttgtcccaagagtttgtgacattctttacaaggagaaagctctgccttatttcaacgataaagcattataccaaatatgtgatggtcattattatacttctcatggtgctgaaagatctagttcaacacccaccttttaaagaagaataaaccaagacataagaggttgctcaaatgcacactgctcatttgtggcagatctaggggtacaagacatatgtcccaattcctgattcattgcaagagaccatactcatgtctattaaagtacagacttgtaaattgtaatcccagaat

SEQ ID NO: 94 - DNA, 4612 bp, Homo sapiens
ggggtgaggctgcagccaactccgctccccgcgcactcggctgcccaggcgctcggaacccagcagcggcgctcctccgcggtgccggtcgcccgcgatgcccgcttagcagcgtgtagcagcggccagcatcaccacacccgcggcaccgcgctgccggccgcagagccgggccagagccttgcacccctgccccagcccccaccccgccccccgccctgaaatgacttgttaatcggcgcagacaccaccaaggggactcaccgaagtggaatccaagtggaatttggatttggagaagagtttcttgaacatttaccctcttccttgttggttttctttttctttttcttctttttttttttggcttcttttttcctctccccttctccgctcgtcattggagatgaacacatcgcgtttgcatcccagaaagtagtcgccgcgactatttcccccaaagagacaagcacacatgtaggaatgacaaaggcttgcgaaggagagagcgcagcccgcggcccggagagatcccctcgataatggattactaaatgggatacacgctgtaccagttcgctccgagccccggccgcctgtccgtcgatgcaccgaaaagggtgaagtagagaaataaagtctccccgctgaactactatgaggtcagaagccttgctgctatatttcacactgctacactttgctggggctggtttcccagaagattctgagccaatcagtatttcgcatggcaactatacaaaacagtatccggtgtttgtgggccacaagccaggacggaacaccacacagaggcacaggctggacatccagatgattatgatcatgaacggaaccctctacattgctgctagggaccatatttatactgttgatatagacacatcacacacggaagaaatttattgtagcaaaaaactgacatggaaatctagacaggccgatgtagacacatgcagaatgaagggaaaacataaggatgagtgccacaactttattaaagttcttctaaagaaaaacgatgatgcattgtttgtctgtggaactaatgccttcaacccttcctgcagaaactataagatggatacattggaaccattcggggatgaattcagcggaatggccagatgcccatatgatgccaaacatgccaacgttgcactgtttgcagatggaaaactatactcagccacagtgactgacttccttgccattgacgcagtcatttaccggagtcttggagaaagccctaccctgcggaccgtcaagcacgattcaaaatggttgaaagaaccatactttgttcaagccgtggattacggagattatatctacttcttcttcagggaaatagcagtggagtataacaccatgggaaaggtagttttcccaagagtggctcaggtttgtaagaatgatatgggaggatctcaaagagtcctggagaaacagtggacgtcgttcctgaaggcgcgcttgaactgctcagttcctggagactctcatttttatttcaacattctccaggcagttacagatgtgattcgtatcaacgggcgtgatgttgtcctggcaacgttttctacaccttataacagcatccctgggtctgcagtctgtgcctatgacatgcttgacattgccagtgtttttactgggagattcaaggaacagaagtctcctgattccacctggacaccagttcctgatgaacgagttcctaagcccaggccaggttgctgtgctggctcatcctccttagaaagatatgcaacctccaatgagttccctgatgataccctgaacttcatcaagacgcacccgctcatggatgaggcagtgccctccatcttcaacaggccatggttcctgagaacaatggtcagataccgccttaccaaaattgcagtggacacagctgctgggccatatcagaatcacactgtggtttttctgggatcagagaagggaatcatcttgaagtttttggccagaataggaaatagtggttttctaaatgacagccttttcctggaggagatgagtgtttacaactctgaaaaatgcagctatgatggagtcgaagacaaaaggatcatgggcatgcagctggacagagcaagcagctctctgtatgttgcgttctctacctgtgtgataaaggttccccttggccggtgtgaacgacatgggaagtgtaaaaaaacctgtattgcctccagagacccatattgtggatggataaaggaaggtggtgcctgcagccatttatcacccaacagcagactgacttttgagcaggacatagagcgtggcaatacagatggtctgggggactgtcacaattcctttgtggcactgaatgggcattccagttccctcttgcccagcacaaccacatcagattcgacggctcaagaggggtatgagtctaggggaggaatgctggactggaagcatctgcttgactcacctgacagcacagaccctttgggggcagtgtcttcccataatcaccaagacaagaagggagtgattcgggaaagttacctcaaaggccacgaccagctggttcccgtcaccctcttggccattgcagtcatcctggctttcgtcatgggggccgtcttctcgggcatcaccgtctactgcgtctgtgatcatcggcgcaaagacgtggctgtggtgcagcgcaaggagaaggagctcacccactcgcgccggggctccatgagcagcgtcaccaagctcagcggcctctttggggacactcaatccaaagacccaaagccggaggccatcctcacgccactcatgcacaacggcaagctcgccactcccggcaacacggccaagatgctcattaaagcagaccagcaccacctggacctgacggccctccccaccccagagtcaaccccaacgctgcagcagaagcggaagcccagccgcggcagccgcgagtgggagaggaaccagaacctcatcaatgcctgcacaaaggacatgccccccatgggctcccctgtgattcccacggacctgcccctgcgggcctcccccagccacatccccagcgtggtggtcctgcccatcacgcagcagggctaccagcatgagtacgtggaccagcccaaaatgagcgaggtggcccagatggcgctggaggaccaggccgccacactggagtataagaccatcaaggaacatctcagcagcaagagtcccaaccatggggtgaaccttgtggagaacctggacagcctgccccccaaagttccacagcgggaggcctccctgggtcccccgggagcctccctgtctcagaccggtctaagcaagcggctggaaatgcaccactcctcttcctacggggttgactataagaggagctaccccacgaactcgctcacgagaagccaccaggccaccactctcaaaagaaacaacactaactcctccaattcctctcacctctccagaaaccagagctttggcaggggagacaacccgccgcccgccccgcagagggtggactccatccaggtgcacagctcccagccatctggccaggccgtgactgtctcgaggcagcccagcctcaacgcctacaactcactgacaaggtcggggctgaagcgtacgccctcgctaaagccggacgtaccccccaaaccatcctttgctcccctttccacatccatgaagcccaatgatgcgtgtacataatcccagggggagggggtcaggtgtcgaaccagcaggcaaggcgaggtgcccgctcagctcagcaaggttctcaactgcctcgagtacccaccagaccaagaaggcctgcggcagagccgaggacgctgggtcctcctctctgggacacaggggtactcacgaaaactgggccgcgtggtttggtgaaggtttgcaacggcggggactcaccttcattctcttccttcactttcccccacaccctacaacaggtcggacccacaaaagacttcagttatcatcacaaacatgagccaaaagcacatacctaccccatcccccacccccacacacacacacacatgcacacaacacatacacacacacgcacagaggtgaacagaaactgaaacattttgtccacaacttcacgggacgtggccagactgggtttgcgttccaacctgcaaaacacaaatacattttttaaaatcaagaaaatttaaaaagacaaaaaaaaaagaattcattgataattctaactcagactttaacaatggcagaagtttactatgcgcaaatactgtgaaatgcccgccagtgttacagctttctgttgcagcagataaatgccatgttgggcaactatgtcatagatttctgctcctcctctcttttaatgaaataacgtgaccgttaacgcaagtaactctttatttattgttcaccctttttttccttaaggaaaggactcttccaaatatcatcctatgaacagctcttcagaaagcccattgaaagttaaactatttaacgtgaaatccattaactggaataattgagtttctttatttttacaataaattcactgagtaaataagtt

SEQ ID NO: 95 - protein, 1022 aa, Homo sapiens
MRSEALLLYFTLLHFAGAGFPEDSEPISISHGNYTKQYPVFVGHKPGRNTTQRHRLDIQMIMIMNGTLYIAARDHIYTVDIDTSHTEEIYCSKKLTWKSRQADVDTCRMKGKHKDECHNFIKVLLKKNDDALFVCGTNAFNPSCRNYKMDTLEPFGDEFSGMARCPYDAKHANVFADGKKATVTDFLAIDAVIYRSLGESPTLRTVKHDSKWLKEPYFVQAVDYGDYIYFFFREIAVEYNTMGKVVFPRVAQVCKNDMGGSQRVLEKQWTSFLKARLNCSVPGDSHFYFNILQAVTDVIRINGRDVVLATFSTPYNSIPGSAVCAYDMLDIASVFTGRFKEQKSPDSTWTPVPDERVPKPRPGCCAGSSSLERYATSNEFPDDTLNFIKTHPLMDEAVPSIFNRPWFLRTMVRYRLTKIAVDTAAGPYQNHTVVFLGSEKGIILKFLARIGNSGFLNDSLFLEEMSVYNSEKCSYDGVEDKRIMGMQLDRASSSLYVAFSTCVIKVPLGRCERHGKCKKTCIASRDPYCGWIKEGGACSHLSPNSRLTFEQDIERGNTDGLGDCHNSFVNGHSSSLLPSTTTSDSTAQEGYESRGGMLDWKHLLDSPDSTDPLGAVSSHNHQDKKGVIRESYLKGHDQLVPVTLLAIAVILAFVMGAVFSGITVYCVCDHRRKDVAVVQRKEKELTHSRRGSMSSVTKLSGLFGDTQSKDPKPEAILTPLMHNGKLATPGNTAKMLIKADQHHLDLTALPTPESTPTLQQKRKPSRGSREWERNQNLINACTKDMPPMGSPVIPTDLPLRDSHIPSVVVLPITQQGYQHEYVDQPKMSEVAQMALEDQAATLEYKTIKEHLSSKSPNHGVNLVENLDSLPPKVPQREASLGPPGASLSQTGLSKRLEMHHSSSYGVDYKRSYPTNSLTRSHQATTLKRNNTNSSNSSHLSRNQSFGRGDNPPPAPQRVDSIQVHSSQPSGQAVTVSRQPSLNAYNSLTRSGLKRTPSLKPDVPPKPSFAPLSTSMKPNDACT

SEQ ID NO: 96 - DNA, 115780 bp, Mus musculus
  misc_feature (1)...(115780): n = A,T,C or G
taacactgatcttttgatgttcttagtgacaggtgcatttgataagactttctttcttccttacaatccacttaagttttatgacctgtctactcagtcacacttgcagtctctgctatctacagctatataacaaatcaccccagactcaggggtttgagagcaaggtctgtttttactggtcatgattctctgggtcgagaatctgaatgaggctcacagggatgcctgctcatcctgggcctgccttgctcatttccacgactgcactttgccagtagctaaactgggctaaaaagagcaccgtggggctggcaagatggctcagcagtttagagcactaatagctcttacaggagactggatttgattcccagaatccatatggctcacaaactacctgtaacttcagttccaggggatctgatgccttcttctgacctctgtagtcactagggatctacatataaacattcaggcgaaatgttcattcacataaaggagacagtggccaggtgttgagcacatatcagcaccatgctcataaagaaatataaaagaaccatttttgtaaaaacaaacaaacaaacaaacaaaaattttggctttcctgtcagatctaggtatagtttgggctgggcctcccctttccctacacacattctttctttcttcctttccttatggtctctattcttccaggcctcagtttctagggcagcctggggctcctcatatggcagatagtgtaggaagtgggcacagccacagttgccaagcttagaacttgttagagcatgacgtctaatattcattggttagaataagtcaccatgtcattcattattcaaggaaggtggcaaagtccatcttgatgcaagaaactgcctgaggctgtctttgcccactgttgttctagacacttgatttccctgattcttacccattgatgcacttccaatataacagtgacagtgagggtttctaggtgacaagaaggagagtttgatttgcagcatctgtatccaaggaagtgtctggacttcctcagggaaataaggaaacttaaatgattacctagtgaatgtagctcctggttcagatggcagtgaatggcacagaatatgtggctgtctgtgtgtacatctatttgcttgtttcatgcacatgtgtatgtgctgtgtacaaggtccatgcatgtatgtgctgtgcatgtggtctatgtaggtgtgtgctgtgcatgtggtccaagcagatgtgtgctgtgcacgtgatccatgcaggtatgtgctgtgcatgtggtccatgcaggtgggtgctgtgcatgtggtccatgcaggtgtgtgctgtgcatgtggtctatgtaggtgtgtgctgtgcatgtggtctatgtaggtgtgggctgtgcatgtggtccatgcaggtgtgggctgtgcatgtggtccatgcaggtgtgggctgtgcatgtggtccatgcaggtgtgggctgtgcatgtggtccatgcaggtgtgggctgtgcatgtggtccatgcaggtatgggctgtgcatgtggtccatgcaggtatgggatgtgtatgtggtccatgcaggtgtgtgcttgtgagtgtgtgcttttgctcacctgtgattgtgccagtggaggtcagagattggtgtatttctcccttgcttttctaccatatttaaaattttgtttgtttgtctacatggcatatgttttctccttcccccatgtgaatcccaagttcaaactctggttgtcagctttgctgcaagcacctttgctcactaaaccatctcaactgcccctccttagttttcatagagtttcaatgtttcattcattctttaaaaaaacagttttaaggctgggcataggagcacaagtctttaatcccagtactcaggaagcagaggctggtggaaccctatgagctaaaggccagcctggtctacagagttccaagacagcctgatctgttacacagaggaattatgaagccaaaaaagagaaaattatttaactttatgtgtatgtgtgcgtgcctgagtatgtgtacgtgcaccggatgcatgcagaaacccttggaagtcagaagagacaacagatcccctggaactgggggtaccgatggctgtgaatcacactgtataggtgttagaactcgaacccagaagctttgcatgagtactgcctgtatctcctgagctgcagtatccagatgcttcatgtagattgattggccagtgagctccctcttgtctcctctctaccctcagcattggggttccagatgcactgggccatgtctggctttttatatggacgccaggatccaaacttagctcctcatgctcgcagagccaacactttgcccattgaactggctcctggcccctctgtctatatgtgtaagataaatttgaaatgtgcaataaacccaactgtgcttttggaaacaaatataacaggtcataaaattcacaaatgcttcttattaatctgcatgccactcaaagaaaaatagttgagtggcttgggagagtttttttttgtggtggtggtagtggtggtggtgtgtgtgtgtgtgtgtgtgtgtgtgtgtttgtgggtgtgtgtgtttcccagaatttcatgtgctgcagatgttttgaatgctcctcagtttagaggcaataatagaaaccacatgcttgcctttatttttgaaattgttttagtaagcacttgtgaaaatatggaaaatgtaaacacgcaccagcacatacaaatacctaatgtgcaaagaagccagactatcatctagcaacgaaggggccacactggcataggggtggctgtcgtaaacacaaatgacctggtgcatgtccgtctttaggtgtgccagtgaatcatgacctagttaaaggcagattctaaggctgggtagaacatttgcctaacaggcatatggccctgggttggatggctagcatcacataaagcgagtctggtggcataggcttgtttgtgttcctagcatttgagaggtagaggcaggaggaatagaagttcaagtttatctgcaactatgtagcaagtttgagggcaatctgctctaaaatacacaaaatcttaaccgtgtgcatggggtgggggctgaggtcacacccttgagaggctttcaggaagatgctgctgtacagatttcagtgctagtaaaacgtgggaggaaagggggttgacaagtgtcccttttaaggagcaggaagggcttagggagcaaatattgtgtgtgcacttgaaattgagctagacagtggaatgccaccatcagattaaactcagtttggggatttactaaacctcgagtcagaaggaaggttaaccggaaagtggatggaaacagaatggtacaaggaggtgtagagttgctgtggactaactctgagcagagtctcgggttcatgctcactgtttaagtagtacatggcatgagatgagtgagctcagagtctctgtattttcatccagaaaaaaaatggtgaccactacagtcctgacctcatagtttgaaatcacaatttcttagtgcgaagcatcagaacggtactttgggcactctaggtaagttctctgccactgagctgtgcctcagtgcttacctcatggtaggaatcaagtcataatgtgaaataatgcttagcagagagtagtgctcaaaatgattaaccatttaatacttgctgttacaatttaatataattataattataaagtaatataacttatcatatataatatatcacatagatacataataaataaaataatataaattctaattaataatattatatgagtgttggtaactaaagaaaatgtccatctgctttctaaaagaaaaatttagcttatgattcatagatccaactctggaaatctattagtaggcatgaaaaagaaaataattttggtcactctcataatgttgttgagaaagaggcatcctgatatagttgatgagacatttcctgaacatacatcatgagtcatgggttagaaaaccactctaagattttacttattcctgactttgtgtgagcacagctctcacctctataaagtggagacagttacaactgtcatatccaactgtcatgtagtcccaggaggcttgaagctgaggtacaggttgacatttaagatcaatctgggcgacatattgagactctgtctcaaaccagaacaacaacttcagctcccaacccctacactttaagaggcacaaatgtcttaaggagtctgacgtccacagagctgtcacttcttagcccatgtggccatgaccattttccttaaatcctccccacaatggagagaagtatagaaagcactcagcaatgtcacagacacaaagcaaacacacaggaaaatgacaattgttgctgtgatatgaaattgctttaaaaaaaaggaatcacaaggtgtgttacttcatgaagatggttattctgtgctgtgataaatatgctgttttcagtatacatccaactgttacttcagagttgctggcagtgaggaataaactttgtgtctctgcatccctaagccctcacatgcttctccaagtgacattgaagagacatagactggggaggtgtgtgtggtgggggggacttagcagctcagtctctggtgatgtcatcaacctatcttggaatcaccattggagttaagagactgcctctttggggaaactgcaggattttgaagtggtcataactttgttgacttaaaaaaaaaacccaacctctcatctaatcagttaaaattagaaattcacaggtaaatgacaagtgtccccaggagatggcttgtgtccgggagtgggccacacagttgttagttgatattaatagttctgagaggagggtaggagcctgtgcaggtcacagctgagccacaggcattacacatgctgctggtggagacatggcagctgcagttggacactagccagctttcccatagccagagatggcacagaaacaaacaaacaaatccaaacaaacaaacaaataagcccacttcttctcacgtctcagaggacaatgctggcactgggggcagggagacatcaacattccctttcatatcccatccccagactctttagctctctctctttctctcttccccatccatctccttgacaagattattggaaagaaggagttaatgagtacacagttgtcttttttttttcttggcagagaagtacaagacaggctcagagcaggctgtcatcgctcttgagattttagggattttacaggtaattattaaccctttgtggcattcctgagggaaaaagcctggggttgaaagaacctactaatatttttctatctctattaaaatcatggacttatgttgcttcagagtttaagtttagcaatacttacccaagaagcctgagatatatgtggtcttacactgcctataacatacctgatcagaatggtatgttgtatgagactgtttagcacttgtgcatatatgtgtacccatgcacacatgtaaggggaggccagaggaggaccttggtgtctgtcctactctaccactccctgccttgttcccttgcagcaggatctctcactaaacttggagctaggctgacagataccaaggcctggccatctcaatctccccccagctctggggttacaggctatgcccagcatcttataggggtgctgggaatttgaactcagaacctcatgctttgcagcacgggttcttagccactgagctagctccccagttcaaactagatcatttttaaaccccctcacacacagagggcatcattcccctttgccatgtgggaacactgaagttcaagaaaagacataactggacaaaggtttctagtaacaaggctggagccagggcttttgatttctgctcaggggacttcattattattattattattattattattattattattattaaattgcaaaactggtgatgtatgcatgccaggcaagggcggtgccactgagctatgctgaagactccaatgcttttttagtgcaccaaaaataatgtaagttctcttttgataccaagaagccataattctgactcttgaaagttggacttttcaaacaatccccatgatcaacctgcttttctgattaaaaaaaaaagtatgtggaggttgggggtggtgtatgctcatgccacagcacacatgtcgaggtcagtggacaaccttgtggagttgattctccccttctccctctatatggattctggggttagagcttaagtcctcaggcttgtgcctcaagtgcctttgcccacagagtcagcttgctggctcctttcctatactgttttgtgtgtgtgtgtgtgtgtgtgtgtgtgtgtgtgtgtgtgtgtgtttctcagtgcagtttgctaattctgggcttctagcactgggattagcatgatgtattgctgagacttttggatgcaagaaaccttgactgattcttaggggtgttggttctgggcattggtttctgcaaactgtaaaatctagaaagcttctatagatgactcaagtactcaggaggcaggggcaggcgaatcaggagctcaaggcgattctttgttacctattaagttctagactaccctggagtgtatgagacactgttaaaaaaattaaagcactagattaaataaataaaaaagataaagcacagattaaaaatgaggaccagctctttgctggaaggaccgtgacctgttctagcaggtagctttccttaaaagtcccccttggtgttctcttcctgatcttcggttgtagctacagacgattctttcctaagctggatttctgctctccagcccacactcttggtgcaatcgcatgcaggttgctagtatgtgggcagacttccatacatggtgtgaggagcagacatgacttcatgctttgctgtagacgagaagaactgccaaggctcaggcgccccattccccccaagactcactccctctgtttggaatcctcttctctggtggtgtggtaaccagaccacaggggatgctgtacacctgtgggcaaattaccttgcagattctcaaaccttgtcctctaggatgccaggagttcccaagtgcatctcatagtcccacccacagcgtttgagaaccttttggaacactctactgtggtgaccagcctgaaggtcatctccagccaggtttcatgacttgtgatgaactgtgtgtactatgctgcttgatgcaggggcagggtggggatgacctggcaagtttctttaagggagagctgatcacaagcattctgcattaaataattcttttgtttaaagattgtctgtaattccagtgccaggggatatgattatcacttctgacctctgtgggcaccaggcatgcatgtgttgcccagacatatgtaggcaaaacacacatacacataaatttaaaaaaaaatcattacaaatttaaaataaaaatttaaattagatttgtgtgtgtgtgtgtgtgtgtgtgtgtgcgcgcgcgcgtgcgcgcgtgcgtgctcatgtgtggaggccaaggatagcctgcaggaatctgctctctccttccaccttgtgagtttcaacgatcaaattgctctctcattctaccatcctactggtctaaattactcttttgtcccagcccttgggatgccgaggcaggaggattgctgcaagtttggtgctagcctcactatatagtgagatgttgtttcaaagaaaaagaaggtggggggcagagagatttctcagtggttaagtattcctcttgtagagaattccgtttccagcatccatgtcaggtggtttacaactacctgtgttaagctacagtggctgttggcttccttggatgtcctgcactcatgcccatatacatactcacagacatacgtacatgcacacacatatgcaattaaaaataaaaggaatctttaaagtgtactattttgtcttgaaattcgtaagcaccatgatagaggactccaatttgcagctcttgtatattccattccccagcttcctatttctacccaagggcatgaaaacaaggagacctgtttctccttatccagttggaaggtgtatgctaatgtggactgcatgtgtagcacatatgttcctgctcatgcgtgcatgtgcacacagatactagttggagctttcctgttaagatttctgaggtattacatttggcttaatttatgcacgtgtggacactgcttcaccatcacttctgagatatacagaaaatgggagagaaacccaacagcattgctctatagtgtaggcaatcaggagaaagggaaggctggtgtaaggatgaaaagaatggcaaacaaagccgggcatgctgcacacacctgtaatgccagttgttccagaagactgaaacaggagcataataaggttgagggagtctgggctacatgatgagactcaaacaatcaaaaaagaaggaagaaagaaggcaaggaaagaaagagacagaaagcacagacagctaggcaacaatcacctgactactaaatacaggtccaattttggtttaaaaaaaaagcaaaacttgagggacagccacgtttagcatcaaatcgtatttcttgaatatgtcaaacatgtaatgaaatccctttaactgttcggtgtttttcttcccgatgaacagcgttcctactccctttctataaagcctaagttagatttaaccgtgctggaacaaatgttttccagaagactccagcgccttagtttccctgaccctgtgtgcagttcggacatcagcaagtcaaaccgcccagaggcggcagatatgtattacagtgctaatctcttccccccgcccccccgccccactccattaagtgtgtgtgtgttcgcgcgcgtgtgctcgcctatgtccaagcactgtttcacatggcggctatcaatctattctgatccgtgtttgccaaactaacaggttctctctctctctctctctctctctctctctctctctctctctctctctctctctctctctctcctctctccctccccccacctctctcactgtctataaagagcacgtcacggataatttcttggaaattgtattttaaaggcactgattttcaataacaaaacacaccaccacagcaaccccctttatccaagtccagagcacttcccgaactatccttcaactaactaggggcggggaagtgggcgtgccctcaagattcaatttctgcagcacacagtcatttcggtagtcaaggacacatttctggattaaagatatcaagaagaacgagtgtggagcacagatgggaaagggggccccacctctgaggaaatagctgagaaactcatgaaagcaagttttaaatcttttttttttttcttttgcaaggcacctgaaaaagggtgctcgtttgctgtaaatccaccatgatgtttttagtttaggagagcagaataaaccttgggtccagatagctcccaaacccgtggattacaaactttctctcttctcctaggctcaatggaccgaagcttaggccacttttccagattctggtacttggtagccaaaaccctacaagtctcctttaagaggaggcagcacgcctctccttttccccgccccgtccccgcctttcacaccttgggtgggaaaagcgagcggaggcgggacctcagggagcgagcgctcttatgggttaggacgccaaaaaggcgctccaggagccaatgagcaacgggcagggcggggcgtaatgctgtagccctgcagccaacgtgggccgatctgcgccccggggccccatcggaggggtgtgtgagggcgagcagccggggcggggcctggggccgcggggctggaccgcggagcggctggccgctgattgttcgcagcgctgaggcacggtgcgctccggccgctccgggacgggcaggcgcgtggggtccacggctatcatcagctcagcgccctcagtgagatgcccgcccgcgccacgcgcagaggccgaggctaagcgttttcagtcctcagaggcggcggctctcggcgtgcgcccgagctctgaaggcgactctcagcgcggcgggaaggacgagcagcggcggccgggcactcactgcgggactccacagagttcgccgcgcgcggggctcggcccggatgggcgcgggggtggcggtccccgcagggtgctgcgaagcggcccgggcagagcgtgccggctgagcgccgcggccccggagccgactggagtcgggcgtccatgtcccggcgcggagcctagctccgagcgcagcccgcgcccgcggccgcccgcacctcgcagccctcgctccccggcttcgcggcgcgttccagacaagatggcgcggcccggtccgggagtgctcggagccccgcgccttgcgcctcgccttctgctctggctgctcttgctgctactgcaatggccggagtcagcgggcgcccaggctggcccgcgggccccctgcgcggccgcctgcacttgcgccggggactcgctggactgcagtgggcgcgggctggcgacgctgccccgggacctgccctcctggacgcgcagcctgtgagtatcgcctttgcctctcgtccgggcgctgtcactaagacggggctgctggtgtgctcagccggagagggtgcggagtgcgctctgtgggctggggagacttgtgggtggccgagtggaggtcacgcgtgggagctcgggagagaggactctgcttctggggtttgaaggtgagcgtgattctggaggagcctgccttgcggcgagcgtgtgttgtggagaggatgcaggacatgagtgatcctgtaagggtgatcgagtgtgcctcgtgaagtctggaagtcagcgagtgtgggccgtggaggtgagccaccggtttgtgatttgaaactgagtgagagtgctgtggagcgcgaaatatgtgtgtgtgtagagtggaggtgagcgaatttgtgtgcatgtgagacggacgcaatggcagagtgtaggagcctgtgttgggattgggatccatggctgtatcttttctcctgtgctgtatgtaacccagcccttaggtgtcttgagttccctcaacttaccttcagttggtaatgaatgacagtgactcacatctccagggttcatgctatttatactgtgtattagtgagtatgtgttgcagtctcctgatcaccagacaatcgtggtggcttgacttggcattggccagggcaaaagggaccctgtcctgaagaagccaggagttgagaagctttgagacagttcttggagatgtctgagtgtggctgttagctcttttccgcatggctggcaagtacaggaactgtgttccagatcccttcctgtctgttccctggggtccccttgggcttgatccactggggctgggtctgctcctaccctcgagtttctcctccataaatggcacaagttagttgtggagtagtgctactatgggagaaggtgacagggggcctggctagctctgtcagtttaggtgcacttctgtgctgctgggattggggttcgttgggaacattagatttctgtaaacaaagtggagtagaatagcattgttattcttaaaaaaaacaatacaaaacaaataaaaaaccaaaaaaacctagacctttgagtcgaatcttgctcagctatcagtaattagcatctctagaactattagtaccttccagagaaaggcctagcttgagtagtctgcgtctcatttgagcttttgaatgtctttcctaggacacagaagtagtacagcagtagcttcagtcatgacatttgctgttttaaaaagcgaaaattgatgacacaggctttaactcacacctgtggcttcattgcagaaaactaggggctgggtatctgaccgtcttgaaggagagaagttgattcttttctaacaagaagactgtattcttagagtgaggggcttgggtcttcacattggtcacttgggcaatctgctgtgggagttctgaagccagcaaagacccttctgctactgttgctgccttgaggatttttctcttcttcagtatctgcttcctctctggaattcactactgaaaatgcctggtcttagagtggggctgaacagtggctctgtcagttactgggaggtagacacactattgctctctgctaagatttttatctattaataactgaggcagtttggggacattttggggttttttttgcatacttaagatggaatattattattattattaaataatagaactatgtgggtagagtcagagaatgttctcaagtgttcacttgttggaagacttgcaaagccatgtgtcaggggtgttctgaggaaggctctccgttcccaagccacacttcctggagaggacagagtgctcttatttgtactttctttttgtcacaagacctaccttggcttgcccttccttggagcagaacttgctggtcatttttaggctttcagttgcctacaagtgacaattcacacagcataaatacctttaaaattgtagtctctcttactcacacaatttagtgatcagtaaataccagactgagtgttctgggcttcaggagataggcctctactgaagatggttttaatggattagttttaatattcaagcagtttggtttctgggttagtatgtggcatgtgcgcgcacgcacgcacgcgcacacacacacacacacacacacacacacacacgggcctttgaagaatactcacgagtttattttatttctgcttaaagtgaaatcaagtgtgaattgtctcctaaccttcatgtttctcaacatatttccccccactggtattgagggttgcacccaagggctgcagcacgcgaggctgggcaagctcagctacttctgaaccgtatctccaataccagcactttccttttaaaccattgcttttactttttggcaggatagcagtggagaaagtctccgtatgtaatacaataaagtatcttgtattttcactgcatttacaccttttaaggtcattgtgtctagaaaatgctttgagctagtttataagcctatgaagtagatttactgcagcctgctcaaacagtttcaggctgtgggtttgcgatagcaggagacctatggctttatgggactcctcccccttttgtaaacagtacatctacctttggagttgctcgtaggccaagtgtagagaagctaaacgtttttaatagtgaataaaagtttagtgtgagtagaaaaagcagggtgatgctgatggaggagaacagaaccctttccaaggctggggataacttactctctatggctatgtagagtggtgtggagcatagctgagtcgcctgtcctgttgcataggagagattggcatggtccgaccagaacactcataaacagcgccaaacacctcccagaaccttacaagaggctgaacttcttagaacttaggtgtttgctttccttcaaactatttttgagagcatgatttcagaagctccttaaagagcattacagatttactttagactgtttctcacctgtctaaatttgaacagagggtttagttacaaaatagtgttagtgttaacattctgagagttaactgatggttgggagtgggagggaggcgggcttaggagggcagtccttggatccttgttcagtgggggaagggaacagggattcaaaagcaagggcctttaggaaaggacaccaagtgtggccatctcgagtgccagtagtgagcacttattgttttggcttctcttgtatcatatacgtatttgcagtatcaggttggctgcctcaaatctagcttcgatggtttaagcacataagtgttggttttggctacattagacaatatgcattctgtgctttcactgtagagttgggacacaaggacaacccctgtctgtcagattctccagcagtgcttcaagggcttggtgtgcaaagtgttgtgagttaaggttctggaaatgaccttctatcattattcaaatcagatgaccaaatccttttagaatccaaactgctgtgtgtgtacgcgtgcacatgtgcagatgtgtacgtttaaatgaagtacccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgaggggatttgcacctttcaaagctttctctgctctggggccatattgaagagatctgtaagaatgggatggaacccaaggctttgcctactcttaggcaggcattctgttaactgagccctatcctcaccacattgtccccctccagggcactattttaagaatccacacgctcaacccgttctataattacatatagttactagatttcacaaactttggacttctgagtggattataggcagtagttcttggcaagatcttgagaaggctggggacagacagtgcagtatgctgtgttaagagcttctttctgtcccatgtccccatatgcctgctctctagcctcctccctctttggctaattatctctcctgggttccctgggctgcttccctgaccagttgggttgccctctggctgaccttttccactgtcaggccctatgctcgccatgaaagagtctcttcccttctctgcagaagtgtttctgtggtgcaaagccttgtcagtagagctagaaatgccccagagcctgctagaggctactgagacacctggctctaaaatatgcacctgcctggaagagaggtctgtgagataggaaggccagatggtggccgtttgaagtagcccatggctttttagaagtgagagggaaatctagaagagggatcctttgaattgaaagttgctgtaagcagtaagaatggtggtggttttgttgattttgtcatctttctcttccttgtcctcttctccctcttcctcctcctctttctcttctccctccttctctcccttctctttccccacatttgtttaaaacctaaaggggattcctctttccctatagttgtaagactaggtttcctggttatgtaagcctaactttcaactagttttgatgagcttggtgacatttactcactggggtccttccccctcctcagcaatccccagggggtctttatcaggagcaaaccgaacttcaggttgtgttgctatccagagttgattacaatggatgttctttcaaaggttaaagctttgtctgagacaggagagagaaaggggtggaggggaaatgtcccaggcagaggaagaaaaatacacagaaatctcaattggtgtctggcctgtgggaggtttaggggttgtaccaaaccagtggggtccattaagggtggacttcattactttatttcttgctctgtgcggaaaccttgactgctgctgttcctagtaacgtagcagttttggttctatttccttatagaccttgttgaagaccagacgttaaactttgtacagtggaagtcacattcatttattgacttagtccacatattttatgtatgaatgaaaatttcagtttttcaccagttaaattgcaaactgccagtttgtgtccacactctcttgggtgggcattctttttctcatccaagagctttttgctttatgtttgtgtgctgttatgttttgtgtaatctagtgcttcctttgtaggtttaaaaatactcatgtccattattttaaattatgtgtacgcctgagtgtgtgtatgtggcatatatacccatgaatgcaggtgtccttggatgccaaaggtgttggattcttggagctggagttctaggcagttatgagctgcctggtctagatgctaggaactgaatacaggtcttccaacagagcagaaagtacacaagtgctcagctctctctcgggcctttatcatctgttcttttgacccaaacatattttgcatagacttctaaaacgcagttccgcaaatctgctaataaaagttgttctaaaagtggtttcttcctttccctgggtcttgtactctttgatttccccctgccttgttctttgtatcctctctaaatgggcacccggtccttataccctggtgtctgatgagtgtgatggatgggaatggcatgaatagaacttcctttatttttactctgctatacatgttggtgccatccaccttgcagggcgcacggggtgggggcaccgggtgccacccgtcacctcggagtgagggtggaaagcttgaaagttcttcttaaggtttgtttctggtatctccactctccagccctttgtccccgtttttttcaaggggatgatagtatcctatctcataagggctgggcggacagttacattgtgcatgtgtgccctggcttcctctgtggagttcaccagttaaaggttaaggtggcagtacctctgtcttgcatccgttctcatgattagttcctccgagttgcatttcccagggacgaaagagtttcctagggaaaggttacttttcagctaggaaggaatcttttgctgtgggagcatggcatgactcacaagccaggcatcgtgctctaacagccgttttggtggttcaggaaagctgcaacaggtagacaccgccgccgtgtgccttgggaatctcagatgaataggcaggaagctgtacacagttgcagtcaattatacaattagcaaaaattgttgaggtagtttaaaaatctattccagttgtacaaatactgccgaggtagcatttattcttttgggaaggtgcatgggaaaaagcaggaaagtgagaagtccttaaaccaatcactttatcctcttgtttctcagggtttcgttgaaattgagctctacccaaatacaggtagcttggaagaatgcaggtgtgctctcatagacgagattatgttacagtctttagggccggctgattctcactgcttcccacctctgtatggaaagacttggaggagaggaggtaggaggggagacagttactgttgaaggcagacaagaagcttcatctattttggtctgtgtacaatggtgtgctaacttgtaggcagtgcagacagcaaaggcctggccatctgaggagcctggcaagggtgcaccttgaaaggccgtttgctgttgctcctggtgcacctgttcacgagtcctttccctcgtgaatggccatgattcacagccttgcccacctgaagggctgcgattgtttgcaccttattactatttaatccaacctaaccggtaaggcccattgtgctaacaactagtccgttcatctccttgaggcccggccggattcatcgctgcttccttgtgaaccaggataccggttccaatcaccgctccttgagtttgttttggcaaaagacaagaaagcacggcctgtctttaagtctttgtgatgcctaggtctctttccttttatgatcagtaggtattggaaatgaataaatgagtaccatttgccccccacaagcagccctgtcccattcttgtaaaagctgatttaaaaaccagttagtccttaaaatttgttttctgtagcttctttgtgcagcagtgagcagttgcccccaaccccactcccttcctgtcctttgacccttctactaatggataatgtgctgttcaaatgattcactgctcaactcgccagagcacacactgcgctggtaaaattctgtcttctggattacctacttgatgatggctgttggggatcctcaggactgaatttctgaactggggggcatcaggcatctaggtagcactaggtcctgtggtcccagtactctccctttgaaagccatttgcatctgaagcactttgggttggacaacaggaaagggctgtgaaagctgtcaactgactgtgacaaagcctgttgcagagagaactttttttttattcttgtgaggtgattggaatgaccagccttaaaaccaattctgagttaaggaaatgtttgccatgtagcctctgttgatgtaggatgttttcttcttatcactgtttcataagagagacaagtgggcagtgtattaatgacgtcgtgaattctgaaactgtcagccaccttcagtaattgcccatgcaggcctgtttcataggctccatgctcctttctccttctacagggttttacagaagtaaatccagagcatgccattttctctgtaaatgtgtaggatgttcatttagcaggttgggggggggggcatactcacatggcaactcctcattaaaagatgactttaagacatgggaacatgaacaagttctgaaaaataatggacttgttttctaaaggaaattctgacaacgtgtttacaggatgtttgccaagcacatatttcatgcaccctgttttttatattctcaaattacgcgggttttttttttcccccctacctttggttttgtgaggagagtttgaaacatttttagcacccgagctcagtcaggttgtaaaagtcacttgagttttcttccatagatccttaaatgagagggttcttccaagctattatttagattagactctattagcaagcaaatataattacaatgggtcatttcaaagaggcattttagatattattattatttagtgtagagatgattagccggttggttgtagctaagtcttgaatctgaattgagttaactcgtgtttactttgcagggcctgaccctccagctgtgtctacttgagtctgctttaaatagagttagaagcaccctataagaaaatcccccaaaagcacagagccagcttcctggaaccctctgggctccttttagcttcacacagattagaacaatgctttttcctccttgctactgagcggtccatggtccttggttccgtttctctgttctctttctgttggttggaggaatttctttaaaataaagttgatgattttcatattctgtctgtgaaaatctaattctaggtaaattacatagtgtttagtggtttaaaaatccagcctgtatgtgtcattttaagctcacagactcagttaagcataattaagccactgtcatatttgattagataccatttacagtggatcctcttgtttacaaaagcatgcatacacaaaagagtttgctaaaacgtataggcaggagaactaactatgaggctctgattgtaactttaagttctgttttgcagattgggatgtgtggtacctagggtcatcttcatgctcacagactgagttttcttttctttctttctttcttttttcttttttttgactaaaataattttgtgtgcgtctgtgacttcctttctccacctgggacagtgtgagtttctggcacatgagcgcctagtgtttgcaaaactttataaacagccagaagagctcgtagcttccaggaagtgggttgttgatgcaaccgagtgatggatgctgaggccaacttgagtgggggggattgtccgctcctcttcaggagaggagagccagaaaccaagccaaacaaagtgtttattagctaccagggctacctcattcccaattcactgttttctcagacccaatgtccgtccgtgtcttgtccacaggtaatctgacctcatggaagaggctctctgccttacgcaagagaaaaaccagaaattctgctaagattttcgctttgtatttgaaattatgtatgtatgtatgtatatgtgtttgttgtatgtgcatgtgttcacatgtagtgtgtgtgtgcttgtgcattctctctcttgcccctggagcccagaagagggtgtcagatgccttggagctggagttacaggtgtttccgagccagccaacatgggggctggagttcagagtctggtcctcatggttgaacaacaagtgctctcaatcactgagctctctctccagcccccgagaagatgtctagattatttcacaactctgtttgaaataataattgggaacagtttaattatgttagttctggacccacaagtgaaatttctaaagttgtggataataagaatgtggtaatatggaaaccagcttgcagctgagtctcagcaggcctgaagttctgtcctggctctgctactgacggggagtgtgacctcgggctggtcatctacttacctatctgtaagagacttaagacttataaaaattcatttttagggttatgattctggcaattggaagcaaagagggagtgaatttactgattattggatttactggtaagagagtaagtgggtctgtgtatgggatgcctagctgaaagtactctggcttctctgcacagatacctaggacagccaaaggagaaatggagcactgggggaggggctccgttagggacccttcactcagcctttggtattactaaggagaagcaaatagtgcactttaaagcaaggcggaccttccccagtctgaaagtccaaaatgcttcagattctgacagttttgagcgctagcatgacaccacaagtggaaaattccgtactgggaacttcgttttcatgtacaaaagtattaaaattagtgtataaagttgccttgaggctatgtgtataaggtgtatatgaatcataaatgaattcatgtttagactcggatagactcctcatgtaaataacccagaactaaaaaaaaaatctgagatctggaaaactgtggtcccgagcattccagataaaggattctgggccaaagaaaactacgggacctgcaagcttgacgtctttgacttagcttttgaggaacatagctttagagaaaaggcaagaagttccagggtcattttagtagggttttcttagggccaccgaaggccacggatggagtagttggatcagtgaagttttccccagcctgctaatctttcagctccatgggctgagagtacagattcattggcaacagctgcaaggaaggccacacccacagctctgtcctctggagccagcttgcctttggttgtatgcatgaacatggctgattctgagtagctttaagccattttccctgggagcttttctgtgtgcttttcagtgtggacactcagtagcctgacttttgtacaaatcagtgacttctttctccaatttttgtattcgctcacttcctttttaaaaattgttttatttatttctccagtctatttttgttgttgttgttcaatagataccaaatttacccatctatgggtttccttttggtctaatattgtttttggaaagtcttgatttatgccaaataggagttccgtggaggacctagtagcttttgttttttgtattctttattttaaataattatttgtgtttgtatgtgtgcatgtgttcttgtttctgtgggtgtggatgtaggtgtgggggagtctggagggccagtgttgggtgtctctcttctatggctccccactttattttgaagtggtctgtcaatgaagctgagactcattctttaggctaacttaggtggccaaaggcgtcatttagaacctggtgctgaggttacaggcgcatcctcatccaactaattatgccggtgctggagatctgaactcagggctctgcgcacacacagcatgcatgcattatctgctaagctatttctgcagcccgttctctgtgctcttcacagctaccttccttccatgtgcatctgttgtcttcgctggagattgttgggctcttccttttatgcaattcttactttgtatgttttcatgagatgaggccgtagggtgttcttctgttctcttcttgaaatcatgcttcagggagtttgagctttgtttggggctacaccatgaatggggtgaagttggaggccaggtagtggtgttttgaacctcttgatataagttcagcaggaattagagattattttaggagtgagtagtccaaaaagcttcttttaaaaaaaatatctcattaggcgccaaggagatagctcagatattaacatgcacgagatcctgtgtttcattcccagaattcatgtaacaaaatccaagtctaatagtttgcacctgaaatgccagtgctggaagggcagagactggcagatagagccctgggctcactgggcaaccattttcgtctacttaatgattgacagaccagcaagagagaaaagaacgggtcaggtggtaccaaatgacacatgaggttgtcttctgacctgcacatgtacgtgtatgtacaccccgcacacatgtacacacatgacacatgtgcagccttagatgtgtataaccttacacctgtagtctcagcactggggaggaggggcagaagaatcaggagtacaaggccaacacctactgtggttgaacccaatctggactacctttgttattgtctaaacaaacaaacaaacaaaaacaagtgaaaaggcagcccttttctgtcctgttgtttaagatcaaaatagcccaaatgcttttcccacccttgtacgagcttaatctagagtgccattttctgctactcctgtgctcttccgtgtctttcctgtttgtgtctgatcttctcccagaggattctcagtcctattaggtaactttttacctcagttagttggggaggccataggaactgtggttgtttcagtccggtctgtggagaggactgaaggcacatggagtgggggttagctgtgaggtactgccgtgtgtgggatctgtgttgccctcatagcccattgaggtaaaggggtgacagtggcctctgtcaggtggggagcagtgcttcttagcttggagtcaggactttgcttgtattcgagagagaatctgggacataaaaccaacattatggcaagtgctcccttccctcctcctcctctcccattttctccgttctgcctgagaaccacttcaaaggctccgatgtgctggtgccgcaagctgcacagttattgttaaagaatttggagatataattgaaaacaaactgttcgagcagagcagatctaggcaagttctagctctgagggagaagggaattccaagttcttcctctatttggagctgatgtctcagaacacttgttctgtagagtcatcagtgaacgttacgtctgggagttgtatgttgggaaacggcgttctttttagatggagaagaaatataaacgcatacatagagttacagtgcagttggaaaagtgtagtcagagttaaaaaaaaaaaaaacacaaacaagctaacatttaaaccagcagagtgattggccatgcgattgtgactcttcaaatggaatgtccatatttggatgcagtaccacagctaacttacttactgggccccctgttcttcgttttgggggccgctgacatttcagaaatatcacaggcagaatcattagccacagcaagtgtgacttcggagtttgagttccctaaacatttgtgctccttacgtcagttcagcttctgtttgccagtaaaggccctagagcatccatggttcggactctgtgagaaaaactcactatcatctgtgagcttcttgtcacaggctgtggttgggagataaaacagcctgtgatctctgattaagagtggcacccctggaacgtggccttgtttgagtgactttggacagtttattttctctttgcctccttttttttttttttttttcttaaatgagaatgactgaagttcccaccttattgagatcgtttaaggacaaatgcctgacacgtggttgaagccacatgagttgtaaccgtttatgtttttatagcaggatatatgtgttaactaatttgaaatattctgttgaaatatatcatggatgttttatacatcaagtccagtgttggtagaggactggtcagggcctatccgtagctgaggttggaagtctagtctgcttgcacatgatcgtaatagaaaaaaacgctgtaagacagttcctggcccttgtagtattttcaggtctgagttccctgaggccagtcactggccccttctgctctcgagtggcctgaattaccccgttttggcacacagttggtgctttattagtggtgtctaaagtgtgattttggagtgtatgcttctggactgctctgtgctttgcctctttggtgaggaggtggtagcaggcacatatgccttgccatctgttgtttattgtttctgttaggttgtggtttgtgtccctgttgcgtgtttctttggtttctggagcaactgccaatattatatgcttggggatcaaaaaaaagtaaactatttataaacagtaaagtatccttgggtttggaaagtgtttttctcaaatgcgtgtatatttggtggctttattataatctcactgatgtatcattagacagtgtgcagattgaggctcatctagaagatgggcaagtcagagtccagccttgtgtaaccagcacacaaacagccttggtgataaggccccggtgttaacgctgacccgagcggtgtatttttaactcaagaacatataaacagtttagcctgctgatggagtttatacttgcccaaaatccttggcatgcccagggccgggtggtgctggggaatacatgtggtcttaggagaatgcttcgagcagcagtcacccatggcccccaacccttcattttagagaaaggaatgcagggatggaaagaatgaagggacaggccggttgctgattttgtatggtgcattttacattgaactttaaaaagtcccttttctccttgttgtgtaggcgtgaggtgaggtagagagctgttgactccgggttttgtcggtgctttctcccctcccttctcaagccacaaggggtctttgcagagtcacaaattagaatagacttcctgctgcaggctgtccactccctctcgagcttcctagtgcattcctagctggttccatctgcccgtgctatcatgtggtgttttttctagcttctggtttgccagcttgtcctgtgcatgtctggaagaaggttcttcagttttggagactcctgtctgtctttcttagatgtctgttccccggaaactatcatttgtattctctttgacttggattcccgttccggaagaccctacagtactcatataggctttgcagggcgttaatgtggcacctcaatttgtctgtaagctgccctagagtcgagactgcctttctttctaatgcttctttttttccctccacagactctaggtagcatcaagcctgatagatacataatatgtgcaggcagcacaggtacagaagtacaaagactgacagtccttcttccaggctctctggcagggcttggatagctcaggttggcctcaagtttgctagtagagaagaatgaacttgaacttcagattctcctcttctgcctcccaagtgctgccttccaggtgtgtgctgctgcgcccactctattcaagggcagggcttgaacccagggcttcctgcatggtaggcatttggtcctggccagtggtcttctttctctctacctttctaagtcctgtaggaatggacagaacagctctggcttcccagggctgtgtatctgttcctttccccattgacctacttgtttagcagcccccttcatcttctaccaagtgctcatgttgaatatttagaagaacaggaaggttttaacaccttacaacaggagtttagaagatgaccgacaggcactggaggcactgcccgggacctgtcttccctgtggggtccctgggttctgcttccttgctggagtcttccccatggctgtccttggcaggtgggccagactgtacagctttcctctgagttgtgtttggccagggcacccatggcatatttctgaactgttgacatggtctctcatctgctcctttgccggagctgcccggtggagtctgttttggggagggttgcttttcacttcgactaaggctgtctagacacccttccccttgtggttattctgctcagtttatgctgagccctcgccaggcagctggttttggttgcctgagctcttggttactctgctaagacctcctctgacagaaagcatgaataggccaaggtcatttttcttcctctttgctcttggcagaaggaaggattgctctccttgactggatccagtacatacaacattcagggcaggttactgtatcctcaggggacaaagccaaagtagcaacacagatttctaagggccagtacaacagactctggcctcaaggacttataaatctgacccctttctgtgtggccctggggtatgacacttcagcccctactccatccttaaatacataggacctctgaaggcagaggagtcattgcagatcttctcagggtgggtcctcgctgggcagttgagaacagctgagaagacggctctgctgcggctcagccttgctcattggttttgatgattagggagacttgcttgggcttgggattcttctgcagggaggcctttgtacctgataacctgagctagctggggggaggtgtgctttctgacgttggttggttgagcaaagctgccttaatctagtgaacatgttattaattacttttaatttatatggtaataaatgttaggaataaaaaagggaaagtgcaaaagaaatggtgattcgctttattattcagtaataaataccatcattttgttgtatgagtttgcatcggtgttgcgattaaatgcctgcttcaaactgcaggtgtttgttttgaggtgacaatatgataatgttgtgcaatcctgaatggctttgaatcccacagcctcctgcctcagcctccaaagtgttgggattataaccccaagccccttacaatacctggctcaaattatgggttttttttggtctttattattttttgaaataaaaatacgatcacatagttttcttcttttctttccccgatcccaccctttctgtgcacagttctctcccttgctctttctaattcatagcctctgtttctttaagagtttgtgtgtgtgtttctaaatacatgaagacaacctgcttagtccatatactataacttgtatgtatatggtttcagggctgcttacttgggtaaccaacaatttcaacttatgttttaaaaactcagtattatgaatatttcctctatggttaaactttatataaaacagtatggtttaagttataattaatccttccctgataacgagcctctaatccttttgtgcatagttatttatatacttcttagttcttagactgagttacctcgtctaggttgctcttgataggaaaattcttaaggcttttactacaacttcccccaagaaagcagctgccaaccagtttccaagctcctgcttgctttcctcactctcagcagctcagagactgcttttcgctctctgtgctgcacaccaggacgctgcctcgcagcctcccagcctccctttctttggatggtgaggctgaacatgtttcactggttagccacaggttcttcctctttcaatcttcttcttcttttcttctgtttgatccagtatcgatcatgatgccctaaccgtgggcttgagacttggccactgtcggactctctggagctggcgtttctgagccagggcagatctaattctgtagaaagctgtgctcctggtggccatggcataattttggccctgaaccaggacgttctttctttttccttttttttcttagactcattttgctcttgtgttccacagaggggaattgcagtggctctgtgggtccccaggctgctgtaaccccctgtggactcaggccagcctactcagcctctgtaccccgtctgtggccagagtgcctggtacctacagctggtaggaatcagggcagattagcgtggccgagaacccttcaggaacagcttccagcaaatggaaattattttaaaacaaattgatgtggtttttctgtcaaacctacttggagcgtaaacaaggttggactgtaagctgcccgccgtctatggacaagcctgtgtttagagtgtggctttcagcacagtaaacatggtctctaaagtgagttgtcattgtgtctgatttgaaaagtaaaagttgtaggctggagccaagccggcagacagttctaaggcggtgctgcgcaagacatcactcagtcatttgtctttctgccacaaagataccacttcctgtaaagggctatggagcgaggagtcatttggtgttaaaccgattaaggggaaagaaacaccagggcgatttctgtggtgagataacttcttttatgttgttcctttgccatgtggtaatatcaaaaacatcttgtgaaatgcttaattcttgggtgtttgtgagtgtgtgccctgcaccctctccccagtctctgtctgtgtgtatgtctttgaattctgtgccaggctcaaggtggttccccaacctaggaacaatatcttattaaattggtttcagcctccctaaagggtgaaacaatgcttttaatgttctgatcatgtattaatgaacagccaggccaaggggcacttgccaaaaaggttagggcgagaaggccaccaatatcagagggactttgtactctgggagtgtgaatggtcttgggtgaaaggagtttattgcacaaggggagcaactagaatctctttgatgttggctagcatcctccggggcttcccagctaacaggtctctgctggctggggtgctgctgcagcgtggtactggggggggggtgtccctgaacttgcccttgactgggaaggaccagttaggtacctgtgcagaaggaagcactggccactcagagggtcttcagtgaagttcagtaagtgcacgccctactgcagaaggaacagctgtacctcccgagctttcctctggagggactgtttgagaaccagcatgctagtattctaaaacctccagccccaaccacagaaagaggtttgatcctaatcttaatatgactaatttattttctccccaatgcactgacatttcctcctgccttctggcctgttctaaatttttgaatggctggcaattgggagccctgctttccatatccttattaaataattactcaaaagaagaaagaaaaaagccttttcaaaatctagaggccatgggcgggaggaggagctcccatttaggttttgtatggtgaggattggctgagctcggagtgagtatgtccttccagaagcagaaaggggacagtggcggaactatcacaggttcaccatcataaatgtaggtactttggactctcctgtaccttctagcatgagagtttgaagttgttgttgttgttgttgttgttattattattattattgttatattgaagtgaggtagcatttttagtctggaattttgagtctcaaagtggtaggacactattttatcccctccctccctttgttttctccttcccctttccctcccctcctttctcttctgtatccactcacccccttccttcctttctttttagagacagggttttactatttagccctgattgtcctgaaaatgaccagagctgtgcctgcctctgcctcctgagtgctggaattaaaggcgtgtgccaccactcctggcaggcaactgttttctttttgactattagctttacggagctagagtttgaacaccacattcatcttttacgtgttgagagtctgagtttttagtatgtccagagtcgtgcagctatcaccactaattctgggttctttttaattgctccaccacaaaaccccatgctggttggcgctcccatccccagccttccttggcttctagttttctgcattggtaagcctgttttgagtgttgggtgtaactggaaacatactgtacctggcctgtcatgctacctgcctttgcttagcctaatattttcagagttcttacatattgtacatatcattccttctttgctcgtttaaaaaagatatttatttgtgtgcgcatatgtgtgcactctcgtgtatgggtgctcatagagcatggaagagtgtccgctcctctggagctggcgttgtagacagttgtgagcactctgatgtgggtgctgggaactaagctggttccttgtcagctcagcaagtgcccttaactactgagccatccgtccatcaccttcaccccactttacctttaaaacatctgaataatgttcaggttttttgttgtttgtttttgtttttgttttttttttggatataacaaatattgtctattcatttactagccagacattgggggttttcttaccttctggctggcaagaatagcacagttatgaacttcccccaaccaggccaggtctggctttgtagcactgcctctgcttcctgtatgctgggatgacaggtatgtaccgtaccataaggtttgacatgacagtttatgtgtatgttttgtgtgagggtatgtgtttctatgtgccttggacatgttccccagcatatgtggaattgctggggcatatgaaaagtacatggtttggggtgggaggattcctaggctgtttataaagaatctgtaccatttttaaaaaagaaaagtagtatgatttcaggtaaggaaagtttgggctgtttctcaggtagggatgttcctctcaggcttgtcttcgggcttagatctcttggagtcttctggtagaaatacaagtagaaatcacaaatgcccattaactcataaaggtaatatcccacagcccatggtgagtgagaaacactaaatccaaaatgtatttgcttcttgtaacttgtagcttagcaacacagtgcttggttgtttgtgttggttgctgggagctgtggcttgcctgcagagagagtaaggatcagaccacacatcactactagcctgggaaaagatgacattcaaaattccaagtacagctcctactgtgtgtctctggctgttgaacctccacaaagtccaagaagagtgactgtctgtacttagtggcttgcccctgtggcagcacatggcagtggttactgtggggaccctcggtatctgagtccagaggggttcacagtgctggtctctgccaggacagactaggggagcttgcttttctgtagcctgctgaaatttgctatgcgtctgcacccgtctctgggtctgatcatttcttctgctttggggcaagcctgctttgccaaccgactggctataaatttaggtcgaaatgcagaaagcaggctgtccaaaggtaggctggataattgctctggacaggtttacaatagggaggtgtgaagtgcttggtggaggcaggaagctgggggagggggattgaacttgagcagttcagggagacggtctgacaccactaattgaaaactatggctctggtggcttctaattggaagggaaaccagggcatacagtggggttttgttgttttgttttgaagcaggaaagcagagaaaaaaaccactcactgagttactgaggaggtcggtttgggatcttttcaaatggtattgtgggctggaacctgtattttaaaagctttaggaaattgctttggatttttaagtgtgagctttcctctaaagtgtgcttgcctgaactcagctgacgcccgatcagttgtttaacttattctcatggctcttggcttttttttgttgttgttgttgtgctcttttacttgaaacactgcctctgatactagttgtttattatacctcagattaagagctagattcattttcatttattccagactcccagcaacaacttgcagaaagtctgttcaaaactgaggtataaaggatatatggggagtggaggtgagtcttccttgaagtgcagtggttctcaacctgtgggtcgagacctatttgggggtcagatgaacctctcattggggtcacctaagaccatctgaaaacacagatatttacattacagttcataactagcaaaattactgttatggggtagcaatggaaataattttatggttgggggtcaccacaacacaaggagctgtattgaagggttgcagtattagaaaggttgggaacactgttgaagtgtgtggtggttaacggttaatctcttttaacaaggctcaggtggacctttatgttgccttgcaactgtgatggattcataaacccacacagtgcagccaactcatatcctcagtttaatttcctttggttgaaataacagccagcagctgtttggcagtctcttattcttcagcatgctgaagacactcacacggtggctggagagaggcatcgtttgcacacagctttaggattcatgtcctggctgtaacatttctttgggaaatgagggaaagtgattttaagtgagaccaaggaaagagtcagagtggttagggtgggaggggagaaggggcggggcgaggaggtgcagagtcacttagtcgcgggataagaaaggtcctctgagtccgagcagcttgtctcttgaatggtggttattctagctctccctctgctccactgtgccctgctatctttggggagtgtcagttggaaggatcaggattaaaaacgggaaagcacagtcacagtactgcctcagcagcaaagcactgtcctggtggggagtgtctacagttctgtaacttactgtccacctgttctgagaggcaagggcagcgagggccttacacattgtggagcccagaggcccaagaacctgggtagtggtatgtctggcttcacaaacagcactttgaagtgctacctgctcctaatggcaacagagccatcagttaagcaggcagctgctaagcacaggagtgtttgcacaagcaaccttcacattttctgatccttgatgaaagcttgttggttgtgaatgattaacttcaatgtgcacgaggaaacgctatcctcttaagtgtcaggtatatttttatgtaagaaaaaaataaaactaaccacaccctcagctgtcaccatttggggttgagaatctgtgtgctcatccggcgaatccactgggcagtgtatttaaagcagagtaggaatgttagtgtgtgctagctctccgctgactgtcacattctgtgagaacgggaagaagggaatgggttctgtgaggcgctgagatgtgtaaacgtgacgatcttatcaggctgcagcgagtatctagattcacagggaggtgctgggtggggtattcctccacttgggaaacacgttatacgcataacatcaaaagagtttggataaaagggttggcttgagaagtctgccccagtgtcacgtcctagcacttcaacaagagcgattgaggcaggtgctctgtctaatctgtccctggggagctgaggactttgattccagtgcagtgtgtctctttgagagaatggcaaagagctgactgactggggagctacagtgtagcatcccagggtactctggatcacaagagacttggagatagccattgtgagtctggttcccaccatgtgcagcagtgcccagaggtccctacagccccttgaagctgacaatgatggggtagttatttcttctatcatttactggggaagaaaacttgcgataaggttttcatgtggagtcagagtggatgaggtcatggggaaggaggaagggagaaaagagtctgggaaaaccaaggctgacctgaaggggccatttcatagcttcccaatgcgtgagagtggtggaggctgaagtgatggatgtggtgtgagtggtgtggagagggtgctaggcatgactcttggggcttggttactttactgcaagcccaaagctttgctcatttccaggacagaaagcacgcatgctgtaggaggggagaaagcaggtgttttgcctttcttctctgcctctttattgtcttcaggtgcagtgacatttgatattggcagttctgaaatacatcgaaggcattattctcaagctgcagggattagtcctgacataaacggtgggtcctaccgccagcctcttgtatggcgatgaagaaaagaaactcaagctgtaaatgaatctctgttttggggctttgtagtggcaaattatgtgaatggctgaattgaaaaggtgcctggttttataccatcatgaatacccaggtcttagataaatattgacaccagcagtgtgacaggcctaccatttgtctcatgctcgtaggaataaaagatcttttctcaggtgctcatgaccttataaaccaccctgacgagtttgtgcaggtgcttttctgcactgcttctcggggtttgagagtcggtggttttctctttgtgcagacttaagccttgcctgatctcaactcactttggcttattgatcgtggttgagttggctgcaagtgagggtagccactcacacagttttgcagtttggcagtcattgggatgacctgggttgggaatacctttaatgacattggttgaatttgaagagtgagggtggctggattatgataagaaagggaaagcatgtatagacctgtgtggtgtacagctatggagcatgtatagacctgtgtggtgtacagcatgtatagacctgtgtggtgtgcagatagggagctcagctgagtaaactctgcctgaatcccaaaccatacttctcttatggaacagagctagcctgacacttctgaagataataccagttttgccagtgtgagctatccagcaggctagctctcctactctccagtgctaatgggccagggcagtcatgttagggtcatttgatttagggcagggtggtgagcagattcatcagcagctctggtttgataccatctttgaaaaggtgtgattggtggaactgggactgttaacccgtaggaagttctagctgttcatagggcagagcgtcagtggcccaacctcataagtgtctgcatctgaagagaccctgggctttgatttcttgctcagatgggaggatactctgtggactgactattctgcctttcctaacatacacaagctgtagagtatctagatctgtgggtctactcttctttctatacacaggtatctaggcacatgtgttgtatttcttaggattttacctttaaatagaactcaaaagggggtcatttatgtgtgattttgttcagacttctaatcacctttgctggttctattctataggcacagtagcatatcatttggttaaagtaaaaggaatcaggtagaattgactggtcatatcaactctctgagacctgccttttgggagcaaatgaccaaaagtcgagtggagaaggagtggcatgctaccataagcctcgctgatgcatgagtaaaaaccaaacatttgttttgtagccagctttcctttatgtgtggtatagttttagtgtattagaggagagaggtcttagacacgcgtcacctgattctctgcacttgtaatgtcgttgaaaagggaggcccatgtagggacagcagaaagcaacctgtgaatggtgcgtgctgagtcctgctgttcagtcagacactggctttgtatctgtcggggatgttggcaccagaagcagagtgattgccactgcccctgcttctcaagcagagaaggtaaagctgtggaccgtctttcatgtccatagtgtcttaggatgctttcctgtggcagagagaaaactggcttccatcttcagctaggcatcctgtagaaacacatgcaatctttacaaagctccttggaaaaacagacggaataaaagcccctgtctgttagctagttaataaggttgttagctgcagataccttacgcctgcacccgtgtataatgcggagcaccgtggtaaattctagtaaacatgggcttctatattgtgttacggattctgatgcttgtgcttgccgtagactcatagtgacatcacatagagatggtagcaggcagcaggcgtgacgttagttaaaaatgcaaggacacgtgtaagccaggggagctcacagtccactggcaagggttttccttataagaagttgcaggatgggaaagttgttacattcactgtgtcctgtgcttattaaagcggtttatatggcagagagagggaggagggactgataacaccaaggtaagctgcagtttgtacagatgtatttgtttaaaacacaccacttctgtttccttcttcctcccttttagtggaggaagttaggcagcatattatgtattgttcctttgtaagctaggacatagctgccgaaaattatccttctgactgcttaccttaaacattgaggacagtaggctcggtggttaaaagcactggcttctctttcggaagacctaggttcaattctcagcacgtacatggttatcccccagtgggactccccccatggttactcccagtacccacagtttacaactatctgtaatgttccagagcacctaacatactctgacatcttcaggcacatacatataatgtagtttgaaaaaaaaatcaaataaaatttaatagttgggtgtaattccaacactcaggaggcagagacaggtggatgtctgagtttgtggccagtctgttctagagagtgagttccatcacagacagggctatacagaggaactctgccccaaaggaaataaaacaatgaatgaatgaatgaataaatattgaaagctcttgattattacatgttaagaaatgagtatcaaattgatgttgtctgtttgtttctgtgatatgaaattttgtactagtattttccctcaactggtttatatatagtagaagaaaaagaattggaactaagggtttaaaaacagaaactataaaaaattatttcctggttctaggaaactggaaactggtgtttaggatggtctgtggtggggtggtccagatagaggaattttgtttgtttttatgaatgcctgttttactcagagaaagtgctgagccatggagccttcattcttaatgcatatttatatcttctgccaggaagacaggtgtggaacttggtccctttaatcagggatgctccttatagagctctgctaagatggttattttgcacattgagagctgtcctttcacggctcttactgttaaacacatagatgtgactctgggcatgaagtagagaatcattttaggtgctggaacaggaagttggtcacagcattgtgggtggtgactctaccagagctgacagctaaattctgtcgctcatcagaagtgtctatcagggtaaccagtttccatcttcctatgtatactctaagtagtgaattttaaatctgtcttgtgagctcaggaaacacactgtctcccaagaactcacatttggtgggctttgcaaagtacttggagaacccaggatttcaaatttattcactaggctaatacatcttttttctcagtccctcctgtcctgacccctttgcccaactgatttttgttcctctagaggcaaacgttagttccctgtttcagtagagcattaggaagctcctttgccatcctctcactgtgagcacttattagcttctaagtaagtggccagaagtgagcactgtctgttctcaggtctggtggccatcttgggatcatgaagtgcccaactccgaatggaaccatactttaaaaggtagattatgacccaagagtgactgttgtacaaataatgaatgaggactctgggagaataaatttatgacttctttgtagagaccagggaagaggcgattctgaggggctagacttgtgaccctgcttccctgacacttccatttctaagtctgtttgaaacctttctctaatggtaaaattaaatagtggccctccataccacttccctgcttcggtggtcatggtcacacgcctctggtggcagatttgtgtgtgtgggtggggtaggtggggggatcaggcttgtgacaggcggccatctcatgctcaaataaacgccttttgcttataaagtgcccaccagctacagcagtcatgggctggaatgcaccttcatcatggaattaattcatttgtaggtgttaatgatgcacagaccatgttaacaagtgactattatggggaaattgtggcttcccctcagtgtcagcctctaccaagcatgccttaataataataataataataaataaaaccatgcccagtcacatcaactctaggtggccaagcaaagattctgtaaggaaaacagaccctggaatctcttctgtaaggcgcgatgtacagaaagcgaatgctgtttgtctgtagcgatgccagcaaacattctggtgtcttaggctttaggttaaaatgtttacctggaggaacagtaggtagttctgtgactgagaaaaggactttagcggtccagtgattggcatttagggagagtcttggctgtgagattaggttaggattggagtaaacgtgggctctcacctgcttgttggacggaccaggaagctctgggctcctctgtaccactctgccctttcctttctatgaggttctggtcgcttggcatctttagccatttgttttacccgtttgccgtgtggcctctctgctcctcctatcttgctactcaggactcttccaccagaaaacaagttcctccacatctcttctgcctcagccttggttttttaaatcattctcgtcacagcagatcttccgtgccctggatgcttctggactttatgtgcccatcccaggggtgctagcctcaactaggggccaagcagatactgctgatgagattagagggcgaggttgttggtacagaaaagcccacacagtgattgttctcgagagaagctgcaatacactcactggggaaacagtttgtgcttgtcttgttcgttttaacatacatacatacatttatttatttatttatttattcactattttcatgtgtttgggtattttgcttgcaagtctgcctgtatactacatatagtgtgagtggaggccagaagagggtgtctgatccctctggaaatgctgccacaaatggttttgaactgccatgtgggtgcttggaaatcatttttccaaacacatttctctgcagttcagttttggctcaggtctactagtgtgcaacttttagtgtacctctgtgagattctttctgagagccgtttggttatggtttttggtcaggagtcctacctgatcaatacattgtaatcttcagacaacagataacattttatcctaatttatatcagaatttatttattcatttaaagatattttatgtgtagggatgctttatctacttgtatgtcagtgcaccacttgtgtccagtgcccccagaactagaagaaggtgccagatgccttaaagcttgagttacaaatggttgtgacctgccatgtgggtgctatgaattgaatcagtcagtggttttacctgatgagtcacctcttacttcccagaaggtacaaacacagacacagtgctaaatgcatagggcttatatggcttgaactctcttgcactttagaattctcaaaaggaacaatcctggtttcctgaagtgggcaattgcctctataatgggtgacaaacactacgagttctggggttgaagaagagacaaatggccagagcatatggtatcatgacaaaggagtttctgggctagctctgggcacctcctggtactcagaagtcggccattggttgtctcttacccccatccccctttgttgtatttcactttagcaaatatctgaaagcttaaactaagcaaaattctgtgtagtccaggagcccagccagggcggagcaatgggaaatatactcactcggaggccaaactgtgtagggaaacctcattcagaagggaatgctttcccagacttaggagcaacgcctcccactttgacttctcggctgttaacgttgagaaccagaactgtgctttttttttttggtttttcaagacagggtttctctgtatagcactggctgtcctggaactcactctgtagaccaggttggcctcgaactcagaaattcgcctgggattaaaggcgtgcaccaccacgctcggctagaaccctgccttttgctgtgctttgtgcttcgcagtgagagtttgcctgtagaggcttgtttgtggggatgaaatgctaattgtgttgtctagtgaagggaggttacttcctcaccacagcttgctcaaaaagtaagtggcactttttgtccctcagcttccaagaagtcagtggattattgtttgccagctttggagcatgcttgccaagtttgtaacatgtggttcaggctataatccaggaaggtgctggtcagattatgtaaataccgattaagcctatagcattacactagagtagtttttattagagtcaccttccgagggacttgggatttccagggcccatttcctgctgggatagttataagaactcggggccagtctggtggtgcagacccaaatcctaacatttgagaagtacaggaagatcagaagttcaaggtcactctcagctgtttagtgtgtttgagaccagctggagttacattactaagaccctgtctaaaaaaaaaaaaagacttggattagtttattaatatctctgtacactttgaacaaagctcttgtgttattaggaaacagctttggagtgctggtgatcaaagtgcagaccttgagtataggcaagcactctcccacagccctgagttaccattatcattattctgcttggtgttgggggggcctcacatatgccaggcaagcactctaccccgagcccctaagattaacttctagcatccatctttcttctgtagttgccatttcagttagaatggtggggtggtcatatcatgacttagatgcattggttctgacacagtttagcagaaatttcagtgataactgaagtgcccacctccatgtagtgcacatgtgtctgttgagcgcttacaatatggttaatatgatgaggagctgagctcatagactgatatgatattaagtggtttcaatgaatggccacatggttagccatggtagtgatctctcagctattgaaattctctggcttgtgggtggggagcttgctgggcagcatgctcagcgagcacagggttgtcctgtgcccggttaaacagtgtgcttttcagacacgcctgaataaaacctgagctgttctctgcagccttgcctcttgtgtgttctgcaaatggtgggctgcacgaccatctttcagcagattagctgaaaaaagtgtctatggctgggcccaactgtttgaagatctgcatgctctttgtgcaagaacaggggcgatttgtgttgtgacaaggctgatggtactcagtgaaagcagcagttggcagggactaaattcccgaggtttctttccttgtgcgctaccgaaaggtgcagaagtactttcgaccgtgcgtcctgctgacagatggattgttttgacaggagaatctgaaccctccactgaagcaccattcagatgtcaggcaggaaggggcagccatgctccttgaaataagtgggatgttttagatgtgtgtgcctgtcagctgccacctggaggagcagagttcggtagttaaccctttcactggtcttgggatcggaaataaattcatgctcctttctgctggcttcgtgggctaagtatatgtctgttaatgttggaaaatgagtgttgatattagtaagtatagaggacaagcggtttaaaagcctgttacttttcttttctttctttttttttttaattttgggaaaaaccacactgtactcataattgctttatttatagcagccaaaatagaaacaagctaactgatcctcagaaagtaggtaggcaaaatgtagactgttcataccaaggagtattgttcaaccatcaaaagcaatgagactttcacatatgtgatgagattcatctatgaaccttgaaagcattgtattaagttaaataaggcagacacaaaaggacctatacctgtgattccacttacatggggttcctagagtagagtttatggagacagaatgatggttggcacatacagggaaaataggattaggaaaaagttgatagtggtggtgacgatgggtgtgtctgaatgtgtatgtggtcactgagcagcaacgtacaaatggttacatacattttataacagtgagcgagcggtattgggcatttttgttttggccggtgtttgactattttattccttgttagattttcacaggggaattaactggtttccctgtttcctgctaatgcatttgaggtctcagttccttcagaaattcaggacctcttctcaaatttaaaagccagagtagctctgtctagggacaggagcagttccaggggctgtgagctgtagcaccttcaccctgtgctgcccacaggtgttatgggagaatggccctttctaggcagtcccttggcacgtgtgttggtctgtggcttttctggttcagtgactatccaggctgacccagtgagggctaacacacttagtgtcctgtctttgtagcagatcgctggcatcctggtatcaaagccctggtgttcttcagctccggatgacagtgtcggtaaaggttcttttctcaatctgccctaagaagcagaattaattagtgtttctgaaagctagttatattatctttccaagaaaagacaaagcattgggtatatggcttttaatggctatgtgaggtgtgggaaaggagagacatgattttgtctcagagtgttcagaatgaaaccatcagtggactatagaaagcctgctgagccccagcccctcccacggtccatgccttctgagcctgtagcttctggagagtccaggtcccaacgtaagctggtgtcctcaggccaagtgtggcagctggcagagaggttttgtttgccctgtccttggttactcttttaggttttttttttttttaaggagctgagaacttttctcataagacttggagtttctctgaaaatccaagcttggtgtcagcacgagcccttgcctctggagtgaaggagtaaatgcctgtgaaggtgggtaggtggacttgctggcttgctccatcagcagcctaatctgatgaccctcccacctgctcagtggcctctgagagcctttattaagttctcttcagctcaaccacgccaattacccgtgatgatgtaagttctgtgctgcctttacatctccccccgcctccgccccagacaatgttcccatatccttaatgataatctgatcaaagcagcaaacagtagtccaggcagtcttttatgatgtagagaattctctcaaaactggagtttctttcctgggtctaagctgttaatatctacattctcattaataaatatctcccaagcacagtcaagttcatacttgacttcagtatgtggtttaaaaattaccaccttcaatctttatggtaacttaatctctggacaaattgcttttaattcagactgtgccatgaacacagatgggccattagtttcaagtgcagtttgacttttatttagacgaatgtctttgagttcacagtaaaatggctatcagctctagggtagtattgatcgaaatgtctccagagtaagtttaaaagatatttaccatttatgattagtagcattgttaattggcattaatgtcaatggaattaatagccaggatgaaaaatgttaatctcttgcacccacaggcctgggtggacttctgtggcaaggaactggaaggcagtgaaactcatcttgattacctgtagtggcttctgttcctgatgggttagcctggcttgtgttcagcgtgtggttaaagaagctgagctgactgaatattactgagcttactctgcctgcagctaaggctgtgttccctaggcagtggaggggagagaggtccagttctgaacaggatgggtgctgttttacacacacacacacacacacacacacacacacacacacagctcttgtgtggcttccctgcctggggttagcaagagtatgtgtccccaccagttggctttcttttcttgtgactgtcattcctaatcttattcattgatggtaggcatcctgtgttcataaatagtcacaattctgaatctgttcatttgtctaaatgtctatcccccccccgacattttttattattaaattcttgttttgactgagatttctgggtctgagaatgaacactgaggtgctgtgtgcctgcttgtgggacactgactgcttatgcttggtgggatgtttgagaacatctgcagcttaatctaccagatcttagtaccgcctctaccattgctgagagctgaacatatctctagacattgtcatgtgagtgcgtgggttgcacgcccgtgtgtgtgtgtgtgtgtgtgtgtgtgtgtgtgtgtgagtgagagagtgtgcgcgtatgcatgaaaatcacccttgtggagaactggcttagactatgaagtgctgacatctgttgttctctctctctctctctctctctctctctctcacttgatgttgatactttagttaaacattcattttttaaaaagtcatcagggctgagcctgttagtgtgcttctttaaccctgccagaggcagggtgatccctgagttcttgggccagcctggtctacatagcatatttaaggccagcgagggagaccctctctcaaaacaacaacaaaagccattaagactgtccttgaggagtcgggcatgcctttaatgctagcactcaggaggctaagtcacattcgtctctgtgaccagactggtctacagagtgagctccaggttatccaggtctgctacattgagaaaccctatcttgaaaaaacagacaaacaaaagattgtccttgaggatttgctgtatgggtctcagcctgtgggtctcagcccctttgggggtatcagatgactctttcacaggggttgccaagaccggcagaaaaaaagatatttacattacaatttattgatccataacagtagcaaagttatatttatgaagtagcaacaaaaaataatttatggttggggttactacaaaatgaggaactgtattaaagggttgcactattaggaaggttaagaaccactgacttagagagtgaaggcacacatggtggcaggcaagaaccaactctcacagattgtcctccgatctgcacgcgcgcgtgcacacacacacacactataaataaaaatgtttctgtgtataagcctgagtatatgtatgtgcaccatagcctgtgtgagcctgcagttattagtagagagtgttaggctctctggaactggggttacaggtatttgtgagccttgtaggtaggtactgggtacctaagccttctgcaaaaacagtaactactcttaaccctttctccagtcctaatacatgcagttttaaaacctgagtggccctggacttgatacggtacaaagcatttggattagtactggcccttcttagtttctcaagtgttggttagccagttggtactggaagtctgcttgagtccaccctggaagtgcaggttcccggccttgctctgtgcactctgtgtgcactgaagcaggcggggagagcgatgtttatgaagctcaccgtgtctgttactaaaacaggacacaggagggaaaggtcactaggcagagggtggaggtttctctttgagggacttggtgagtggggaaaggtttcttagtctttgatgaaatgtcaactattaatttcgtacttttcactttctcttctaccagaaacctgagttataacagactctccgagatcgactctgctgcttttgaggacttgacgaatctgcaggaagtgtgagtgtcccctaaagccataggggtggagggcaagaacgatctgggggaaatcttattctattatactgttctcactctcccgggtggctggtctcaacttataggaaggaacatttgcatatggtcagccatagatggatgcttgtgttcacgtaatgccaatttcccgagtaatggtcccaaaacacagggttagtgatatgacaataggatatgccaaaaagaagctctgaagtggttcctttaagtgagaaaatgaaaatacagtaaggttttgtgtaagagatcaaattcgcataaattttataatataagtgttccttaaattattgtcaatctctttctatggttgacttttttttttttttttttagatttatttattttattatatgtgaatacactgtagctgtcttcagacactccagaagagggtgtcagatcttgttacagatggttgtaagccaccatgtggttgctgggatttgaactcaggacctttggaagaacagtcggtgctcttaaccactgagccatctcaccagccctatggttgacttttgtatggaaaaggactatatatagaatttcaggtacccatggaggttgaggagtggagccctcatagataaaggggtgccatgttaaattcctttccctttgctgtaggccccgttttctatgaagggcatgctacagtgcagtaggtgtagtattattggaaatcctggttgcccaatgggagtataagagagtgtcctttgatggaaggtcctgttgactgattggggaacacttctgtgccagtgcattctcacaggtgccatagaggtataatagtgtagtcagtggtggtacctggtgctagcccaccacttgcagtttccacaaacctggcaagaagcatgggcaatagaggctcctcttccctgtcccgtctagcaaaccaagcatcactgtcactgagcaccaggcttgctacctcttgagcatcctttaatgcaggccctagacattctgtatattataaagatttatgctttggtacatccattgggattatcaagaattttagccccacagcaagtttacagaaatttcatgtaagttgtgcaaagctctcgtgattacttgctgtaaactacacacataaatgcatataggtttagaatctaatgtatattatagttctttttccttgtattttttttcccaagacagtcttgctgtaagcccaggttggtctgaaattcataattcttttgccttagcctcccaagtgcttggaaatataggtatttatggatttatatctggcttgcccaatacttctcacagttaaaaatattttgttgtataaattaaaattttcccacattatttagagacttcattaggattactttcatctatcttaggaagtttctgctgcactggttcccatactccctcgccagtgcccctcacttctggctgtctctctctacatttcttccttcaaccccacttctgctccccctccccacttgatctttccatcctgtcatgcccctccaaccctccaggccttccaatgtgctctatgctcttttatgaatatttatataaaattactataaatcattatcaagttgtgttatagcattttagcaactcattaagttctctacacatttttactccaggcagttgaggaaagtctttggtggctagtctttgttccattgtagcggtatatctaatgaaaccttaattttacttactgatatagtttgcaaaatagctgcattccctatcctcatggccagattttatggcctttatgtctttttttcaaagcatagacttccagggttaaatcccagagttggaaatgccttgtgttgtgccttcatttgcccatgaggtcagtgagacgggtgtgggaggatgaaaatgtgaaggcggccaaggcttcagtaacagatcccgtagaccgctggcttcattagcagaggctgactcctcctggtggggagctagaaggctgtagggctggcttcacctgcgcgccctctccttagcttgcaggcggttgcaacttactgtgtcttctcttggtctttcctctgtgttcatggaatctctggttctcgtgatgcatcctgatttccttttgtacagataccggtcacatcactcaggatccacccatgtggatctcacttaacgttagtgacatctcctacccctgtgctagagattaattgcagagcctggaccatgcaagccaaacagtccacaccaagctgcagcctcagcctcctgagtctttaaaggcttgtctgtaaacatctatactctgacgtcctggagctttgtccttcaacactgatttgaggaaggggacacagttcagtcagtcatagttttctaagttggtaagcttagtctaccaggagcccgttgactttataacccagggctttgctgtgctttgctttggtacaggatggtgttgactcttgcggttatcctacgttcaaattctcttgtcattctcagagattattattggaagagattagaattatgccatttcctgtgacatcacagacttccgtttatacttacttgagtgtctgctttgtgccaggtgctcttctgagccaagcgagctacaaaaataggtctgtgactaggatgaggcaagagaaggcctgtccttaggcactgatgtcacaagggtgccaaaacttaccagccacgataatggatattttgacgtcacatttaaaaagtcaagacgaagaatattttagaaagtgtacagtgagcaaaacatggaaagtctgaatcagtgttgctggtgttttcccttccatctcagctccagactggcttgaccacgctgtttttgatctatcttgtctcggacttttgagttcgttcattatgtgtttcacattcattttgacctttatcttaaattctggtaatagattcagtgtcctgcctttcagacatattgtaagctcgttctttattttccctacatatctgtaccttgctcgtgagctttctgcttccatgtnnnnnnnnnnnnnnnnnnnntttgacctaccccctccccctcacccctcacccccagaatctccatcataccatagctaggaaggggccccccgtgtaccacagaccgccctgttctctgtgactgcaaggcctcccggtgggaaaatggttgttctggtagcaagagtgctagatttgagattctagttctggatctgttcctgcacaagtgacttggctcttcagtgtccctttccctttctgtgacatggacagagtgacccatggtcagtgcctgatgtgcatgtgtgactccttcctgcttttggaacctgcagctcccatcctgagtgcgttgtttagaaacacatccttgaggctgacagagcggactgcttgccactgctgactgcctcctacctctgtggttataagttgaattcatcatgcccagggcagcaaaatgaacttctcagtggtggagacccaggactttcccttagagaattctggtaaatcctggtgactcaaagaggtaccagcagtgagtggtggaaactaggtaagaatatggaaggggaaaaaaccaaaccaaaccaaaacaaaacaacacaacacagcccacagttgacacaccagtgcttccaaattaactgggctcaagtcggttctcccggaccttgcggtcttcagagccaaaggcgggcgcaggagttgtggtggcttagcagtggtttaattttagaggctctagaaccacataacattgtgggttgggaagagagagagaaagcaagccctttggaggctcctggaggacatgtgcagctgcttccaagccacagctctccactgctcacaaccctgaggaaagcccatcagggagtgccctaacccggagtgctggacaccgagtcctctataatcagagggctatttatacagtcctctatgaaaaggcccttggatcacattactgtggtggcttgggggtgcttgctactaagctgctttgctggggccactgccctacacgcttcctggagagggtaagggagccctgccttcaggtatttatggctcagctctgctctgtccatgctgctgctctttctctctctcaccctgctgtgtgcatgcacaagaacaggtgcagagggttgggatggctgtgacgtgaaggaagactgaactactgaggagtgtttgatagactgcggctgttagttaatagctaatagctgttattgctattagtgctgactgataagtatttcccatgtaagtatccacagcctaaacttttagatttatttctcctggatcctgccaaagccccatgactctggtacatgtattatttacattttttttttaaagaggaagactaaggttcagcaaggttaggtggcatgctgaggatcatttgattggtacggagtagaagaatcgctctctgttttttaacaatctgttgctgtatgaccacatgcctctgacattgtaattgagtgtactcctgaaggactggtgtgttactcagactttggacagagctggacacacactcatctttcacccttcttgtcatattcgactattaacttggacctccatatccatggatttgtcatctgtggattcagccaaccactgattgataattgaaaaatgcatctgcttgcaatgcacaaatgtccttttttccttgtctttatgtcctatacagtataattaatggtttacctagcacttatattatcttaggtatgctaagtaatctagagacaattgaacacagggcacattcaggtctcaaacaggcactgtatatattcctgtaagggtcttgagcagattctggtacttgcagggtgtttggatcaaaccttcatggattctaagggaagatatcgtatattatcctaaagtaattttatctaaccagctgcatatatcatagtcttaccaaggaaactctttagccagtgttattctctagtcccttgaagccttgattataaaacccgtgtttgcttgtaagcgctaatggattttttttttccttgtaagaaatgaccatccaaacttccaacctgactcctatggactgcagctccatctctgttaggaaacagccaacagcccagagcacccactctgtctacaaagagccaactggctaaataaatgagtgaacatagtggcttggtctcacctcccacgtcagcaaaaggctaccctgttgctggtcagaagaacgtttgtagtacgtaagaatctgtgtgaaacagaaatgtgcaagtctcccctagctgccagaggagcgtcctctgaggaagtgtggggccggaagcgtaaggaagcatgctttatctttcatcggattctcatagtcttcactggggtgtttgaaattcttattgcctgtccatttcagccatttggtaaattaatacagcaccctccccaccccccactgtaacccacaattacttcttaggtaggttttatgtcgtttgttaaagccaaatttgactaagttaattaatgatgatgctgtactgtgaactgccctttatgacgctgtgtatattacagcgtgtaatattctctttaacaagctacttgtaagtggaagcttggagagaaagctgcaggatcagaacgttccgactgacctccagggtcagggggaagcacccctcccccaggttctgttctggggtcgggcactcggtgtgcctcattgacccccacttacacctcctccagctccagggttgggccatgattcatgctctggtcttgaatcatcagggaaaggtttataaaagccagacatttcaggaagatttgccgtgctttgcatggaagtaaagttttgggggttgggtgggtagagtcagcagggaaatgctagggcacagggctcgaggaatggaagtacacaaccgtagatagtgaaagtacctcagctcacactagcctccatctttaaaagttctgtgttcatggagactgctgtacacccagcacgtctttttctcgcggtgctccagtgctatttttgactggtctctatttcagtctggcacacagctcttcgtgtctcagagtgggtttgatgcctttgccttctgaggattgcattctccttttggcctgacaaacaactggggagccaagagtggtggggctagccacttacactgaactagctttttttttttcttttttaaagtaaaaaatgatctaaaagtaagctagccatgcagttagttcctgtgctttgggctccaactgtcctctccataaatcaggcagccctgttgaaattagagcctgctatttctgactgagcctgttgctccaggactgctcatcaagatgtataaattcaccgttcagctgtagccctgctctaccgatgggaagtgctagctagccccttgccctcgctcatttagttctgtgatatgtatggagtggggtgactgtccatatgtgtagcagggctggcctgagaccaggcttctcagctgaggttcacctgcagggaatcctgtactcattgtttcaggttcaaaatcaagttataataagcaggcaggaaatctggcactcttgctgatccctgagggttctgagtggtcaagcctgcctcgtgcttcctagcctgtgagcttgctgctttctgatttgcccagcaggttgtctcctggctgtgctgccctggtcatgtgaccccaggctagctttttaaatggacttaaatttactgtaatgtagggaataccagttgctggtatctgactcaaagttgtggcaagcgatgaaatcaccaaagcgcatggtgcacgggctgtaattacaaagcagcagccggtagcgttgggcacctagttcttgaggcttccctccttcagccactgtcgcttatttgtggtgaccttggtctagttactttacattggtgtactgggatgttcctgggacctacatctaggtgtcgaaagatgaggtaagctcctagagcgacacccaccccagtctctaggagatcactgctgttattgtgactatcactgccatcctggtttccagcaaaccttaagaaatgagcttttaatttttttttttttaatttattcactttacatccatccccctctcctctctcatactgtcttacgcagaccccacccccaccccaacaacccccctgcgcatcaggttgctgaagaactaggcacatcttctcccactgaagccagacagtccatttaggggaatgagatccacaggcaggcaggcaacagcatcagagacagtgttctccccatgacccgccaccccactccagttattggggaccaagctgcttatctactgtatatgtgcaggggcctaggtccaacccatgctcaatctttggttggtgattcagcctttgggagaccccaggggtccaggttagttgactctgctggtcttcctgtggggtccctgtcctctttaggtcgtgcaatcctcctaacttttccatgagactcgaagagccccatctaatgtgtggctgtgtctgcatctttttccatgggctgctgggtgaagcctgtcggagaacaggtctgcaggatgccttgttggcagcagacctccagcagttttctcgctctgataaaccgagggggtcatttctactcatcagcacaccgctgggcactaagaagatttattggttgagattaggactgatgagcgctttcagtgcctccactctgtgataggaaatggcaggcaggaagagataacaggagagaagcaggatctctgtgatttagggggcagtcagataagagactgttaaagtaattaattgtctatttccccaaacaagggctctttaagtagcgaaaggatttgccacatgatacagacctgccttctccctgccagatgcttcagacatggaattagtgaaaaaggcattctgtgtcctacagacagtaattgccaagtttcatccctaactgactctggcactgaagaaagcaaatgggataattcaagcccccaccacttctattcatttctgaaaagatggcagccagccagatgattcaagcaagtatccaagccatgtacttgtttgaatacagctgtcatttctgtggtcttgtccccaaatggagtgacatgctttctgtaagatgtacctcccttaagaaattgggaacaagataaccaatttctttcccctcactccccttgttaaatactatttccttccacctgatcccctcagagcctgaactttgtgccttgggtttcttaaggcttcgggggctggcactgtaagtcttactttggcttttcttcccagatttagccatgcatgcccatggaaagaggtcaggttacccctctcggggcaggcaaggcaggctgtgctttggcttgcggactttcccattcatgaaaagataggaactgtggaaatctggatttagactctcataatgggacagggtcctggagagtgaatcctgtctacagaggagtttcaaagtttgcacttttttttgtttgttttcttcacatgtcacatagtccaactaggttggaacctcaagaagatgagggtgtgagtctagcctccttgttacatcagaagaggagcactggatgcctgggatgcccaccctggagtgagcaggctcctgctcgcattctctcgttgccccttgcctggggcacactgccactgagatctgttcttcctatcgagacctttgtgactgcttcagttcgccgccatcgtttctgttgaaggtcatgggaacacatttggctagaacctgcatcagggcctgttttcacttcccttgttagtctgatgtctgagcttgatgggaggccagaacatagttcctgcctgtgtgtacttctggccagggatgtgataggtggttagtggttttgacttcagatggcttgtctccctttaaaaactcattctaaatgccttatctcttacctcacatctcatagcctgactatggctaactacagcgttgatctgttatttttgttgtgtgtgatttctaactactaatgtaaatgctctaagtgatggattgtttcttcttcttacaggtacctcaacagcaatgagctgacagccataccatcactgggcactgcttccataggagttgtctctctctttttgtaagtggtgacacctgagaactctgggctgtgtggtggggtcatggcggtaactgacacttggttactgatacctcctgtccttcttggtaaacaatgaccttcatggtgcctaataatgattataccaacactgtctttgctgtttgggagtttatagaattacaagttgaaagtttgctgcatttctaatggggaaaactagtctttttttttttttaaacaccctgacagaggtacacagatcctttgcttttagtaattgagttctcacttgggtgatgatactaggttaaacaactgaactatgacagttttatctttgtgcagtgaattttggtaaacgcagtttacttttatggccctaaaaaaaaaaaataatagagtccctataaagcactggcaccctcctaacagtgaggagtaatccgtcgacgtctgtagtaagcagagacaaagcctatgtacggcgcttgcttgtgcatctctgagacaaagcacctgatggaaacgggttatgcaaggaaacattgattttggttctgaggggtttggtccctcagagggggatgcgagtggtgtgtagtcgattggtctgttgcagtagaaacttgtggcaatggctgtctaaatgccacagagaggctagaactagtcctcataacctccaaacacctgctcctagtggtacactctgctatctagccccagcttctaagagtttcacaacctctccccaaacaatactgtcagccaaggaacaaacactcaaacgtgggtctgtgggggacagttcaaaatcacagtgtaataccatgtgttactgtagacaaaacattcagggtcttaaccagaaacgaagaggagggagctttgaaggtgttgtcatttaagctgcttctagccttttctggggattaagcacctggcttcactccattcctgtggcatcaggtgaagtgccacaggtttcagctcactcagcgctctttccaactgtgccctgagtacagtaatgctcaataccaggttttactggcagcttccccagcagatttccatgcgttactgagtttcccatcttccgcacgtttctctgcataccttcaacttgttggtttaatgattcattgcctcacctgtatacattggttttttttttttttttcttttctttcaaagtgggcacagcaggctgagcagagggacttagcaggaagctaggaagattgctggtgtggcttacagatctgattctggctggccacaggagctgtgttcagggctgctgtgtcctgtgaactgtgtcctggaacttaaccctttctaaggcctggtggcttgcaggagagcacaggaagtagaatctgactctctgtgtcctggggatatgactcgccctctcagaacctcttttccctcatttacaaaacgcatcccttattctttacacattccccatgagcaaggtcaggactaaaggggagcggaaggaattttcataaagtgtttgttatcccatgagacatgatacatggctactgcttctggcgggtggcttgtcacagctctgtggaccttggagacctctcacttttaggggcataagatttgtgaatcaacactcattctgtgaggtgcttttgtgaaagctgtaccccttttagacaggcaaaggtctgggtttttgttttgttttgttttgttttgtatctacttggcctttgtgcatagcatctggagagtgtttaattgctggtaaattaggtcagttagccttatgtgaagctaattagggatgtgataatccctcgtgtgtccatgaagcacagcccttgaagatgcttgtaacttgtggctcctggaagcccaggttgtagaccagcgatgcctgtcagctcccgcatgctagagtgcagaacctcatgccactcccatcacaggccttatttaacaagggctcggccacttgcccactcgtcagagtacaagaagtgctgctttcattccctggctccttacttggtgaggaagccagagagggctagctccccaaagtcgtcttagttgctggatgagaatgccctgacaggtgattcttgtcttgatttggtaatttctctgaatctagcagttgaaggatctttatcttcttgttctgaaactgccttcctgatgatttacagtgtgaccgctagggagcatgattataggccatcttgcttccaacagatgggcggtagatccttggtccacattcagcttctcgctttccttctgtggtgtatcacaaagacacatcgaccttctgcctcaacttctacccttggtacttgagactggagggggtaggttctgactctcagtgtgggacacctgccattctggatgaagctttaaagcatgctccttccttctctctctctcactcactcaggactgggtcttcacatcacagttcccttctttctcggtgtcaaccctgggaaggcctcgtggaggaggttcggtttcgtgcctgtgtttaatatcagggcatcaaaagggcttgagaagctggggtcatcagcacaatttcagttggttattgctttctgattgaaggcatctggttcaattaacgtgcttgtcaaagagcaggtttatttgcattaatgttgaggataatgccaaagccatttgtccttaatagcagaaagcatgaaaacccaaggaaagctttttaataggattgggttggcgtgagggagctcatgtcataaagatagacttcagggaaagaaacagacttttgttaggaagggacagaatctgccagcagatgtttatgtttgagataaaaaaaaatgttggttttgtttgtttgtttgtttttgttgttttgggaagttcaggaaactcaagttttgattgtcagggcaacagtaatttgtctgacaaatggatcgcgtttctgttggaggtgtgtgccctccctccagcgtgactgcacttagactactgagtactggaagcatccttcatccgtcactgcagagaagcgggctttgactctgcctcgtgcacctgctgccgcgcattccccacgtgaccctgtagcagctgctgtactcctccaggtgtcaaatgtttcagacttgaacttgtcaccacgccatgctctttgttcttctcggtctgtgtcctggataggcaggacacccgagcagcagtgagcacagaatcgtttgtgactttgtaatattgctgtttaaagtttatgttgttacttcgaaatgcttactattactattacgattactttagctcacgtgtatggttgttatagctccacatgcctggtgctcacaaagcccagaggaaggcattgtgtcccttgaaactggagttacaggtggttgtgggctgccctatgggtactgggaatcaaactcagaccctttggaagagcaaccagtatagaaatcaattcataatgaaagtgtaattgaaaagcagttttaaaggggagagagctgtgatttgcagaccctgtacctccacccccactcctgccatgaaattatgcctagtcctgagctaagaccatcaggaattcagcttgaagcataggcaaattattttctcttttctcctccccttctcctcctccccttctcctttccccctccttcttctcctcttcatctttgcgtgtattatgtttttagaggcagatcatagttcacagtcacaggtataacttggctgggtatagaactcagttgctaatattcttgaagtagggtttgtgtactgggacaggagtgtttttacccttcacctggggtacaagtggaggaggggctcttgcctttgactttccctagctgtctttcaaacttcctgtgagtgcatcccccaaagggccagtatttgcagacacaataaagaactcatgggggggaaaaaaaccccttcgttagcgcatgaaggatgaaataatggtcatcttatagctgaggctgactgtcatatgggggctcattgtataaactgggcgttgtggggtgtgcacagttgaggtggctgtagctgctccccttcttggtgtagcatttgccagtcaccagtagaagaaagacaatcaagggtgttgaaagctggctgccctgattcaatagttatgtttgggtcaagagaattagcttatgtcttccaaggtgcggttgtcctgctgtggaggaccactgcctagctttacgtgagatgtgggagaggagcccagggctgatgtattcttaagcccgttgggctttggaagacaataaactatacatttccttgtgtcacctgtgtggcaacctggagtcgtgggctacaagtgaatggcaggagactacaggcatgagtaccatggatatactgaccatgccagagacccatgacccttatcagtttgatgcttataggtgagctacttggggctcccagctgactttccaaggtactagggagggaaggagctgaggagcactgaggagcactcttgtgtgtgccctaacctggcaggacacatactgcccctgaacagatgattagagacctggtggctgttgaagcggtcccccattcccccggggcaggagtcagggttaacacctcttactttactgtgattatcagttactggaatccctcaggtccttgtccttacctaagccctaaggcacctctttgtttcttatggcagttaaaagggtgttggtgaggtctcagttctctccttgctctaatgggcccccctcttgtctttccccagccttgaattgtatataataaccctgccatttcttcttgctttcccagccttctgccctgagaagactttagtccttatcactggtaggcaaaagaaataatgaagaaccagcttgcctccactttaggcataaaagctctcttagaataaagataaaccaggtccattcctgtttatgattaaacctgtttctcaagcattgggctatgccccctgtaaccttaactacaaatggttctgtgctgcctgtttcaggtatggcagtcatgtctttgtttcaaaaagctaagaagcatcctgctaccctccctttgcatcaaagggttgctatagctaccttgttgcgaccacctgttgttatgcctgccttgcaaccctgtctttgtttcaggaatcatgatagctaatctgttattcttatgttctgctcctgtaaccctgctggtttttttgtttgtttgtttgtttgttttgcctgccaactccccatttggaaaccctgtacccgtgagctataaaacacttgtcttcctcacatccagggctgttctctaaaattccaatttagggtgagacagctggctggccaatcctgggtgcacctctaaaataaagcttgctttagtttgctctttcctcttacagtgctcaggtttaacaataaaagcaaagcagtagggcacaggctggctctcatggacttggcacttatagattaaggctgctgtatctgttgggaggctcctgggagggccctaggagctcagtaacaactggtcagtgtcttcttttcctaaggaacaacatctacctgcagagaaagacagagaaaacagataatcatcatacaagggccgggtactgtctgagtcccttcatgttgctgatgtgtgcatgacaggaaagactctcagataacgagtcatttgacccaaggttgcttaccctgtctgtggtagcagagtatggcatagagaaagaggcatcagaggttaacaaaagagccaaagccagttggcaaagccactgggaacccctccccacctggctatatgaaacaaaagttgaagcaaaagcccacaaattcttcaagagaaggtgggtgtgatgggcatgacctgcatagggtctccaggcttagggcaagaagctttgacaaaagtctcagtcctgtcccagctgtctagcccactcccatcttaggagtgcctttctcttccttaatatactttccctatctctataactgtctgtgtgtccctattgtaatctttgttctatgactcaagaatttggaaatctcagcggctaccctgtggactctgacccacaactctaatattagactttcgttcttacccctcctggaagtgggtgtgatttagcactgttcagctagcagagtgagaccctgaggcactcaggggtacttgcaggacgactaggacatggctagctttatttgggggccaatttgcctttctgtctttttttctttgtcagcgagtgggctgttaggcaagccagcaagcttctgttgaaaggcccgagaaggacctgtggactcagaactgcagtctcattggatgctgggtaccaccagtgagcctggaaatagaaaactatctacttttacacagtgatcagtcctgtgtcccggcagcttcccggggactctgcagtgcagacgtccttttgcccccagttgaagtgagcctttctctgggaaaggagcccatgtggcctgcctcctagagagcctgccaaattacacacagtcatgactggtcattttccttctctcccccctcccctgtctttgagagtgggggtggtggtaagccagggagatgagaggtacatctgcaagttatttgctgagaaagtgaagggaacaccagctgcagagctggggagcccaggcaggggggcgcttgccgaataccaacttggtcatggaggtccctgcctttttgggaactgagcagctgaagttgtgctgatattagttaggcctttgggtggttctctccctcccctctcccatctctccctttgttcctcccctttctctccctctctcaatatagtacaggatccagagggaatacaggctgcttgatgcttgagaaaccaggaagacttggaggggaggagccactccttgcagcagcgggctctgaacaccccccagggctccgggacttgcagcttggaagcagagctgctctggttgcacaacctcccgtgtgaaaggggctggctcctgcccacaccagcagactcattccaactgggccatttccttctcccctcctccccctccccacttcctgcaggtggcttctctaatccagttagcacttggggaagcctcctgtgcctgtgcacctaatccgaaaatggctggcttgactttgacctgcagcgtgaccttgcaaagaaggctggacctattgtgtctgctcacacctgggagccattttcagctgtcctagtgcaagtgagagaaatgtgttcgtgtttataccaggcaggcctttctttcataaggcctgtcattgttgggcagtatatatggaatgtagaatcaacccacttgtgcagaggttgacagtttgtcaagataggctacatcgcttggtatattgacaggcatatgaaatagacttttttttcttttaaattaaaaaatggccagatgttattcttccaccttttcacatataagacattgatagcaggtttggtgtgtcgtcctgtgtacgttctgagatccaattctgtagcccagtgagattgcgaaaagcacaggaaggcaggtatcttccccgaggttccttttctctgcttctcaagctggctgctcactttgttctggaatctgtggtctgggagcttaggagggttaatacaacttgatatgccaaatcctgagctgacatatcaagttgtattaggtgtgagacccctcggggtgtggggcaagatgcggtctgtccaggtagtgtttgctttgcaagcattctgtcagcctcaggtgagctcatttggtatcattctcattaaggattgcaaatccttggaaaggcttcctgcctctgcacttcaggctagtcctccccatcctctcactcacatagctgctgctgcttctggtggtggtggtggggcgtttatggctgtctactcctaagagcacatccagggacgtgatcctgctgccaagcctctgcagagccccagccccctttgtggtaatgccagcagagttgcccacaatggggacctgcccttgaagacatgactctagggcagattccggagtactctcctcacttcctggatgtatttcaaacccaaacagctgaggcaaaggtgccaatttgtggtttctcttcccagcttcttaactgggtgctgagtgtggggaggctgcagcactggcaccctgggccctgtctccagtgccagcagcctctgcacagctgcttgggacagagccttgggggataaaaaggtactttccctgggagagctgccggggagtcacttctggaccacgtggctctggggtgaaggtgaataggatctccttgcttcctaccatctcctgtagcttcaggttgcggtgaggtggctcttgctttgttgctgtgctctgagactattgctttcctttacctgaaatcaggaggcctggaataacatagtctgtctgcctggaattgatcttacttgcaggaattccttctgaatgatctcttgtaaacctgttggagttcagagactgtgtgtgtgtgtgtgtgtgtgtgtgtgtgtgtgcccgtgcgcatgctcattcttgactttctgttatattagttccttcattggaagctgtggagtatagctctcttactccaccaggccttctggtagctgtgactgtcctggcattttgttcttgttacacgttttactttggtaccttaaagtaaattgttgattgacaagtggctgtgagaaatagaaattctctgaatagctttagctccatttcctctgtggtgcaatcttgtaaaatttcacaaccaggacattcatatcatatagtcaagtcctagaacgtatccatccccactaaaggccctcctcctgcatggccacacccactgccttccttgtaacgtgttctgaagaggaaacggactggacagcacagtctgttgggattggtccttctgctgagtgtgattccctggaggttggtggggtttgtgtgttgatactttgttcctttctgctaccaggctgggtctaatctttcaccactgaaggacacctgtggtccttccaggctttgattgttctgagaaagactgctgtgaccaatcatcttcagccttattggctacctgtgggctgtttttatattttgctggttttgatacagcccaggctggctcttgcacccaagacccaagtgcccaactatctgtgaatctttttgctgaaatgtcagacttcttgcttattttcaaactagtattttactttacttttggtatttcagttctgcaggtctttacatattctagatactgggcctgtgttggatgtgtggtttgaatatgttttcctctagtctgaggtcaagtccaccaccttctggattatgcttttagggtcaggtctaagaatttgcctagtgctaagctaaaagattttttttctctctctctctttttttcccctccatatgttttgcaggcttacctttggcatttaagtgcacaatggcttgctttaaaagcatgcagttccaagaaaaaaagagcacacgcgtgctctggtggggcctgcagagcagactggactggggtctggtattcaggggtgcagaacagtggcattgaccgtggtgttgctctggtcctgtggcagttgtgtcacctatggggtggataaggagggcatcatgaaagggcctgctcatgagcccatccttgaatctccaagtgtacttaattcatatgctgaaaggcttgggaaatcgtgtggtaagagagaatctaaatcttataatcagtagatcaaaagtcttccagatgaggcaggaaacaggcctggttttatttttaaaggcacaacatggtataactccccagagggagaggactttgtctcagaggctgcagccaaatgctgaaacagcttcctcctctgcctggaactgcagggctgtttcaaagctggcttatggatctaggggaatgtttcagtggcaggcagcccgttggtggcccctgaagaaatttctaagacatcccggctccaccagtttcctttttgttatcttcttgtgcttcttctgcacacaggacatcatagctgggagtctgagaacacctgggcttgcaccctagttagctggataactcccagccaggatgtagcctcttcagtgtggacctggatgagccttgactggtatggttgggagcagagggtggaaggcttctccttggacaataggtctaatgccctagagcaacaatgtgtttatagcttgtgcactaagggcgtgggacgttctttgcaggtgtgtgggtcactaggggtatatatacaatgtttcctagtttcatttgcttccttggcatctgtaaagacaggtcctactgctgttctgatcacgtggttgcccctcactggggatgcttctctctgaggggaggttctgggttctgtccagtgatgatctcttccccagggatctgactactgccctcctccatcttgaggcttttccacatctctgagactgtgggtgggatttacattctgggtacaaagttatttccatctgcaaagtgggaaggccagcctatctgtggacaagctccagtgggtttaatccaggttccaactacagtggctttttaaagggtctaccacctggagtaggctcacatgctgtgagactatgttagggtacagggttctataggagactccagactgcagtacccggaattctcatctgtgcacagtgcacacatagctaattaatgaaggctatgccccatacatactctttacctaggtatttccagttaaagattaggactcaggagggccagagtgatggctcagtggttaagagtcctggttgttcttccagaggactaatattcaattcccagcacctacatgactccaggcccaggagctctggtgtcctcttctgtcctttgtaggcactgcacacttgtgcacagatatatattcagaaaaacaaaaacaaaaccacttctacaacataaaaataaataaaatctaagaaaataattttaaaaaagattaggtcctacagctcagcatctaatgcacatttaactggtttttatttttattttttaaataagcttatttaccaaattggaaagcacagtggcaattgtgcaaaatagtaagagtgaaaatttgattgctgtcagactctggtgagagctctgtcctccctttctccgtctaggacttttagagtggtccccacacacactgacagcccatgtatcctgcctctggcgtaccacattggatagacgatgtcctggtaaacttgacacccaaggatgacatgaaggatggccatgacatgaaggatggccatatgaaggagtctgtgctctgcttgggaatgtggaatgaggtcaccctgttgttgaggtcaccctgttgtttctcatcctagttacatcagtttttctggtcctggatggtgaggtcagtaggaagagggaccacaagagttggtgacagagcccgttggtgtttggactcctggtgttcccctcacaaaccagcatttgtgtggggtctctttcatgaaaacccttgctgggatagagcccttagaggagagagactattcctatggttacttggtcagagtacctggagtatgttgctggccttaaaaggtcctcttcccatcttgttttggtatctgccatctcctaccttttctccttctccatcctggtaacaggaagaataatccacttagtggaccgttaggggcaaggcactgtgcaataacacgagtgctgcctggctttgtctgacttggtcgttcagagacaactgcccgaaggctaggagagcagttgctcctcattgttctgtagagttttctctcctacaggcacgggccatgaccttgaccacgtaagacactggccttagactcctttactctaagtcaggagaggccaggctggtcttgctgcacccttcgcccttcggttgtgccagggatgggggcttcacagcctggtagtctgctaaagtctagtggagggggatgcagggaaacatggtggatgtgctagggcgtgtgaggtagcagatgtacctcataggtagactacggtcgctagggtcagaaacaaggaaaacaatcttggggaagagaaagctgaaagagcatctgagggccacggtggtggccttgaccaggaatgaaaacatctgtggcttttccctgtaggatgtctgtatgtagatggaaattctaatggtctcatggctgatagacaacacgcttccctgcccagatatcaggacagattcccttcctgcaggtatggaaggaagtccaagcctttagaaatcccagccagtactggggatcccagcatgtgtccctggggattaaaggcagatgtggcttttagaacacactggtcagtgacatctgattggaacccttctgagggagtgggaaagcattgagctggtgacattaggatgactcagactgctgtcatccatctctccagtgagttttaattcaggttccagctacagtggcttttaaagtgaaccaggcaaaaagaaacagcagctagccttgatgtagcagtgtctcactcacccttgctaacttggactcatccatggatctcagtgtttggggctgaatgaaaaggtgtaagtaactcagaaacccacttctccccactctattccttaacatcgcctataggctccttacctggaaaggaaagttagctctctgctttacttctaatttccctgctttgttaacaaatgttagcttggtggttttacttgcatttgcttctatgtaattgtcaggaggttgagctacagttgtaattcacttgtttgctcaacaacccttggtagagcaacttctgtatcctaagcatttttctgggttctgagggtatagcagtaaagaagagaagtgtgtactctgcattctgctgctgggacgtcaggactgtataatacttcaggagacttttttgaggtgggggcagagatttgagacagtctcactttgcagcccaggctaactctggattcattaggctgcctcatctcgtgagtgctaggattattggcatgggccatccacacctggctgagattgtatttttaattaatatatttttagagcaggtacaggcttatagaatagttgcacagagcattcctctagcacccccttctaccccaatggttgcttcccttgttttactgtggttcgttatgtttgatgaatcacaaattgatacattatctcctggtattggaattctatggatctgaatgtgcagtgtctaccccgagactctggaactccacttgttttacctatccatcctgccgccttccctatcgctcttggcaactactgataccttactgtttcagtgtttttatcttctcagaatttctcagaatgttgttcttcagagtgtgtattaggaagccttttcacgtgggccctttttacccagcaatgtacactttccccaggacattctttgttaccgttttatttgtgtatctttatataggatacgacaacactctgacaggacttcctcatgaaccagttctcccctgggcagggtccctctatacccgggcttctcgctcttcctaatgctgttcctttaatacagttcctcatgtggggaccctaaccataaagttatttttgttgctacttcataactgtaattttgccacagtcatgaatgacaatgtaaatatctgatattcagcatatctgatgtgctcgtgaaaaggttgttagaatcccaaagaggtgaagatccaaaggttgacagccactactctagacttaaatgatgctgactgctccttggttgtcccctggttcttcttcgtaaacctttagtttctagctcagtcctcctaagccgatggtgggggaaccacgtgggatctgccactgtagccgcgtccttggggccatgcgttcacatgggcatgagacaccaggtccttttttttttcttcccgagagttaatggaaactgtctgctgaggaccccaagggggtcagtgatcctgaaggaagtgagccggctgggagagtggttgacacagcccagtcctgccttaggagggttgaccctgcctggcggaggctgtttatcctgccactgggctgctcttgttttttatccaatctccacctgaataaacagattcagaacgtcatctgcagccaggctgagaatctgccaaaattccccagggaacgggtgattcactagcagcaggggaaagagagagaggcagtgggcaagagacctgctcaccctgattctcacttcctgtccgccagatcatccgggctgggccatcttaaaagatactggtgtcttcaagcaggttgtcagttcacacaatgggccagatggttctggttttctctttaggaagatggttataaaccaggctagtgggggcaccgagacctctgattgtcatgctgcactcagcctttgaaagctcttctgtgctcacttggtttaaaccgctcctgggccttgtgttcaggctgcatatgggcactaatcttgacatcatccttgccagcttataccttacacatgttctcatcactgctcattgttaggtcctcacttcacagcttaacaaggtgattacattgaatgtttgtggttctgagctatgttcctgatacttaaggctcttttttttttttttaacatttactctgagatggatggatgaatggatgggcggatatatatatatatatatatatatatatatatatatatatatatatatatacacatacatacatagatagatacatagatttttcaggagctagtcttcagtagtcagcttctaccatgtgggtcccagtggtgaacttaaggttgctagacttggcagcaagtgtctttatccactgagccatctcactggcccttgtaacataataggttttaccgagaagtgggggacaggaacatggtgtgacttccggaaatggttaaatgaaacagcataaaatgggtatttgaactcactgtttctcaggttcatttcaaccttggagaatgtagtctacaagaaagctaccagcgtctgcgtgaggctgaaaatgtgcatgcctgatgaccgtgtgtaatgtcaggactggcccttgcatgcctaccagatatgcaccaacaggcctatttggaagactttcctgtgttcatggttatgatttttcacaatagtcccagctggaagtactccagtgttggtttaaaaatggaatggagaaaacaaacaaacaaaaaacaaataaccaaattaaatgtcagtagaaatacgatgctgtagttggggtggaggctcaagctttaggaggttgagagtagtgccagcctgggctacagacctagactcagttacacacacacacacacacacacacgaggcagacatgcatgcacacacacacactctttctcagtagaaaagagcagtctgagtagaacttaaactctgagggaaagtagctagaaagagaagagtttatgtggaatgattttgtgtatataaagcatacaaatagatacaattattcatggttggaagaaactatagggttggtttgagaagaataacagctaagagaatgtcagtcaggaggtggcagttttctgtcctgatctgagtgacgtcacgtggattgtgtatgtgctttttaacaggatactctgaactgtgcatgtataacatatataaaagtctcagggtgactagtgtagtgttacaatgtttataaatgtatataaataaatatcacgtggcctgctcaggggtgccttggttttttgaactcatcatctcagttgtggtttgcagtggaaccgaaggtcatcagtgatcggatgtgaggtctggtgaactagccagcttcagtctgctttagcgtagttggggcagttttcgggagccatacacacagtatggctgtctgtgtgctccactctctccaacatgaggcatttgaatgcaaacacccccctaagaagcctgagggcctctcagtgctgcactgttaaacttcatggagggtctctggttgtctcacatcgtgccagttacatgtatgatgtgttaagctacactgtagtttcccgtgtctgaccagacttgagtgtctgctgaggttgagcagtgggctgtgtgctaagtggcagagtctcttaaccccagagcagagctgtgctatgcaacgtgctctatgaagccagagttgtcctgctgctggagggtctgatcaactgtctccaggctggccatgggaatgctgggctggaggtgagagagttgaaggtatgctgggcatgttacaatttttttttcctgttcaggtctagattgtgtaaaaaaactatgttttcttcagaggttcaagcaaagagttgtaatttggatttttgctaacttcagtgatttaaaattatggaagcttttttatttcttgttaagagttcacagtcataatggcttgagagaactgaaggtcatcaatgactggatgtgaggactagtttccccccaacccccaaatctgcttcagaagagttgggacagtttgagagtgacacacactctggtgcacaccgtgtgctccttgatagctgcattggctgaactctttccatcagctccaggatgtaacctgggtcatcttcaaagaacacgccaaagctgggaatccggctttcatttacttctgaagagctggaaaagacaggcagtaaagagtgcaactcgagatgtccaccatgggcaaggaggagagggagaaagggagacagacggggaggttttctctggagagggatgctgagcacaattttgcaggtagctaaacctgatataagaaggagactgacacacaggtacaaaactgtaccacacctagaattggagtctctcctagaaacagaaactgattgccctgctacccagaaggtagcaaataatagcagatgcccagcctgggcctgcttcttgtttctgttagtaaagtttcagaagagcacaaccatgctgactttgtattgtctgtgctgcttggacactgtggtcaaagcagaatttgagtagttgtgacaaacatcacatggcttacaaaacttaagttattcaccacctggcctcttccagagaaagcttgctggttcagacagtgagtggggtgcacaatttcaggaaccagaaattgccactcgacctaccgtgtccctgtgcctttgatccactcacctctcctcctggctgtgatctctgacataagatcttttccactactaaggggacgtggtgaaccaggcttcacagggtggagtggaacaggtgctcgtgataagaagtcttaagtgctcttctgcatgcctcggtctgttttactgtctaatttaacatcagcctgaaagtgtagccaagtggagggagcttatcatgcttaccctcctcctttgaagactgatattatttttgaagcctttggcaggtgttcctgtgacagacttctgctgtatcgagttttccttaccccagagggcagcctcaggggtaaactaacacaggatagaagtgagtaccacgtgaccaggctgactgcagaatcactggctttgtgagtgctcctttgatgaggccattgctgccccccaaaatgtagccttttgctgcctcacttgcccaatgaggaaacagctgtctgtgagccagtctcccttccagtgtgagcgaggcctttggttccatctgtcatgcttgtctaggcttggtcccacaggtcctgtacccgtatgctgttcatgtagaatcctgggaagttggaactggtggaagccagtttacatagacccatcagagttgatcaagaaatagttagctaggggctggagagatggcataccagttaagagtacttattgctttggggctggactgatggctcagcagttaagagcactgactgctcttccaaaggtcctgagttcaattcctggcaaccacatggtggctcacaaccatctgcaatggggtgtgatgccctcttctggtgtgtctggagacagcaacagtgtacttgcatacataaaatattaaaaaaaaaaagagtatttattgcttatctagaatacctaggcttgattctcagctcttaagactgcccgtaactctggtttcaaggaatatgaagctctgtaagcacaggtgctcatgaggtaccatggcatacatgtaggcaaaacttactcatacacataaaagaaaaagaaaaaggtatagccagctagtatgcaaatagagtcaagctttctgtgtacttgctgggagacccttagcaggccaggccaagactcgagctctcctgggtttgcctcacacctcctcttacatctaactgtgacctcaattaagtaaattccgacagctctgagccttcattgctttgaaccatcaagtagaaatggaagtcacatttacctggctagatggctctttggtttcattgttttacccaggactggctatgtgacatgcagcagtgggtcagctatggtcatgaacttggagatgagtcagagtatggagatgaatgtgaaatgacttgtttgaatattcattaggaatggggtgttttctcatctgggctgtatgggactctgtcttaagcaaacaagcaagcaaacaaaaagaataggaagttttgtggtatgctgtcttgagttggtgcagcagatgggctttcatgtcctctgctttcaggagggagaagggatggcttctctgtgtgatctccatgcttgtcctttgccctagagccaggaggcagggccagcgagcgaccaagaagaaacggtgttgggggtgcttagcactcatgggtcaaagatgcatgcttgctgtaggaacaagaagtggatctaccccagctggttagaggtcagtcttggatttgctttggagtctggctccctgagacagcttggttgttccagtggctggaaatggtattcttaccgctgaagcaggcctggttcctaagtgaagaagctgagagctctgactcagtcctttgttcctgagagaagagccaggcttgcctatttgcattgaatgtgcaatggaacaggagggagccagtcagtcagtcattgttctcactttttatttcaaagcacttcctatgagctagattcacagattgcttctgaggatgcaatgtgactaataaaacaagtactcattttattgagcaactgctagaacatgttaggtcatatcagcctgtgggttataggaacttcatactccactttacaaatgcgactctttaagattcacacctgtgagtggcaccactgggctgtgagcttgagtgacagcagacacagcacatctccagtagggctcagacagatcttgtgcatgttcacgttgattgtctttcaaggagaacacagagaggctctgagcttggctgagtgttcgggaagagttacttggggcccggggtgtagttgatggcaaagatgaagccccagagagaatgtggttatattctcagcagctgggctgccttggacatgacataggtgtttgcatctgggcagggctgtcagaagacctgtgccgtagcaaacttcttcctgttgattctgcctgaagttctttgctcgaacgatttcttttgcaagaatgctggtgaatcccatttgtgtgctcacccgtagctcttttgcatcgagctgcattccctcttggtgacctgtattgcagcttgtacccttctagtgcctggaggcacagtcggaagtagagacacgtctttcttcgtggcagcatgccatggtgggaaagaagatggtgaactagataaatatgcacccaggatagcagacagcagttggagtatagacagggcaggtgacggggtgggggggggtggtggtggtggtggtggtggtgtatgtgggtgtgtgatttcagaaagggtagccaggaaaacctcactagcagggagtaggggatgagacgcacggctctgtggagtgtcccaggcagtagaagctggaggtacaaaggctggtggcttccccagcgaggacagatatgggacagagcatctgaagttgaagattaggagcttaggcaggtctggcacagacactgtgcctagaggcctgaggtgacaggtgggctacagttagggtggagttgatttcaggagaggtgtggcaggaaccaaggactccgttccttttgacttttaattttttttttttaactgaagataaaatagacatgaaaatgaagcaggaagttcagtaggtttttgagtttgttgttgtgcagccttcctcaaggggcttcctgacctgcaatactaaaactccatgtccactgccaagcaatctctatttttatttatttatttatttatttatttatttatttatttatttatttatttatttattaaaagcccctgattttgcaaccacttttatattttactttttggtgcctgcccaccctcctttccttccttttgaaacagggactcatcatatagcctagggtacctagaactctctagaacttgccgtcaaacttgcaatcctcagggctagggttaggattagattctggcacccacgtaatgctaggcattctgaaatgcccttagctctagcgctgagagatctaataataccctcttcaagccttcacatgtgcacaggtttgcattacacacacacacacacacacacacacacacacacactcaaagtaaatctttttaaaaatttataattgttagtgctaagaatgctattttgtatgtgttgtacaaaatgataaaagtatagttagggccatgtacaaactgttggaaattctatcctaatttaaaagagaattctttgaacaatgtgtgtgtgtgtgtgtgtgtgtgtgtgtgtgtgaaactgagatcatcaactgaaacagcaatttttaaaatgtaatatttgaatatatttcagagatgaactagtatgatccatgttcagcaatgaccggaaagtttagaagtctttgctttttagagttaaacaattacctttctataagaacagagagcttgcacaatggtaggcatatgggtgtataaaataggtatacaaaataaacctactgacaacaggccatcaattactttgaaacatttctttggtgtatatacaaatcgtacagtaaaagcactggcgtttgtaactgacagtcgtttcaaatgtaagctgagatgtctttctgtagcgtgcggacacacacagcacagccattggtattcagaccctgggctgcagtaagtccacgtgatccaccatgggtatgtgcaattgggagcactcgtgacaccttcaattttgaattactattttgtcagtgtacattcagaaacctactaccgagttttcgcctcctccatgcatccattcagttatacgatcacacatacggtggcacacacagcttaggcaactctactttatccctagttttctttaatcatctgccactagacatttgggttgcttcaccttttgaatattctgaacactacttctgtgaacacatgaaagtgtgcccttgagacctgccttctgttttgggggtgttgaacagtggtgattctgaatggctatgattgaggtaactcttcagccatactgtttgctgcagatcttcactccacactgcttgctgccatccattttctccacattctcttgtgtgcctttgatagcagctaccataacttggatttatgtttccctcaggaacactgatgcctactgggcatttgtgtatcttcttcgggaaatgtctatttaagtcctctgctgattacaaacatttttgtgttctttatgtatatgcgtgtttatgcgactgcatgccatgtctgaggtggctgtagatggtatctcccttgagctgctgttgcaggcccttgtgagcaccctgacattcatgatggaaactgagctctctctccagccctctttgctgatattttaatcgatgttttgttgttgaattgtagtggttccttatcaatacctaaacccagaatgcttaagttctatatgcaaactaatgcaggatttgtatgtcctgtctacagtactcgaagtgtctggattacatttaatacccagtgccgttcaaatacttagtaaatagttgtcttactcatacgatattgctttgggaatggtgagaagactgcgtgtgtgcagttacaggtgagacgccttttttcctcctgagtatcttgtgaatgcatttgtttaaatcagcaggcgtgggacccacaggatctaagttgactttgcttcgcccttactctgatgcttgatttgtgggtgtctccccctgcctcacatgtgaccccattggttccttcagctgctggcttgggagctgactacaggtggcattgctcacgtggctgtctttgctgaccagtagacgtttctcttgatgcggtgcctggctcctgtcccccttttttggtggctacccctttctcttggcccactgagtgcctcctggtttggttcagcctgatgggccagctcttaagtctgacccagcgcctgatctccccacctggctcttcctgcctcagtccccctcttcaggcctttcctgaagacttataccctgttttgcccatagcggacggagctcatacctcacgcccacagtctcttcatctccatggctgctgctctgctcagtggggaacttttcccactgtgtaaaaatgtcttgtcttcttaacagcggcatctaaccagaatgggggcctagaattcaattcaggggataaatatactgccaagaaagaagaaaaagtgtaagacagaagacaaagacagaggggaggtgtggggagagaagagaggcaagactgtcacagggcttgcttgtgtcaggcttcagagtgccagactcttttgtggagcctgtcttctctgtccaggtcctctgtccctggctccctggtactatattcagagttcccggatgaggcccagtgctgtggcctttatttcttgttctttttcttcccatactttacataataaagcttctatttttcttttggagtcagaaaactgaagagaccgcctttattaaagactttaataaagaagtcaggaagtagcttggggaggagcctagagagctaaagggacaggattgctcctctctgggaagtctgtcgctccctcagcacagttgtgcaaatgcattttgagtttcagggcctgggagacttgtgaagagaacaaaggggcctgggagtccagagcttctgggaaagaggtccttgtttatgcctgttggaactgatttggtcaagtgtttgtttaaaggagatgccacttggtaagcaacaccaagcttttttggtttttgttccagaaggcttctgattggctggagagctgcccctgtttactcatagctggcagagtgtgtgcctgggacccgcagtctcagcacttccacccagcaaacttttcactgtggcccaactaggcagccaaacccacaccagtgcgcccgcccctgcccgcacccagttgtctgttgcctttctcctgatgagttgctaacgctggctagttaggttttgggttttgcacagagaggattaaaggtgtggataaatcatgccaaggaagttaagcaccagcagtactccccagaattttcagtgtggtttcaggtagcaggctgtggtctcccctttctgatctttcagatgagaaaaccaaggcccagagtcaccaagggcggagattcagggatgtggtcccagctggacccagcaatgatctcccgcctcctttcagagtcaggtttagtcattatcatggtgttctttacagttccatctgtcttcatgcctggcatacagtacatgtcagtagactgtaacctgtgacatgattggttgggttgaactgagctctgggctctggtgcctgcagtctgtagtcacaatgctacattgggttccagagatcgggatggggttggactggggcagcatggtgtacttgcatatcctctatgcactgagcatgaatcatcctgtgttcttttgggtggatcagctgaggcacagtacttgggcaaagaacttattctgcacagaaagcctgtatatcacattgaagcatcggatgacaatgcactagaaagaggaataggttacatactgaacgtcactgacttgtagttttaggtaaatgtagaattgcagaaacagtgaggaagacaagaatcttgcctcctgcttagtctcagcgtgtatgtgtatgtgtacgtattgtgtgcgattgttggggataatcagctgttgtcttaccccctgctctgtctcaggcagcacaacaagatccttagtgtggatgggagccagctgaagtcgtacctgtccttggaagtgctggatctgagttccaacaacatcacggaaattcggagctcctgtttcccgaacggcctgcgtataagggaactgtaagtgtctctgccatccatgtacctcagcttccaggtcttgcagtggctgccctggtgcccagccctggacacaggatgggtgcttgcctcactgtggctctggcctggttaagtccatgaggctgcacagacctttgtttggcagaccaagggcggggtctactcttgatcccttggacacctgttgtagaccatttccagctcccttatagtactcttggtgttacaggcagaaggcagcaccgaggtagggagaggttaattggctatccaaggagcctccccttgctgtgcagagcccaagagtcaggcctaggctctctgctcacaaagtctagttttgctctcatgctctgggctcttcttcctgagaaacttgtggggaagagttgggtgaacagtggatacacagcagagggagctaggtttaaagagcttgtatttctagcatcagagaccactcagataagctgcgctgtgttgtggctggctcctttgcagagggcagctttgtagttgtttagatggccttttttttttttttccttttaaataaaaacccatttcagtacctgcctcacacagtgtatggtagacaggaatgaggaagctaaacctatgtaatccactcgctgcaggtaggaaaatgctgctttgggtaggaatctgaggactgaggctaaagcaacagtttctagttatgagtgcatttcatcccatctccttgctgtttctgggctgttctgtagctcatctgcaaggctgctgtaggtctcactgtgacccatcttctcagggagggtgacacttggtacatctttccaagtcattctaagactccagggacagaaatgatactttctgaaagttcatcaaggtacaagaattggagacaagaggctctggcttctatgaagccctgggagggggctttctaaaggcccagctactacctggtacttcttgtgtagagagccgccaaccacgacgctggattgtattgtcctctctctgcagagatgcagagggcactttctccttggcagctgttggctgctgtgtctccatcacactgatgactctttaattggagtgttaagaacaaacagtccagccccgtttgcagagtcctcatgtgccctgccctcggctgctgcctgatggcgggaatagaagtacctcattccctcttggcacacaacccactgtggttgaagcttctctctagtctgtctcatttgcacttaagcttttgtctggggaaggcaggaagaggtgtggggtggtccttccatgtcttgtcttttttactacctgagagaacatctatgctgtatgctgccatgtaactttgagaaagagtcccttcccgtgtggtcacaggaggctcccctggcatgcgtagtgtgcagccccatgaagatgtatctcttgttttctaaaggactcacagaggtctctaagtgcttcttgaagttgttagaattatttaaacgaacggtttgtgcatcttcataagtcatacagttagccctcttcaggattaaataaaggatgtttctttaaagtataaaacccattgaccttgtctgccaattgacttttttgctattagggctttcctggccagcctgaattagtgggcggtaaggcaggaatctgcaagttctcccgaggcaggcattgttctgtgcagctgtgtggggaaaggttagtcatgcccaccggcacgagcacattgctttgtgctgcagtaaggcctgtgccagtgtcttctcttcatgagacattcctgctaccggcattcccaggttccctgtcttcaagtcagggcaggctgggaagccttgagatgatgaacagctaactcagtggagatctgcccctctgggtctgccttagcacttttcctagcggacccagctggatctggaggcacaaggagtgaggaaggcctcccactgccactacattttctctcctgaatcattccagcaacttggcgagcaaccgcatcagcatcctggagtctggagcatttgatggtctgtcgcggtcactgctgactctccgtctgagcaaaaacaggatcacccagcttcctgtgaaagcgttcaagctacccaggctgacacaactgtgagtacagaaacctgcactttaattaaggttagccaaactttatggggccagatttccccaaggaccctgtaccaatcgccaccccttcctcacccccctggtaaagctctgcataaactatcatttatgaccctaccgcaacacctaataaaagcaaattaggagctgggtctggtgctggcaggctgcctcagatggccaaggaaaagaccctcgtgcttggatgattagcctccctgatgctatacttctgaagtgcaggccccacctcccccatccccacccccccttgatccttctgcctcagcctcccaagtgcactcaccactaccatcctcacttcgttgagctctcatcttgagtattagcaatgtttaaggtgctgaggccgtctgtagcttggaagggaaggtatctggtccttctggggaagttaacctgaccagaggcagctgcctcttcatttcctaaattttagaaggttagccagtttggttttgtataaaaggatttatttatgtctcttttcatggagcctaaaatggcacagggtgctagaaaccatatattaaccaaaactccccagtcagtaaaaggttcttcaactctttgtttccctgtgtcttcgttttagcagaagagtatatttcagggaaataagctagaattcacaatttggttcgatcaggatgaaacagttgcagaccaggctggcacagggcagagagtgccctgtcctcatttctcctgagtgcaggagcttgactctgctctttccagtctaagaagctgaagaggctgtgtgtgaagcagggtcatgagacactgcagaaatatttggggaaaaaccaagggctttctaattagtgcagtgtcttcccaccttccccagagttgctaatgggatccagctgacccagattccagatagctattggtcaactaaggctgttctgctaggacgaggtgccaagtgtgtatctgctccaccccccacttctccacaagctgtcacttcttcccattgcacagaggtctgtcagatgccccgagtggaagttttgctgatatttggtacccaatggttaggattttcttgggttgaagcatctggtatggatttctgttgctgagctcagagacacctcagcgaaggaatgaatgtacctctgagtcatgcccagggcctgctctagactcctgaatggtggctgtcctgagggaagaactgtggggtgcttatgtccccacagtactggggcagtacagagctagccatgcagcattcactgtccctctcctaggctgtcacccttgctgttgacagtgccagtgtgccagctgaggtgtcccctcctccatggtttcaccaccgactcggaacggtgcagcctagatgtgcacaagggatgctctgacccgatggcttcctctctctccatagagacctgaatcggaatcggattcggctgattgaaggcctcacgttccaggggctcgacagcttagaggtgctgaggcttcagaggaacaacatcagcaggctgacggacggggccttctgggggctgtctaagatgcacgtgctgtgagtgcggcctccctcctgggcacggggatggtggccacctggatgctgcctttttctgcaaaatgaaccaaaaccaaggttgttttccttgcaaggtagaaggaggttttaatggacacatggtcagctaaggaagtgggaagagatggattgcactagtctgctgggcctgctctccacccccacttcctccacaaacccaagactgcagagtgattccctccccacatcctctccactcccacaccttatcggaagtcccttctttcctcacgctgggcccgataggctttcttgatgtgcaggtgggccaaaatgtatagttcatcttgggagatttattcccgccttgtgagctaatcaagacacggagtgcagatgtgcagcttttatcaagggagtttccagccagatgtgtgcagcagcagagctgcctgctgccagaataatgaaaaagaacagcagaggggcaattactgatcttctgattttaaacctctacaattgtttaaatcaaaagtaacgaatctgcatagtcaggaagtaaagagaaggtggtgttgtgacccccccccacccccgttgcccccagcttgttttccaagaggcagtcatttcaaccatccatatctttggtgttttggtgttctggttttcatgtttgccagtgtctcctttcaggtggacacaactgtacctctgcctttgcctgtgtccatcagcggctcagctgctcacctcttttacgcctggtttcctatgcaaattacattacaacctgtacatatgctgttatttttgtagctgaaatcaaagtcggaagcctaggttcacagccaccagtgtgttccccagcctcatcagcagaagcatctcccagtgactctccctccccacgtatgcccactttgtatggcatgcacaggaggagcctgctgcttggcttcttgctgttcacacttcccacttctgattagctgaatatcggtttcctgtgttcatttaggaatctgaggtccagatcagagttctcagaacaaaatttgttatctgccacttggtttttaatgttgcgtacatcagtacaaatgaggggttagtatgtttctcaggactttaaaaatccactaagttctcatgctttgagcggtaggagaaagtcagatggaccaaagcaagatctgcttgcttaaatttcctctctaatactgaatgtggcacagatggcctcctggttgctgtctgtgtaatgggagactggcagtctcatcccctgcatgtgtgtctctgtaggcacctggagtacaacagtctggtggaagtgaacagtggctccctctatggcctcacagccctgcaccagctgcacctcagcaacaactccatctctcgaattcagcgtgatggctggagcttctgccaaaagctgcatgagttgtaagtctggggcagtgggcagtgaagtaccttgggaagtgaagcctctagagcccagctcaccccatggggtccaaataaggaggcagcccaaaggtgggaaggctggcagtgtgtgcaggaaggaagacccacgtggactcgctgcccgccaggtcttagacttggagctggaaatagaggacagggtgtgcaggaaacagaagcctgatgtcgtcaacacaacactcatgggtggcagtagtccacacgcatctcttgactgaaaaggtcacatctgagtaggactttgaagctatgctgatggtggaaagatgggtctggccttgggaactccagcaagagacagttcctcaggacactgggatccttgctgcctgtttgcatcccactgcctggtggcagaagtggagatgcagggtcctttagacagggttcctaggttgtgcccttgcttctgagaatggtagtgacagacttccatgatggggagggcgtggcctggatggcctggccatgccctcacagcaaacacactaacactgccagagccatggactcatcaagcatcttttgcccctttgtccctgtccctcatctgggagttcttttagtttaatagacactgtatagtccagtaggtttacttttgagaaattcagggtttctctttttatcttctttggctaggcttgggtataggaaaagattgacccaccaaagcatgtgattggtagaaatgttgcaccttactcagcctctcttgtatttgtttatctcagcaggaatagttagagaccctggaacccaatgatgactcctgcagcctgttgtcctctggtcttctctattctgatctcgccctcagtgtgtctgtcattacccagggttcatactttagccagtccctgtgctttgtgaaaggccacagtcctgccccttgctttgtattcatttctcttccattctgtgttagtgtgcattctttgagtttagcttcctgccacctagaggtgctcctgctgaccactgcccatggctttgaccgaggcttttgttgggagctcggacttgtagggaaaagagaggccttgaaggtgttcagtctagttcccaagtaaggacagtcttatggaacacaccagaacggtgtgggccccttgagttagggctacatggaaagggaaaactcgcaggcagacccctgagttccttccttccctttctgcatggcggacaacattacgctatctcctgtgccatttagaggaagagaaggttcacttgagtgtattagactagtcctagcgatctgctccattttagaaaatgtcagagccagatatagggttgctctgcagtgtgttcttaccctgccttttagttaaattctttaattgcacatgaggatgtaacgatggtctcctgctaggtctttgcaactgatagacactgtgacatatttctcttaatagggacagaatatggtcactgtcacctttaaaactgcattaatcttctaccaattcatttttgttccttttgtaccagtccagacttaacatttccaaccatagataactaatgttacataaacctacccagtgtagtgcacacctgcagtagtgctaggaagggggtttggttctagcaaaaggtatgctttggcgcccaatccctgttgagcggtgtacaagtcacagcctgagcctttagtgtcagggtcttcccctggtgtggctgtcccaggcagtggctcatggtgccctctgctggctgatacagcaagtgtagctgtggctcagttgctcagtacagaattccaggttctgttgtgtcagtctccatcaagataggtccttcatttcctacaccaagacatgcagtggaggggtttggcgccttgggatttgggttgtatgacaggtttttacagtgtatgtaagcggtagttctcagctctgtggtactggtttcatggcttgcatgatagttatcaaactaggtgattgttgacctgatggtcttctgacagcaggagtcctgtggacatgcttcagtctcctgtctccagggaggtcaggccagttgtggcatgagacacaactgaagacaagagagaatagggcacccacatagctgctcagtggtgacatttgtcttcttctttcttccttaggattctgtccttcaacaacctcacgcggctggatgaggagagtctagcggagttgagcagcctcagtatcctgcgcctcagtcacaacgccatcagtcacattgctgaaggcgccttcaagggactcaagagtctgcgggtcttgtaagaattgtgcttttgagggtgacagcatgaagggggtccccagatgggagagcacacagcaaagcacttgctttgttgagattccctcttgctggcttgtagtcagaattgggctgtaagctggtctgcaacaggaacaaggactagaaccaaaaataactgctgaacagttaaatccttcctttactgagcagaaaaatccttcctttcccacagtggtgcctattgcaggatgaggactcttgaaaaatcactgttatcaatagttctcagtacacttggccggatgggatgggtgggtctggaaaagcatttctacatagggtatctgcagcaacattcacacagtcctgcatgtctctgctccattcttttggttgtgacctctcatttatttctcttttagagagggtatggtagtggttttgttcatttgcttttaaagactgggttctctggctcaggttagcctcaagctcatatattgaggctggccttgaacttgtggccatcctcttgcatcaagggctaggattacaggtatgtgagcctccaggcctggatgtacgttttgagaattttttcctaaggtttctatggatcaaacccaaagctttatgtgtaataggcaaattctcttctactgagccacacccccagtcctgtcttccgttcttaaatcctatgtattgttttctgtaactcagtaccatggctacttttctgctctttctttgaagctctttagtggacctggtatccaagatagaagtgagggtcctgtgtccttgtcctcattcaggagtggtgtaagaaagagaaagtgagaataccatgtcctttgaagggtcagatgggtgaggctgctagaagctgctgagggtgcttttctgggacttttcatagaacttttttcacttgtaaacgctaggctgtctcctagcagccttcagtctaaaaccccccagaagggcacacagtcttccacagatagtggtagcagttccacagctttcttctgcagcctggtctgctgggggagcaagcctgtcgttgtgcctggagggaggcctctgcacttgcaccaggcagagtgggcttcaggtttgagtcagggatggggagctagtgccaagcaagctatccgagcccaggtcagtctgtgagcccttccgaggcccggacagaaaggccagaaacattcaagctgagcaggccagaaagagaggactaatttggcaggcaaggcccagagcaggaagacaggcacacagaaccgcagtctctgctgtactcagtctaaagatgacagggtgggactcgttgagagcagaggtcccttccagcagcacattctcttttagcttcatgctggaaagtgaaggtcagagcaagcattgtgtactttcgtcccagctccactcccagctggcaatgactttccagcgtcttcccagagccaagagctgcatccctttctgtccttggccatatctgcagggactcgtgcaggggatgtgcagggaccagggctctgtgaaaaattggaaagagtgaatgtgagagtaggggtctggctgccaggtgcgtgtggctgggcagcgtgacctgcccttggaagctcagggaggaagctgaagcactgaccatatccagacagcctggggccgagtagttggcctcctttttcctgtcctggcaagtgggtcacaagattgactcagcacccagatgtgtgctctggctcagtatccagtgctacataagcctcacgaggagcagggtgcaggccctaggcttccaggccggcctggaggaacatcagggcccagctccttcgccgccacctcttccttccacgtgccttccagtgtcctggttgaacccgagagaggactgtggctaagagtagacaggaatggttaggagtcttttgggttagaggtctgcttcagagaggtgtgtgcaagcctggcttcttcttgtgctgtctctactatttccctccctgaggccagccagattggttggtgggcgggctggctttgttggaagcagcagaagcaaggtcatgctgatagtacacaaaaaagaacaacaggacgttctcagggccatacttctcctggcaatgcatgctgctgggccccctggggtgcacctggatgctttgcggctcctagtgaaagcctgggtgtggggctggtctcccttcatggtggagaacaaaggcagagcttaagatagtgggtgaacttgccttctgtttccttcttagggacctggaccataacgagatctcgggtacaatcgaggataccagtggtgcctttacggggcttgacaacctcagcaagctgtgagtatttcagactgggagtgtgcggttccgcaagctctgggatgcaggggtgccactcatgcagctcccctgagtctcctgtgtcctgggaccacagaggacagcagcaggccttctgctgtgtgcagagaagaggctgagggctacagtgaggaatccgcagtggctcacaggccactctcacagtcttcatactgtcagtgtgtggtggtccttagggctgctgggcttggtcctgtttacagcccatctgaaagcacctatatgttctgtcctctgcacagaggggtgttgctgccttctttagtttctagagatgtgtgaagtacctttcagtagttttgaggctcttgtcagtctttttgttgctaattataatcacaagtagaagcagccatcaccaagagcactagtcatagctactttgaattcagtttggagagtctttgtcctgccctcctagaattcgtccactgctgtagtaggtacatgtctgtgtgcaggctccattatgcagcctttagagctccagagacaagtgaagggaactagcccaggacctggcaggtggcaggttcggatttgtacccctggatatggtatacttgttctcttgcccaagttgcagaatgctctgcagttctgctgctgggggcctgtccatgccagcttgtgagggagggggcatttctggacctcacagaagaacttcaagagaacctcgagcgacctgtgtagaagcagcccccgcccgacccctgtccacctctgacattgatcaggaggggaagagggtgttctgtgtagggcacacgtaaagggggataggtagagtacacagaagtgggaccctggcttcctgtcaggatgggcactccacattgtgaggaaggcttgtccatgccatggctccttccaaggccgtgaatacaaagccgaccatgacacgttccgcactctgtacacccatggtgcctttgtgcttgctttagcaagcactgaaatggcttttgggagcctacgctgggctggccagatgtgtaagaggtgacatctgagatcactgcctgtctgagtccttagcagggaggtcaggctagccacctcttccctggagcacccttccagtccagggaggcacagatgtgtgctgagaggaggtcagggcctgtttgagcctatcagtggtatgattggcactgtgtaattgagaatttgagaatttgttttattgctgttgtcaccattagaagtaacagcctgccctcactgtaagaggtcaacgtgactaatatttaatggatgaaacaaggcacagcttttcctagatctggtttacaggagatttcactaaacagctcagcttgtttttactaggccccggagcacatggtaccctgcttgtgggatctgagtaagtgcaggagctggcagactcgcaggcactggggttcagtgccccgtgagctgttatttgctgctagttttgtggctaaggagccaaagtgaacatggccactgggcttctggcatttggtttattttagaattccagattgcgagttgtggaagtcttttcaggatgagattgttttcttgtccacccagattgcctgtgagagagaggggagatagaagggccattggctgtttgccctaagtcaggaaacagtaggttttgtctaaggctgaactgaccacaggggcccctggggccagaatctgtaatgaaacaggacttaggaggcctcatggtgtgctctggcagggcccttgggggcaggtggatccgccacctctgtctgtgttctttgcattgtaggaggctgttctgggatgcggggccgtgctcctgcgggccagcctgtttctgccccgtgtcccttcagagccttgacagttagtctgaagctcaggccacatggtgggtgatggcgaggccatggtcacaggcaggctagtatttgtcttcccttgagggaatcagtctgacataggtggaagatagcctctagtccagatcttagccctgcttctcctctctttgggaagaggtgagccaggctagctctgttcagaagcttcctctgtccactgctgcctggacttgctggttctgatttcccaggcctccagcctatgtatgtaacatgcctgatagaaaatgctggaagacattaccctcgaggggcagagctcattaggcatcactgtcgtgccctgagcagacacatgcttgtgttgagttagcgcatacctttgatgcacctcaaaagcaaaggaaggagctttgccttccagctacctgggccacagtgcagagcctcttctgcagaccctgagaggagggtaaatatcatcagggcagctacatcctggccactatagtgcatggcagacgcaaagagctacggggctatcttgatggatgccctcttcctgttctctgctggttagttgggaccctttatgcccacagtgcagtgcacagaagtggatggcaggttttagtcccagtttctattgccttctgaccctgctgcttctcactgaaacagtaaccagcctagttttctctgcaagggcactacctgaacaaactccccacccccttgggtggtcccaggaaagacagcatggcctggccatggcgatttccgcttgacactacaagggctctcttgagactgggtggaacatgcaatttcagcctgtcatcaccgtgaaatgtaatagagctagagacatttcatttcagggtggggatggcctgtgcaccccagccctgtaatccccttacaggtctgcagtgcacctgcctcttgcagacgggtgtcaggcagcactgccctgattgtgtgctttctttctcgattgcttctcggtccctttctacctacctaccctgggcctggatgtttggaaactacaggactctgtttggaaacaagatcaaatctgtggctaagagagccttctcgggcctggaaagcctggaacacctgtaagtaccctgccagaccctgcctggccctgcctgccaagcgtggctgccgggggagtaaccacttctttgtaaaccaagaaacaggctgtttggaaacaccatctgcttccttctcattataagtcagcttcaactctggcctttcttttgcctctgccaggaacactcacagagcatatagtctgctgctgtgctcccaattaatgtgattggtatttgaacaaacaccttcctcccacctgttgggctatattaccatgcatcagactccttaaagggtccctaagctctcgccactttcataaggatactttattctagcaaagccaggcaatacccctccccctttaacagctccctgtcctagtgcatgctgggagcttttctactggggtgcttgcctatgggaccttggaactgattgaggaacgctagtcctgagatgttcatactgcagttgggagtggatgcttctagttcctggctcttagttttatcttcgaatcaaagtaagcctttattctgggtaaatttttccccagttttctacctaacgtcaaggctgctcttaggttggtttgctcccaagtcattctgtgtgcttgcaacaacaggagaaccgagagcctctcccagtggatctggcacacggggtatggctagcacctgtgggtcatctgtgaaccagggctggcctgaaaaacccccaagtgtcctcacttggccacacatttgacaactgcccatagctcctaagcacaaagtactgtgttctgtttcaggaaccttggagagaatgcaatcaggtctgtccagtttgatgcctttgcaaagatgaagaaccttaaagagctgtgagtacctgggaacccatggcctcactggcatgagtggagacttgtaattgcattgtgctcattttctgtaatagctgtgattgtttagaggtcagataggacttgtctttaaaagcaaaatgccggatgggacttagctctggatgggggtggcagattctttctgaaatgctgacatagcaaacgttttggacttttggggtcacaggggctgggtcaggaatacttaaatgtgttattacagcagacagcattaataatacacagacaaatgggtgcagctgtgtgctgctaactccacaccaacagagacagacagtggcccgcaggccagagtccactgttctgtaccattctcttccaaacaatggatcggcacctttttaaggagagcagttttcatcttttagatttattttgtattgagagagggtttctgaaggtgttctttggacagtggcagggtctctgtggcctgattccggacgctcagcctgggtcccttgcctggtctccctttaactgctgtgtgttctcaaaccatgactggtcctgggcccagtcttctgatgggacaaagaggcttcctcggctccatcattttcttccacagcagatcacacaggttaccctctgcccttagtttctgggtaaatttccacaatcagtgatgagaaacacacttggaatcatgaaaatccacaacggaagccagtgaagcactgggatggttggaggcgggccacagagaacactgcctatctgcctgtgtgaagaagagactgggatctacagagcttaggcagccatggtcccaccatccaaccggcctggcctttgcctctaactacggggtcccatggttgtctaggatctagcgttctcacttctgtagggctccagtcattcgttccctgtgttccttgctcctgtactcatcacttaagaaaaccttccctttccgggttcccatggttttgcgttatctagcctggcctctttctcggtgctaaagaccttagcgctaaacccagtgtatacactgactgtggtacaaagcctgattctttgaacatatatctggtcaaaggttgaggtgagatttatttcttccagcttgttcctgtggctaacatttaaatatacccctgtcatggctcccagcaatgccctggcttcgttctctaggccttctcctgtcttgtgctctaccacacacaagtgtccttttgatgaggaggtgaggaagtggacctgacaatggaaagttcctctggcccttgaccttgactgagacagccagcctgccaccacacagcactcattgctgtgacacttgcctccttgtgtggtgtatgaatcggtcactctctcatgggtagtgtgaatggccttctgccaccacagtaactcctcagcaggacagccctcagatacctcccagttgaatactacctgcccatcaaatgaaagtgcagtgcctcctctggtactgctgtcacagagggatatatcacaggatgctatcacagcatccctgttaccatgctttgagataaattagtcaagtctttggaaacgtatttcctaaagtgatttaaagaggccacaggtgggtgatgagaagagaggaggaggggttgactgtgctgtcagcctagggtggtggtgacctctcctgtccttcaccagtgtgacaccttcactgttcattagaaatcaggagaggaaacagaaagctagttcatttgttggtatgagaagaagccgtgctcaggatttctaagtacacgtgggttccctttgtccctgcgtaccacaggccgttcaggacaagaagcccatgtttcctttcttgttcttgtccttgggtatgtctggtgtcactcattaactcagggctccaggcctttccgaatcaaggcagctggatagtgtgtcactaacccaagtgactcttggagaagggatgtccgctaggatggccattttgagttctgtttggaagtttaacctaagttgctgaaaaatgaaaatgttctctgttttggttggaaactcagaaaaccaaagttgagcattctgctgccctcctcagtaacactggtgtgaaggtaaacacaggcaagaggaaggtataccggcgaggctccagcttagaagttaaaacatcatacttttgccaaattaaaaagatagcagccatgtaggaaaagatttcttgggattttttgcagaatttaagtaaagtctgcttctgtttggctgttgcactctgcagaatgaggagagagttgtgggtagtgcccctcacatacagtgtgtatcccaggtcacagcaggttagaaggcacccccagggtgacaggagctttgatcccctgagaacatggatgctgctgttccagttgtggtcttcagaccagcattctcaatgccgctctggggctagtttggcatgttgtatcttgggctctgtatcagaagccatattctattcaaatctgcatggagggtgcgtgagctgtccctggtcactggggaaaatcgttccctttggaactgcatgtcctgccttctaagctgattagctgtgatgttttgcaaagaacccttccttatggtctgttaaatattcacctcttgtttctctttcagctacatcagcagtgagagcttcctgtgtgactgccagctcaagtggctgcccccatggctaatgggtaggatgctgcaggcctttgtgacagccacctgtgcccatccagagtcgctgaagggccagagcattttctcagtgctgccagacagctttgtgtgtggtaagattatccttgaggtttttggttttgtttttgatgtagggcagagaggccaggaagaacgtctcatcataagactgattcctgtgaccctagttagtgtagtccatggttacagatcagctgctgggtgcaatttatttcccacggaaaccacatgtatttactgcacagtgcctcattctgtggttcttggagtacacatatttaattaaaaaggggtaggtttagctacaaatctaaataactggttacagtgcgatagttctgatcttttcagaagggtcctgggcccaggtttggctgtgaatgagtgcatggggatagggtttcaatgtgtgtttctttccagctctaagaatgagaggttaaacacaggaagagcaggtctcaggagagcagccactgcagtaaaaataattcctccatgttgacttgcactcttgctgcttgtccaacccgctgaaatgtgcactgggagagtctctttcctccactttgctggaacatagatttaaccatcttcttgaccagtggtagtcaggacccaagtttagttacagagagcacagagaacacggaacagctgaaacacacccacaggctagctctggcaggactagcatagcctcctagctaaggagatgggatccaagaccgagaagaccgttgaggtctcgttgaggtctgtctgggttgctctgagcagcagtgggaatgcatgatcctcctgtcagtggttccctgtggcctcacggagctacaggatcacttcctgaacgatgctagttatgacccatctagcagcctgggtgtcccgggccacttgtccgaccttttccctgtgagttatgcctgctagaggtaagacaagcatcctctacctcccactgcattaattcccaaagcaggcttgctgactctcggtgcactggctacctgggtagaatcagggttgtgcagacagcaccctagtcacattagagcaggcagcactttacagccagtgctaattgactccacactcattaacttgtttaggttttctcaagttaagttgtctttggcttccccctctgtctggtggagggcagttttctgtttccctaaaacctgatccctagttggtgaccatgctacactgggcattgtagcaatcccctcagaactacccacccacggttcatgagaatccttggtaggaaatcagaggttcaaactctgctccctgtctcccacttgtttctaagaaacagaaatggccaccatacacattctaggaaatcagcatgaagctaggtgatgacaagaacagatgagatggggaggtccttttgtggaggaagcctcgctatgtagacagcacagtatcggctcctgggcccaccctgggatccatccaagcggatgggagcagctctgaccaagtgctcaaagagcgtttctcataacagccccagctggagcaacccagacacccatgcatagacagtaggcaggtagctatgccatgggacattaggtcagtctgtctgtctcacagcatgggtgaattttgacaatgatctgccaagtgaaagaagtctcatgaaatgtctagaataaaggaccccatagaggtcagaaatgtatgtcaccagtcccactggtgagcagtggagacagaagggagagctaaacaggacagccttctctgttagagatgataaaaacatttaatatcgattgtgccagtgattacaactatttgtgaatacacagcgaccgccgtgtctggtggaactgactcgcaagtgaccagttccttgtcagcctgaacatttgctggtgtccgaacagaacaggggtcttacacttggttctctccctagatgactttccaaagccacagatcatcacccagcctgagacgaccatggctgtggtgggcaaggacatccgtttcacatgctccgcagccagcagcagcagctcaccaatgaccttcgcctggaagaaggacaatgaggtcctggccaatgcagacatggagaactttgcccacgtccgtgcacaggacggcgaagtgatggagtataccactatcctgcacctccgtcacgtcacctttgggcacgagggccgctaccagtgtatcatcacaaaccactttggctccacatactcccacaaagccaggctcactgtgaatggtaaggacatggcatctcgtgcttctcaagcacagagtcccacagactacactgctgattgtcctctctgacactggtgtgaagagacacgagccgtggggtgcatctctttgtatcagtccttgggtttgtcccagaccaagtttaacagattgaaccatcgttttttgtttggggtgggagatttttaaagtccagttatgttaagtgacattgtggagttaagctttgtatttttatgttccttgtcttccataagccaagagatgcggtttctagattccaagcatccctaggttctaaggaagcttgtgaccttagaatagatgttataactgggagcaaggccgtttgggacaagtacaagccccacttcctctagaacaatggttcttaaccttcctaatgcttgaccccttaatatagtccctcatgctgtgctgacccccaaccataaaactactttctttgctatttcataactgtaacttcgcaactgttatgaatcacagtgtaaatatttttgaacatagaggtttgccaaaggggttcatgatccacagggtgacccattgttccgagccgctactcttcaggctgtggagagcaggtgtgggttgagcccctggctccgaggtccagtgtgcagggaagttgtgacaagggtctcttactcaggagccagcccctggccatcagggtggctttcttctggactactgatggatgtggtatgttgagggatgaggacagcatcagtagctaactcttccacactaggctaagctggcttgtgggtggcctgaagcactgcctccatgctctctgctattgtacaacaccacaaagcactctaccacagcgaggctggcctaagagaggccagagtgtttcttggagaccaagtagctgtagactctccaccacagtagctcagacatcaagtctggatactgtccactgtggcagcattgatactaaagctacagaagcgaacgaactacatatttttgcctgggtgtggctggtagtgtagcccccatagacaccacccagagtgggtttcctcaagagaggtgagccagctcactggttcctcctggtgacagcatccagctatcccctaatagcaaatgttttgttgcccagctctctccagatagctaactaaagcaggtcagcaccagacttttacttctggaggattccctacatagtaactactgtggagcttcgggaggcaaaacgctccatcagaagccttccgagagtgcttagcaccaggctatagcaataggaaggcgttaagtgtagtgggtgcagtattgtgtctgtgacggggagaggctgggcaccccttgggtgggatggagtaacaatgaactgaggcctgggcacagtgggatctgtttactatgagtttccttttgtatgcagccattccaaatagctttacctatcatttttttccagtgttgccatcattcactaaaataccccatgacattgccatccggactggcaccacagcccgcctcgagtgtgctgccacgggccaccctaaccctcagattgcctggcagaaggatggaggcaccgatttcccggcagctcgtgagcgacgcatgcatgttatgccagacgatgatgtgttcttcatcactgatgtgaaaatagacgacatgggggtctacagctgcactgcccagaactcggcaggctcggtttcagccaacgctaccctcacagtcttaggttcgctacgacagctctcgcgcacgtgtggcagggtcgggtggggattcaactcaagtattagaggacctgctttctggagtccctgtggtagactctgtctagttagtttgaattttggggctgcttttaagcgagtagtttcagctcataaaagacaatgagctatatgttagtctgcgtgagaattctgtgtgtgtgtgtgtgtgtgtgtgtgtgtgtgtgtgtgtgtgtgtgtgcactcacacaggtgggctatgatcttaggagtagtgacaaaggtctataacaggacagtttgggatagggtagggctttagttctttgctctgttgagctgttcctagaatggcagtgatttaattacattaggctttctggaaagcttggtgctccaataaaagatctcagatagcatttcactacaacatgggattgtcttctgtctggaaaacatgtatacctccagcaagcgagacccatagaataaatgtgcaatttccactgccttcctgcagaaactccatccttggcagtgcctctggaagaccgtgtggtaactgtgggagaaacagtggccttccagtgcaaagcaaccgggagccccacaccacgcatcacctggcttaagggaggtcgcccattgagcctcacagagcgccaccatttcactccaggcaaccagctgctggttgttcagaatgtgatgatagacgatgcagggcggtatacctgtgagatgtctaatcccctgggcactgagcgagcacatagccagctgagcattttacctacccctggctgccggaaggatgggaccaccgtaggcatcttcaccattgctgtggtgtgcagtattgtcctgacctcgctggtgtgggtgtgcatcatctaccagaccaggaagaagagcgaggagtacagcgtcactaacacaggtcagcagcacagcggacttggggggctgggggcagatggggtgacactgcaggcctgggggcttgcctagaacctgaaaggtctctagaacatttaggaatatggactctgcctgtagagttgggactttggtccatgtcctcccccccccccccaacagcaagctagctctgaaggacagaacagaaaatgggaatactctcacatgcaaggactcgatggtctctgcagtttctggtctctttggcagttcagaggccctagggccacgcctgttatgaaccggattgttcctaggctctcagtcttggttaggccttcctttccttgttcctcatggagccaggcgtctgactgccgtgatgtttacaccagggtgtaaaggaggttaatgagcggctgccgagcctctgcacagctttctgtgtgtgagccactgtcatgtgaccttgtgatagtgcgtagttatctgtatttattgttgtggcagccctgttattttattgtcttggctccttgcagatgaaaccattgtgcctccagatgttccaagctacctctcctctcagggaaccctttctgaccggcaggaaactgtggtcaggactgagggtggtcatcaggccaatgggcacattgaaagcaatggtaagttcggaacagtgagccagctgccctcgtcctggatgaagctttcactttctccacggggtagtctggcactgggtcacatttggtgaaccaggcctttaattgataagatagtttgctttggatctggtgtgtgcaagttctatacttttaacgttagatcctccggaaagtccctgcattgggcttagcactctgtcttctggtcagaaggattatatgataggattgccagaaagaatatatgcaaaggacattccaggcccccaaatcagcccatagcttttacagtactgtagcactttacatgggctaagtataagtcaaccaaccacagactgaaaatatttagcaaagaaaaactgaatctatatggacattttacatcgttactaggtactatgagtgaagatgacttaaggtctgtcagagaaggtgtacagtttatgtgcaaacagcatttcacagaaaaggaacttggcatccttggatttgggcatctcagaggagcataggaaccaatccctgggtggatgccaaggtgctgggaaaagcagtggtctggtggccatcaggctgcgtgatgtaagcagcttctaagtggtaagggctctgtttcaggtgtgtgtctgagagacccgagcctcttcccagaggtcgacattcatagcactacatgtaggcagcccaagctgtgtgttggatacactagagagccctggaaggtgacggagaaagccgacaggacagctgccccacatacaacaggtaggagacacttaagtcaggggacgcggttgcttttggccctgaagctggcttgactgagtaaactagagtagcggcagatcactggccgcacgctgtctctgagttatgtttagaatacaaacaggattttgtgtgattctagagtcctgtgtcgcttaggtaagtcagtctatgatgtggtgagctgaaggctgagttttcttaacatggctgagttttcttaacataaggaacttacaagacaaggcctgcccttgcgccaggactgttgtcccgacaaggtttcacttcgtggatcaggctgtcctcagcctcctgagatgctgtggctgggctaccgtgcccgtcccttagagtgcgccttcctcatgtcactcagctcatgtcctcagtcactctttgtcctgtgtaatgaacaggggttctctctcaaacccagggttcactgatccaattttctagcctgctagcctgctccggggtttcctgcctctgcgttagctgggccaccacacctgcctggcatttccaggagtactggggacctgaactcgggtccttatgctcagcaagcgctttctctactgagccctccctctccgcagccctgctggcgggactctccccacccgcattttcctgtgattagagtgtgccttcgaaattaattttacacatatacttaggcacacaagactaaggcatggttggtctagctcctctccacatacacattccagggggtggggaggggagagacagggtggttatgaaggcagtggtaagctggactcatcttccaatagtgcctctgagagggaatggagactcagttgacctctggttctcttcttccctcagcacacagtggctctgctgtatgtagtgactgcagtactgacacagcctaccatccccagcctgtgcccagagacagtgggcagccaggcacagcgagcagccaagagctcaggcagcatgaccgggaatattctccacaccatccttacagtgggactgcggatgggtctcataccctctctggggggtccctctatccaagcaaccatgacagaatactgccatccttgaagaacaaggcggcgtctgcagatgggaacggtgtgtattgtgttagaggaacctcggtggctgctgggagccctttggttacggtgcataggctgagctgcctcttttttttttttttttaaacaggagattcctcttggactttagcaaagttacatgaagcagactgcatagacctaaagccttctcctacgttagcttcaggcagcccagagctcatggaagacgccatatctactgaagcccagcacttgcttgtttccaatggccacctccccaaggcctgtgactccagccctgaatctgtgccactgaaagggcagatcactgggaaacggaggggaccactgctattggcaccgagaagctaggcttcatctacctcagctcttttaaagcagtcgctacaggaaagaggtaggagaggccgtggaaagcttgtgtccagacgtcactccggacagtccgacttccgtgtggaatgtcagtcagtcggctagaggagtggcatctggagctcagaaacgtgagagactatttgtgtacaaaaggcaggaaaaagtatttgataccactgtacataagagttttcagagatttcatatatattatatatcttttacagagactattttaatccttagcgcatgggtcccgcttttggtgatattttcacattaggttgctgtctaattttggagagggtcaggaatcgttctggtgccttaatgcacagctggaattcaggtaaacacatcagctgttgctggcggttggaaaggagggcatcttggctgtgtggcacttagtggtcagattcgagtgcactggccagacctatgcaggcgtggtgttggcagcctcactgtagagcagggtgcacgggtctgtagttgaggacgagattgagagctgttaatccaccaaatgcaatggctcagaacaattaagcactgcctttcgtctttctttgtaactcacttggtaaaagcaaatgtcttgtctccttcagtggttctttgaagcttagtgaggcggaggctgccagtgttggtacctgtggattttccaatagtgagggttagctctgcctccagggcccgctaagttctgctgagcaggcctgtccacgctgttccttaccggtgagactgggcttggactgtacaagacttgagtcctagacctgggtgtatttgcactttggggccctgttgctagccatcttgtgagtgccaatgtataatgcagtaaagactacatggaaacacaaactcagtccttaaaaccccaggagttgaggggaagtgttgggcacagnnnnnnnnnnnnnnnnnnnntggcacagtgatggcctgtgtcaccgtgtagtgtcataggccatcacctgtgccagagcaagcacgctgagaaggctagtctccatagttgatggttaatgttacttccacaaaatatgtgaatttgctgcttctgagaggcaatgtgaaagaggaagtattactttttatgtacagagttatttatttatagaaattttggtacagtgtacattgaaaacatgtaaaatattgaagtgtctaacaaatggcataaagtgtctttaataaaggttcatttataaatactaagtgtgtgcggcggtcactgctcttttattctgctattaatgtttctccaaaaggagaatacttagacgaagcagcatagactacacactgttgccccagaaagacagtggcactgcattcctcagatagcttttttttttccacatggagttggttagtcaagccttatgctccccaagtatgctgaccctcccacctcctgctggcatataccatgaggacaaaggagctgctccagctggcctccagggacggacagtggtgggcatgggctttgcttccctcaacatgttcctaactgaagtcacttgggcccacccactcactggcgctgcagctgtctgctgtctgtcacacactccagggactttggggcactttgctgtaaagtaatataatcatgtgtttttataggagaaatacaaggtaattaaaaacagcatcctcaccagaaagaatgcatgctatgcacctgtagctcatgctttttaaacaaagctataatcttacacaataggcacccgcccaggggagaaacagccacacgcacggttcttgcccccttccttttcccagtctggtcattcactgcagttgtagccagcttgctttcctggtgactccaacagacagcagaaagcacaggatgctaataaaaagcattctgaagggcctggccttggccttaccgggagtatttattgagaggactgagacggtggccccagtttcaccaagaaaagtttcctggggcagcctgtgctttggccttcattaagctgctctctgcagccatcttcagggagccacactggagccccaggcacaggaaggactgcaaggacatgtagtgtctgcttcatgggctcttcctgcccacctctaacagcaagcttcgcgcctggtcataggcgcccagaaagatgaagccgcccatgctgattgctgccatcctcgggaggacacctgcgaataacctagggacaggaaatggtcatgttcctgactgcccgcagttcgctcattccatcacatccattgtgaaatcccacagaaatttacagtgtctttccttccttttagaaggctactaagtaatattccccaatatgcatgagaaactggagcttagcctagcatggccacactagctgggaacactcacattaacacagtaaccactctcccagcagtgtgctcgaagaagggagtcaaggatacatctgaggtgaggttggtaagggtgtgtggccctgggacatctgaggggcctctaggtctcagtcagggagacaaagcaaattctgaaacagttctgctctcctaccctgggctcggttatatttgtcattggagtcccacaaatgcgattctacaagaaggggatgatgaatctttgtggactccctttttcttgttcaatcgaaataaggacgccagagtcacatgactgtggtaaaggtggagcgcctcacagtgtcagttcgggattctcaggtgtcccatccccaatccagtcagaacaccacagtggtgtcaggaagccattctccagaggcccaggaaatttcaaatattcatcgtgacattactgaagtaatctactagtgaccttacttggccagatgagacagcattgtgaaaacagagtggcgcacagctggagagaacaagacagaagccccaaccctaaaaggttaccatccccatggtcgctgggctgatgaacacagggcaagtcctaggctgtaaattactgctttctacagaggcagtgggagtgagagagtgacagacagaaagcctgatcttatttctactgaaaccctgttacccagaaaagtgcttctatatgcagaaagacaaacttagaagccagaacttgggctgcctcggtgggaaaaggcacttgctgtcaagactgatggataacccaagttcgatccctggacaaggaaagaaccagtttgatgtctatgtgtgcacactcgtggagaggctttgggtatagggcaagtgttttattataacaatgctcatgccttttaaagatgtgggaaagcctttgtgctaagctaagtggaagctaatgaagaaagctgacaggaatctctgctggatacacagcccatgccctacacagccagtggaagagatccgctgcccctcccacctctagcaggcagcacagaagaaagcaaggacttaacatagtgggacccctcttgctaagctacttagggagctagagagaatagcttagtgggtaaagcgagcaagacctgagttcaaatgtctagaaacctcgtgaggctgcgcgtggcagctctgcagtaaccccagtgctcctgtagtgacaggaagtcccggaggctcttgggtcagctagcctggcccaggaagtggcaaacaaggcacctaccatatagaaggcaggcctggagacactgagctgggcttggaggtcagtctccctcagctttgccactacccagctcagcagaggccagagacagatgggagcagttacagcgtcacagatgaccaacagactgcagcctccttaaagtggaggttttgtaggggggaggggttccacctctgcttacaggcagacttgtgagtagggcaggttgtgttccagggacaacaggtgacaggataagcaggagctcccagcagcagcgagtacataaagggcatattcaagggaaaacgttcaggggatcagccaggggcaatccaggacaagtggacctcccctctgccctgcagcttctgggctaaccccagtctgccctccagcgtggctccctaccatctcctctgagatagcatcaggttccttggtgggaggggctgctgggagttatgtagacttgataggcttagtgtgtgtgcagggcagggggcacagacagtggtggctctatctggcactgccacagaggaagtaggctgagccacctgcccagaaagggaccagtagttttcatttgtctcttggtccaatcacttgctcactagaggggctggagttgctgtatgctcaggggtggccactgctgctgggaacatgctgttcagtgctgccctggacaaggtgaccagagtccaagactggagactcagaagacgagccaaaaatccaagctacctttcagcaccaaggctgggtcagaacaaacacacacccttggcctgttttgctgtctttcctctggcactgcttagttatagtcaagtgtgtgccatgacctggacagggaaggccgctcttgcatcatctacccagcagcatgcggtggccacagcggggcactgcctcatccagtgtgtcctttcttgtcaccactttctcgacactggcaaatgggctgcagccccacaacagtatagtcaggggcccagctaagtcaccacacaatctggcagctggccttcaggatgtcaaaagtcactgtcaccagctgctgcctcgtgagcacagccactgctttcctaagaggcttctcaaataatgcatatggggcacacaacccatgtccctcctcattccatctttgttcagtgtcaaattcgtacccaaattaacaactaatatgttcttattcctcacgcggggtcagccatgaacagcagactcactccggaagctagcaccatgcctttcctatgtctgacacatctagagtcagtaagtcctgtctgttagatccaatctgcacctccgaccatcagagcagacattgagtgaaagcacccagccaccactttgaaacatccagctggaaaactcaaacagacatggagtttgctctctggcaaaagcatcaccatgtttcccggaccatcagctgaaatttaaaatgccaaagttacacaaaaatagtgatcagtgatgtaccctggcatgggggtgagcggggcggctatgccaggtaaagaggccaggagggcacagtgctgctgctcccaatgccagccatcccagctccaggcggaggcacgtccacacagcatgtccagaccgttccgtagagaaaacccttccgcttttctaacaactcagcatagacacagctccagcaccaccgtatggtgaaccagtgtgcagggacggctttttaggacttaaagcaagacatttggaggcatgtggggctggagagatgcttcattagcatgcttgcagggcaagcttaacccaagctcagatcctcagcaccacagaaagccaggtgcagtggtcctcacttgcaacccagcgacggggaagggaacaggttggtcctcgggtcctactatagtcaaaatggtgagctccgggttcagtaagagactgtttcaagtgtgactgaggaagacatccaactgaaaactctatcctctatcctctatggctacactagtgggcacacacacccatctgcataccacatgcaaaaaaatgtgaggtacttagcaaccaaacagtaatggccacccaaggctgagcactgtggagcagacagcgcagtgatgagctgggtaacgctttagagaaaaacagactgcatataagatgatggtgcatctgaaacccacgatctctccatttctgtatctccagacacactaatatctactgctcttccaactgtccatgatcttctgggtatcacctgctgcacttgcagccaggagcccgattccacaggtctgtaggtgacaccatctacatttgtgtaagcacatgatgtttttttttttttttttttttggtttttgagacatggtttctctgtgtagccctggctgtcctggaactcactttgtagaccaggctggcctcgaactcagaaatccgcctgcctctgcctcccgagtgctgggattaaaggcgtgcgccaccacatgatgttttaagtgacaaaattacccactaacaacgcccatggtgcagagcgcaggcccatcataaggcacggctgccagtggttcctactcaagccccaaatgctttcttctaattcactggcagtctgcactgcgtaggtgggagcttatttgtaccaatgctgcagccaaaatacgacacacatttgcatgtcatccagtgtcaaggacaagaccgagaaccatgtggctagaatggtatgtcgccgagtgtgccatcttacatatgcaacctaagaaaaggcaaaggcgaagtgttcatccacagcaagcatagggacctgagaaagagccaatgaagaagaggcaaggcagccgagggctcgctttgtccttacccggctagtccctgtgagcgccacaccccgtgcatggcagagagcacgttccccacagcagtgctggaacccgcctagggaagataaggaagggagagagggccgttaccttctggttctctgagcagactcccctcaccttcatccaaggcttgccctggggttagcttggaaatcttgcctacatttagacatacagacaaatacttggggatgggggcgggggggggcagcttctcatagctcacctagaaactaatggtaactattcaacaggaagcccgatgggggtggcacttctacgtttgcatgggtctatctttaaaatgaccccgtcatcagggttggtcctctgtactctgagagtatactcggtccagggatgttactggaattccttaaagctcagctcagagcttgttttgttgtttggttttccttttaacaacatggacaactgtcttcagtggtcaccgcgacccatggcctgagttctgactctgcagatcagctgcctcagaacatgaagcctgtcagcctctctcaaggcttagatctgaaaacagcaagagcaagcaggggccctcagatgtgccgctcccacggcacagctgggagagtgctggagaaatggaagcgtgctacacacagatccatcacagtgacagctgccaacatgcggtggcgatgacagagccgctcttccaaagtcagggttattaatggtccggcaggttctccgatgcttccacccccataccctccgctaacagacacggcatagaacctgcattatctgatacccacctttgccagcatgatccttgtcttagccacgtccagaggtgtagtcactgcagctgcaaagccacctgtgtgtaagacccagcagtcagtgacatgtccagactcgacagtaacctacacgtctacacataactgcgccgagtacacataactgtcagaataacttgccatcgtgtctacatgacggcgttgagagcaggatacacgtgaacaagttcatctccctatttcacatcttttgccgtactggagaaagaaggtgaagggtactcaggctgaggagtgaggccctgcgactcaccttgctctcccaccgcctggtacactaatccaaatgtgtacatgacacatgtcaatggccagatgtggattttcggggagagaagcacatggctcccagggctttggggaatcgcaccttcctgcaggctacctgtcttaaagcaccaggacgctttggtgctcctgttctgatgagacagatgggcaggctccgtcctgtgtgtcacaggggcttctgtataaccagccaagctcttcatgatacaagacaatgttttctttatttccgtatagcctctgcatcaccccttgccctggcgtgcatttggcctccgcactctcactaggttttcctcatctaatttctgtgatgtcaaactgtccatagatttttaacagtgttcatatctgtggacacagaatccaaaactcttattgctaatgtaaactacagtttgtggtctgacatgattttgtttgcttaagacaaggccttcagactatgtacttggagctagcctgaaaattgctatgtagatcaggctggtctcgaacccacagaactagctttcacccccacccacctgggattaaaggcatgtgacaccaccataccaagcttgatgtcaatattttcttcatttggtacaacaatgcagttgaaaccctgaaaggccagaagaatggagaaataacacccccccacacacacacaccctaaagggctttcaggaggttcagctcctaggagctgccgatgagcagctgtttggggtgggggtgggggggttgcacagaggctctagaaatagctccaggcgccccctgctgtggtgtgtgagcaaaaagggcatttgacctctgacaaatatctttctaaatacggggctgaaatgaagttgttacagtgaccctggctgcggtgacatctgttctgacagttgtgggaaggccaggcctgcccactccttgtttatgttctattttcagttacccacaattggcccacatcttaggcctgtcagtgccccctttgtctagaacctcttactttttgtccttttagacagtttgtgagccaccgagatggcttgcaagttcagagcatttgccatgaagctacgtggaggaagaaggaagctaaccctcacctgccctgactccccaagcttccatggcacacacgtgccttcacccccacccaccacacactacacagacagatcttacaacagtcaaaaactgaggtccgctcagaggtccagctttggccctggtccctgatgcctcaaaggctcacctgtaaagtgcaggcaaccgtggggcagattctcgtcactaaagagtccctacagtgtctagaagaggagtaacccacagcagtgctaataggtaggacctccagtctcggcgggcactgtgctcattagctctttgataacttgatacaagctggagtcatctggaacattacttgaggagtggcctgtaagcaagtctgattcgtgtgtgagggcccagcctactgtgggcagtgccaccccttgccaggtggtcctaggttgtaggaaagggcgggctgagcaaggcatgtcgggcaagcctatacagtgtccctccacggactctgcttccttccctgctttgagttccattcctgacttcagaaaaagatacaagctgaactaaaccccttcttcccacgtttagttttggtgtttatcacagcaacaggacgcaagctaagacatgggtagagagaatgggtgatttttcttcccatctctaatctagtgcacatagtaggcactcaatatgcgtagttatatcttcagacaagtctacagtttttacaaactaagcatgtaaggtgaccctgtaagacgcagggaagggctggcactagtgccaccctcgcttacttgccaggctctccagattgatgccagcaccatcgctggtgtctactgctgccacacagcagccgtatggagctgggaacaaggctgcaaatatgctagcccctaaaatgatctcgccacacccaaggactctggtacaacaacacactaaaataagtctgagcattaaactttattcttttatgtaaaaatattcacaagctgccctaaatcaactcataaagctgacagagaacatttaataaatttggttaactcaagccgaacctgccctggccacagacaggttaaccatccttccctgtggacacctggatattctccagagatgtgggctccgtgaaagtagtgtggaagaaagatgaactcaaaacattttttagctttgataggccctgattttactaccacactgagatctgtactttatggaaggcattaataaatcaatttaaaggccctcaaacgctgggctactttaactcacacagggcacagttttgtatctttaacatttagattaaaaagtagtattattagaggataaatgtaaggaacacactagcacaccagataggaaacaaccattaggcacagcaaacacagactgttctcaagtgaacctagctcctggggtgtttactgaatgttaagctgggccatatccactgatctgattttcacagaaaaactactttctgccttggggaacaaatgccctctgacaggcaaaggaactcctttctttctgacagcctggggctatcacctcagagcagaagctaggaatgtacaggagggcagtgaggtggaggcccaagctcagccccggcagcctggcttctctctgctcctggatcctcgtagctgatgctttcaggagcaagacctccttcctgcacccctcacacttagtctgcaagcacggctccacagtgtggctgtgtgacccagcctgtgccaagctctcacctctgtcacacactgaatcctgcattccgtgctaccacgctaggatgagagagctgcctctccctcatttcttctctcttaagagaatgtaagaagtttctactgtaagaaactgatcaaaagataccggaatgccataatgggaggaagtataccatatcaatactcaacatcactgttttaagagtcagggcctggagtgaggagctggcaaggtctttctttttccttactttaaccctgaccaaaagccaggggaatgtctaagcatgacaagccatcaacacctccaatctcaagagacagtttgggtatttgtgccaagtcgtttatgaaacaagcaggagcaaggagcaggccgaggatggcagagcacggttcttggcgatggccacgcacgccagggtaaacttggaaaacacaaatgcagaagaaatctgatctgatggcgggcgagtttgatcctgaggagaagggagtccataggcagtgtgtgggtgtctggacaggactgtggatagcaggccgttcttcatctccccggccgtacaagacagggctgcaatccgtccgctcttgcagaactccaatttactcaatttggactattttcaaattacgtttatcctgcagcaatgttttcaaaatactcatcttgtttctctagactaacatttataccaagtaacccccccccccataaacaaaaacatatttgttttttaatgtataaaga

SEQ ID NO: 97 - DNA, 4832 bp, Mus musculus
ggtgcgctccggccgctccgggacgggcaggcgcgtggggtccacggctatcatcagctcagcgccctcagtgagatgcccgcccgcgccacgcgcagaggccgaggctaagcgttttcagtcctcagaggcggcggctctcggcgtgcgcccgagctctgaaggcgactctcagcgcggcgggaaggacgagcagcggcggccgggcactcactgcgggactccacagagttcgccgcgcgcggggctcggcccggatgggcgcgggggtggcggtccccgcagggtgctgcgaagcggcccgggcagagcgtgccggctgagcgccgcggccccggagccgactggagtcgggcgtccatgtcccggcgcggagcctagctccgagcgcagcccgcgcccgcggccgcccgcacctcgcagccctcgctccccggcttcgcggcgcgttccagacaagatggcgcggcccggtccgggagtgctcggagccccgcgccttgcgcctcgccttctgctctggctgctcttgctgctactgcaatggccggagtcagcgggcgcccaggctggcccgcgggccccctgcgcggccgcctgcacttgcgccggggactcgctggactgcagtgggcgcgggctggcgacgctgccccgggacctgccctcctggacgcgcagcctaaacctgagttataacagactctccgagatcgactctgctgcttttgaggacttgacgaatctgcaggaagtgtacctcaacagcaatgagctgacagccataccatcactgggcactgcttccataggagttgtctctctctttttgcagcacaacaagatccttagtgtggatgggagccagctgaagtcgtacctgtccttggaagtgctggatctgagttccaacaacatcacggaaattcggagctcctgtttcccgaacggcctgcgtataagggaactcaacttggcgagcaaccgcatcagcatcctggagtctggagcatttgatggtctgtcgcggtcactgctgactctccgtctgagcaaaaacaggatcacccagcttcctgtgaaagcgttcaagctacccaggctgacacaactagacctgaatcggaatcggattcggctgattgaaggcctcacgttccaggggctcgacagcttagaggtgctgaggcttcagaggaacaacatcagcaggctgacggacggggccttctgggggctgtctaagatgcacgtgctgcacctggagtacaacagtctggtggaagtgaacagtggctccctctatggcctcacagccctgcaccagctgcacctcagcaacaactccatctctcgaattcagcgtgatggctggagcttctgccaaaagctgcatgagttgattctgtccttcaacaacctcacgcggctggatgaggagagtctagcggagttgagcagcctcagtatcctgcgcctcagtcacaacgccatcagtcacattgctgaaggcgccttcaagggactcaagagtctgcgggtcttggacctggaccataacgagatctcgggtacaatcgaggataccagtggtgcctttacggggcttgacaacctcagcaagctgactctgtttggaaacaagatcaaatctgtggctaagagagccttctcgggcctggaaagcctggaacacctgaaccttggagagaatgcaatcaggtctgtccagtttgatgcctttgcaaagatgaagaaccttaaagagctctacatcagcagtgagagcttcctgtgtgactgccagctcaagtggctgcccccatggctaatgggtaggatgctgcaggcctttgtgacagccacctgtgcccatccagagtcgctgaagggccagagcattttctcagtgctgccagacagctttgtgtgtgatgactttccaaagccacagatcatcacccagcctgagacgaccatggctgtggtgggcaaggacatccgtttcacatgctccgcagccagcagcagcagctcaccaatgaccttcgcctggaagaaggacaatgaggtcctggccaatgcagacatggagaactttgcccacgtccgtgcacaggacggcgaagtgatggagtataccactatcctgcacctccgtcacgtcacctttgggcacgagggccgctaccagtgtatcatcacaaaccactttggctccacatactcccacaaagccaggctcactgtgaatgtgttgccatcattcactaaaataccccatgacattgccatccggactggcaccacagcccgcctcgagtgtgctgccacgggccaccctaaccctcagattgcctggcagaaggatggaggcaccgatttcccggcagctcgtgagcgacgcatgcatgttatgccagacgatgatgtgttcttcatcactgatgtgaaaatagacgacatgggggtctacagctgcactgcccagaactcggcaggctcggtttcagccaacgctaccctcacagtcttagaaactccatccttggcagtgcctctggaagaccgtgtggtaactgtgggagaaacagtggccttccagtgcaaagcaaccgggagccccacaccacgcatcacctggcttaagggaggtcgcccattgagcctcacagagcgccaccatttcactccaggcaaccagctgctggttgttcagaatgtgatgatagacgatgcagggcggtatacctgtgagatgtctaatcccctgggcactgagcgagcacatagccagctgagcattttacctacccctggctgccggaaggatgggaccaccgtaggcatcttcaccattgctgtggtgtgcagtattgtcctgacctcgctggtgtgggtgtgcatcatctaccagaccaggaagaagagcgaggagtacagcgtcactaacacagatgaaaccattgtgcctccagatgttccaagctacctctcctctcagggaaccctttctgaccggcaggaaactgtggtcaggactgagggtggtcatcaggccaatgggcacattgaaagcaatggtgtgtgtctgagagacccgagcctcttcccagaggtcgacattcatagcactacatgtaggcagcccaagctgtgtgttggatacactagagagccctggaaggtgacggagaaagccgacaggacagctgccccacatacaacagcacacagtggctctgctgtatgtagtgactgcagtactgacacagcctaccatccccagcctgtgcccagagacagtgggcagccaggcacagcgagcagccaagagctcaggcagcatgaccgggaatattctccacaccatccttacagtgggactgcggatgggtctcataccctctctggggggtccctctatccaagcaaccatgacagaatactgccatccttgaagaacaaggcggcgtctgcagatgggaacggagattcctcttggactttagcaaagttacatgaagcagactgcatagacctaaagccttctcctacgttagcttcaggcagcccagagctcatggaagacgccatatctactgaagcccagcacttgcttgtttccaatggccacctccccaaggcctgtgactccagccctgaatctgtgccactgaaagggcagatcactgggaaacggaggggaccactgctattggcaccgagaagctaggcttcatctacctcagctcttttaaagcagtcgctacaggaaagaggtaggagaggccgtggaaagcttgtgtccagacgtcactccggacagtccgacttccgtgtggaatgtcagtcagtcggctagaggagtggcatctggagctcagaaacgtgagagactatttgtgtacaaaaggcaggaaaaagtatttgataccactgtacataagagttttcagagatttcatatatattatatatcttttacagagactattttaatccttagcgcatgggtcccgcttttggtgatattttcacattaggttgctgtctaattttggagagggtcaggaatcgttctggtgccttaatgcacagctggaattcaggtaaacacatcagctgttgctggcggttggaaaggagggcatcttggctgtgtggcacttagtggtcagattcgagtgcactggccagacctatgcaggcgtggtgttggcagcctcactgtagagcagggtgcacgggtctgtagttgaggacgagattgagagctgttaatccaccaaatgcaatggctcagaacaattaagcactgcctttcgtctttctttgtaactcacttggtaaaagcaaatgtcttgtctccttcagtggttctttgaagcttagtgaggcggaggctgccagtgttggtacctgtggattttccaatagtgagggttagctctgcctccagggcccgctaagttctgctgagcaggcctgtccacgctgttccttaccggtgagactgggcttggactgtacaagacttgagtcctagacctgggtgtatttgcactttggggccctgttgctagccatcacctgtgccagagcaagcacgctgagaaggctagtctccatagttgatggttaatgttacttccacaaaatatgtgaatttgctgcttctgagaggcaatgtgaaagaggaagtattactttttatgtacagagttatttatttatagaaattttggtacagtgtacattgaaaacatgtaaaatattgaagtgtctaacaaatggcataaagtgtctttaataaaggttcatttataaat

SEQ ID NO: 98 - protein, 1238 aa, Mus musculus
VRSGRSGTGRRVGSTAIISSAPSVRCPPAPRAEAEAKRFQSSEAAALGVRPSSEGDSQRGGKDEQRRPGTHCGTPQSSPRAGLGPDGRGGGGPRRVLRSGPGRACRLSAAAPEPTGVGRPCPGAEPSSSPRPRPPAPRSPRSPASRRVPDKMARPGPGVLGAPRLAPRLLLWLLLLLLQWPESAGAQAGPRAPCAAACTCAGDSLDCSGRGLATLPRDLPSWTRSLNLSYNRLSEIDSAAFEDLTNLQEVYLNSNELTAIPSLGTASIGVVSLFLQHNKILSVDGSQLKSYLSLEVLDLSSNNITEIRSSCFPNGLRIRELNLNRISISGAFDGLSRSLLTLRLSKNRITQLPVKAFKLPRLTQLDLNRNRIRLIEGLTFQGLDSLEVLRLQRNNISRLTDGAFWGLSKMHVLHLEYNSLVEVNSGSLYGLTALHQLHLSNNSISRIQRDGWSFCQKLHELILSFNNLTRLDEESLAELSSLSILRLSHNAISHIAEGAFKGLKSLRVLDLDHNEISGTIEDTSGAFTGLDNLSKLTLFGNKIKSVAKRAFSGLESLEHLNLGENAIRSVQFDAFAKMKNLKELYISSESFLCDCQLKWLPPWLMGRMLQAFVTATCAHPESLKGQSIFSVLPDSFVCDDFPKPQIITQPETTMAVVGKDIRFTCSAASSSSSPMTFAWKKDNEVLANADMENFAHVRAQDGEVMEYTTILHLRHVTFGHEGRYQCIITNHFGSTYSHKARLTVNVLPSFTKIPHDIAIRTGTTARLECAATGHPNPQIAWQKDGGTDFPAARERRMHVMPDDDVFFITDVKIDDMGVYSCTAQNSAGSVSANATLTVLETPSLAVPLEDRVVTVGETVAFQCKATGSPTPRITWLKGGRPLSLTERHHFTPGNQLLVVQNVMIDDAGRYTCEMSNPLGTERAHSQLSILPTPGCRKDGTTVGIFTIAVVCSIVLTSLVWVCIIYQTRKKSEEYSVTNTDETIVPPDVPSYLSSQGTLSDRQETVVRTEGGHQANGHIESNGVCLRDPSLFPEVDIHSTTCRQPKLCVGYTREPWKVTEKADRTAAPHTTAHSGSAVCSDCSTDTAYHPQPVPRDSGQPGTASSQELRQHDREYSPHHPYSGTADGSHTLSGGSLYPSNHDRILPSLKNKAASADGNGDSSWTLAKLHEADCIDLKPSPTLASGSPELMEDAISTEAQHLLVSNGHLPKACDSSPESVPLKGQITGKRRGPLLLAPRS

SEQ ID NO: 99 - DNA, 142976 bp, Homo sapiens
  misc_feature (1)...(142976): n = A,T,C or G
aaatctacctcaatcagtccttcagtcaacctagaggtttcatgtctactgcattcattccgcatatctgtcctgagcctttctcatgccaggtgctgtgagagaccctgaggggtagagtggaggtccctggcctcaggctccagccctactattagaaagagtcagatacaaaatgggctgacaaaatctaaaaataactggaaactgtgaaaggtgttatgaatacaaataaaagaatgaggtttaaaacaaattttgagaaggagctgggaatctactataataaagtatacgagagtgctggtttaaagtgtgagttctgggccaggtgcagtggcttatgcctgtaattccagcactttgggaggctgaggctggaagatcgcatgagctcaggagttcgagaccagcctggctaacatggagaaaccatgttgctactaaaaatacaaaaacttagctgggcatggtggcacacacctgtagtccagctactcgggaggctgagatgggaggattgcttgagcctgggaggtggagtttgcagtgggctgacattgcaccactgcactccaacctgggatacagagcaagaccctgtctcaataataataacaataataataataaagtgtgagctctggagtctaatttcctagctgtgtgatcttcagcagattacttccttctgcacctcagtgttctattttatagaaagaaaagattttaatagttctgcctcatagggctgtagggaggatcaaatgagttgatgcatttgaaccactcaagttattccctggtgcatactgtagtaggttctcatatagcttagctatacggcatgcaaaaggttctaagtgtgcatttagaaactagaattacaattagggtggccaatttgtcctgatttttccagaactttcctattttagcacttgaagtcccatgacctgggaaacccctgagttccaaacctgggtggttggtcactagaagtttctgacctggcagatctgatgatccggcaggcttcaccctgacctactgcactcaaagacacgaaatccctttgtcttccaatagtctgtggctctgtggcctgcttcctgtgagctgcttatagccttgactggaaaatgaggtttgcatacagaaaaccgttcattcatttgatcatgtattcgttcagtaatatgtattgaatgcctgctatttgtcaggcactgttctagatcctggggacctagcagtcaacaataccatcagattataaactctctgatggcagggacttagctaacttgattttgtaagcagcactgcttaacagtgatggcttctaagaaatgagagctggagaagagtgcaagacaatatataaggaggcagtaagctatgctttgcagaacttaaaggttagcacacagctaagagatataatccccaccactgtcacccgctaccaaagcatacccccaaactctgtatctcagtgtcagttttatggctaggattccattttaaaatattcatttatttgtcccatatgaaaaatggagtaaacacgttaagccttatctgatcttttcgggaagaatagatcttcaattatttcatcctctcaatcagttattttacctggatgccatggggttacataagagaacataccttttataaataagcagatcctctgcatttctctcatacctgtttctaagagaagtggaagggaacctgttttgtggcctgctgaagaaccagaatatttattatctaagaagttttgttcgatggcatcagccagttagcctgttgcgttcaatcaagggccctgacaaacacgtcaggaaggtcagctgataacactaatttttttgacactcctgatgatgggtttatttgattagattttattcctcccccaaaatccactcacgttttattgcatgctcacttagccacacttgttatctcagttatctatggctgcataacaagtcaccccaaaatttagtggcttaaaacaagagctttttttattggtcatgattttgcgggtcaggaatttgggaaagacccttggggatggcttagccctgctcatgtgatgttggcgaggctcatttgtgcagttgcatttagctggtctgtgctaaaaggtccaaaatgagttcactctcatgtctggggttatgatgctggctgttggctgggccacccagttttcttgcacgttgcctctctctctccatggtctcttctcctccagggcctctatttctaggagggcagcctggacttccttacatgacagctccaggtaggaagtgggtgagagacaaagctgccaggcccagaactggtaagagcgtcactctcactgcattctatcagtcagagcgaggcacaaggccaatccagatttaagagggagagaaaatagactttgcctcttgaggggagaaactgctagtggccgtcggcagacaattattctatacagctgccttctccaaatagtaaccagtcaaggcacttcaaataagaaagagttgcggaaaagacaaagacttttctttgatttatagcatctaaatccaagaggagtgtcaagctcccccagggaaataaggatatttaaatgattatctaaagaatgtagctcatggataagaatgacagtgaaaagcatataatatgtgtctgtctgtaggtttataataaatttgaaatgtgtcataaacccaactgtccttttggaaacaaatataacaggctataaaattcgcaaatgctttttattagtctgaatgcatggtgaaggaaaagagaattgaatggcacgagaggattttaccaaaatctcatgggcagcagatgttttgcatgcgcttcaatttaggtgcaataatgtcagccacatgcttgtctttatttttgaaattactttttttttttttttttgagacagaatctcactttgtcaccaaggctggagtgtaatagtgtgatctcagctcactgctacctctgcctccctggttcaagcgattctcctgcctcagcctcccgagtagatgggactacaggcgcatgccaccatgcccggctaatttttgtatttttagtacagacagggtttcaccatgttggccaagctggtctcgaactcctgacctcaggtgatccgcccaccttggcctcccaaaatgctgggattacaggcatgagccactgtgcccagccttaaggttcacatttctgagaagctccaggtaatattgatgtggtcagcacacatatgtgaatagcaagcatgtataaaataaaatgggggaggaaagaggcttgataattctccctccttgcagggcaggcaggactcactcagcaaatattgtctctgtgcctaccatgtgcctggaattgtgttagacaacaggaataccaagaagggatttagactcagtcttttaacttacttttaacttactgagctactagactggaggaagagataaacaggaaaaataatcaaaagtgagaatgataagagagggagtgtgattggggtaggttagctgtgagcctcttcctgctcagcacctaattagggtataatgtgggcaaggggattgatttcagagtttcagtaacttcatatgtaagatgacaatctctaaggtatctcatagaattcttcagtgaaattaagccatgatgtgaaataatgcctagcacatagtaagtgatcagtaatgttaaccactgttgttatacaagtactgctgggtatggggggagagaaaagtctagatatttatcctttaaaattttaacttattaatcatagagggaactttgaaaatctattagtaaatatgaaaaagtaaagaaatcacatccattctcatggcatccctgagaaagaagctccatgatacacttcgtaagacattcactgaatataaaatatgtgtgctggtggttgtgatgaaacttgtgatttaagattctatttattcctgatgccgcgtgaccttgggacaatcactgaacctcagctttctcatctgtaaagtgggaacaataacaattttcatattcaaagtttaggaggctcaaatgtcaaaatagatctttggggttttttgtttctttgtttttgagacagggtcttgctctgtcacccaggctggaatgcagtggctcgatctcggctcaccgcaacctctgcctcctgggctcaggtgatcctcctgcctcagactcctgagtagctgggactacaggcatgcaccaccatgcccagctaatatttttctttttagtagagaagggatttcaccatgttggtcaggcttgtctcgaactcctgacttcaagtgatccacccatcttggcctttcaaagtgctgggattacaggaattgagccaccgtgcccagcccaaaatagatctttggtgtccacagaactggtttggaatcttggccctgtcacttattagcttgtgtggccttaaacgtttttcttagctcctacctcactgaaaaaagtacataaagcactcaacaacatgaaagacatataaaaagtgctccgtaaatgatagctgttgttatgatgtgacagtgctttgaaaaatgtaaggtatatgacttcataagattattattatgttatgatcaatgtgctgttctttatatacattgcagtgttagttctgagtggttggcagtgaggcataaactttgaatcctccctgcactcgccctcatgtacttctcggagtgacatttgcaaaggcagcagattgggagtgagaggtgcggtctctggtgatgatgtaattagtccatcccatcatcatcaccgtcagaggtaagggactgcctcctacaatgaccattactccagaatctcaatctcagaattatgaaatgctcatacctttgacatattttttttcatcctttcagtgaaccagtaaacatttcacattcacaaggcaaggacaagtgtcaaggttctagtttgtgttagaaagtggactctaaaggtttttggcccctgtcgatggtgctctgtggaggagggcagatcctgtgaagggtcacagctgagctgcaggcaacaaccattcttgctgtggaactgcagcagctgcagcttggcactgtctgggcattaaccaatattccaatagccagagattgcacaagaaaactacctccaccaaaggcaaatgttggaatgggggatggggagatctcaaaatctttctctttttatattctattcccagactcattagcctcctctcttaccttctccacccatccatctccttgacaagattattgcgacgaaggagttaatgagtacacagttttattttccttggaagagagatagaaaacaggctcaaagcagggctgtcatcaccctgcaagtcttcaggggtttcatagctaattattaaccctttgtcacattcctggacaagaaactttcctgctgaaacaacctgctaagattttccatctacattatacatatgggctctcagtttttcagagttaacaaatcaataacaccttgaaaacaatgagatgtaaacagtttataatgcccctttggtcctttatcaaaatgatccttctttactcactcagcacccaggtcaagtaccattatccttgttttctatttttcttttatatatatattttttttgagatggagttttgctcttgtcacccaggctggagtgcaatggtgcgatctcgactcactgcaacctccgcctcccgggttcaagcgattctcctgccttagcctcccaagtagctgggactataggtgtgtgccaccatacccggctaatttttgtatttttagtagagatgaggtttcaccatgttggccaggctggtcttgaactcctgatctcaggtgatccccccacctcggcctcccaaagtgctgggatcacaggcgtgagccaccgtgcccagccccttgttttctatttgagaaaactgaggctccaagacagaaaatgactggtcaaaggtttcacccataacaaggcctggctggaacccagctctcctgaatggtgacctggtgcttttttaatgtattgaacacagtgtaaaatctcacctaacattaagaaagcccctctgaatctcagcattctttaaaaccactaaagaccaccacctagaactatagcaaactggcacaaattcagtccccaggaagttgtgttaaaaaaaaaaattcctatggttaaccttctttcttgttattttgttatttgcttctctccccaatagatttcaggctatttagattttgggttcctctctcaagcatgattaacttaggatgattaactgctagggcttctggagtcaagagagacctgcagagattctcactggggtttgattccatgctatccctggggtagatgaaaatgaactggaaaatctaaaatccccggatgactcatttaaggaataagcatttagaaagatcaaagttgcagtgtgaggaaaataaggacctacagcacccaaatcaactgttgctctgtgctgaatggaccaagacttgcacttttatgagcagggacatagattcccttagacatttgctgttgttgttgttgagatctccttcatcttaggtggtggctgcagatgaattcccccctgagctggatatcactgctctccaagttcacactctcattgcaatcacaagcaggttgctagtatgtgggcaaacttccatacatggtatggggagcagacatgacttcatgctttgctgtagacgagaggaactgccaaggcttaggcgccctgtccccccaagtgtgccccggctttggaatccttttctctggctgcatggtaaccagaccacaagggatgctttagatttgtgggcactccctcaccttgcagattcttaaattctatcctccagaaaactaagattccaaaaaggcatctcacaagtacacccatacacatttgaaaaaacattttacaagaattacccacttttatagtactagaaatgagacaaacctgaaagataattttaggtcagcatctcaagtagttcaatcagttcaattcattttttgctgcatatgctgttttattgtggggtggggacagggaggatctgacagtttcatttcaggaaacggctgtgggtattctgcatcaaattactgttttgtgttctttgtgtaaaacttaaacactgactgagaggacttcataaatttagggtctttttaattccattcccactgcttattattattatatttaccaaaagggatagaacaaaaggacatatttcttctcgtccagatggaaggtgtatgtttatttggattacatatgaaacataaaagctggttaaagctctgggtgggatgggtcaggtgcagcatttttctgataatatttcttgggaattagatttgaattgatttacccacatatttgagcactgctttgggcatcactgctgagatcatgcaaaattaaacaagaaaaaaatgaggcgcaatgaattcagaaggggaagaaggaaaaaggggaggaagggataggaagatcacattttggctaaagaaaagaggtgatcttatggctgagggaaagtttaacacatttagtgcatctcaattaaagcaaacctcttagattgtgtcgaaaatggaataaaccctttaattttttttttttttttgccttttttccctaaggttcaacttctcctctttacctcccaccccaccccacttccataaaacacaactcagatttaatgttctggagcaaatgtttttcaacagacttgacctgcttaatcttcctgacaatgtgcgcagttatgttagtaatttgcatactcttgggaagggatatgagacactagcaaaccaaaacgcccagagggcagctatatgttacagtggtaatctttttctttttttctcaatgtgtgtatgtctgcttaatgttaccacgtactatcgtaacacactactactatggtctgatctttaagagcaaaagttagaagctttgttaactattatttctcctttaactctgtctcttacgaatacacaatggcttcttgaaaattatcttaaaaagactctgattaaaacaaaaacccaatgacaacaacaaagcaacccctttatcaaaggctgcagcatttctagaagtacccttcaactcactagctgggaaggagagtgcacttttttttttttttgagacggagtttcgctctgtcacccaggctggaattcagtgacaattcagtgacaagtctctgctcattgcagcctccgcctccggggttcaagcagctctcctgtcccagcctcccgtagctggtattacaggtgtgcaccaccacacctgcctaatttttttatttttcatttttagtacagacggggttttaccatgttggccaggctggtctcgaattcctgacctcaggtgatccgcccgccttggcctgccaaactgctgggattacaggcgtgagccaccactcctggccgagggtgcacctttgagactaggtttctgcagcacacattcattttagtaatcaaggacatattgctggatttaggacgtgaagaacaagtcaggagcagatgctccaggctgctcgaggaggaaggggaccacgcctaatgaaataaccaaggatgtcccagtcaggaagaaatgtgttaagttttaaacctctgtcttcgcttttggaaggaacctggaaaacggacgcgggtttgcttctaatctgcagtcctgcttgcagcctgaggaggacgtaaaaagccttggggccagacagccccaaaacgggggcgttttaccctcttaactttctctccccttcttgacgcagagggcgtatcttcacgcctcctttccccagcccgcgttcccgttctccaacaacaacctgcgtgtctcctttaagaggcgggggccgtccctccctttctcctcccagtctcccgcccttcacaccttgggtgggaaaagagtgtgggggcggggtagccggtgaagcgggaggggcgggatcacagcgagcgctccaatggccctcgaggctggccacggtggactccggcagccaatgagcagcaggcggggaggcgtggcggggcgctgttgcaaagcatccaacgtgggccagcaggcggccgcggagcgcggagcctagggggtgtgtgcgggcgagcggccgggggcggggcttgggggaccggccggggctgggccgcggggaggcgaacagcaagcggctgattgttcggctgcgaggtcggcgggactcttgctgcgcggaggagccgtgcggaacccgaggctgcgcgcgcgcgcgcgctctctggccgcggcgtggggacagcgaggcgcactggggcctcccagcgcggggccggccgcgccgtccagcccgaggtctacggctttgcgctccgagcccagaggaagatgcctgccggcaccgagctcgggctgcggggctgaacgcctgtcttccaggcgcagcggcagcactgccctcggccggtgtcggtagcggcactcggcgtgccccgggcggacgaagagcgcaggctgggtacaccttgcccgaatcggcggagttcgcagctagcgagggcgggccggccggcccggatgggcgcggggtttgcggcccccgccgggtgctccggagcggcccgggcaccgggggcacgctgagtgccggagccgcggccgcagagagaacttggggcgggggccatgccccggtgcggagtctagagccgagcggagcgccccgcgggcccgcccgcgtctgcggccgttcgggtcctcacagtccccgcgcccggagttcgcagcgcgctccagacaagatggcgcggccggtccggggagggctcggggccccgcgccgctcgccttgccttctccttctctggctggttttggttcggctggagccggtgaccgccgcggccggcccgcgggcgccctgcgcggccgcctgcacttgcgctggggactcgctggactgcggtgggcgcgggctggctgcgttgcccggggacctgccctcctggacgcggagcctgtgagtgccgccctttccgccctctctgcgccccggggctctgtcacttggggatggagcggcgggggttcgtactcagggagggggtgcggactgggttgtgtgtgtggagttgtgcgtgcttgtgcgtgttggaagactgtcaggttggagtggcggaagggagattctgcgtggaggtccgggggagtaggcgtgcgagagagcctggagaagaagagcgtgcctcgtggggtctggagacgagcgagcgtgggtcgtagagatttgggggttagccagcacgcgtcgtgcgggccatctgggggtgagtgagtgggagtctggagctgagtgtgtttgcgggtgggtgggtgggaaacgtctggagaagagtgtgaagaagtctgtgggggtatgtgggtgcgtttccttttcctctcctgtaatccaactatttggtgtctgagctccttggtcttccagtgggtaatgaatgaaggtgactgttgggtccagtctttcgtttacattatttattagttgatagtgtgtgtagccgtctcctgatccccgaagaccgtggtggcctgacttgcctctctgtgcggggcagaaggcagtcttcccccgaggacccctgagttagagggctttgacagttcctggcgacctgtgagtgctgggagtttgtccttttacgcctgtttggcattttacggaactgtgttccagacccttcctgtgtgttccctggggccccattgggcttgatgatccagtggggtggggcccaccctcaagactctctcctccataaatggtgcaaatgagttttggagaagtgctgcttcaggagagggtgccaggggcttggctgatttaagctgtttgtttcacccgaaagaggttcttttctgtgctgtcaggatgtgggcttattaggacttagtgggacacttcttacaggagatttgacaggaaaaaaaaggcattagacttctgtaaacatggtagaatagaatagtcttcttttacttctaacaaatctggtgcatgagtcaaatcccgttcagttatgggtaattagcatctctgtagaaccattagtacctttccagaaaaggcctagcttaaatagtccgcatttcggttgaataattggacatttttcctagaacataggaaaggcacagcagtaaccttaggcatgactatggctgttttaaaaagagaaaactggtgtcacaagttgtaaccagcacctgtggcttgatcgaagaaaatgtggcctgtgttctgactaccgtgaagggaagaaaagttaattccttttaaatgtaaagatcctgtacctctcaaaatggggcacgaatctttaacttggccccagacactgctccatgaacaagtactacagagttctgaagacaaccaggaaccctttagttacagttaggttttcaatatctacttcttctgtggaatttactgagttagtgaaaatcagtggtcgtagggtggaggcagagcttttgtgaagtactgggagatagagcccagtattgtccttaggtagtctcttatttagtctggggtattgtgatttttcccttacatacggtagtttttttttttttttttaaatagaatcatgtgggcaaaatcagattaacttcttaagtgttcacctgttggaagagtgactcccaatgccatgtgtcagtggcattgtggggaaagcacttagttccacagaagtaacttcccagagagggcagggtgtcctcttatttgcactttcctatggtcacaagatccactttgccttgccctttaatttttggagcaaaacatactggttatttctttaggctttctgttgcctaggagtgacatttcacatggcataaataccttcaaaattgaagtccttctcttttactcacacatttgatgatcgagaaataccaaagtgggtattttgagcatcagtagactttagtatactgattatggtgttgactgattcgattttaagatatgagcagcatgatttctggttagtatgtagcaacacagtatgcagtgcaaaatggctatcctttgaaaaatatttgtgaagttttcttatttctgattaaggacaaatcaagcaaatgtgttctttttttctagacttcagacttctgaatttaaatcattagtctccgtgagtcttattctggaatttccataagagtatttatatggtttgtattcctggctaagattcagcaagactttaggggagaaagtgtctgtatatgatataatgaaatatcttgtagtttcaccaagtttacacgctctaagcccacgttgtctagaaaatgctttgagctagtttataaacccatgaactggatttactgcagctagttcaaacaacttcaggctgtgggtttgagatagcagaggacctgtggctttatgggaccttttttttttttttttttttttttgtaaacagtgcgtctgatgtggaagttgcttctaggcctgatataagaaaaataaaacttttaaatagtgaatgtaaatgcagtgtgaatagaagaaacagaatggataatgataatcggttcatttttggggcctgaggataacttttcagcacaataacttacagttgtagtagtcaagccataatttaagtctcccagcccattacgtaggtgagattggcatggtccaactagcacattcataaatagcaccaagccactgccaagccttattccaacttcccagaacctgagaagaagttgaacttcttagaactcagatatttgctttctttgaaattatttttgagagcatggcttcagaagctatttaagaagtattaaatacagtttaccttagactcttacctgtgccgtaaatttcagcagtgtttagtcacaaaatgttgctagtttaaatgtcctgagagctgaatggtagcccattgggattgggattaggattaggaaggcaggcctagaggaagaacaaaccctgatttttgttctcagtgtggagtgaagatgacagagcattctaaagcaaggatattcacaaaagtgtataccaagtgtggttatcctaagccacattaagatgagtttattgattttgatctctttgtactatgtgtttgcaataccagatcagttagcttaaatctaaccttgccagttttggcaaagaagtggtacttatgattaccttagaaaataaacaccaactgtggttgccattgtggttgggaagcaaagagggcctttgtctttcaaattttacagctgtgctggaaggcccaggtgtgcagggtgttgtgaattaagggtttggaaaatactttccatcctgtttatgcaaattaagtttaaagtgcagatcaccaaattgttctggaacctaaactgagattcatgttttttttttaaagtagattgttgtatggatggtcctgaaatatttccttctccatatcacttaaactcaacagactttgaaacaaaagtcttccgatttgtgggacagggaagaacctgggttgtttggaatagggagcattttaaacacaggttaattgccaagaatacagtctgaaaggtgcaagtgctcttagagtttcagggaactttagcttgagctcagagtccttttcttttgcaacaagtgtcttccctcttgttgggggataacttgtctgttgatagctctctgacaactttttttgagtaaggtgagatttctggcaaataatattggttgtcgtgagaaaaaggcacactgtttaagtcttgctgatatgaaattgtggccgtaatatctattctttgagtactgctaaagtaggaagtgtccagagattcccagcgccccatgtaaattaactgtgtattggcacacaatgtccctcttgcctttaggacatgtcagaactgttcctgccccgcttttcaagggactgttttaaaaagtagtgtattgtctctttgcataattatatttggttactagattttacagactttggacttttgaacatattatcagcagtaattctcggaaccatcttcagaaagatgaagaaaaattaagtgtagtgtgatgagagctggttcctagtggatgtcctcatgtcccatctccccagctctgcaccgttagctgaaagctttcctccctccagtgttaattactttgcctgggttctccctgcagcttccctgagtccattgggacggcctctggctgacctttctctccctcagacaccatgatcacaatgaaagggcctctcccgcttctgcaggggtgtctccttggtgcaaagtcttcagcctcctctctttcagggtggacaggaatgcaggagagagcactggggttttgtgtgacttaacaatgcacctggcccagtgctgtgcacctgctaaagccctgaaggtctgttagataggaaggctgggtggaggttgtttaaaatagcctatagttatttaaaaagtggcatgcacaggagagggaaatctagaagagggattcattgaattgaaagttgttatatgcagtaaaggatgttggttgtatcagagtctttctttcttcttttcctcgtttgtttaaaacataaaagggattcctctgacctaccccataggtagaaggactttaagtttcacgagcaagcctaactttcaattccttttgaatgagctatgtgacatttactcactgggtacgttccccctcctcagtgactgcaatttgaaaccctgggggtcttttaaaagcgaacagaactctgggccgtgttaatattcagagctgtttacaatggatgcagtttcaaaggctgatggcattgtcttgagacaggagggaggacgggtggaggaaaaattcccaggcagggaagggcaaatatctaaaaatctccagtgtttaccagcctgtgggaaatttagggaccgttactgttattttttatgacttaagcatgacactgagccactagggttcattctatctacctcatggcttcagttcttgtatgtcagttatgtggttatcttgtgcttttgtttcaagttaaagtgtggaaattggtaagaaactcagatcttatctcctctggaaagaaatagagcactttgaagaccagtggttaacatttttataatagtttacctctgggacctgcatttatgttttgctcaaagaatttgatatagctgcacagtttagaagagcagtcccgactgaccaattaattgtccaattatgactaggactgagaagttttttgctgaaatacttgatacatgaccattcttattaagcaaaatgaatggatcaataaagattgcagaaaaaatttgcagtttattgatggtctaatttctagttgaaagtcggcaatttgtgtctcttttttgtagggggtggtgggtatgcttgtgaacttttcttatacaaaggctttttgctttatatgttcttatattcttatattttgtataatttgttatcaatggtttttacctaagtactttatgcatagtcttttgaaacacaagttataacttcaatctgttcatagaagtccttcagttttttaagctgtttctccatttcactgggttttatacttttcatttcctgcctttagttctttatatcttctaaatgggcatttgctacccagctgtctcctggtctccatttgggttattgactgggggagagaatgggctagggacaaagctttcctcacctttactgtgttaaatatgcaggggctcttgccgctggtggtcacacccaactcacactcgtcattaaggagtggcggtgaaggggttgaaagttaattctgtggtccatccctggcacctccagtctacagctacatgtgtgattttgggcaaacctcttcatgtctaaaaagacagaaaaatgctctatcttatagaagctgtgaggacaaagttagatgatgcctatatttagctaggttcctcaacttgggtccatctactttatgatgattctggagcacaatttgaaggttaaaggcctcagtagctccaatttattatcctgtctcacagccagtctctccaagccagattccttccttcttcccttccccttccctcccccactcccttcccttccctctttctctttttctctttcttttctttttctttctttctttctctgttttctttttcttttttctttctctcctcccttctttctttttttccttctttccctccctccctcccttcgtctttcttcctttctttctctttctctctctctctcttttttttctttctttcctttctttctttcttttctttctttcgacagggtttcactctgttgcccacgctggagtgcagtggtgcaatcaagactcactgcagcctcagcctcgtgggctcaagcagtcctcccatctcagttgcctgagtagctgagactagaaggctcatgctaccacacccagcttccaagccagattgctggtgacagaggctttcctgggaaatgtttacctttctgctgtgaaggagtcttttggaatgggaagatggcagccttctcctgtgagttttggtgatatgtatgaagcggccttctcccatggatttttggtgatatgtatgaagtgccacaagtgaacctcatgtacccttggaaatcttagccaaacaggcaggaagctatgaacagttgcaacagattatataattagcaaaaattattgaggtattttataaatctattccagttgtacaaatagttatgtctgtttaccactatccttttggaagggaggcaggtatgggaaggtggcagggaagtgagaggcccttaaactaaccattttatcctattatttcccagggtttcattgaaactgagccctaccaaggtgcaagtagcacctctcagtcaatagcttggaaaaatgcaggtgtgctcttccaaacagagttaagttacagactttagggctaactgaatcctcactgtacccgcttctctttggaaaaccttgagggaggagggaggagggaggacaggagacaattgtggagttgtatgcaaagaacatttttcatttgttttggtctgtttggaattgcatagtaactttgtaggggacacaggcggggaacacagggtcatttgaggaatctggcaaggatgccacctgaaaagctgtttactgtttgctatcactccttgtgcacctgtacctgagttccttccccagtgaatggccatgattcacagccttgcccacgtgaacggccacgattgttttcgtctttattactatttaatctagcataaccggtaaggcccattgtgcgaacaaccaatctgttcatttctgcaagtcctaatacattttggtttccttatgaaccaggatgcaggttctaattactgcttgttcagtttgttttggcaaaaggtgacatttagagggtttaaagaaagcatggcctctttttaagtgttttgcgttgattagtttttgaacttttgtggtcaaaagttctaatctcttatcttttatgatctgcattctcaagatctcacattattgggaagaaaatgaaggaaatgagtgaaggtctctcttacaagcagaattagctggactttgagaaacacgatgaacgtaatgcagggtttttcttcttttttttagctgattagaaaaaaaacaactcacaactttattttctaagactcctttatgcagcatttaacagcttccccctccctgttttgctccttccaccagtttataatttgccattgaaatattttactgcttatcttggtcaaagcatacattgcactgaacttcttttcttccggattacctacttgatgatagcctgttaaatgcaatgagaaggattgaacacttctgaactggaggatagataatcttgctgttgtttcaaatcttgtagttccagtgctcttttgtttgaaagcatttgtctctcaagcattagcactttgggctggataacaagaaattaacaagctgggctctgcttagagaaaacttacaactgattagaaagtaagctgttgcaggtacagcttctttttcttgagagatgatctgaaatacatagcttttagaaaaaattttgaattaagggaacagttgatatgcaggcaggtagtttaaataaactaactcacttctgttgctctggagtgttttttcttaccttttgaatatggagaaaggtaaatatctacacaagtggacagaataatgtaatgaactctaggtatctgtcacccatcttcaacaatcatcagctgtcttatttgatctatttcccaatatgctgctgcccttccatgttatttatttattttttctttggaaataaatcaaaggcatatcattttatctgcaaatgtataggttttttttaagttaacagctttattgagatataatttatataccatactatttactgtagggtggttttaagaaattggaagttttgaaaaaattgacattcattttaactgtgtttttccaaagggcgttttggtaagctatatatttacagaatgtttattgggcacattctgtgtgcaccctagtttatatgttctcaaaatacagattttttttcttttgtaggaggtgtttagcaagctcttttgtgctagtcctctgccagaatgtgcaattctgattaaccttccactttctccacatagctcttacttgggaggtttctaccaagctattaattgttgattaaaatccattagtgaacaaacataattagaaatggaatagatcatttaaaaagtgatgtctcagatactgttgtttagtagagggataattagccgttggttgtagttaagtcatgagtctgaattgagttaactattgtttactttgtaaggcctgaccctccagctgtggctacttgaggctgctttaaatagagttagaggcagcctgtaagaaaaatcttcaaaaagcaaagaactaggttcctggaaccctctgtgcttgatttaaacttcacacagatttgaaaatgtgttctccaagtagctgctgaatggtttgttttattttataaaagtccatagtttaatttctcctcagtccggtactttgttggtgagggggcttctttagaatggattttttgctagctgcagcttcatttaggaatctgagtgggaattactagtcctccaaattccattcactttatcctagtttttggaatgacttccatcttctatctgtgaaaatcaaattccaggtagattatggagtgttcggtggccttaaaagctgtccaacatggtcaggttaaactggtggatctgtgaagcttaattaaatttatatgataaccgattatacaccatttacagtgggttctctgtttagaaaagtggaagcacgctccaatgcatttttttttttaaattatggggcagaaaagcttagtattgagaggttctatgaaattaagtgctgttctgcaaattaggagaacaccattctttcatctggttttagcagtgtggtggtaccttgacccagcatcatgcctccgtcttagttttcgttttatttttaattaagaagaatttttctctgtgtctgtggtttcctccctccacctgggctggtgtgagtttctggcacacaagctcccagtgcttgcaaaacttataaacagtcagaagagctcgttgcttccaggaagtgaattgttgatgcaatgaagtgatggatgcagaggctgcagctcgaagggagcagggtttccttccatcttggaggaggggagatccagaaaacaagctgacatgccctgtagttattaagatctgcctcatcccaaattcctctgattgttttctcagatttggagtctgtgtaggactctttgctttgggtggtttggccttatccagggctatgctttacccaatggaaaaatcagagactcttctatggagatttttgggttctttcacaaggtcatttgaaacaatacttagaaatgagtaaattatattcatttcattactatcctaaaataaagattggctgaccttattatttacttgggagaaactttatgtgaagtcgtggtgctcagaatgtctttctggacagaaaggagaccacgttttcatggagtttcttaaaggggtgcttgcccaaagaggcataaaaatgattcacctgagaggaaaaaattaattttcttaaagtcatgaaagtgaggatgtggtagaatgggaaactagctcatggctgggcctcaggagacgttggggtttcgtcccagctctgccactgattggcagcataaccttgggctagtcacttcatttcctgtctgtaaagggatgtataatttctaagacccctcatttttaggttcatgattctattctaattgaagcaaaaagggagtaaacttatatttcattggatggtaagaattaaattgatctgtatctaggatacttaaacattctctctctctctgtgtgtgtgttagacacacacacacacacacacacacacatacacacaaagggtcccactctgtcacccaggttggagtgcagtggcgcaatcatggctcactatagccgtgacctcccaggctcaagtgatcctcctacctcagtctactgagtagctaggactacaggcatgtgccaccacacctggctagtttttattttttgtaaagatgggatcttgctgtgttgcccagactggtcttgatctcctgggctcaagtgatcctcctgccttggcctcccaaagtgctggggttacagatgtgagctaccatgctaggccaatgtttgctacttctgagtgaaattctcagatggatgccataagcagcaaagagaaaaaagggtatgtgcatgcagagtctcaatgagggacccttttgtgagccttgagatattattgaggaggagtgaatactccacaaagaaagtggtgctttccttcatttttacctccttttcccctctggcccaaagaaaactgtggaggctggtacagatccactttcgatctttgatttagaattttaagaacttaggtaaaaatttaaagaaaaaaaaccaggaaaataaattacaggcatgttttcccaaagggtcctttctcagggccactgcaggcagcatctttctcaggcagtccttcagtgaatacttgccataagtgaagttgtaaatgatgctgagaaactgcctttaaggactggatgggccacctgtcacattctatagtcatggccacaggaagggcagctactcactgcactgcctgttctttctgggccagcttgccatcccttttaccagggagatctttcgtgtatccctttcaagatagaaactcagccaattaacatgtacagcctagtggcttcctttttcttttttgaggcagagtctcactctgtcgcccaggttggcgtgcagtggtgtgatctcagctgactgcaacctctgccttcctggctcaagtgattctcttgcctcagcctcccaaagagctgggattacaggcgcctgccaccaagccaggctaatttttttttttttgtttttttttagtagagacagggttttaccatgttggccaggctggttttgaactcatgactgacctcaagtgatccatccacctcagcgtcccaaagtgctaggattacagatgtgagccaccacgcccggctgtggctttttctaattttgaagtctgactctgtttttggccaaattcatattaaatttacccatctacctaggtttgcattggttacctcttagttacactgtttttgaaaatcttgaaaattatgacagtaattggactccttaaaatacttttcatggagaatctagaagcttttattttctttgttctggatgtccacttttcttcgacgtggaatttgttagtgccttcagtggaaattcttgggcttttcttttccttccactcattctttatcgtgtaaattttcataaaacgaaacttccggatttaaaatttatttttatttttattattgttttccggaacaaattcttggaatttggagttttgtttggggatacaactaaaatgcaatgaagttggaggaacagttagtggtctggaacttcttgacagaagtttaacaacaattagggactactttaggaatagagtgtccaaaaaactagactttacaaaaaaaattctccctttaagaaccaaagatgacctttttccattgtgctttctgagctcaaaacaggccaaatgatgttcccacccttcttcgagcctcgtgtgtcagtgtcacacactctccctgttactcacttggtctcgttctggtgaatttattgttgacatctcgtcctttcccggaggaatctctgagtctatctgattaggtaactcttcacacatccctgtatgtgtgtatgtgtgtgtgtgtgtttctctccacttagacttgaaagcagcagggatcattcaatttcatgtacctaggagtcccttgataattatttgtttattgccttaccactttgtcttggagcttggtacattctttcagggcagaacggatcccccagtttcattgtttctctaaggggttctgaggtttacccctgaagtgtaatttttcctgattggcctgtgtggaggacttcataggagtgtttttagaatttaaatatcaggagtaaaaggccattttctttgtgctgagggtctgttttcccctctggagccagcggctaaatgcagaggctttcttcaattgctgttgcttcttgcagtgtggcccctcaatgagaagtcatagcttgtggtttgtctgattttatatgtcagaacttttagagagaatatttgacctaaaacaaaaattatggatagtcctctcttcctttcccatttctccttattttctactttctgcttgagaaccacttcaaagaatcagatgtgttggtgccagacgccgtggagttattgttagaagaatttggaaatataattgaaagcaaactttgttgagcaaagcagatctaggcaagtttttactttgagggcgaagggaattccaagtttttcctctatttggagctgatgtctcagaacacttgttctgtgagatgaatcatctgtgaattctacatctgggagttatatattgggaaatggcattctttttaaatgtagaagaaacacaaaagcgtaaagttacagtgtagttggaaaattctagtcagagtttaaaatactagcattgaggtgaaattggcagagtgattggacgtgagtctgtgatacctaaaatagacatgtccatacatggaaaacaatacgatagccacacttacttattgtgacccttttcgtttgttttgagacatttttaaaaagtcataaacatcagctattcagaatcattagttgagtcgattgtgacttgagaatcagaatttaagcgtttgtcttgagctctttaagttcaggtgccttgctaaccagtgaaaagcccagagcagtgcagtatttcagggtcttcaggggaagataatgttgtgtccttgtcttctcagagtcctgcattccaggcatctggttatgaggggccatggttgtggggatgcagcagctgtgcggttcatgacgcacggtggttaagaggcagctctggggcctggctgcctgggtgaccttggcaatttactccacttcagtttccttttctgtaaaatggggataattgtagtgccgacttccttaagcttgttataaggaaaaaaatgaaatatttaacacagggcctaacacacaagcagaagcttgaggaagggtagctataatgttattattataactgtcgcaataatagtgtacctttctgcagcaggatatatctgtgttaactgatcatcaccatcttaactctatgaaaaatattgtctctgttgtatacatgaggcccagagtagttgaatgacttgtttagagtctagcacttgccagttagaattcagacctgcgtgtacatgtttagaagaaaatacggtaagactagcactgccttctttctggcctccctttgacgtctctgaattcctggaggccgattggtctttggtggcttgaagcacctagtgtagttctggctgtacagctggtgctctatacatggtgtcttgaatgtgatcttgaagagcgtgtttctttgttggtaggcgtgtgtgtcagatccatttttggtttgcctgtttggtaaagggggtggtaacatgcacatatgttttgccatctgttgtttattgtttctgttaggttgtggtttgtgttcctgttccatgttcctttggtttctggagcaactgcgaatattatatgcttggggatcaaaaaaagtaaactatttataaacagtaaagtatccttgggtttggaaagtgtttttctcaaatgcgtgtatatttgttggctttatgatcatctcactgatgaatcgttagataatttgcagactgagacacatctaaaagatgggcgagtcatggtccagccttgtgtaaccagctcacagacagccttggtgataaggccctggtgttaacgctgacccgagtggtgtatttttaactcaagaacatataaacagtttagcctgctgatggagtttatgcaccgcctgaaatctttggcatgccttggatttgtggctctgtaagatgtacgtagtcctgggagagtgctgtggccgccagtgacccactgcccccacccttcattcaaaagaaaaggaatgtagcagcaagatggaaggagaaaggtggaatttatcaataattttgtatgataatttttccttttttttttttttttgagagggtcttaatctgtcacccaggttggagtacagtggtgtgatcttgactcactgcaacctttgcctcacaggttcaagcaattttcccacctcagcctcctgagcagctgaggctacaggtgtgcaccaccatgcctggctaatttttgtattttttgggggtagagacagggtttcatcatgttgcctaggctggtctcgaacacctgggctcaagcaatcgctggcctcggcctcccaaaatgctgggattacaggtgtgagccaccatgcctagcctgtagtataaattttatcttaaattttttttgtcattactatttcactttgttatgcagactttagagggaggagagagctttttactcacatctgtttgcaaccccttgcccccagctgtaggggtctttgcagagttgcaaattggagcacatgaatcccattgtttaaagctgttactgtccacctgcccctcatcgcgcttcttacctggccccacctgtcccagccaccacgtggggctttttaaaaagactttttaaataccaccatgtcccatgtccctcacccaccatttcctctgtctggagaatgggtcttccctcttcgccttgcagatttctgttcatctgtcttaaacgtttctccccatagaaaccatggctgacgttccctttaagttagattcccatcgtgaggattctgcagtgctatgtatagaagttttgtgtgaatgtttgattcgtttctgactaccccattagtctgtaagctccctgaatgcagtgactggctttgtttccaatccaccattgtattcccagaatctagtgtgaagcctgtgacacattaaatgctcgtgacagataccagtgtagatagagatagtggcattcattctgtagagtcctgtatgtcctgtggaaatacctctgccagatagaataattcagacctcccaggcttcatctgtgtatttcctgaatataccttgcttgtttagtagcttcctatacccctcaccaccctccaccaaagtctcttaagtgttgagaaacttagaagaatggaaagaaagaagaaacaaatagaaccgaagttgaaaagatgacaggctgtttacctgccacatttagaattggcggtctttttggtctctctgaattttggaaaagtcccatatgcaagaattgtcactgaagtggctttgtagttaaagcagtgcatgtgaactgtccccacatgaggtcctcgggcgcctcgtccctgctggattgctggtggctgtccttggcaggtgggccaggctcaggcgctctcctctgtgttgcgtttggcgagggagcccgcggtgcccttcccagctgttgacatggtctctcatctgctcttttgctggagccgcgttttggagcctgcttttccagagttgacactgcaggggagggtggcttcttccatagaccgaggctgtctagacacccttccccttgtggttattctgctcagtttatgctgagccctcgccaggcagctggtttcggttgcttgagctcttactttgctcaggcctctgctttgacaaaaaggatgaccaggccaaggtagcttttctccctctttgctgctggcagagagaaagactgctttccttgaccagagggagctgtgagaacactaaggacaggttaccctgccctctgtggacccagcccaagtaactatgtaaattgatagaagcttctatggcaggagacttcaggcagatacatttctaaatctgggcctttttagcttggacttcagatgtgagacattggcccccacccccatcctcagacacgcaggatctccatccatggcagagagagcactgcgaacccagctggcagagctcctctctgggcagtctcccaggcatgctagcaaggggcaatgggaagctgtgttctccctgatgagctcagcctcacatgtttcttttaatggctatcgagatcttggactgtgatgctgtagggaagccttttgtccccagtgagctggaatagtctaggcagattactgtcttggtggccttacggggggtgctggagggggtgctattgatctgttagcctagttactatgtctttattacttttgattttctggtgacaaatgttaggcatttattgaataaagaagaaagtacaaaagaaaaaacaactgatttcattgttcggtgataaatattatcactggatagtgtataaatttccagtaatgtgtgaggctgaatacctatttcagttatgttttaaagactcaatatcttgaatattttccctgactttaagcagtttttaaaatgtgctttaatatttattgtataataaattattacacaacttacatgaaacttgtaaagtttctctgatattgggcatttaggctttttcctaagctttgatagacatccttatgcataaatgtttagccatttatttccttaggatgagttacccaattcagatagcgctggatatgcagattcttaatattttcggtaccactgcctctgagaaagaggctgccaacttacatgtgaacttgtgcttgtcccacaccctcacaaacattaaatgctgtttatttctgtaatcatgtaccagtttaatggatggaaattgcctcagattattttaatctgcatttctttggatgttgaggctgaagactttacacaggatactcccagatatttcctttttcagtttccttcctttgttgatgctcagcccagtacatcatctgctgtcctccactgtggtctttgggcttgagcacagtacatctctttggtactagggaagctgtgtttctgagagagcacaggtgtaattgcatagaaaactgtgctctcaacaggcatgtcacatgttttgactctgaaccaggacatctttgggttcttcttaaacagatgtggacgcgtgttgcggaggggactgttgcagtggctctgttgatcctgtactgctgcagccttctgcagagccagcctgcctgtgcccaggctgcccggtctgtggccagggtgcctggtacctacagctggtaggaatcagcgcagattagcgtggctgagaacctttcaggaacagcttccagcaaatggaaattattttaaaacaaatttatgtggtttttctgtcaaacctacttggagcataaacaaggttgaattgtaagctgcttcccttctgcaagcgagcccatgtttagaatgtggctttcagcaaagtaaacatggtctcgaaagtgagttgtcattgtatgcatgtgctttgaaaagtaaaagtagtgcactgaacgagcattctcatagataattgtgatagagttttagacatcccttctcgtttatttgtcttcctgccacaaagatcactacttcctgtaaaggttttaaaggtaaggagtaatttggtattgaaaggattaagggaaagaaatgccaggtcagtttctgtggtgagaagcattttaattttgctcctttgccatggggaatataaaaaacatcttttgaaatacttaattctgtgtgcatgcgtgtgtgtatacacgtgtgtgtgtgtgtgtgtgtacataaaccctccggtctgtgcatctttgaattctctgccaatttcgaggtggttccccccaccctagggacaatgtcggctttattaaattgggcacagcctccctagaaggtgaaacaatgcttttaatgttctgattatatattaatgaacaaccaggccaaggggcacttgccaaaaaagctacaaagtgagaaagccaccaatatcagagtgaactttgcactctgaaagtgtgaatgatgttgggtgaaagagtttatggcgcaaggggagcaactggaatctctttgatgttgtgtagcatcctggccccattagactttgggccttcccgtttaactgcatctttgctggcgagggcagtgctgaggtgtggtctgaaatatagagggacctcagccacagaggactggcatacctgtgctgggcagggggaccgttggccatttctatctgttttcaatcaacttcaacaaattttaatctaacactgaaacatatagtttcacacccccaccctcccagcttttactctggagggactttccagaaatagcatgctattattctcaaatccgcctgccccaaccacagaaaagggttagatcttaatcttaatctaactgatttattttctccccattgtggtgacatttcctcctgccttctggcttggtcttaatttttgaatggccactgggagccctgctttccacagccttgctaaataatttctcaaaggaagaaaagaaatgctctttcaaaatgccaagaatgtgttttctgtgggagggtaaactctagctgaggttttctgcatctgatggactcatggacagagcttgggagcgagtataggacaatctgggaagcacacagaagctgatgttctttctgggtgttcttttgggtgttcatttatctcctggcacgtagaggggcagttctttctgcatttctgtggtatggaagtagctaggtggcattttcagtctggaattctgagagcctgctaaggtgggcaacaggactttttttttttttaaatagcttttttgagatgtgattcaaataccacaaaactcatccttttcaatgataggattctgggtttttagtatattcgtagatttgcgtaactactaatctagaacattttcatcaccccaaaataaaaccctgtacccattagcactccctgcctatccttccttcctcccatcccccggcaacatctactttctgtctctatagatttgtctgttctggacaattcatataaatagaatcatgcaatatatggccctttcttttacttagttacttagcacagtgttgtcatgattcgtccatattatggcaggtatcagtacttcattaatttttatggctgaagaatgcttccatcatgaggagagactgtattttctttatccactcatcagttggtggacactttgtttatttccactttttggctgtaatgaacaatgctgctgtgaacatttgtgcgtaagtttttgtggtgaatgtatattttcacttgagtatatacctcgggcatataccgaggagtggaattactgggtcatatggcaattctatgtttgactttttgaggaactgctagactgtttcctggagaagctgtgtgcaccacgtggcacatccaccagcagggtatgaaggttcccatttctgcactacctcaccagcacttgctattatctgtctttttaaattttagccatcctagtgggtgtgttgtggtatcttgtgttgtggttttgatttgcatttccataatgactaatgacactgagcatcttttcatatgcttattgaccatgtgtatatcttctttggagaaatgtctattcagtttctttgcccgtattttaactgagtcctttgtctttttattgctcagtggtaagcagagcatgtttagaaagtacaatttcaagcagcttggggtattcccctggttggtagtgtgcttttctctatcttcctcaggcgagaagagtttttatttttaagactttgaagatctacaggtagaagtgtaatgcctcataacttgcccgtctgtttggaatctcaagggaaaaagaaaatgtggcaggaaagagcagtggttttccttgcagtgaatccagactacagacgctctaggggagcttattacatagtgtccctaggagaatgggagaatttgctctcctgtaacctaaggaaattggctgtgcatatgcatttatggaagagcctgaccgttttctctgcatttcctctgttccgaggcaggtctgcctttgccgacggagctttgcagctataaattagacagaagtgcagtattgaggctgtccaagtgcaggcagggtaattgctctggacaggtttacaatagggaggtgtgaagtgcttggtggagaccagaagctgggggaagggaggacgtattgaacttgggcggctgcagggtgatgggctgacagagctaattgaaaactatggccccggtggcttttaatgggaaagggagccgaggcctgcagtggtttcctttagagcaagaaaccagaaggaaaatggctcattgagctactcagggagttagtactaaatctctgcaggcctctgggggtagagggtcaggttttctgagttttgtttttaatttcttactccttagtcccattctagatgaactgacaggagggtggtggtgagcttgagaaaaggcctgcggggacatactggaaaaaaaagctgacccgtacagtggagacccttggagatccatgagttagggagatggtcagcgggctgaactgcctatagacaagtgagataataatgacatggtagcctctgttagtcctctagtcagagtttatggtgccagggcctgggaatctgcattgtaaacagctgttggaggaaattgctttggagtcttaaatgtgagggcagactccctgaaggcacagcctaccttattgacctgtgtggtcctcctggcacgcagcaggtgcttaataaacacctgtgtgcttatttccaaaccaactgtgagttaccgttgggttttctttcttgatagtatccaggacactgctttctcatgtccctgaaactcctgcctgcgcacacctgtcgagataaccatgggttggctgtcctacacatctgcccttaagttaactgttattttctgccccattggggttaactggttaccttttcaggaccacctacatgcactgaaattagttgtgtattaaaagcaaaaacgtagaaccaaaaactggatttatctccatttatttccaattccatggtagcaacgtgcagaaagtccttttcaaaggcggcaaataaacggtgtggagatggtggaggtgataggattttccttgagatgtgctgtggttaatgtgtaacctctttcataagacttatgtagatgttgatgcggccttgaagccattgcaggcccacaaactcaggctgtgtgtcgtgtgtttgtagcaagtccatggctttgcagctaactcatacccccaaggtttaattttttttggtcgaaacaacaaccaacatctgtttggtaatcctcctatcctacagcaggccactcctatcctgtagtgcatcactcaaatagttgctggagaaggctttattagatcacctcccctcctctcccctcttcctcccccataggtgtgtctccagcacacctatgcgtgattttacatttctggctctgatgataacatctttaaaaatgagagaatgaacttaagtgagataaaggaagaaaggtggaaaggataaggtttgaggcgagaggggattgggccctcctttttgaggatgactgaagtataaaaacttatcttctccttgtaataagacatcttggtctgaagtccagacagtttgcctcttggatgaggttattccagccctacctactgctccattgtgccttggcatctttggggattgtccatttggaggggccagattagaaaaggaagagcatgattacagcaatgttttaccagcaaactaggatcatcttgtcctgtatttttgccttgccagaattacctgttttgtctgagaagcaacattaagcacaggagtttggataccgtggaatccagagggcaaatgacccgggtcgtggtgtgtctggctcaagaaataacattttgaagtgccacctggccctaatggcaacagcagccatcagttaaaaaaaccagctgttaagtaagagcaagaacaggagtgtttgtgcaaacaacctttaaattttctgatccttgatgaatgttagttggtttgtgaattattaacttcagcgtgtgtgaggaaatactggctgcttaagtatatttttatgtaagaaaaaaataaaactgaccacaccctcagctgctaccattttgggctcagttcttgcctgctctcactcaacagacgtatttaaagcagagataggaatgcctgctcctcacagaccacatgtgtgtcgtgcgtcacagtgcatcagttgccatcacaatttcactttgaagggaacggaagtgttttgcagcctgctgggatgtataagtaggatgatccctaccgggctgcacagaggatccagagtcctcatgaggattttggtatagataccagtgtagttgggaagaatcctgcgtatggaatcagaaaactaggtttagtgaattatagaaagctggcttgagaaatccatttaatgtcactcagccagcaacttttaaagagtgttttgaggcaggttctttaatgtgaccctggagagacagccatctttttctagtgctttgatttacacagcagtgtgtctcgcaggaagaggccagcagatttgactgaggaactgcagtgtggcatcttggaaaaaggggatttgaggactttgagagataggaagagacttggagaaatccatttgtgaacctggtttccacagctgtttttcagaggtctcttggacctcttaaagttgatactaatggactacttatttcttttgacttttacctgggaaagagaattgtgattaggcccttatctgggggagaggagaggctaagggaggaaggggtgaaggattaaggagttggagagaattggaactggccagacagggctatttgagcttcacatacctttgggtattggttgctgaattaatcctgcagtgtaagtcacacttagacatgcctaggtgtgactcttggggttcatttactttactacagggtttaatctctgcgcatttcgagtgaggaaaacatgcttgccatgggaaggaagaaagcaggtgctctgtctcccttccccacctcttcattgtcctcagttgcaatgccatttgatataggtagttctgaaatacattgtacgctttattcccaggctgcagggattattgctgacatagaccatgggtcctgcagccagccccctgtgtatggaaatggaagaaaagaaatcaagctgtaaagaatctctgttttggggctttgtagtggcgaattacgtgaataactgaattgaaaaggtgcctggtttataccatcgtgaatacccaggccttagataaatattgacactagtagtgtgacgggcaggcctaccatttgtctcatgcccctaggaataaacgatcttttctcaggtgcttgtgaccttataaaccatcctgacgagtttgtgcaggtgctttctgcactagttctttgagagtggatggttttctccctgtgcttatgtgagcttaaacctaaccaaatctaaagccactttggcttattgatcctggttcactttgccacaagtaaacgcagttgtcagcacagtttcgcagagtcatgtttgtgtagccatgcggactagacctgggattggaacagcttttatttactttgataatatttcaggactgagtgtggtggggagtaaggagaaaggaaagccagtttggggagacttagctggagtacaggttgcatctgatagctgagtgcctgccttttccagcaaactgctctcacccccaaccaccaccttttgtttggttccctatatctcagggcatagaacaaaacccacttaattttgttagtgtgcagtatgcagacgcaagtcattctccacccttctacctccctaccaatgatagcatgtttattggagggaagtcatgttggagtcacttgatttaggacaggctaggcagagactttgacaaacctcgatttgtcaaaggagtgattggtagaacctgggagattgtgtgttcgttatatagcaagtgttaggctaagtcctagctgttttcatagggcagctgcctcaatgtagctgatcttgtggatgtctcaatttggtatgaccagtgggcttggattttctgtttggatgtgaagatgctctgtgaattgaatggctcttgtctctctctagtgcacagagaggctgtggagtatctagaagtacacatggtgtttcttagatttctgcctgtaactgaaactccaaaaagagtttactgataattgacttttgacaaggctcttaaccacctttgctggtgattggctttaaaagaaagaactcatattccacaggtaccagtattcattatttggttaagatacagtttagcaagtggaatttgccgctagggtccaccctgtaagacacatcctttgtgagtaaatgacctggacctgcaaatgggagtgggatggttggggaggggacaggcgtgtggtggggtgatgcacccagccacattgaatgtagatggggccgggtgctgtggctgacacctgtaatcccagcactttgggaggccgaggcgggcggatcacctgaggtcaggagttcaagaccagcctggccaatgtggtgaaaccccgtttctactaaaaatacaagaattagctgggtgcagtggcgggcgcctgtaatcccagctattcaggaggctgagataggagcatcacttgaaccagggaggcagggtttgcagtgagctgagatcacaccattgcactccagcctgtgtggcaagagtgaaactccatttcaaaaaaaaaaaaaaagaacgtagatggaccttgtggaagaggtgaggcattgtttttagggactttggcgaatgatttaaaaaaaagaaataaaagtgtgttgtggcctagtcattttcacagccagttttccatttgacatagtaaaattttagtatgttcaaggatggaggtcgcatgcagcatctgctattttctgcttgtaatttcagtgaaaaggaagttccatgttttaatagcagcatagtctgtgtacaataatgcatgctgaaatactttgtggtttttgaatcttgacttcgtgtcttctcagccatttcaacaaccagaaccagggaaatcatcactgctccacgcctctaaacagggaaaatgatgtggtagatggtcttttaaatttagagtgtttcacgacgtcttagtactgcagaaagaaaaacttagccttttggctttagctaagcatttcatgacacacgtaaactttaagaagcccagtggaaaaagtgaacaggacgagatcccaagtcgataagctagctattaaagtcagtgacttcactgtgggccagacggctgaccttttaaaactgtgtgttttctttaaaatacttagctagagatagtcgcgtgcctccctgtaatacagcggatgtattcttgaaaagttgtgggtaaattcgcttttctaatttggctgatttaataccagggatctgctgtctgtatttgtatgatctgcattgttttgaggcagctgagaaagagaggataaacctagaaaataatattggaaggaaccttgtacttaatccatttgtaacgccgagcattgtggcaaatgcaagtaagcatggatttttatatgagctttatagattttggatgcttgggctttgcacaggcaccaggagacctcacagagatgttagtgagctgtgggtgtgatgtcacacagttgaaaaataaaggacgtgtgtaagttccagtggaggctgatagaggactcccgtactctggggaacttctggcttcccaggaagggtttttcttacaagcagctccagcctggaaaggtagttacacccacttatgtcatttgtcccttaaaattttttgtggatggggaatgaaggagatgccagtagcactaaggtaagctgttgtttgtgcagatgtatttgttgaaaacaaaccactttcattttcttcttcaaataggacatataggaaacctatacattgctcttttgtaacccagaagggtatttgcctaaaattgcccttctcagtctctttaaaaaacaacaaaaacccctaatcactacacgtccagaagtgagtcaccactgagtttgctttttttttaatcttctgacatacatttctgtaacatgaggtttttgtactaatattttcattgattggattatgttagagagtgaattgtcaaaatgagagttaaaaaggcccaaaatgtccgatcctttcctggtcctaggaaagtcctagacaagagtgtttagaatagtgtgtaatgaatgactcagatggagggaaggggttttttgttttgatgttttaatctgtgtctgtcgcacccagaggaagtaatatattattggaggtttcattcttaaagaaccaagagtcactgctatagaattttcttatcactttatcccagtgaaatccgtggttgtaccttctgccggaaaggcaggcttggaatttggccaccctgctctcatgaccaggagcaattttatgggcctgtgttaaaacaggtattttgctctttgatagcagggttcatctcagggcccttaggtgtgagcgtgtagtgtgtaaaatcactcaccgttaagtggtgaatcatttcagtgtatcggaacaggagattcatcacagcatcacttacgggtggtgactgtgccaaagtttacgcaattctgttgtgtggcacatggcagtcgaagaagctttccttgttagtttgcatctttcctgtgaccatccgaagttagtgttttttttttttttttttttttttttttttgagacagagtcttgctctgtcacccaggctggagtgcagtagtgtgatctcggctcactgcacgctccgcctcccgggttctcgccattctcctgcctcagcctccccagcagctgggactacaggcgcccaccaccacgccaggctaattttttgtatttttagtagagatgggatttcatcgtgttagccaggatggtcttgatctcctgacctcatggtctgcctgccttggcctcccaaagtgctgggattacaggcatgagccaccacgcctggcccgaagttagtgaattttaaagctgcatcacattttcagaaacaccctggattttgcattggtggtttcataggaagctaatcagtctcctgaaagtggacatttagcaggggccaggggcggatgtggaggggtaaaggtggaagttttaggaaaggaaaacagtaatccgtgaccagagaagctttggtggactttacaaagcacttggtgaacctgggattccaaatgtatccaccaggttaatgtgtcctttttctcagttttacccatcccatatttcctgtcccttttgcctgacttgttttcagtactccagaagcaaaagtctccgttttctgccgcagtagagcgtggttttcatttatgagaaccctctgccatcctttaactgagagaacctctgggttttacctctggccgcccttcatccccgccatgccctccgtccctgctggttgggatggatgagcctttgctctccctgcagcggctggggccctaggctgtcagggcacctcggggaagagttcagtgggagcagggagcacctggctccaaggttccaacccccctctgttctgcagaatgactgggctcccaggaggtaaagattcagctctgttactggatggggtgaggataggggggctattgtgcaggtgatgagtttgccaagtcctgtagagcttaaggactatgtgaaagttagtgaattagtgtttctttttggagatgataaagtagagaataggcgatcctgaatgaccagacttctgacccatctcttcccgctccccatttccaagcctctgcaaagcacttctctaatagcaaagccaaatggtggctgtaggcacctcttgcctgctggggtggccatggtgatattccctttgtggcaggtctgtgggagggtcagcctctggcagcagctattccctgcccaaattccttttgcttgtaaagtccccaccaactgcagagctggtgtgttggagcgcctcttcttaattaaattaattaatctttaggggttaatgatgcacataccatattaacaagagactattatgggaaatttgtgggctttcctcagtactaaactgcactaaagatgagactgcttaaagtaaaacaaaacaaaacccattatagctaattattttgtttctttttggccaaactaagatttttggtaggaaagatcctagaatctcccattttaaggggtagtatagaaagcaaatgctaactgccttcagtgatggtgagaaaacaaattgggcctcttgattatctagttcagaacttttaagtaaatgaacaaggcgatactctgttcttatggaaatcaactttaatggccccatagattaatgttcgtgagggacctggcactggggtttgctaaggtttatataacccttgacttaaccgcctggtgggttgtgggtctggcagcatggggctattcttctcaactttgctgtaaaaccatttgtgtcttgccctttcctttctaggaggtcctgacttcttggcctttttgtttgcttattttactccatgccctccattccttattttacttttctggcctcgtttcccaggactcctcttcaaaaaaacatgctcttcttctaggcttagctgaaatcttgcattttcaataaacgtttctcattacagctgatctttcctgctctggacgccatctggccttcattcatgttatccatgctagggatgacaaactcagatctcgggctgggaagatactgccggtgaataaagagggcatgggtgagacaataaggagtggtgaggtctgtggtcattggaatgcttggtaaatgcatgtagttgattgtttctgttaggaatgctggccctccgattattttcaagaaaagctgaaactttagtttttggtgaaaactttaggtttctaccaacactgttcagtcagaaacaagcaagtttccctgcagcccagctttgtacccacaaactaccaatttgtagctactgatctaccattacagaatgcttgcaagtgtcagagcctttggctgtgttatttggtcagtattctttttttttttttttttttggtagggacagggtctcactatgttgcccaggctggtctcaaattccaggcctaaagtgattccccgactttagcctccgaaagtgctgagatttataggcgtgaaccaccacacccggccaggagtcttaacttgaccagtgggttgtaaaccacttcaagtcacagactagatcttatcctaatttgttatcagtttatcacagtgcagtataccttgtagacaataaatatttgtcaaatttgacatttgttgggtgctagagggaaaagatgtagacttgtactcaaattagctacagaccaggatgacatgtgtgaactagtaaggccgagaagcacatgtaagaccttatgggatcacagaggtaggcatgagtttcttctctcagttaacgtcacgggcgttagacttcagaggcccacactgattattatagctgatttttaaggagtaaaaataggcaatgagtctgggtccatatatagctgtatgtatatagtatctcctattttgagtcactgtaggtttcccttatttgcatagataatggtctatgtaaaattttcagaaatggaaataactggtgactcattactgactttgtgagatacaactgcccaaaagcttacaaaatgagctatttgtatcatgttgagatctgagtgatttttttcatttgattatttgcagaatatgttcttttgccatagggaatatgtggctgcttagcttactgaagagaggtagcagcaagtacagaaccttctcctgagtggagatccttggataggatactagaggaatgattccagttcaagatacaattttgtcatcttaatataagcctttaatgtgcattatccgcttgttcagttgtggtttttggttaacaaggggaagcatcacaatagaaaaaaaggtaagaacatctaatattctgggatttgaacgaagtcttattctcttttataaaaccttacaacatgggaacataatgtggtgatttcattggagcttgatgtgtactatgtaattcctcagaaagtaaaaatgcagcagaaacagtcttaaaagcttaaaggattaaataacttaaacattgttgcatgttcttccttatttgcacccgctgaaattttgaaaggacgaatcacctttttccacctttttctggtgagtcccaagcaggcaattttttaacgagtggctgacagtgcacgttctgaggttgagaaagagatgaatcgccagagcccacggctcccaggccagagctgggtgcccactggtgctcagaagttgggttgttggattgcctcacacttactttccagctgtattaatgcagtttagcaaacatctgaaagcttaaaatatgcaaaatactgtggcgctcaggagtccagacagaattgagtaatgggaaataggctagcctggaaaccaaaccaagtatgaaaacctcattcttcagggaatgcttgtcacggatttaggaccaattccttccactttgaattattctgttaatgttgaaaaatggagccatgggttgcgctcctcttcacagtgagagattttgtctgtgttcgtcagtggtctgtgagcaatgcttgcttttggggatgaagtgataattctgttgtctaacgaagtggggttgtttcctcaccacagcttactcaaaagtaaacaactttttatccctcaacttccaaggagtcaatgaattactgttcaccagctttgaataacatttgccaagtttgtaatatgtggttctggttgtaatccaggaaggtgcttgtcagattagataaataccgtttaagcctatagaattatactctgagggcagtttttattaagaatgtcttcctcataacttcagtttttgaaggctctttcccttgttgagatggttcagaactttttgtgtgctcaaaggacttgtgttaatatcagtgtccatccctcaccacagccttttacatagttctcgagttactgggtagctcagatttgtgttttagattcaagttgcttctgtaggtgacatttaacttgaaatgtttgtggattatttcatgatatagatatattcgttggttattttgtaattcagacacagcacagtttaatagaaatttcagtgctgatagaaataacctctgtctgcattgtgcattttgatagccactagccacgtggtactgttgaacacttgaaatatagctaatgtgggctgggcgtggtggctcacgcctgtaatcccagcactttgggaggccgaggcgggcacatcacgaggtcaggagatcaagaccatcctggctaacacggtgaaaccctgtctctacttaaaaaatacaaaaaattagctgggcgtggtggcaggtgactgtagtcccagctactggggaggctgaggcaggagaatggtgtgaacccaggagacggagcttgtagtgagcggagatgcaccgctgcacgccagcctgggcgacagagcgagactccatctcaaaaaaaaaaaaaaaaaaaaatagctagtgtggccaaggaactgaattcttaattttatgtaattttaatttcatttaaatatacatgtaaatagccagtggctactaaattggacagcacagatttagataatggtggggattttgcagctattgaaggactttagctcttcggattccttggggttggggcaaggggacttgttaggaaacgtgctcagcgagcaaactgttgttgtgcactggtaaacagtttgcttttcagacacgcctggataaaacttgagctgtcctctgcagaggtgcctcttgtgtgttcagcgaacggtgggctgaacggtcatctttcagcagattagctgaaagaacatctattgctgggctcagttgttcagagatctgcgcaccctttgtgcaagagcagggaaaatttgtgttatgacaatggctgacagaatgtttaattaaagctgcaattggcagtaactaaattctccgaggtttctttcctctcctctttgctactgaaaggtgcagaaatgcttttgacagcatctttcctactgacagatgaattgttttgacaggagaatttgaaaccttcaactgaagacacattcagatgtcaggcctggtacagggcgatcgtgttcatagaaataagtgagatgctttagatgtgtgtgcatgtcagctgccacctgaaagaaaggcctcattaaagattttcactgattaactctttgattgttcttgggatctcagatgggaattcacgctgcttgctgcagagctcttgggctaagtgtattttcttaattactgagaaatgcgtgttatcagtaagcagtgaaaagtcttgaaaaaactaagtaattttaaaaatttggaaaaaaaatggcaatgttgatagcaacatcattcacaatagccaaaaggaggaacaacccaaatgtcatctgtgatgaatggatacacaaaatgtggtatatacatacatgggaatattagttagccttaaaaagaaatgaaattctgccaggtgcagtggcttactccggtaatcctatcactttgggaggctgaggtgggaggattgcttcaggccaggagttcaagactagcctgggcaatatagggagaccctccccccaccatgtctactaaaaaagtaaaatttagccaggtgtggtggtgtgtgtgcctgtactcccagctacttgggaggctgaaacaggaggatcacttgagcccaagagtttgaggctgcagtgagccatgactgcaccactgcattccagcctgggtgacagagtgagaccctgtctctaaaaaaaatgaaattctgacacatgtgacaacatggatgaatcttgaagacattatgttaagtgaattaagccactcacaaaaggacaaatattctataatctaccaacatgaggtacttaagagtagtcagattcttagagacagaagtagaatggtggttgccaggggctaggacagaggggaatgaggagctagtgttcagtgagtacagactttcagtttgggatgttgagaaacttctaaagttctggagatggacggtggtgatggttgcacaacagtgtgaaggtactcggtgccactgaagagtacacttaaaaatggttacaaaggcaaattttatgttatatgtattttaccacattaaaaaaattatgctcaggccgggcacggtggctcacacctgtaatcctagcactttgggaggctgaggcaggtggatcacctgaggtcaggagtttgaaaccagcctggccaacatggtgaaaccctgtctctactaaaaatacaaaaaaattagccgggcatggtggcaggcacctgtaatcccagctactctggaggctgaggtaggagaattgcttgaaaacaagaggtggaggtcacagtgggccaagatcatgccactacactccagcctgggcgacagagcaagactcgtctcaaaaaaaaaaaaaaaaaaaaaaaaattatgctcagagtttgtcttcttgaattgggccaacaagaaagtgtctctgaggattttatttcatattgtagttcctggggagaatgtggtaactattttccttatttcccaataaacctattgaggatctacagctggctccactctttaggcccacttgcttctcagacttaaaaaccagaacagccccttgtccacagcagaaagggacgtgagccttggtggctgtcttcttttttgccaacaggtgctctgagaggagagttaccctttctgggtagcaccctaacacttgaatgttgataggtggcttttctagttaattccagctgaccccgtgaaaacttaacgtttccacttctaagtgtgttcatctctgttgctgcttgttggcatctcagtgttaagtcctgatactgctaggcttctagatagtactggaatggaagaccctttgctcaagtagccttacctaaaaagcaaaatttttataacatttttgaaatgtgaatacattttgtctgctctttaagggaaagacaaacccaagggtgttgtgacttaaatggttttataccaagttgctgaagactttggatacttgctgggtgggaagtgagggaagttatctcatttcagatagtcccaaaccgagccatcagtttaattgcgtaagacctggtgagccctagctctatccaggccacatgtgtaagccagaaacatatgttccctttgaacctaatggcctcaagagtcagtggcccagatcagaggcaaaaactggcgatcctcaagccaaatggggcctgcagatatgtgaaatcttttcagtttttttttttttttttaagtaataaagcaaccctgaatgggccaaacaaaacatgaattcagatcgtgagcctctgagaagacgggtctgcactggcccttgtttcgggggacaagaagcaaatgcccctttaggtgtgcggcaggcacttccgtgtcagccttgttacacacagggcaggctcaccagccctctcttacttgcttgtcctctaagctcttgcctttgtggtttctgagtatttctctaatatcccttcctgcttcacaactcctgttacctatgatgatacaaaagttacagtcatcgtaaactcccagtatctttacacccagaaacaatatttccatccccctttttatgataatctgctcaaaatagaagaaaatctcagtctattaagtcctttttctaatgtgggagaattctctcaatttctagattttctttctcaagtctaagttgggatttctgggtacccattaacaaatacccccaggcacagacaagctcacacttgagttcaatatgcggtttaaagcattaccaccttcagtctttatggtaacataatctctggacaaattgcttttaattcaggctgtacccatgaatacagaagtgccattagtttcaagtgtagtttgacttttatttagatgaacgtctctgagctcacagtgaaatggctctcagctctaggttagtattgattgaaatgtctctggagtaagtttaaaagattgttgccacaatacgtgacactttctgagacagactttaaactcaaaattagtcgtactgttaattggcagtagtgtgagtggaattaatagctgagatgaaaaatgttaacctctttggcaaacacggggctgggtagactttggaggcaaggaaagattactttctggcaaagaaagttagggcccatttggatcacatctttgtggcttctgttcctgaaagatgaagctgctctggttgagattgtggtcccctaacagaatagttgcccagcttgctctttgtccgcctctaagggtatggctgggttatgaagcagggagagttttaattctgaaccattgacacagacgccatcatcttgagaaagctgctcatgtgaggctttccctgcctgtggttaacacgaacaagaatttccagcaactggcccttttctcctgtgtgactgtccctcccggtttattcagtgtaggtgggaatactgtgttcataagtagccttatgattcaggatcttacagtgtttactttctaaacactcacttgaactttgactatttgtgcaatttttagtcttaagctcttgtgtagaccagggtttttcaacctctgaatcctaggattgacatttagggccgcgcagttctcagtcgtgcagggctgcctgtgcattgtaagatatttaacagcatctttggcttgtatccaccagatgccagtaacaccccccactccctgccaccagttgtgacaaccaaaaatgtctccagacattgccaagtgtcctctggggggcaaaatcatccctggttgagagccactggtttagacaatgaaggggttttttcccttttctcctttactgctgcttgatgttgatgctactaaaacattaatttaaaaaaatgccgttaagaatagccttgtacttgatagggtgcaaagcatttggaccaggacaccttaatgtaggtagggagctggtttaccttagaatttctttccaagttgttaaatagtgaaatgatactgatagaaattcgtttgggttttcatagagttgcttggagtgccttatttatggatgtaggtggggagggggtatgtctgtaaatctcagtatcaatacggttacttaatacatgatcatgggatgggggcttggatttgagggtgggggagccaggagaagagaagatttctgaattctgggtatgatgccaggttgttgattccgtttttttctctctctgtctttaccagaaacctgagttacaacaaactctctgagattgaccctgctggttttgaggacttgccgaacctacaggaagtgtgagtctccccctaaacctctggtggatggaaggatggagagctctttgggaaaatcctcttgtattgcagcatcgctcactcccctagatccgcagtgtaaacttgtaggaaggaacatttgtgtatggactgtgttgatgaattctactcctgcttatctctcccttactgtaggctcttgaagggtgtgttacaattcagtaggcatagagctcctggaaatcctgggcgcatggtgggtgtatagcagagtccctccattgtgggaagccttgtaactggagtgacacatcctgggctggtactttctcacagttcctgcaccaccacgcccagctaatttttgtatttttagtagagatgagattttgccgtgttggccaggctggtctcgaactctggcctcatgtgatctgcgcgccttggcctcccaatgtgctgggattacaggttaatcagcccactcaacagtggcatgtgagccaccaaacgtgtatttcccaggaagtgaagttatagaaggatggactatagaggcttacctgttcctctccacctccaaacagagctaggtatgactgcctttggagctctaggcttgctgtcccttgcagtgtcttggaaatcaggctgcagtctttccttctttttaatgcattctgtttttgatgtggatgttaggattatcaggaattttagtttcatggagactttatagaaaccttcacatatatgtagtatacatattgtagaaaaattggcaactacagaaacgtgtgaagaatgaaaatcaccagtattctcacccaggcatacccattgtgaacacctagtgaaaactattacatgtacatatgtaattttaggatcaaactgtacattgtggttttatatcagtctttcctacttatccttacataagatactttatcatgtaaattaaaagtttttgaatgtcctgttttagcttttatgtaaaactactatacgtggatatttcatatattacctacccagtacttcattattatttttattagacattattaggtaagttttttacccatttttgttatgagtaactgataaaagtcttatttgttgttttttgtttgtttgtttgtttgtttaagacagggtctcgctctgttgcccaggctagagtgcagtggcgtgatctcagctcactgtaacctctgcctcccgggttcaagtgattttcacaccccagccttgtgagtagctgggactacaggtgtgtgccaccacatccagctaatttttttagtagagatggtgttccgccatgttggtcaggctggtcttgaactcctgacctcaagtgatcctcctgctttggcctcccaaagtgctggggttataggtgtgagccattgcacccaggcttacttgttattctttgattccattattgatgacatatctaaagaaattttaatttcatcagctggtacaatttgcaaaatacttgcattccaaaccctcatctccagattctccagattggcgtttataatttctgcttctgtttaaaaaaggtttaggcttccacagttaaagaagcatcagaacaggaaggggccttggaaatggtttctctaggactctcattctcccagaggatcagtgagtccatggcaggggaaaggaagtttgaagtgggtcactgtgttagtttgctaaggctgctgccataacaaacaaatagcacaggctgggtgccttgaacagcagaaattcatcttctcacagtctggaagcaggaagtccaagatcaaggtactggcaggtttggtttcttccgaggccttgcactgtgccctcacgtggtctctcctctgtgtgcattcatggtgtctctgtgtgtgtccagatttcctcttcttataaagacaccagtcatattggatcagggcccatcacctcttcaaaggccccatctccaaatgcagtcacatgctgaggtactaggggttagagcttcagcatatggaccctaggggaacacagttcagcccatcatagtcaccaagatgataaacccaggccatcatggagcttgttaggtttgtaacccagtgctttccctgatccaagctgtctttaatgcttgtggttagaatatattcaaattctgtgtacatctccaaacttagtggtttcttttaggactggacaaaattggagaattccctctagcatcattcaagctttcattgaatacttactcgagcatctcctctgtccaggagctattctgggtgctggggctacaagagtgaacaggacacagatagggctgggactggggaggggcaagtgaggcacccaacacaggcgcaaaatttatggggacaccaaagactcagcagtcaagataaagggtattttgatacaatattttgaaagtcaaaatgaatgtaaaaaaaaaatgatgagtaaaatataaaaagcttagatcaagataggattagtattactgatttctttccttttgccttcagttccaggatggcttcacacggtgctgttgctgattttgtcttgatttaaacttttcatattttgttcatcatgaattttgttttgcattcatcttcatatttaaaaaatattgcattaatatagtctttgtcctcgtgactgggtttttggctgtcccttaaattttgtgcccctccctacccaattccagccctgcagacaaacctctcctctcactgagtttacattaagttgagggaagccatggactgaataaggaaaccagtaagacttattggagataagtggtatgggggaaatagaacagagtaatgtgggagtattttttgtatgaagaattttggaggcttgataacggaaacagtgtgatcaggaaggtcctgagtgagcaggtgtgaatgatgaggacagggagcactgcaagtacagagcctcaagaagggaacaggctgaggaccactgtgcctggcatgcacgatggaggggtgcgtggccagaggccaggtccttttatggtttcaaccctcactgacccctatctatcaggggcaggcatggtacatgctctggtgagcattttcagtggtgttctaactccctgttcctgttgttccttgcctagacaggcttttacctttcatttgatttggctcccgtgacctgcagcctgtactcagcacttgttagagtttatgtcccacccagctctagaactgagcactcccacctttccttcattggagatactggttatgagtctcaaaaatatatttctcacttaggaacagtcacagtaattgtagcagtgtgctaataaacctttggagaatacgacatcacttaaccctaacatcaactctgtgatataaaacattatcttttttttttttttttgagatggagtttcgctcttatctcccaggctggagtgcagtgcaatcttgggtcactgcaacctccgcctcttcggttcaagtgattcccctgccttagcctcccgggtagctgggattacaggtgcctgcaaccgtgcccagctaatttttatattttagatagagatgagatttcaccatgttggccaggctgatcttgaactcctgacattaggtgatccacccgccttggcctcccaaaatgctaggattagaggcatgagccaccacgcctggcctgatataaaacattttctttctttcttttttttgagatggagtgttgctctgtcaccgtggctggagtgcagtggcgtgacctcagctcattgcagcctccacctcctgggttcaagtgattctcatgcctcagtttcccaggtagctgggattacagatgtgcaccaccacgcccagctaatttttgtatttttagtagagatgggatttcgccgtgttggccaggctggtctcgaagtctggcctcatgtgatctgcctgccttggcctcccagtgtgctgggattacaggtatgagcccccacacccagccccttaaaacattttccacccagccccttaaaacattttctttgtaagcattttctcagctgggtgcagaaggatcacttgagcccaggaatttgagaccagcgtgagcaacaaagtgagaccctgtctctacaaaaaattagctggacatagtggcccatgcctgtagtcccaggttcttgggaggctgaggcctcaagatcgcttgagcccaggaggttgaggcttcagcgtgccatgtttgcaccatgcactccacccaacagagcaagaccccatctctgaaaaaaagtaataaaaataaaaggagtttctctgctttgcagaagaggaaacagatacttagaaaagttaaacttgcacagtgtcacatggttggtaaagctgagagttgaactcaaaacctgtgctaaccttggcggctgcactaccttaaattcctatatccttcatcttaactctcacagtcaactgaagatgaagaggaactgaggcatgggatttggctgaaattgcgtgattagtgagtggtagaacttgacccatgttctccagtataatcctggtccacaccatctatggcaacagtaccgtctgagtgtgggggatgttaagacagaggtcatatcttagggattcaatatgatgtggtgggaaaaactctcattttggtagcaaatagactcacgtttgatttctggttctgccccttactagggtcctgagaccctagacaagttacttagtgcctcagcgtttgctttctttcttctgtaacattgacatcgtaacacattgttggtgttactgtagttattaagatgatgcacagggccttgcacatgcgagaggctcactgaatattatccctcttctctcctgctacgtttggaactgcccagccctccaagctgggtgcattgtttagaaatgaatctttgcaggctgactggttgaatgtcttaccattgtgcctcctatccctagtgtcactccctgttctgtgagatggatgagatgaattccctgctgcctagaacagtagaacttctcactgataaaagacccaggccttaccctaagggaattctaaaaagtcgtggagacagaaagaggctgttaggtgttgaggggtggggaggtggggaaggatattgaagaaaagaaaaaaaatcgtagctgacatgctactgcttcaaaattaaccagtctccagtgttgcccaggcgctgtcagctctcccaaaccttatagagccttcagtctggagccctcattgagaatggagccacaggctggcagaacagcaggcagtggtttagcagtggttttattctggaggcctcagaaccacatgacatcatgggccggctggagagagaaggcgaggcccctggaggacacgaggacgcttgtgcagctgcgtccaagccacacggtcttcactgcccacagccctgaggaaagcccaccagggagtgcctccagctggggtcctggccagcaggctcctctattaataaaaggggctatttatacagtcctctgtagatactgccttcagatcacagtactgccgcctggcccgcgagtgcctgctgtgggtgttgccgtgtgcttgccagggccactgacctggtaaggaagcctcaagtgtgccctgcctgctattgggtatttgtggttcatcgcactgtgtcaggctgctgctccccacagtgggtgtgtgtgagcaggggtgcgggggatggtagtatgtttagggagagggtaaaataatgagggttgtcgttttggggtactgccttttggctgtgaattactatcacttttttttttttttttttttaagacaggatctcactctgttgcccaggctagagtgcagtggtatggtcatagctgactgcagcctcaaattcccaggctcaagcgatcctcgcacctcagcctcctgagtagctggaactacaggcgtgcacaaccactcctggctaattttttgtagagatgggttttgtcatgttgcccaggctagtctcgaactactgggcttaaatgatcctcctgccttggcctcccaaagggctggaatacaggtgtgagccaccatgcctggtcctcctgccatctcttaagcatatcctgtgtatctgtcaatatcctgagatcttaggtttaattatttcagctggatcctcccaaaaccctacaaagctggcacttgtattatttacattcttcagaagagggaagtaagggacagcaaggctgagtgacatgcttagcattggattgataaagggtgcaattggagttgagtgaaccaagatatgtctgatttaaacatctgagctatataatcccatcctaataatccctgttctgtaactgtgcctcagtttcctttcttaaggagaggtgataatttagtactttcctcaaagtgttagcatgtcattcgctgagatattgcacatagaaaacttaggacagagtctggcacatagtagatgttcacctttattattgtttattttgttaaagtaattatatcctacgctaaaataattttatctggctatcttgtgtagaaaccacgtatcataaagtctcaccacatcaattagttagtatacattattctctagtaactaaagcagaatacagttattaagtggccctgcttccgaaacccatattcctatgtgatactgatggctttcacccttttaagaaacaaaaccaactacagtttcaacgcactgcccaactttgactactattaattgcagctctgtctgtatttgggagcaaccaaagaaacagccactatgtctgccagtagtggattggccagataaattatggtccattcataccagcagaggactactgtgccaccagttaaacgaatagtggagacctccaagatatattactaaagagaaatggcggtacacaacagtctgtttaatacacgtacatttgtgcaaaagaaaaacacatacacatctctagtagccagcagcaggagctgccctttggaggcagaccagaggatggaactgcaaagaagctttatgtttactatgtattcttttttgaaatggtttgaaaactttactctgtgcttataccagctatttaatgagtaaataaataacagcaagaaaaattcaggcatggtggctcacgcctgtaatctcagcacattgagaggccgagaagggcggatcacctgaggtcaggagttcgagaccagcctggccaacatgacgaaaccccgtgtctactaaaaataaaaaaattagctgagtgtggtggcctgtgcctataatcccagctactcgggaggctgaggcaggagaatcgcttgaacccaggaggcagaggttacagtgagccgagatcatgccaatgtactccagcctgggccaccacagagcgagactccgtctcagaaaaaagacaagcacaatttctgcattggtttgacattgttgaagccaaatttgattaagattgatgatgatgatgatgtagtactatgaaatagcctttatcacattttgtagcttacaaaatgtaaaacttcccttaagtcaattaaatggaagttttgggagaaaggtgagggaccagaaggtccaagctgaccttacggattgaattgggaaaggacccacccctaggttctgccctggggtccggaatccttttaccttagctacaccttctctagccccagggtctggccgtgattcatgggtctgatgcatctgaggcacttcttaatcctgaatcatcagaaaaggtttagaaatagagaccagacgtttcagagagatttttagggccttggatggaagtaaattgtggggagagatgggcgtcggcaggggaagtaaattggcgggtagggggtgagagaagactgtacaatcgtagatatttaaaaaaatttcatcaggcacaatctttacttcctaaaatttctttattcatggagactctgctaaacttcctgagtgcctttcccctcaaagctgtagctgtgctatttttgaccagtctctatttcagtctggcaagaagttctttgcatctcagagtgagctgggcctctgctgccttctgaggagagtattcttgtttcaacaggggacagagtgaacaaaaagggagccagcagtggtggagctaacagacttactctgaatagcggttcttttttcagtagaaatgatctggaagtaagctcactgtgcagggcctctcctgggggctttgagtgtcctccctgtaagtcaggcagccctgttgccaccagagcccactgtttctgactgagcccttgactcgggcctgctcatctagacatagaaggcccagttaagctccagcactggtccaccacccctctatgctccacttccagcagttctgtcacaatttgaaatatcatgatgcccgcttcccttgttcatttatttctgtgaaattgggtggagcagtttgtcacagatacagtaggcctggcctgagaccaggctcatcaggcgtagccccctgcagagaagtccatacgctttgtttcaggtttaaaatcaagtgagatcctaagctggctgaaaaacaactgtgctgttacctaagggattatgagctttccagctggcctttgagcccgctgctctcctctggtttgtagtcatacttttttcaggtcttggccatgtcctctctagtagcatgaccctagatgagtgacttaaactggcctagagaacttaccggtaatgtagagaatggtagtagttaacctggtacctgactcaaagttgttgtgatggtgaaagtgcacgaggcatgtcgagtttttgctgaaataaagaaatagaaggtaatgaggaaaaacctagactttggggctaggcaccctgggccactgcaacttattgctggtgaccttggtcaaattacttaacatctgtgtttcagtttcctcattggtgcagtggaaatgttcctgagacctacttctgagggctgtagagatgcattaatatactgaaaagctcttagagctgtgcctggcacatagtcagccttcattaatttacctgcttttgtttttgttactaacattctctgtgtttgagaagaaatcgcaagcaatgaaagagttcttaggcaagctgcctgattgacagcaggtccccgaccttagtttttcttgctctgataaaacctgggggtctcttgtaataataggtacgttgatgggtactatgaaaaatttattagctgagattaagactaatggggagttttcagtgtccctgagtgaggatgggaaatggatcacagcagggttggaggagataaaaggtgaagcagaaacaatctgatttagggggcagtcagataagagactgttaaagtaattaattgtctatttcaacacacaaacaagggccctttaagtggagaaaagatttgccacatgatacggatctgccttctctctgccagatgcttcagccatgaagctattgaaacaggcattctatgtcccacagcccagtaattgccaagcttcatccctaactggctttggcactgaagaaagcaaatgggataattcaaggcctttccttttttttttccttctcctattcacttctataaaagatggcagacaaccagattattctcttcaagcacatgctagctgtatacttgtatgagtacagctgtgatttcagttgctttgtcttcaaacagaaacaggatgctctgtgttagacgtacctcccttaaaaaactgagaataagaacccagttttatccccttgactttgcatcgcaagtacaatttctttctagcccatcacctggcagaaagcctgaacactttgctttggttttcttaaggattgttgggctcactttgcaagtctgattttggattctcttcccagatttggaaatacatgtccatgtaaggaggccagattgcacagcctctgggggcagaccaggcgagccgtgctttggttcgtgggtttccccttccgttaagagatattaactatggaaatacatatttggactattttagcaggaagggagcttggagagcaactctcgtctgtggagaattttcaaagtgtctatgcgcaaaagtgtgtgtatatatgttcattttcctgggggatgcatccagaggcttcatcagagtccagctggaacctcaaatggaagagagtctctgagtccagttcccttgttatttcacagatgaggcactgaaataattggccccatgtgtcccaagcccctcagaactccatgtgagccagggcgtgagtctctggctcttgttccacacatgttgccctttgacaggggcaaatttcggcccacggggagtgttctcaccgatggtcttaggggcgcttttgtcccgaacctgcctcttggcttgttctcactgttccttgtcttgatttctgagtttgatgggaagctgatgggagacaggagatgcttccccttagtgtttgtttctagccatgggtgtgatcagtggctagtttttgtgatctcatgtgacttctttccctttaaaaactcactgctaaattctttctcttttctccaacattagaatataggtttactgtggcagacttagcagcgtttgtttatttctgttgtatgtgtatgatttcagactaattcaaatgccttacatgattaatttcttgttgttgttacaggtacctcaataataatgagttgacagcggtaccatccctgggcgctgcttcatcacatgtcgtctctctctttctgtaagtggtgccgtttgggggactctgggctgtgtggtggggccatggtgtttgttgccttgctgatacctggtggcaggataacttgagttcatgtgctcgctggtgaagaaagacctttcttcatgtggccctcatgatcatgacaaacgctttgcttgctgttttgggatttgcagaattaaacgctggaagttttacctcatctttaatttgcaagaaagtaggtcttttgtctttttttttttaatgcgcagaggtatatggaactagatttcttgcttctgtggttggttaagctgcaactttgagtaaaactggagttaaaggaagctgtgtcagttataagacagcaagctaatctttgtgccagtgaattgggtaatgtgactcagtttacttttgtggctttaagaaaaagaaagtgcccccaggcctctggaatcaacgtaaaactatgttgtcatggtcaagtgttagataagatgcgatctatttgttctagacagcacactggaaatgaaaaagcagatgaagggccttagctaaaaagacatgaaggcacccattgggaatattatcatttgtgctgttacaaacctttgctagagaactgagcactgatcctacccctatttcttcagcagtcaggtggaggagcttgcttgttttaaactcacccagaagactttccagataaaccagccatgagtccaacagttttctctgccagattttattggcagcttccccagcagagcacctccctcttcacactgaatttcctgtttccactccaggctttcatagtttaattttattttgattttgctggttttataattagtttgctcacctatatgaatcttttctcaatactgaggctcggcaggctgagcagagaaactttgcaagaaggtgctattaataagagtgctggcatagcttacagatctcggatctttggctggcagcatgccctgtgttcaggaggtgctgtgtccctgtgaaacatggtcttgggtttaacccttttcatggcattgtgggattgcaggagagcgtggggggttagaattgcacttcactctgtgccctggacagatgacctagtctctctgaacctcgtttccctcatttacataatgcatttttgacccattttatacatgaggaaagtgaggcccgggggagtggaatgtatatgaagctcccagcattctgtgggagtgtttgacaaatggtggttactgtcattggctggtggctagttgtcacgtagctccttggatcttggcaggatctcacctttaaggccgcaggatttaagagtcagtctctgtttctgtgaagtgctggaaggaaggtttgtggccctttgttcccttgatgggtaaaggtctgactttattttgtacccacttggtttgtgggcccagcatctggaaggtgtttaatttttggcttaatcaatgagttcgtcttatgtgaggctgatagggatgtgataacctgttgtgtgtccataaagcaaagcacttgaagatgctaggagctccttgctgcttaaagcacaggtcatggaccatcagtattgagttagcttcgagcttgttagaaatgcagaacctcaggcttaatgccaacactactggatcagaagctccatttaacaagggccctggccgtttgtccacgagttcaagtttgagaaatgctgatgtaactgctcttgttcctcacatagtgaggaagctagggccacagagaatatctctgtgttgtcagagaggaaactgagcctccctggaggtcttataagttgtaaaagtgagaggtggaactgagaccagacacaaacgcctttgcatcactcctttaaccccatgcactcggggcaggagcgtggcaggtgactctgaaccacactgtgccagaggcaggcagggcccccagtttgccccacgggcctgtggcacttagaattgcaccttgctctgctgactaaaaatacatttctgttccttggcccaagtgccaagagaagtggggctgtttggccttgttcctgctattccattagacagcatcgaagtatgtaaagcaggagagaaaaaaaagagagttactccctgtttggattcagtttggaaaatgcaggttagcactggcagccagctctttggcctgaagttgggcaccatctgacttggtcagtgatttctctgaaatgacagaaaccgaaggggctttatcttggttttctctgaggtgcctgtgttccccattcttagattggatgcctggattcagtgctggcaagttaggttagcagcatgacatctgggcagctggattattgataatgcttcatgccttttctgtatttcccaagtggaccgtgcaaaggacaagggagaaaacaacagagcaggcagtggatgagcatcattttacagcccaaagaaccaccttcctcatcctaatcaatgaaggcagaagacttagcagccccatccacatgatgattccagtcatccaggttttgaacagcaggttttgctgatgtgtctcttacttttcggaactagtgaactgaagggtgtcacgtgttctgtaaatatttagtaggcactttttgtgtccctgcagttgtggcccagaggctgtcccagggagaagcagaagcctcaacacatcgtctgaaaatgtggtagttaatagttagatgcttatagtccttaatcctcaaattcttattccgtttttgtgggcagacagaggatcagaaaaaaataatcaaaatatgcagagagaatagagcaaatgtctgctgaggccatgtgagtgacaggagcccagacaactttcttgggacaagtttataggtagatgcatcacagaaaagtcagggctaggtgtgggtcctgctgtctctaatgtagttgtgacctgggatacatacgttactttttttctcagatgaggaagttgaagcagatggtagaagtaccctcgaagcttgtgtattctctttgtgacccgaaagttgagagtaggggcaataatgtcacaaaagacatagttaccctctgaccaataaccactgttgttgctttctgtcttttcacagaagtagtgggtttgttaattttcagcttggacacctataattatggacttttgcctctggaagttggccctttctctctgtgtttcattttgcttatgcagaattgagccgacttccagacaccagagccctcccaagctgggtggcaccattgggagagcctcatgggaagaggcattgctctgcacctggctttttctgtcagggcttcaaaagagacttccatagttttgggaactggagtcatagagcaaaatttcagttggttaatactttctgattaaaggaatctaattcagttaacatatttgtcaaagaacagatttatttgcattgtgttctgaggataatgccggagccatttgtccttaataaacagaaagcatagaactcaaggaaagctcttaataagaatgggttccggtgagggagctaatttcataaaatagtgccgagaaaaagaaacagacttttgttaaatgggggcagaagctgccagtggattttcacgtttgagatttctttcttttttaatttaaaatccaggacactcaagttacgattcccacagcaacagtaattttgtctgatgcatcaatgacatttctgttgaggaaaaatctctgtttttcctgtggtgttgctgcacttgtactgtcgagaagattggtgacagtggaaatcgttgaatttttcagtcctgggagtaaaaatgtatgtggtatagttggtcttagcttttgtctcctgtgcatggactgtagcatattacccatagggttggccttgtctacctaacaacttctccagctggtttgttctagacttcatccctttatggtgccttgtcatttgctctcccacagcctgtgtcctcaaccaggaggaagacctaggcaaaacttaggggcacacaattaattgtgactttgtaatattgctattaaaattccttaggtttaggttgcatttgaaaacacattgaaatgccttttacttctaatcttgaaaaaatgtttttgaaaactattttttttaatgagataagataaatgtacccagggacatggggaggcagtgtggggctggtcaatgggtacaaaaaaatagaatgaagacctgctatttgatagcataacagggtgactatagccaataataacttaattgtacatttaaaaataattaagagtgtaattggattgtttgtaatacaaaggataaatgcttgagggcatggatgccccattctccatgatgtgatttttatacactgcatgcctgtatcaaaacagctcttgtacaccataaatatatacacctactatgtactcacaaaaaaatcagaaaatttaaaaaaatgaacttaccattaactcaccatttaaaagccacttgtagtacgttctcagtgttgtgcaaccatcaccactacagaatgctaaaacattttcatcaccccccaacccaccccgccccccaaaaaaccccatactccttcaacagtcacttctcatatccctcaccctagcccctggtaaccacttatttgaaaactaatttttttttttttgaggaaagcatttttctctcatgttaacaaatgaacctggaagacttcatttataaataacttaataaaatatctgaggtggctttaactatattttgctgtgacctcttagctgaagagaagtgattaaatgaaagggataggaaggccgggcatggtggctcacacctgtaatcccagcagtttgggaggctgaggcaggtggatcacctgaggtcaggagttcgagaccagcctggccaaaatggcgaaactccatctctactaaaaatacaaaaatcagccaggagtggtgggaggtgcaggtaatcccagctactcaggaggctgcagcaggagaatcacatgaacctgggaggcggaggttgcagtgagctaagatcgcaccattgcactctagcctgggagagaagaacaaactctttctcaaaaaaaaaaaaaaaaaaaaggcgggtgggcgggagaggataggatacttaacagccctctgttgtaatttctggagaataaaacttggaaggaaagaaacgcggtgtcctacctgtgaccaagcggggaggtggtcaccttcccccttccccgggggtgagtgaagagtggacgaagccctgggtggggttggagggatctgaggcagcaaaggcctgagccctcttcttggctggatctgttggtgaagtaaaatcaataggaatacttaactctctgagtacctagcaaaccctctggaaaaaaagaggggcgaaatcaatcttctttacaggctcgttaatgcaaagatcagttcgcattaaagtgtaattaaagagtgagccttagagagaggcagctgtgatctgctgcagctcagggctggggggaataatgagagtcccttagaaggcccaagctggaagtgacctggagtgcaacgtcggaaaattaggctcggcctcatgatctgagctaaggttgttaataatcaggcttgaagcacaggtgagattatactgaggaacaggcagcggctggcattcccactgcatgtgtgtgtggggatgggcagacttattctccatctaaggagctgggttgagacgtcttgtccttctcttcactgcctgcctttaaaactttctccatgttgcatctcctgaagaaaggcatccttcactggcataataaagaattgatgtgaaacatttttccatgtgatgtttatctttggagggatgaaataagaatttgtctttaaaagttgagtggtaatctcagatggtggagctctttgtgcatttattcctagctggacctgtgggcaccataggtgtgtgtacagtcgaggtgggcgtagagattctccccaagaccaagggttgccccatccttccttcggaggaattatctgctggtccctccaccagtcaccagattaagagtggacctaatcaagggtgttagaaaatatgaaaacaagtatataggtccccatgctactttggacaggcttcccccgcgtagcaacctgatttagctttactgttgaaggatggccagtccgtttgggtaaaagtaaaccttactttaaaaaaaaaaaaccttacttttaccatttgggtaaaagtaaaccgtcagtgtaaaagtaaaccttacctgggctacaggcattttattgctctggcaataaaatgaattctcattaagagtgtggagttaagagtgaatgactccagctactttaggaagaaaatgtgagcaaagctgttttaaaaggcccaggctgagttcaagtgaatgccttttgttccttgggtagtccaaagctgttttggttcccagatgctaaagggggaagatacaggcctagtcaaaaaaaaccagcacaacagggaggaattatatatatacacatacatatacacacgtatatatatgtgtatatatgtatatatatgtatatagatagatacagatatgtgtgtgtgtatatatatatatataattatctaaagttctggtcctcttctgagttttcaaagatgtgttcacttccttccctgtttgcacagatttttgttgatgtgaactgattgtttcttctggataaaacctcatgccctttcccttgggagatgccagcctctgctcactggtagaccacctgtagggcttgctgagacacaagtcactgggtcttaccctcgtttctggcttggttcaacgggtctgggatgggacaagagaatttgctttgctcatgagttcccaggtgatgatgccactgctgctggccaggtggctttgagaaccactcctggggctcatatggggctggggggagccccaaggctcatgtgtcggttctgaccaagctgtttaggccttgggggacagtaaatttccactcctaatgtcaccagtgtggtggcaggcatttgtttgggacagtggggctctatggccctggtaatggcttctgagaaaggctctggggcagtgggcagagtgagctccagtaccacggacagaacagacctgggtggctcagggttggaggcccatgactgttacatatttgcttgtgcttaatttgctgtttgttggtgaccactcaagtctgcccagcagaccttcaccggctgctgtagaggtggagagcgcttcgtgagcagcccaacgtggcaggagccctgttactctctcagccggtgggtgctggcagctctgcttacaggtgagcatcccctctcccccggcaggagtcagttttagcacacttacctttcttttgattatcagtcactcgtatctgatcagtctttatcctcagctaagacttgaatgccacctctttttccagatggaagttaacaggcgtgtctgaaaggtgggcattttttcccccaccctactggggtccccacctgccccattgccctttcctagcactgcattgtttatgaccagattactctcctcccattttcccagcctgggaactgtggtcaggtcaacagtgggcaaaagagatgaaaatgtggaggaagtctcagctggttcatggtggagaccgtgggttcctctgcacggctgctgtgaagttggccagcacatgccccactcaaggcctttcgtgagcaaacagatcgggtcctatgggcctggagttactgccctcaaggaactggcagtctagctgcagaggaagatgggtgaacagacagttgtcatacaggggctggggaatgtctaaggggcacctcactgcccgtcactgatgggtcacatgacagagaagtttcccagatgaagtgacattttagctgaggctccctgttctgcaaacctcctttctcttcccctacacagaggtgtaagttacaggtgtaagtaacaccctaaatgttcagccaacacagtgggtacttggaggagcattcagaggaataccaaaaggacatggctaattccatctttaggccaatttgtgcacacacacaccccctcactcatcccccgcccgcccctcactcatcccctgcccccaacacataccctcccttccctgccttttttctttttcaacaggcgggcttttatgaagagccagcaggccgctgttgcagttcttagaactgcagcctcatcagatgctggataccaccaaggagcctcaaaatagaaaattaaacacccaatttacaaagaaagcagctctctgtcccggaaacttcccagggattccgtagtgcagactgccacttgcccccagtctaagcaagcctttcgctgggaaaagagctgctgtggcctccgcagccagcctgccaaattacacagtcatgacttgtcattttccttctctcttttctttccttttttctcctttctttgagagtgggggtggtgagccagccagatgagaggtacatctgcaagtcatttgctgagaaagtgaagggaacaccagctgtggggttgggggagccgaggaaggggagatcccatggaataggagcttggtcacagagatcactgcctcttttggaaactcggtagcttttgttgagcgtagggcttttttcctttccaccaccccgcccgcctctttctctctttctttcccttttcctgatgaccatgcaagctttaaatatagcccaagatccactggggacccgggttgctccccaatgttggagaagcagtggatggtctcggaggggaagtgctgcttcttccagcagtgagtgctgaaaaccctccagggctgcttgaaatggagccgggaagcggagctgctctgtcattgcacaatctcccgtgtgaaaggggttggctccagcccatatcaacagtctcattccaactgggaccatttcctcctcctcctcctcctcctcctccccctcctcacttcctgcaggtggcttctgtaatccagttaccactgggaagcctcatgtgcatatgcacctaatctgaaaatggctggcttgactttgacctgtgtggtgaccttgcagagaaggcagggcctattgtgtctgctcacacctgggagccattttcagcttttatagcccaagtggaagaaatgtgtttgtgtttatgccgggcctttccttcataaggcctgtcattgttgggccatacatagggaatattggattccccctgcttgtttaaaggcaagagtttttaaagatagaatagttgactcagtatattgagtcccatgaaatcactgtttgtgttttgttcagtagtggtcagacatcagcaatcttgtattgttcagccttttgagaagaaaaaatagtgaccgtcagcatatatggtacactgatattggcaggcgttgctctatggacttcccgggacctgtcttactgtgtcacctctgcagtcctatgagacacaggatctgttaagcacaatttacagatgaggcacctaaagcacagagacggcaagtaacgtgctcaacgtcacagagcaaggaagcatcaaagttggatcctgttatttctctccatctctggggcttatgctcactgtacacttggaagtatgtggtctgggtgcctagaagggtcttgtcattttaagtgctgacatttcaaactgtactaggtgtgggaagccttggtattgtggcccagaggcttcgatgatactctggagtgtggagtcagaggctcctaccctgcaaatgcagcatgcatctcccaaagtggtgctgcgtgcctctgtaatgcccttgctttaaaagcctctttctgacccgaggtgaacttgctttgggtagctcttggtatgattttctttcactgatgcgaagtaacagaaggtccttccccctactatctttccctgtctctctctctcatgtcaattcagagctgattatgccggccatctgtgaaaggtacagtgaggaaaaacactcttgtcgtcaggtctcggcagagcccaaacgtgttcgattgtgccagtagattctcggatagtggctatctgcccccgaagacatcacttcaaggcaaattcctctgcagtttcctcacttcctggatgcctttcaaacccaaacagctgaaataaaggtgtcagtttgtggttttttttcttcccaacttcatcaaccaggaggtgaaatgtgtgctgtgaagtgtgcagccccagaggtactcatgggctgccctctcaggggccactggcttctgcccaactagctgtcctattgtagagtctctttgggggctctgatactttttttcctcggggacagctgctgtgacgttagtttgtaaatagcagggctccttttccacgtagcggtaggacaaaggtaggtacaaatggatctcttcaccttacgctgattcaggcatcatgtgggctttatagagagggggcatttttgcacagtggttaagagaaggctctgtatccatcagatctgggtttgagtcctgcctgcatcacctttgctatgtcacctgggcaggttctctcaggcctcagttttctcactcataaaatgatatttgctgataaggtggtggttaggattaactaaacagtatgtgtcctcagtatagtgtctggtatatactgaacgtgcactgagtgttagacactcttgctatctctgacagctttgtactgagcacctttggggttgtgggcaaggcaagcctgcttttgctgctgtgctctgaggggcattgctgctgtctacactgaaccctggaggccgcctggtattggagactggagaggggtctatttacatcccataaaaatggatcttacttgcagatatccatcatggctcaccctcctataaaccagttgaagcttacagaaaaccctcgtatatgtatctgttcattcctcttatgggagctgttgaggacagcagcagagtttattttctctcctctcttgtcatcttctgtttctctacctggggtaggtgcagcaagcagcaaagtgctaggcaaatgtttaagcggtggctctcactcatagtagaatgacctagggagcttaaaaaaatctagatgtctacgtctcagggcagttaaatcaaaacctcgagttagtgggctggggagcagagggggtgagtgttgggcccaggcgttgtggtggttttttaaaaaagctctccaggtcatttcagtgtgcagccaaaagctttaataagccacagctggataattgcaactgaaaggcattgttcctcctcttgtctcctcccctctcataactatcatttaaaatacccaggctcccccacctccctccactcctttttttccccctctttctttctcaccaggtggaggggaaataaatattgaggctggccttcattttagtacttaggactctggggatccctagtagaggttttagtttacctcttttcactgttgatttaatttgaagatactgtgcagttagccacagcgtgatgaggaagttgctttggtggtgcgcgggtgagggtgtttggtctgattagacctgcccaccttatttggagatcacagaattcaactgtggatttgccccttatctgggtcattctttcttctgatagcccacccaactgtcatttgcattctacctatatgtcagaaatgtcccaccatgatggtggaaaaaactctctttatagtaaaacaataggcaaaactgacttattctaagctccttaaacacctttttctttataacttcaaaagtaagacttggctcttttttaaaaaaaaaaaaaagtaaatagatgatatagaaactgaaggatctcacccaaaagctttattgtaatatagcaaagttctggtgctaaaattgagttggataattgtataatgggattttgtgaaggttgtgtttggaattggatgctaggttaagttgcaaagagtagaactttggaaatgagaaaaaaaattccccttggactttttagaatgtgacttttctgcaaatcaaatgtactttttataaggggaaaaacagtggttatcagcatgcatagtgaagtttttctgcctcgtaattgttgggttcttctcaatcggaatgagagctggcgtgttgagaaagccagcatgggcttcgtgggctgggcccggggaggccttggcgcagttcttccaggggctccccttccccatggccttgcagacagctgtgataaaccctttcaccacctggctttcctcacgggctaggctggcccctgctctgtcttcctctcctctagtgtgtgttaacgagaaccctgatttggtgatgctatagcaactatttggttccaagtaagagcccagtgcctgtcttcactttcccccattccctggaaaagagctgtagtccctgagagattcaatacgtcatcaaaggaaatggtgatatggcagagatgtgcattccctgccttggtggcctcatgggtcacctctaggaagagaaagccaaaaggcgtgagttgttggcatagtggtgaggaccaggtggcctctcacagcgccatccctttgtgggcatttcagtagagggcattggtccatttttgctcacctccagttgggtgctggaatttctgcagtggtatctctgctgcaggggaagccctctcaccgtcctcttgtcgggacgtaacccaaggctcattccaactcttgggaactgggaggaaacatcccttcctggagtgtacagggccttttcccccttgttagcaccagtagtgttcagaggaacgagtgtcagggcacttggcttgtggtccctactctgacattatggatccattataggacgtttcacaaaacacttctctttgtgacttctgttccctcacctgtaaggagaggggctggttcagtatcaaccatactcaaccagggttaaaaacacacatggctgcttccctactggaggcctgggctgtatgttctttggaacagactcacatccctagttgagaactgctgttgtgggtgaccctgtagttctggggccccaggttcctggcaggctcacatgtttatgaattctgtggagaaggccggctgagctgtgtgctctatgttgcaaagtctgcgtggagtgggacagggggtagcaccctagcaggcccttcgggtccggtgccaaatctgggccctgcatctcatctctacaggggttccccaaggccttggctcccaagcatccagatgtggctctgaggcagccctcatccctccccactccacaccagccacccaatgaagtaccttcatcaatatttgacgaagacatgaatgaagggtcccttcgtggcttcccatcctctatgggacaaagtcccagctctttcagagttggccctggctccatttcttcctgttctcccacctctaaattgtgcgtaaggaaagcccacactgggtgtgtctctggatcctgtacctgcttcattttgctaccttgatctggaatagccgcccctcttctgacctcctccccccatgatgttgtgttcccctctgccactgcacctatgacatccctctgtctcctctggggctggggtgaggggctgatggcacagtagccacgtccgtctttccttgcagcagctgcatgtagcaggcatcccatccatgtatggatgaatgactctgagggaccaagtggaagggtcatcttaaggataagtgattgtggggtatggggcagacactaggttgttttagatacttattcaaggtggagagacaggcttgggcacgttatagtagaagtggcctgctgaggggtgctggagggcgtggctctccagccaggggataagtcttgcttgcctggatttactgaagaggcaggcagggtgtcaagggagaaaaagtattagtggaaactgccatgtgagaggccgcctggcccagaggtggacagggcttgcccccagggctcattattggggtttgagtcctggttctgccatgttctagcagcagcttttcaagcctctgtttgcttagatgagaaattgctcttaccttaccacagatgtgtcaaaaaagggctctcccagtctctgctcgcttgtttgaggggccagcaggtggtttgggaaaggctttctgtgaagcgaaggtggagagtcactgcagatccctgcaggcgtccagcccatgctgggagatgccacccgttccccactgcagagacggaaggaaaatgagggaggtgcagcaggctgcgtaaaagatgacattaaggagtgcctggattctagaggtgccagtagatggcattgagggggaaaagagtgctctgtgttcagaaagttcagaaaacccagagttgaaggtgagcacctttctttcctgcagaacatttcagagcctttagtgcttgatgttccctttgagtctccaaggacaagcagagatcttcctaagatcatttcatcatagctctattatgttttcattttctttcagaggtaggaagggagattttgggagcatgagaggtgctgacctagagaatgataaaatccactcctcacgttcccctggcagtagagagtgctgcttccctgtctctaaatgcacatccatgaagtttagacttcgctaccacaggcatatattcccccctcctcttcagttcttcctgtgcaggcttgtcacagtttggcttcatttggaggctggcaccagacccccgggctctgcgttgtatgtcttttgacctcaaatgagggggagagacgtggtgtttcccacagatagtgagtagtgagccacctggaatacttgttctgtgggatgttaatggtcgtttcatgaaaaggattttgtggtcatgtaagtttagcaaatgccaaagcaagccgagtgaaaggtgttgttatcatctctcctaagccgcttttctttgctgacctgctgagggagtctgcaagaggcgggggaggaaatgccccttcctgagctttcctgcacccagcaccctttccatggaacacctcccaaggccagtatacgaaggatgatgctttgggagtgtggtgtctggcaacctgcgtctgccactttctgggcatgcacgtctggcacgtcttccttggccaagtagtgctggaagaagacacagggctggatgacaacccctgatgccaggcaagggccacgctagctgtcctcagctttatcagcaacacccttgtctctaggagtcccagccctcagccctttcctaaatgatgggaagtaattaaacagttcatgcatatccctacatttcagaaatcacacagagcccagtggtagttggtgcttggctctgagacctcagtcatactgtgtaagtttctgctggtttgaaggatggctggagactagtaaagtagcaggaaggctgattccactgggaactcccccagactttccatctgattccaccgtgaatgccatgacacttttgtattgttgttttaatgatacttagggataattgttgattcacatgcagttgtaaaaaaaaaaaaagtaatatggggagatccctcacgtacccttaaacccagtttctcccaatggtgacatcttgtacagcttttcataaccaggatattgacatcgatgcagtcagaatgcagaatatttgtatcattgcaaggatctctcccctttatggccacagtcatttacttcttgccctcacacccttggttgtcttttgttttctttttgagacagagtcttgctctgccatccaggctagagtgcagtggtgtgaccttggctcactgcaacctcagtcttccaggtttacgtgattcttctgcctcagcctcccaaatacctgggattacaggtatgcaccaccacacctggctaattcttgtatttttgttttttgttttttgtttttagtagagatggggtttcaccctgttgggaaggctggtctcaaactcctgacctcaagtgatctgcctgcctcggcctcccaaagtgctgggattacaggcttgacccaccatgcctagccccccctggttgacttctaatgtgttctccaaatttgtagttttttcatttagagttttatataatggaataataaagtatggataaccttttgggattggcttttttcactcagcataattccctggaggttcatctaggttattgtatgtgtcgttccattcctttttaatcacagagttgtattccataatatggatgtgccgtactttaaccattcacctgatgaaggacatctagaatgtttccagtttggggctgcttttaaaaaatactgctatgaacatttgtgtttgggtttcttttgtgtgtgtgaacataaattttcacttctctgggataaatgcccaggagtgcaattgacaggtcatatgggagttgcatgtttagtttttttaagaaaccgtcagactcttccagaatggccataccatttgacatttctaccggcagtgtataggcaattccgtttctccacattatggccagcatttggtggtgtgtttttttttttttttttttaatttttttgagacagagtctcgctctgttgctcaggctggagtgcagtggcatgatttctgctcactgcaacctctgcctcctgggttcaagtgattcttatgcctcagcctccccagaagctgggattgcaggcttacgccaccaggcctggctaatttttgtatttttagtagagacagggtttcgccatgttggtcaggctggtcttgaactcctgacctcaaatgatccacccgcctcagcctcccaaagtactgggattacaggtgtgagctaccgcgcctgaccgtggtgttgtatttttttaatttcagccattctgataggtgtgcagtgatagctcattatggttttcatttttatttgcatgatgaccaatgatgttaagcatcttttcatttgcttgtttgccacctgtagattctttttggtaaaatgtccattcatgccttttgcccattttctaattggattttttggttgttttttgttgttgttttgctcttgagttttgtgagatgtttgtatagtctggatatatattctggataccagttctttgttagatatgtgatttgtaaatactttctctcaatctgtagcttgtcttttcatcttagcagagtctttcactgaacaaacatttttaattgtgataaagcctaataagtgttaagttttccttttatggattgtgcttttagcgtcaggtctaagaattttacctgtagatcccaaagattttctcttgtgttttctcttaaaagatctgtagttttatgttttgcatgtaagttcatgatgacatgtttttaaaagcctgaaatagggaagaaacttgaagcttgtggttccacaaaagaaacagcaagaattgcttctcataggaccccagcatggacaaggcacgggttgagatggttctggggtacagagaaggggtgctgcagacagtgccactttggtgttgtaacaaatcatttttggggtgggtgaggaagggctgcgttaaagggccaactcctcaatcccacccatacccatccttaaccctcccggagcactgtcaggtcatatgctgaaggcttgagaaattgcgtggtaagagatattgtaaatcgtatgattgggagatcaaagtctttcagttggggcaggaagcaggcctggttttatttttaaaggcacatcagtggtatccctccccagaggaggagaggatcttgtcttagaggctgcagccaagtgctgaaacagcttcctcctttgcctggaattgcagagctgtcaggaagctggcatgtgaatctcagggaatgtgccagtggccagtagaggtgaggggcccatgtgtaacctcagagggagctttagcgctgcagcacccacagtcccctctctgtcttcatagccgcaggctgtctggtctggcttactgtgccactgtcactccagagagcggcacagcctggagtcagaggatacctatgcttgcatcttggttagctgggtgacttcataccagggtcttaacctctctgattctggagtaggtggtggcttctctggcgtggtggtaagcaatgagcgaacaagtttcttttgttccctggagagtgctcagttctgtgcctttatacttactgcctgaggaaataagagccactctcacccacctgtttaggatggggacatggccgctgaccactccagtcatcctaaatataaatagaggtggtctggctgggccctctggcaatgctgtgttgacatgctgtgggctgagggcctggaagcctacgtgtgggtgtgggcccctggcaggactggggatgaacagtggcttgcgacaggacattccccttcttgttccctctgtatctgcagagtcaggtcctgcctctgctccagtcacatggtgtggccccagtgtagggttatccctgtccctggtggatgccgagaagaggtgggaggtatggggtgctatcaagagaagctgtcttcctcaggtttcttctgcccgcttccctggtgaggcagttccacatcctgactaggagtgtgggatatggattcctgttccgggctccagtcccaactgcactgcttactgctgtgtaaccttcagcaagtgagttgacctttccgtgccttagcatccccatctgtaaaatggggacggtaatagtggccgcctctggggttgtcatgaagattaaatgagggaagatgttaagagcgaagccagcgcctagctactggtaagcactaacaaaatgttagatttgttcccactgttcctgccattatggctactcctgccaccccttctactggaaagaaaatgcagtgtgactcctccatagctaagcatcaagggcaagctccctggacatccatggccctgtgcagcattggaaccacttcctggaggccgcagaagcaccagggctccattccagactccggctacaaaggccctttgaagtttgcaccacctggagcaggcttttgtgccatgagagtgtcgggggcagggggttcaggaggaggttctgtgtggaaaaccctcctttgtgcctggtggactggtggtggaatgctcaggccaccctgggctgtaccaaccctacacagctctccaccacacttcttagtctgctctgcacttaaggattaggtcccaaagttcattgtctacgttttcattaactgctttgtaaatataaatttaatgtcacataattgacaggcagtatgcaaaatggggtggggattccattatcatcgtactgtgagaacaacatcctgtattccctatctttttttctacgtgtatcttctagagagggacagtcatgtgaattggtgggctgtgtgccctgcttttggtttagcatggtggcatggacagtctccaggtgtgtgagtgctgcagaccgctttgcccaaggctgagatggaagggtggctgtgagaaggaggttcattctgctccctttgggaatttggcgtgaggtcagcatgtttctcaacagtggttccattttttcaggtcctagttggtgaggtcagaggaacagaaaccacaatagctcatgtcagagctcattggtcttggactcctgggtgaccccctcccccagttgctgaccagtccctgtggaacttgggcagaggaggtccttgctgtgtgaagtgcagtatctccatcatttcacacccctgggctcgggacttcccacctcaccctagttggcggagccttctttggaagaaaaccatgcatggcagcctcctgataccctccaacgtgggtagtgcggacgcttcttggttaaaatttctggggttagtccctggccttaagggacactctcatcacctcattcttgatcgttgccatctcaccttttctgcttttcttgtccagaaacagttgctcagcccctggagtctggttgaatccatgtctctcattctgtgtcctggttttcttacctccttccctcaaggggcagagctgaacaggcagggacacatgtgccctgacaattgtaatgaagtatgtttagccttcttctcaaagggaaatcagaggggttcagttcagctgtgccgtacccgggatccacggttgtgccgggcttgctggctccacatgacacagcttgatagcccggtgctctgccaactttcagggtggggcctgtgctctacgagggctgagagcttgtggcggggtctcggtgtggtggagggaacaccatcagtgtgctggggtgtggggtagcaggtcaccagggaaaggaaaacaaagggggaagaaaatagggatgtattgatacatttgggggaaaacacagccctgagagagaatcaagtgtctatgttggccctgagcaaaagcgataaatacgtttggctcttctgacccagaggtgggcatatgtggctgggaattctggtggaagtggctcattgtccatctctggcccaacttgagcctggtttttcatctcttagcccaacctggtactgctttgccatgcccagatgccaagacagctgacctccgtgtggacatggaactaactcctcaagccccttagaagtcactgcccatgttaggatggcatagcctttctccctgggaatgtgatccatatgtggcttgtacagcttcctcgggtcagcagtgtccacgtggaactcccaggggaggcgtgtggatggggacctcaggcagggccgagctgtggctagaagtgagtgagggagagattgttggccagccttggataagcataattgtctcaacattgcaagccagtgagggccagtgtttggggttcaattgaatgtgggaaatgcgtaagtaacccccaccccgtgctatttgaaaatcgaaaatccatcgtattcgacatttgcttttaaataggtctgtcagcttccctaccttttttaaaaaagttaactccacgttgtgtcttaaatttttttctttttaaaagtttttaattggatggttggtcctgcctcagtgtttttttttgttgttgttgttgttgttttgttttgtttttcctgagtaatgttccttggttcaggtttgttgtggtgaatgtaagacattgaactaaagttgtaatttgtttgtttattcagcaaatattgattgagtaccttttaagttctaagcgttattctgggggctaaggctatagcagtcaatacgatagactaaaaattcctagccggtgtgcggtttatattctacccagtcgagactgcaggactacttaatactttaggaggttttgttttgttttgtttttaattaatggacttttatagcagttgtaagtttacagaaaaatggagtggaaagtacggagagttcccatatgcccccgccatctcttctctctccccctcacacacacacacacacacacccaccctgtttcccctattgttaacatcttgcattagtgtggtacatttgttacaactgatgagtcaatatcgatccattattactaaagtttatagtttacattagagttcagtcttggttctgacaaatgtataatcacatgtgcccaccattacagtgtcatacagaatagcttcactgacctaaaaatctcctgtgctgaacctgctcatctctctctacccagcctctggcagttaaatattgttactgtctccatagttttgcctttctcagaatgtcatacatttggaatcatacaattggtagtcttttcagatgggcatcttttactcaacaatgtgtatttccttaggagttttgctgctgctcttgtttatttgtgcatcttaaatgcagaacattctgatagtttggattgggtcctgggtcattcatgagttgggtcactctagacttcacacaacacaggtggccagctgctgatcacacctatatattttctttcaggagccgcggctctcacttcatgggggtaaatggtgggtgggagaacaacagggatctgctgtagcaaggtccctggggttaggtagtctcatggggatgggacatagggtcgtctttgcaaggagttaatggaagctgtttgttgaagacccaaaggggagggtgaccctaaaggaagtgaacgggttgggaggttggttgacacaacccacacctgcctttggaagagatgaccctgctctgcggaggctgtgtatacccccacgggctgctcttgtttttatccacactccacctgataaacacatctggaacaccttctgctgcccgctgagaatttgcacaattcccaccgggctgttggttccccccccccggggggaaaaaaggacacccccagaaaaaaacctctttttnnnnnnnnnnnnnnnnnnnngtcactctagacttcacagaacagtggtggccagctgttgatcgtacctagattttttcgtttcagggatccggggctttcagttcaatgggtgtaagttgatgggtgggagaaccaaatgggatctgctgtagcaaggtccctggggttaggtagtctcatggggatgggacattgggtcgtctttgcaaggagttaatggaagctgtttgttgaagacccaaaggggagggtgaccctaaaggaagtgaacgggttgggaggttggttgacacagcccagtcctgcctttggagaggttgaccctgcctggcggaggctgtttatcccgccactgggctgctcttgttttttatccagtctccacctgaataaacagatctggaacgtcatctgcagccaggctgagaatctgccaaaattccccagggaactggtgattcaccagcagcaggggaagagagagggaacaagcaagagagagagacctgcttattctgattctcatttcctgtccagcaaataacccaggctgggctgtttcttacgagacagcagttctttgagtaaatgatcaatttctgcaatagaacaaatgattttgattttaatttttaagaagatggatgtaaagcaggctagagggaaatggtttcaactgtcattctgagaagggagacttttattcaagttggattaggaaagctcttccgcattcacttgttcttgaaaaatgtctcatcttaattttcaagttctgtatgggcattggtcctggcacaagtgcattatcgtaagctgtggactttagcatcaacattatttcttgccaattttgagacttagaattattcttttttttttgtgatcattaggccctcacttattttaaaaaattctactggacacctgaagaagattagattgagcttggccatgttcggtggccccaggctatattcctaatgtgttttttggggaggggtcagaaaggggacatatgagggcagtggcatctgagaatgtggtcaaatgaagcagcatgaaacagggcacttggagctaatggttttcagattcatttcaaccctgggggacttgatttaaaagaaaactaccagtgtctgctaaggccagacatatgcaagctcaatgacctgagtagcaattccatgcctggacattgcacgcctgccaaaaatgcatgcagacatgcaccagaaagcaagtgcagaagacaagtccgtgttcatagctgtgatttttgcaatagcctgaattggaaataactcaatgtccgtcaacaatagaaagaaaaaataaattgctgtatgttctgtcaatagaaatatcgtacagtgatagaaaagaattaactactgctaatgcagcaacccagatggatctcataaacaatgttgagtggaagtagccaaataaaaaagggtatgtacagaacagttttgtgtctgtacagcacagaaataggcagaattaattgtgggtggtagaaattagaggtttcctttgggaggaataacaaccaggagacaggaggagggaggcttctgggtgcggaaatttttctctacattttgtaaaaatcctttatatttcaataaaaatgtttacaaacaaaacaactgccagcatttggccatatggcctgtctgatagtgctgcaattttaaaaaaaatttttttaagagatgagggtctcactgtgttgcccaggctggtctcgaactcctggccgcaagcagtccttctactgttggctcccaaagtgttgggattacaggccagagtcactgtgcccagcctgtgtcttctgacaaggagaaatcatcaccttcatgtgtgtttttgaaatggttaatgttttttggcatttgcagtcataaagtacacctccttaggtaggcatcagggctggtgtgccctgtactaagtttcatcttccgtcagtaatatgagggtctcagatagtctcacattgtgtggattccaggtgtgatatgttgttaagatacactgtagcctcagaaggcatatgtgaatgtgtgcacgccttcattcattttgattattttgagtgcgtgctgtatgtgggtggtgacagtgagtgtgtgatgcagagccttggtaagaattccagtgcagcaccatgatgggcagagtgctgcagggtgtggagtttgatgaaacctgtctgccaggatcactttgttggggtaatgggggccgggggtgttagattttttttccccccagtctagggctagattatgtgaaacttattttctaaccggaggttcaggcgaagcaaagagctattatgtggatttcgcttattcattaagtaagacgtgttaagatttgatcttgaagtaaaactgtggtagatttgccatttcggtgagagtccacactcagatagttgactgtggactttgtgaatcactgtaattgtctggaagggcggaagggcacagcttcttagatcttagggatggagagctggccagcttcagtatgtttcagactaattggcggaactgaaacgaggaaggatataggatatacagtgtggatttctgtcttctgtaaagtaaccctgtttgcccatctatcttcactggctccagtaaggaacctggttgatctcttgaggaacataacagtggtagagagacttatgttccatttcactttctgaagaggtagaaaagacattggcagaaaagactgtgattagtgatgtctgacatgggcactggagggacaatgggaaagttttctctctgcagttaagaggtatttccttattttgcaggtggttaaacgaggtagagaaagagtgatttatacatggttccaaaattgcatgacagcaagaattagagtctgggtctctgcaccccaagaaacacaaactggttgccatagggttgacagggtcagcacaccacagacagtggtcccaatcctggcccactgcttgtttttgtaaataaagttttattggaacatagccacactcattcatttacatattgtctggctgcttttacattataacagcagaactgagtggtcatgacagagacagtatgacccacaaagcctaaaaatttaccatctggcccaatgtagaataagtttgctggcccctggtgtagaaaataggtgcataatttcaggggtcagaaattacccacttgacccaccttgtcccaactgcctttgatctccttgccctttcttcctggctgttatctgtgacatgagatcttttccaccactaacgggaataccttgtaaaccaggctttcacagaactgtagtggaacaatcacttatgagaaaaagttttaaatgttggtttcaaatgcctccatctgtttcactgtctaatttaacatcagctctgaaaatgtagccaactggggagagcttatcttgcctgctttccgcctttgaagactgattttatttttgaagcctttaacaggtgttggtttaatagacttctgctgtattaagttctcctcgctccagagggcagcccaaggggtaaactgacactgtggatggaggcgaatgccacgtgacctggccaccacacacttcccccggtccccataagtgcagaatcactggttttgtctggttgcagagaaaggctgcgctgttcctttgatgaggccaataagaactgttcctagcacaacactgtcctcttgccttgcaccatcctcacccttttttgtaaacttaagtggatccctttgcagcttaccttccctaacaataaagatactccttcctccctcgatggcagatctttcaagatctcaaagaaactgcccttttctttccatccagaacattcaaagtaaaaacttgagctttatctgccttatttgctgagattctgtcacatgaagtcctgtgcacatttgcttctcacacaggactctgggaagcttgtatgagagctgggccacctggccgaggccaagctacgtagaacaggctgagttgactgagaaatggccagctaatgttcagatttagccaagctttggaagtttatgggtggaatctgggccagtgcccttaaaattctgccaggagagcctctcggacgggctagatagggtcatgcttccctgggcttgcatcccggctcctcttgcttcccagctgtgtgaccttgggcaagctccagcagacttctgagcctcaatttcttcaattgcctaagtatagatgcttctcaactgacaatggagttatgtccagataaacccatcctaagttgaaaatatcattaagcaaaaaatgcatttaatacctctaacctcctgaataccacaacctagcctagtctaccttaaatgtgctcagaacactcatattagtccacagttgggcagaatcatctaacacaaagcccattttataataaagttttgaatatctcctataatttattgaacactgagtggaaaacagaatggttttatgggtacttgaagtacaatttctattgaatgtgtatagcttttgcaccattgtgaagtccagaaatcgttaagctgaaccatcgtaagtcaggggctgcctataaagataatagtacctaccttgttagattgctgtgtgatggcattgatgctttgcccaggatctactgtgtatataataggtgttcattaattggtcagctgttgagaggcaataaaaagaggtatggatcttcttgggaactgtgcagttagttatgttaaaggagtgaaaatgatgaccacttgggtttgcatgtggaattgaaaacatggatagtttcctgaaggtggaatgccgggttgagcgagggcagcagacacgtttccatggcatcaactctcaggcaggaggtgggaaggcttccctgcaggggtttgaatgccagctgtttactctaaccttcatgggggggagacctagagagggtatcttagaccagcaggctacctctggaatggtggggttggtggggtttggtgggcttgggtcagggacgtggcctcagttccacttgctgtgggagtgggggtggggggtgtcatccagatgctggggaatctgtcagatgtctagccaccctgaatcctgcagaagttgcagtctgggatttgctttgaaacgtggggtcttcccagtggctgggtttgacactctccagctggagcaggcttcttttatgcttgaagttaagagtgagagctctgagtcagcccttcgttcctgagaggggagccagagctgcttgtttgcactgaaatatgtcagaagagtagacaagaaccagtcattaattttattcttttttccagagcacctcctacagactagatccttagcctggctctgatgacacaagcatgactactaaaaacaagaactcattttattgagcagttgttacgtgtcaggtcatatcagcccatggggcatatgaacttcacacatcactttacagaggggctcttctgaggttcacacctgtgagtgggatagctgggatttgaacctgggcagggagacactcaaggcatattgttccacagtgctgtgccatgttccacagcaggaagaactccacatgtgccttggagaccatggacaggacttacttgggagacacaagaatcatcatttgagatttagacagaggagtgctgtgaactgagtcacattttgttttaatttgtttcttttgagatggagttttgctcttgttgcccaggctggagtgcggtggcgtgatcttggctcactacaacctctgcctcccaggttcaagcaattctcctgcctcagcctcccgagtagctgggattacaggcatgcgccaccatgcccggctaattttttatttttagtagagacagggttgctccatgttggtcaggctggtctcaaaactcctgacctaaggtgatccgcccacctcagcctcctaaagtgctgggattacaggcgtgagccaccgtgcctggccttgttttaattttaaattgtggtaaagtacacataacataaaatttaccatctgaagtattttttaaaatgtggagttcaatggtgttaaatgcatttatgttgtgcaaccagtctccagaacttttttccatcttgcaaaactaaaacttcatacctatttgatatggtttggctgggatgatgtctacccagatctcatcttgaattgtaactcctacaattcccatgtgtcatgggagggacccagtggcaggtgattgaattatgagggtgggtccttcctgtgctgttctcataatagtgaatgagtctcacaagatctgatggttttaaaaactggagtttccctgcacaaactctctttttgcctgctgccatccatgtaagatgtgatttgttcctcctcgccttctaccatgattgtgaggcctctccagccaggtggaactgtgtgtccaattaaatctctttcttttgtaaattgcccagtctttgtgtctttatcagcagcgtgaaaaataactaagacagtaaattggtaccagtagagtgggacattgctgaaaacatacctgaaaatgtggaagtgactttggaactggataacaggcagaggttggagcactttggagggctcagaaggcaggaagatgtgggaaagtttggaacttcctagagacttgttgaatggctttgacaagaatgctgatagtgacatgaacaataatgtccaggctgaggtggtctcagatggaaatgaggaattgttgggaactagagcaaaggtgactcttgttatgctttagcaaagagactggcagcattttgcccctgccctagagatttgtggaactttgaacttgagagagatgatttagggtatctgatggaataaatttctaagcagtaaagcattaaagatgtgacttgggtgctgttaaaggcattcagtttcaaaagggaaacagaacataaaagtttggaaaatttgcagcctgacaatgcaatagaaaagaaaatcccattttctgaggagaaattcaagctggctgcaggaatttgcataagtaatgaggagctgaatgttaatcaccaagacaatggggaatatgtctccagggcatgtcagagatgtttgcggcagcccctcccatcacaggcctggaggcctaggaggaaaaagtggtttcgtggggcaggctcagggtccctgtgctgtgtgcagcctagagacatggtgtcctgtgttccagctgctccagctgtagctgaaaggggcaacatagagcacggaccatggcttcaaagggtggaagccccaagtcttggcagcttccatgtggtgctgagcctgcaggtatgcagaagtcaacagttgaggtttgggaacctctgcctagatttcagagcatgtatggaaatgcctggatgcccaggtagaagtttgctgcaggggcggggccctcatgaagaacctctgctagggcagtgtggaagggaaatatggtgtggccctcatgaagaatgtctgctagggcagtgtgggatcccccacacagagtccctactgcggcactgcctagggaagctgtgagaagagggccactgtcctctagaccccagaatggtagatccactgacagcttgcaccgggcacctggaaaagccgcagacactcaacgccagcctgtgaaagcagctgggagggaggctataccctgcaaagccataggggtggagctttcccaagaccatgggaacccacgtcttgcatcagcgtgatctggatgtgagacatgactgccccgctggattttggacttgcatggagcctgtagcccctttgttttggtcaatttctcccagttggaatggctatatttacccaatactgatacccctattgtatctatgaagtaactagcttgcttttgattttacaggttcataggcagagggacttgcgttgtctcagaagagactttggactgtggacttttgagttaatgctgaaatgagttaagactttgggggactgttgggaaggcatgattggttttgaaatgtgaggatgtgagatttgggaggggccaggggcagaatgatatggtttggctgtgtccccacccaaatctcatcttgaattgactcccacaattcctatgtgtcataggagggtcccagtgggaggtgattgagttatgggggcaggtttttcctatgctgttctcatgatagtgaatgagtctcataagacctgatggttttaaaaacaggagtttccctgcacaagcccttttttttgcctgctgccatccatgtaagacatacttgctcttctttgccttctgccatgattgtgaggcctccccagccacgtggaactgtgagtccaattaaacctctttctttcataaattgcccagtctcaggtatgtctttatcagcagcatgaaaatggactaatacaccgttaaacaacagatcttccttctgcggtctccccggtccctggacaccaccattctactttctgtttcagtggatctgactactctagctacctcacataagtggaccatacagcatttgtctttttgtgacaggcatctttcacttggcatcatgtccgcaatgctcatccattcagtagcacgtgttagaatttcttttctttttaaggctgagtaatatctcattgcatgtatatacaacattgatggacatttgggctgttccacctttggctgtggtgagtgatgcttctatgaatgtgaggatacacatgtctctttgaggtctgctttcagttatttagatatgcagaagtggaattgtgggatcatatggtgtgcctctgtttaattttttgaggaatctccataatgtcttcttctgcaggtgcaccaccgttttacatttctaccactggcatacagggtttcactctctccacatcctcacccacacttgttattttctgtttgtttttttgttttgttttgttttaatagtggccatcctagtgggtgtgaggtgacttctcattgtggttgtggtttacatttccctaatgaatggtgatgttgatcatcttctcatgtgcttcttggccatttgtgtgttttctttggaacaatgttcaattcttggctcattttaaaaatcaggttggttgttttttgttgttgttgtagaggttctttatatctggatattagccccttatcagaaatgtgatttgcatatattttctcttattccgtgggatgcctgaagtgacttatttttaacgggtctctctggctgctgggttgggaatagactgtaagtgggcaaggatggaagggaaggtctagtcagtagcccatgggcatggttatcttccatttccaagctagaacattttgaatcattattgatgcccctagttgtcatctccagcccccaccagggcagggtgtttcaaggtaggatgctgaagttgggaggagacaggtggggagaggccagcagctttgatcagagggtggagctggtagggtgggtaggacctaatcagagggtctcttgtgcctgtctctgtattgccgccatctctctcctggcccactgtggcatccattcccaacttgttagcttgggctgcgaggcatttgctgttgtggtcctgcccaccctactagctctgcaatctgatccaagctcctggcttctgcctacctgtctcctcctggcctcagcatcctaccctcagacattcgccctggcaccttgtgcactcccttgctcctctcacagaccctgccactgtggccctcactcccacacacccttgtctcccatctccacggctgcctcttctgccaaatggggaactttcccagcgggtgaaagagacttgtcttctgcacagggtcctttatgcagagtggggcccggattgtgtttgattcagcgaatgaaaagactgacaaggagcaaaaggtaccggaccacagacaaagactgaggagacagaggaggaggtggggagaggacagaactggcgtgggagagatgttgggcctgcagctgtcccacggcttcgcaatgtaaggcctcaccccctctttgtgcctttctgggccggtggcgcccggcccttctgtccagcacagacccttttcctggcgccctgataccatattcacagttcccggataagactcagctctgtcgcctttatttcttgtttcttttcttcccgtactttacataataaaggttttcttttcttttttcctttggagccagaaaactgaggagactatctttattaaagaacttaataaagaactcaaaggaagtggctttgggggctggggaggagaggaagggaaagggtcctttcatgccagggaggttctgtgtgcagagttgcacccctggaaatggactttcgagttcagggcctgggagacgcatgaaaaaaacaaaggagtccacgagaagccccagagcttctgggaaagaggtccttgtttatgcctgttggaactgattcggtcaagtgtttgtttaaaggagatgccacttggtaagcgacgcctggcttacttgtgttgtgttcaagaatgctttgattggccagagatgctgacactgtttattcagaactggctcgagtgccagtgcctgcaacctagaggcccagcgccaccacccagcagattcctaagtgtctaatattggagtgagggctgcagtggtttgactctgccaggcggcgccaaacccacaacagggcggttagctacctctagccttggctagcattcgtctttctcttgacttataactgttgcttgtttatatagtgggtttgacagaaagtagattaaaggtgcgcacaggccagctgtggtggctcacgcctgtaatcccaacattttgggaggccaaggcgggtggatcatgaggtcaggagatcgagaccatcctggccaacacggtgaaaccttgtctctactaaaaaaaattaaaaaattagctgggtgtggtggcacgtgcctgtaatcccagcgatctgggaggctgaggcagaagaatcgcttgaacccaggaggcggaggttgcagtgagccaagatggcgccactgcactccagcctggcgacagagcgagactgtctcaaaaacaaaaacaaaaacaaaacaaaaaaaaaacacaagttacagtggaacattcctgtcttgggaggtggtgaccactaaacatttaccttcagatttgccacatgctttatgtggttttaggccggatcgtccctatccctgaagtgatgggttgtggccccatcttccaaatgagaaaaccgaggcacaatgcttaatattaatggtagagtcgggaggttcagggaactcaatttcagttagactcagcagtgagctcctctttcccattttacattgtcaggattttgtcgtaatctttttttttttttctttttctttttgtttaaatcctctgtgtctggtatatggtaggtgttggtaaaatgtgaggtgtgtaatgatgtgttaaactggattaaagtgaactctgggctgtggtgcctatggctcttgtaagttatgaggctggactaggtctgaggatgatgggtgagagttggactggagctgtctggctgcacaggacagggcacatcctttatggtgagtgcatccgtggattctggtcaggtcatgctggtctcacatggtcttcagtgtcactgctgtgttgttgcccttggagagggaagcctagggatagaactttgataaacttgtcccagattgaaaatccaatattctcctagcatctggccagcaggtaataacttgatgggaaaagaaacaggagatctcatttttaagagcgtcactgcattgtagttatattggtggggggtggggtgcaggaatactagtttcttgtagttactttgcaaaaagagatgctcaagtcacctcccttgttgtgtttcaggcagcacaacaagattcgcagcgtggaggggagccagctgaaggcctacctttccttagaagtgttagatctgagtttgaacaacatcacggaagtgcggaacacctgctttccacacggaccgcctataaaggagctgtaagtgcctctgttctgccacctgtggctggcccgctgtgtccagccagctaacagcttcaccggcacccagttctggatgcaggagggatgcttccttcccttctcaaccacggctgggccgagtcagtggggatggttcagaccttccctgagcagggcaggggcgagccccatgcatagagcatgtccagatcctgcagcattatcctgacattacagacagacaagggacagaggcaggaaggactcagcactccaagacgagagtctaggactcaagaacagatcgatcttgaccacaaagcctgctttttttcccatttccttggctgcctctcagaaatgcttccagaggagattcagggaggatggttagaggattcacattggaagcctgtctaacagggcttagcttatcagtgcttatctttctagtgtcatgcactgtaaaacaagtcattgggtttgtttgggggagggcagttactctattatgtgggttttcagcaccttttagatttgtctgtttctcttacccatattaatgtcccatctcacacacaatggatggtagacaggaaggaaaaaaagttaaaacctacttaatcaactacttgttggtaggaaaagtgttactctgggaaagaaactgcaaccccaggctaaagagacgttttccaattccaggtgagttttcattccgtgtgtcattactgttccagagttaactttggaacgcattcgcaaggctggtttaggggtcattgtgacccatcttttcagggagggtgaggtttggcacatggattttccaagtaaatactgcaagaagaagagtgatttctttcttagcctgcattagggcgccagagttgggaacaggaggccttggcttttgtgaagcctccagtgtgggccctcaaaaggtgtccacgtgacaccactttgcttgggacagagaaaccataactgctacactaagttgctctgacctctccctgcacaaaagtgggagggactttctattttggcagctattgggtgatatatcttcatcacacaggctgttctttaatctgaggtgttgagaacaaacagtccagcctcatttgcaaagaatccttatgtgccttgtcctaggccactatctgctggagagacaaaaagtgccttgctcccttccaccctctgtggcagaaaatcctctctggtctttctccttttcacttaggccagaaaaagcagcatttgtttggggaaggcagaggagaggtgttggaaaccacttctcacaggaatgccatattgttcttccttgtactttcttttcttttttattacttgatataatttgcatacagcaagatgcacagatctgagctgcagacttctgtgccttttgagaagcggtgtctgcctttttgtattgtcacgggagatgccccgacttaatcacgctgtaagtgtaggtaccatgacatattgcttgttttacgaagggattctgcacaggtctcttcagctagagtgtttctttgaggcatttacaattacagaaatgaattggtttatacatatgtgttatgtagttcatatagcaagacccacctcaaaactaaaggctatttctctaaattattaaattaacactgaccttgcctttcagttgattttctgctttctaggagttttcacgtcaaccttgggcactgggtggtgagaagagtcctgcaggtggctcctgacgcagggctggtgtgtcagtgggcatgggggtgtttgactttcactcccaccctcttggggtggcccagcagcttcaaggacagtatgctttcgactaaatcggccttgccctcagggcttaggtgcacagtcctaacacctgcatctctctagctccccatccaaagcctgtggctgataaacatctcactggaaacctgtccctctggtgtcttaactcatcttcccaactcagacccagagaggtctggtgtctataatgaaatgaggaaggcctttgaccaaccaccacattttcttttctgaatcattccagcaacctggcaggcaatcggattggcaccctggagttgggagcatttgatggtctgtcacggtcgctgctaactcttcgcctgagcaaaaacaggatcacccagcttcctgtaagagcattcaagctacccaggctgacacaactgtgagtacagaaacctacactttaattaaggctagccaaactttatggaggccagatttccccaaggacctcgtaccaaacgccaccctttccttgctccatttggtaaagctctccataaattaccattaatggcagcacctcataaaagcaaattcggagctgggtctggtgctgtggctgcttcaggttgctgagaaagacatccactgaggtcgcttttcttccctgatgttttccaaaatggaatcaggagtcctgctgcttagctgatgctggctaatgctgaggctgcatgggtttgggttcttatttatcttagatgtttttctgtatttttttaagatacccgtaaaatctgtaccttggacatggtggtgtccgacacttcttgaacagtttgagaggaagttagtgtagctggagttagtaagcaaaagacaagcctttgtcttcatatctttaatcttacaaggtagttgatttattattattattatttatttatttattattatttttttttgcgacagtctcgctctgtcccccaggtggggtgcagtggtgtgatctcagctcactgcaagctccgcccccggggttcacaccattctcctgcctcagcctccagagcagctgggactacaggcacccaccaccatgcctggctaattttttgtatttttagtagagatggggtttcaccttgttagccaggatggtctcgatctcctgacctcgtgatccgcctgccttggcctcccaaagtgctgggattacaggcatgagccaccgcacccggccgatttattatttttgtaaacaatttaattgtttagtttactgatggaaggctgagtacccttctagaaggcagagttttagattcaagtaaagctctgttaaccagagcctgacgaaggactttttttccctgatttttttttttcctgtgccctctttttagcagaagaatgtatttcaggaaaataagacagtattggaaattttgtttcaacaaaacaaaataattgtcgagggccaggttggcggcacgacggggtgtgcctggctctcatcctacctgggtttcacctcccctgggtggggagtcctagactttgccattttcagtctgtggagaaggtctcagtgattcctgagaaggtttgtgtggggcagcatcatgagacactgcagaaatatttggggaaaaccaagggctttctggctgctctgcctccccttcccgcaggggtgctaatggatctggcccacccagattcctgacatcttttggtgaactgaggctttgtcatactggggctagaagccaagtgtatatgacttgtggggtgtctctaccccatctccccctgcccccatgtgcagtaacttctctccatagtggagatgctgtgaaatgcccccagtggaaagtgttattgccatttgatacatagtggtttggtttttcctgggttgaggcatgtggtgtggatttctgttgctgagctcagagatacctcacataagacattcaccccttgagtcatacccacgtcctcactgcagagtcacaaatggcactggtgctactgggggaggagacgtgagcacacacgcgttctcttctgtgcagctgtgggccagcctcggagctggctgtggagagctggcctcactcacccctcttgcctgcactaggtgtggtcaggtggcagcatcagtgcctgcatggcagccgagacacatggtgggctcccctacacatcctggcttcccagggatccctgcactgggatttctcctctggcttggaaacttagccaggactgcttcagaatggttgtgggtgggatatgcacataagacactctgaccctgctggcttcatctctttagggacctcaatcggaacaggattcggctgatagagggcctcaccttccaggggctcaacagcttggaggtgctgaagcttcagcgaaacaacatcagcaaactgacagatggggccttctggggactgtccaagatgcatgtgctgtaagtgcggaccaggttactggcattgctaaggattgctgtgtggtgtggtgtgatgtggcgtgtgtgtgtgtgcgcatgcatgtgcgcaccaacaccaacgttgctgtgtgttgggtgtgtgcgcccacaccagcattgctgtgtggtgtggggtgtgtgtgcgtgcgcgtgtgcacgtgcgcgcccacaccagcattcagctgtgcactgggcatggagtggggcaccagtgcccagcccctctctcctgaaggattcttcaagacttcagccggacccagcccccttccctttgcagcttcacctgggcccaactcattgtcttggggaccgggccaaacctgagggtattttcctagcagattgggacatccactgaaatccacttgggggaagtttcagcggattgagtcagataagttggttgatggagatggagtttgggggccattctgccaggactgctttccacagcttgcatccactgcccccgcccctgcttcttcggtgaacgtggggctgcggaacagacccctcctcacatcctctccactcctgaccacaggaagttccttctctccccttctgggtttgacagtctttcctgaggtgcaggtgggccaaaaatgtagagctcatcttaggaggtttatttctgtcttgtgagctaatcaagacactgggtgcagatgtttaagttttatcaagggagcagtctcttcagccagatgtgtacagcagcagaaggggcttgcctgcacggtaacgtgaaacagcagggcagcatacagaaaaggctttttaaacgttgaaagcctttttaaacgttaatatttatttttaatcaaaagtaatttgactgtatagttaaataaaatcagatagtaaagaaaagccatcactgcccaccccagcctcccccgccaccaccccctcattctctcttcaccccagttcttctcccaagaggcaagcacttctaagcctttctctttttcgtttttctgtttttagctttgctggttgttccttccaagttgatagactgacaccactgtctttacttatccacttgcgatttcctccttgagagtcaatgatttaacttgctcatgtccgccccttcttcttccagtctgggcaaattatatcatgactcgaatgtcctttactggttttcttggcagtggaaacgagctaggcccaggtccatccacatgttgtgctgtgtcactctgataaccgtctctgcatgaccagccctccctactctgtgaacagtgaggatgtttcctgccgctgggcttcttgctctacccattctccaccctttgttttacatattcaaaaacgtttcacttgacctccttaggcatgtcattttggacttggaagtccaaggtggtcatgtgctgggtggactgaagttaaaagagaattctcagaggaaaatggagttagcacctaccatttggtttttatgttgaacagatttgtataaattgagactgatgagctgccttagaggttatttatacattaagtgcttaccttttgagcagtagcagaaagaaagatggaaaaaagcaaaactcagttacccaaagcccttgtaatactgaacacggagcaaaattcgggttacggacttttgttgaagaggcggttgcctgggctggcgctgtccttcctggcacatgctgtgttgggaagcggggtgctagcacacttacacggtgggcctgagagctcaggcctagagctgcactgaatcctgatgtacccttgtttccttcttatagtgaccccatggagtcagtgctcttggatatctccatgttagtagatgtgcaggtttattcagccagcaagctgcaaaattaggatttaaatccaggtagtctgacgccagagctaaagcgggtctcctagcacagtggcacagagtccagcctttggtaggcagacccagggttgaattaattctagccccttccctactggctaagctgtgtaaagtcttagacaggttacctggcttctctcagcagcacattcctcatgtgtgagatgcgggtgataataagagccgcctcctattcgctctcctttctattcctttaatgggctttgcccttgcctggaactcctgtgcccgtttgttggcctgggtcactttttgttttgtttttggtagagatggggtttcgctatattgcccttgctggtctcgaactcccgagctcaagcgatcctccttcttcggcctccccaagtactggatgggcataagccgccacacccagccctggttcacttttactcagccaaaaaagtcacttctaggaagctccctcttgccctatgaacactcgagtcggccttggcatgtgctgtcatccattttgatttgcctgtcttctcccagcccctactcacatgcacatgtgtgcgactagactccacagttctgtcgtgcactgttctagccttggtgtgaccgcagtgtcaggtacagcgtggctgctcatttgctgtctgtccagtgaagggagtgaaagctcctcttcatcctgtgcatggctgtcattgcaggcacctggagtacaacagcctggtagaagtgaacagcggctcgctctacggcctcacggccctgcatcagctccacctcagcaacaattccatcgctcgcattcaccgcaagggctggagcttctgccagaagctgcatgagttgtaagtgtcctcggctctgggctgtggcagtgtttttagacactgcttggaggtgaaagtgctaggcctggttcgttccaccacacagtggcctcggggagggctcagagacaggccagtagccctgttcccaaaccagccaggcccagggtggaaccctcagcgatttgagccccagtcccttcctcatctccccttcacttcctctgcatttgtattagcaggggctccaggagtagcagctaggtccctgcagggagccttggcccccaaggtcctgttgggtttggagacagttccaggggtagaaagttcctggggaagggcagctatggcagagtgctcacaggagccattttgagagtgactgtgtgttaatggccacaccaaatagcatgtgcttcttcagtgagggggtcatttgggctcaaacagagacagtgaaacgctgactgtggatgaatttgtgtcctcggagtcgccaccttccttcctgtagatgagctgcccaggttcttggccccttccctttctctgttttgcaccgcagtggcctgctggcagaggctcctgtgcagtcgtgtgcgtgcttagttcagagatgtgtggtgtggtcctcttgctccttttggagatttccagacaggggtcccaggttgagactgagaactgagcttgtcttgcccaaagttctgagattagtagtgacagactgtcgcctgggtagcgatgggcagtggccctggccaccccatcatgtcagggtggggttactggacagtgaacgcagcattcctaaggactcagagaacatctttacaagtctatagtttgtgttttcactgttctttccatttgatatgctccagtttagtctactgtgtttctttatttttcacaagagttgggtgggtttttttgttttgttttgtttttttcttccttttctaggcttggctgttggaaaaaattcacccactgaagtgaatgattattaagagtgccaagcctcagtctgtcctgtctctctcttgacctcaccaggcaaactcaaggggatgcgtgaatctaatgtggattcttgcagctggtgtttgtgtctggtcttctgtgttctcctctctctccctgtccttccttccctcctcctccccccctccccccaccacacacacacacacacacacacacacacacacacacacacacactgacttggagtttatattttggtgactccatcattatctaatgcaaaacacagtggtcctgcctctttcctaacttttcttggattctgtgagtgttaaccctttggtttcagcttcctacgcttcagggcctgcagttgtgcattccatgtggtgctggatggctcctttcaggctctgtagtcaagctgtgaccccaccaggggactcctggttttgttggtcagggccgggaggtgtgggaagcaagagaggtcttttaagtccccgaagcctgagccagtccaattcttaaagtgaggggccatcctctgactcaccagtgtatcgtggccccagggatggcatgctgtcttctgcggggtccgggatcccctctctagctggtggaaagcatgaagccctcttccatgccctctagaaggggcagcaaagatcacagaagtgcgcttgagcagtcctagcagtttgcaccatatccaggtaacctcagaggcagatttgggattgcttcccagcatgtgtttcccacccctcctttaagctaaattctttaattgcaggtgaggatataattttgatctcctgccaggtctgtttaactgacagacaccctgacttatttgtccaggagggaaagaatgctgctcctagctgcctttaaaagctcattaatcttctctgagtttattttccatcttcctatccctgccccagccccaatttttcaacgatagatgaccaatatgtcacgtaagcaacccagaggtgcaggagtgctgggaggaagctttgattctgaggttcaggcaaagcatgtgcttttaccgcctgcagtaggggatcatgctctgaggtccacgtggatgggggcagggaggcctgagcaggagcctcctgccctgggggagttgccccactaaggcatgaggcacaggtgtggttgtcccacgcaggggctagtggtgccctctgctggcagatgcagggagtgtgactggggctccctggcttgctgcggggtcatctccagaatcccaggcttctgctatgagagaggtcttttgtagcctgaatcaggagctgccttggacagcatgaaggcgctggagcttgagagttgttgtgtgtcatgacctcgtgtgtagtcttcacagtttaacagccaccctggcccctgtgacctatgcacccattctacgagtcagactagtgtgttgggcactgatgagtttctagctgcatggccacttttacccccaggattctgtgggtgtgggtgtgtgtgtgcgcgcacgcgcgtgcgtgtgcatctgtgtcatttcccactgaaacccagctgactgtggcccaatttccggtggggtggggttggggggcaaccacactagatggtgacattgctgccctccctttcctcagggtcctgtccttcaacaacctgacacggctggacgaggagagcctggccgagctgagcagcctgagtgtcctgcgtctcagccacaattccatcagccacattgcggagggtgccttcaagggactcaggagcctgcgagtcttgtacgtctcccactactgacaggataaaggggtccccagtggggagagcagaatagagcaaaccatctgctttgttgaactccatttgcgttggcttcgagtcagaattggatccaaagctggcttgctctatgtgcagagtctcaaacttttatgtaatcaactgaaaaagaactggttaagcagaaaaatctctcatttccccaggatggtgcctagagagggatggcagctcctaaaaagtagttgttctcaagcagtgatgcccacgttgtgctggacaggatgctggctcctagtgttggaaaaagcttccccacgctgagcgcctggtgcagcctccagttcggcagccgtgggtcagtctttcccatcttgagtcttcagctgcaacttccaagtcctgaatattttttctctaaaccatgggaatactgcagtgcatctctcgtctgagcatttgaacttcttcagcataacctgtaccaagatgcctcctttccaaaagcagcacttagggaatcctgtgtctctccttgtacctcgtcgggggtcagttaacaaagtggaggtgctaatgccatttcccttgaagtccctaattagatggggttggcaaaagtggctgcaggatgcttttctgaggcttgtataaaacttttccatggttggcttcatagaacttccaagcagctgtcagcataaaacccccagagaggggcatgcaggtttcagaggacagtggtggcgggttctagggtctccttctcaggcgtaatccactgcacagagagggatctgttccagtgtgacagggagggaggcctttgcacttgcacctggcagagccggctttaatgtggagccattgccagggagtgtgaaagaggccggagccaagctattcaggccaggtcagcctgtgagcccatacaaggcccaaataacaaggctgggaacattcagactgagcgggccagaaaggagagaaaaactttggcagccagggctaggagcagagagacaggcacacaaagccacagccccgggtccctggttcctggttttttcagtatgcagatgataggaaggaacccattgagaggagaagtcccttccagcagcagaatctccactatttgaccttcctgctgtgacaagaaaggtcaccgccagcatttcactcttcagtcagagctgccctctctgctggcagcattgattcctgctgcagcttctcacaggagacaagagttccttttctctccctggcctgtgtctgcaagggctcggggggaaaatttaagaaccaagaaccttgtggaaagttggagagggcaggatgggggcctggtctccaggtgtgatgtctcgcctgggcactgtgacctgctcctggaagctgggaagccattgagtcatcggccatgggatttgcattgttggaggggcctgggctgagttggcctcatccctctgatcctggcgagtgggtcacaagtctgactcagcacccagatgtcctccctggctcagagtcagcgccctgcaggccttgggaggagatgggctccgggctccagacccactggctggtacggaggcgcccacgggccggccctgtgccgggtctctttcttccatgtgctttctgcagtttctcggtcatgtccagaaaagggactctggttggtatgagagcagacgggagccttaaggaaccttttgggttgattctcagtgctggggccagatgtccgctctctcggggcagaatacagactgggctgtctgcaccacctcccttcccttgagtgtggcctccgcagacagggaggcaggtggagcccagggaagtttcttgtctaaggcatgtgtcatcttggttggaaggctgagaaacagggcttccctcccagggccacgtgtctcttcaccctacgtcccggctgtgcctccagggtgcatgcacccaggggacttcagcttccgagcagcaggctgggtgagagtttgctttcccttcacgccccgactgctcggtgagctgctttctgtcctctccccagggatctggaccataacgagatttcgggcacaatagaggacacgagcggcgccttctcagggctcgacagcctcagcaagctgtgagtatccgccgcacggagctccgccggcaaatgcgcgggacacacttgggtgggagatgtttctgtggcgccccccgcgcctctctgctctgggcccaggcggaagaggagctggcttttgtttggggcagagcttgttttgtttgtggagaagagtttgaagaagagggtgggggacaccccactccttgatggcctgggtgttgggttcttgggggctggcaacccggcgtttggcggctggtggagcttctcttgggcttcactcacaactcacatgaaaactgctgaatttgctgttgccctttgtacaaaggagtcttgccctgttactgggtttctcaaagttgtgtaaaggtcagtaaggtgtgagggcggtggggctcctgtcagtactttcgtcattaaccatcatctcaaataaccacgtcatttccaagggtcgtagtagcagctattttgaatgtatggtttggggtctttttcttttttttcctagctagctcctagattttgccagttaatctgccaagcacctgtgtgtgttgtacctaatgatctcatgagggcaggctctgttaggcaacctctttattagttgaggaaagagaagtgaggggattttgcccaaaactacacggctggcaagtggcaggctcaggatttgcttgtttggctccaaagcccacgttcccttccccttggcccgccctgttttctctgcgtgtaaccagcactttctgcagatgccacccaaggaccgtgcaggaaggggacgagagtcattattactgtttactagcagctcggagggaagactggaggagggcaagacagagaggacggctgccgctcgattcccccagcccgtccccagtgacggggagctcagcagagtgcgagtgtcaagtaaatatttggaaagccctagtggagctcgatgatagaggagagcctgtggtagggagagtctttttatatagtagatgcttctgatttgttttgaaaagcgtggctttttgcaccttttatatacaagggtcctgcttaggaataagctctgttggctgtctgaagaaggtacttcttgagcgtcctgtactccagcagcatgtcggagatgcttatcagtgattcttctccttattgtccctaaaacaatgctgattttccccagcctttaacccatacgtgacccctttttatcccatacggggcaaacctgggaagagccagaagtaccaagtggggtggggcagaggccttcttagcaagaagagctccaggcctgggatgtggctgctgaggtgttcagcactggcgccaccactcagcataagcctccctgacctcggccataaccgattgaagggtgagggtggtgagagtgggcagcactgccaggttcctcgtggggcgtgtcagtccggaggaacctggagccgtttcctgggtgtcatggcttccaggaggctctgtctcaatacagaaggcccgtgaggtgtgcctggccctgggtcgcctgggcttccagtgctgcatgagtccgccactgccttcctgagtgcccgccctctgtgccctggtgctttctcctttgtccccctgctggactaggctcagctcttccacctgagccccaagaggtcagcccaagcccctgctttcctcactcacataatgttgtttgtagtgagctggtcctgagactcctgggaacttgttaaaatcgaagcctcaccccacccagccactgagtcagcatcttggggctggagactctgtgtatgtttgaaaaagggtgagagagaaagacatgcatccaagtggggaagctgggacaataattaaacaagaattccttaatatgattaaatatatgcaatcacttatttaagtgtgatgctatcatggttatgtggcaaaagaaaaaaatgaatcattttcttcttggataaagaaaatggtatgatgcctatgatttggattccataaactcctgctgggtttgagaacgggcagtggctagaggtagagatgaggtgagattggcacgaccggaggaggattggcactgtgtcacgggcacttggggttcaggatactactccgtctacctagcatggtatgtgcaaatttccacattgaaagggaaccggagaagtaaatgcttctcatatgatcatggtacacagggctatgtaaaaactgctgtgtttggcctatcacaggtgttgagtcgatgtttgttgaatgaagggagggacagaggaagaacccagtgcctctttggtcccctccccacccgcctactcagaacattccaggaaagttctgcgctgtggccctggctgagagaagtgaccacagacagcactgtgttgctctgtgggagtggcccagtgccggcctgttaggatccactgagaagtggggtgcgtgttagcacagagaagagccgcccctctagagcagctgatccgtcctgtggggagtgcagccagtgcctgagtcccttcatttggtgtgggtttgtttttggagagctcaaggagcttgtgttcagggtctgccctaggatgggaaggtagagacccctgccttcgctgagttactcaaggaagaggtcagacctaaattaaaatgttttccaagaaagggagatgtgagtagcagagccataaacggcctctctgtgaatttggggtggatgctgacctgcccttaatttttccagcttacgcacacagctgtgttggagagagagttcctcacactggagcttcccagcagggtgggaatgttcctagaccccagcgcatgcctttcttcctaactggtctgggattctgctgtagacccactccagggcctgtttccaaatggttgtgcggttcccgggctggggcctgcacgatggcacagagtcagtacgcgggagggaagggagaatttctggatcccaaattacaggcagagaggagcagttagtgacctgggtatgcgacttcctgcccagtggttccagctggctccatggcattcctcggagggaggggcagagtcccacacagggcacatgggaaggggcatgtttgggggatcttgcagagctgatgtgagcgcagcctccatccctgcctatgtgggggccgggcctgcagtggaactcattgtgtgtgtgggtgggaagcgggggctagtgcacatgtcgcggctacttccaaggacatgagtacaaggacccatgtgagcattgcccccagtacctgccacttgatttggcaagcgctaaccaggcctttggagctgttggctgggttggccaggagatggatgggaggtttgacaggtgactcccgcaggtcgctttctgttccaggttggtgctggggaggtcaggccaggtgttccttctgaaagggagcccggctgtggtacagaaatagtgtcctcccagcccataatcccgcctctcctttctcctggcagcagccttttattagagccatcccagtctgctggctgcagctccccgtcccagccccatatgtctgctgggggaaggtaaggaccctgcctaatctaccaacaagatgattagcccctgcataattgagaatttgagaatttattttattgctattgtcaccgttaaaaataacagcctgccctcattgtaaaacaggtcagtgtgactaatatttaatggatgaaataaagcgcagctttttcctggatctcatttacaggagatttcactaaacagttcaatgcgtttttactgggacctggggcacacagtgcctgggcggggggatctgagtaagagtagaagttggcagtgctctctgaagcgctcggggtgcagtgccccatgagctgttacttgctggcgagttttgtggttaaagagcctaagttagcatggccatcagcttttctgtgtgtttggtttatttgttttaaaataaaagtttcagactgaagagaggtgtggaaacgctttcagaatgcgattgttttcacattcatgcagacggcctgaaagaaagaaaacgcagagggtctctggcccgtttgccccttcaccgtccggaggcaggaaacagagctggctttgtctgagggctgagcttgcagttagtgctggggtcaacctgaatggtggcccccagggagggagtctgtttctgatgaaacggagggtcaggcagcccctgtggagtggctgccctggaagctggccacacggactggtggtgcctccctctggctctgctgtgagcctgtgtttccaggaggcagcctcctggtacctgcccaagcggttcccaggaggcctgttgcagtcaggaagaagcagcggcccgtgtggtgggcaggtcccaggctgccctgccatctttggtttgcttcagggcttatatttcctttcttttcctcctttcaggaaggggctggggcttcttgttttcccttatgggtcccagtcttaatgcaggctgaaggtggagatggcttctagtccggtctcttccccgatgctaggtgagatcctggaccaagagtccccttcccagtagggggctgggccagatgggctttctccaggggcttcctctcctgcccacctgcaccccattgccttggacagacctgttgacgctgagaatcaccaggagttggctcccagcaatcggtattcttagccagcctgttagatcctggtgtaccttaagattgacaagtccacgaagctgatggtcagcactgcctttggttgttccctggtagtctcctgtgccatcaggattagagggaatgcctttggtgggttctcatcagagaacatgataacggggaggggaaaactcgattctcttcattcccagtgtccaccctaggggcttccctgcagagagacaagcttccctttagatcacacagtgtggtggaggaggcactcatttcttccatgtgttctgcaggggcgcagactttggtttctgggagaactcttaacagttactgctaaggctgggatcagagttgcctggaggcaggaacccctttttatgagcaggcagtccaggaaggggacaggcactagcgataacgttggaggttggcccactgacatcatgtaacgtctggggtctggcttaagagccaaagcactggggcatctcctgcaggccctgaggggtccctctcgtaggcagggacacagctcaccatggctgtgtgctggctgccaggacatctcaggtgcagacagctgtggagccagcttgatggatgcctattttactgtcctcttcttgcctcttttgggaaactttattcccagaatgcacttttcagaagtgggtggcagtttgggggtttttgtttgttttttgtttgagacaacatcccgctatgttgcccaggctggagtgcagtggcgcaatcatggctcactgcagcctccacctcctgggctcaagcaatcctcccacctcagccttctaagtagctacgactactggtgcgtgtctccatgcccggataattttttagtttttgtagagacaaggttgccctatgttgtccaggtctcaaactcttgggctcaagtgatcctcctgcctcagcctcccaaagtgctgggattacaggtgtgagccaccatgcccagtcatggtcagcagttttaattccgaagatttttctttccttttttgactcagcttcctctcactgaaaccataatcagtctcatctctccatcactaaacttcaccacccaagggttggtggtccttggagagagactgggccagacaaggtgatttctgcctaacactgggaggggccttttttaggccagacggcacatgcaattccagcctatcatcactattaaattctaataaagataaaagtatttcatttcagaaaggggaaggcctgcgtgcctcaaacccgtaatctcagcgcaggtcagctttccacctgcccctcactggacagacttatcaggtagcactaccttaattgtgtgttttctttttctttttctttctctcaacccttcctgtttcgctttccttccctggccttaatttctggatgtttggaaactacaggactctgtttggaaacaagatcaagtctgtggctaagagagcattctcggggctggaaggcctggagcacctgtgagtatctcaccagccctgccctgaggcacagcctgctgaatgcggctgccggggagttctgctagcaatttaatcgcatctttgtaaactgagaaacaggctatttggaaacaccagctgcttccttctcattatgtcagcttcagctttggcctttatgttgcctatgccaggaacagttacagaacatatggccagtggatgtgctcccagttaattcagttggtatttggataaataccctcccccctcctgctgcgcagcctaacccctgcactggctccttcatggacccctggcctcattgcctcttccaccaacgcgcttcctcctggccaagcctgttgcctccattaaagcagcttaacaatgcagagtaggtgctgggctgaaccagtttggtgtggttgcttctgagaccctgggaggaagggaacagagccacccgagacagtcatgctgttgccatctggggaggatgcctcatgtatgtgattcttagtttgtttcctctttgaatcaagtttgactctaactctgttgggaaaggttttgccttgctgagcaggcctcagcccagctttgatggtgccctaaggctggcttggctcctgagtcattccatgggcttgtgttgcgatttgggaaacaacagccacttatagtagttaggacacaggtctggctagtccctgtgggtcatctgtgaaaccaggactgtcctgaaaacccctcaggtgtacctagggtttctttgcataagtaatgtatgttctgtttcaggaaccttggagggaatgcgatcagatctgtccagtttgatgcctttgtgaagatgaagaatcttaaagagctgtaagtatctggattccctgggtctgattaatggtagtggagactttcagagtaagaaacttctgcaattgcattatgctcacttgttaaaagttcacatggtacatattttggattttgtgggccacagagtctctgtcatgactacttgattgcatcattgcagcagaaagcagccatagacattacataagcaggtgggtgtggctatgtgcccataaagtcacattgacagaagcaggcagtcgggccgcaggctgaagcttgctaaccactattctaggcaatgtgaaatatactctcctctataaagtggataatcacccctttaattatgtcagggccaagttttcatcttttgggcttgcttacgataaaggcctgtgttgagagggtctacttcagagcctggtgggctgtgagcaaggcagagctctggaggggatgggatgcttaggggtgcagtggtgtctgcccataccatttccaagctttctgggcacggttcacaggtggtggtgctgccactgtggacttggactgtgggctcttgggtgacaaggttggaaaagcttccctgtatcctactctggcaggggagctagtctgggtcctcaggtgtaacacccaagttttcctttctggtttttttttttttttttttagctagacatgaatctgattctacagccagtaagttctagccatgatatcagttccctgaaggggtaacttttggttcctagaagtgctgacagaatggcagatgccacaggacagtcatctttgtgccctgacctcatccccattccccgaggccactcttgatgaaccctcagttggggcagggaggctgggactggggaaatgaggtgcattccccatagctgggaactgaagcgggccgggtgacaccagactgagtgaggagggaaggtggcctgggcacttgccctgtgatgttcagcatgctgtgagcctcaggcctgctgaatagataccgtccttgcaagggttggatcttggagcgggtgtctgtgacgggttcatggagctcagggctctgcagacagctgctccgtgcccagggccttccctcttccagcctcagcagctctgcctccatctgtcgggtgagacggaacatacagaaaggattccatggctctccttccagagcaggggaggagatgattccagaccaccgtggaagggaaggctggactcagaggtggactcgcagtaaagcaagtggaatgaaacattggttgtagaagacaagcggtggggcacaggagcattcactgtggaattctttcaccttttctgtctttgaaactttcagatatgatgtcaggactgaaaaatacctgattcaatttaaacgggaagaaggtattttgagagaaggagggaggaggataagattttccttgggaagttgggaggaactggacccttccagaagcttggacctccagcgtgcttctgcatggttctggaggctcagcctcggtctcctgcctgggtttcccatcgttgctgcatatacctcgctggagccggccctgtgcccagtcctcagatgagagaaatggttaattccacttggtcgtctttttctccatcagatcaagtcaggttgtactgtgcacttagtcatcctctgggtaaatttccacaagtgatgattagaaacacactttgagttggaatcgtgaaaatgcaccatgtgagccagcaaagccctgggatggcagcagaaggcagtagagccgatggcgctgtgctctccacgggtggaagaagggcggcaggagcctgcagagcctaggggttggaatcctcgctactgcctggccccaggccctccccatgtatcctctcagtcctaacttgctgtttaggaacatgctgtctccaccctgagtacccactgtcttcctggagtctggcctcctgtctgaggtgggtttcatggtggaagaagtaggaaatcctcaaaggcgttagccccacacgtccagggcgtgtgtaggatgaggcttagccctttctacatgtgtctgatcaaagataaatgtcaaatttgttttcccgtttgttcctgtggttcaaatggaatatgtccttgtgtcctgcacaaatgcttaacgtcgcacagggatggcccagccttctctcctaggctttcgtgaacagtgcccaggctgttctgcctgactgcacggaagtgccctcttgctggggagctggaggtgcttctgacagcggagagttctccatccaggctgagttccccccatgcctggcgcagccagccctgacccccatgcagggtgcactcctgggagctgccctccccaaacactgcatgggaattgaccatttcctcagggatggccgttacagcccttccgccacctgcagtgactccacagtaggacagccctccagatggctctcagcagaacgctacctgcccgtgaaataaaaatgcaaactctcatgctgattttaagatctaatatgggccagcatcccagttataatggccttgagataagttatttctgtttttggaaaagcactttgcaaaattataattattttaataagatgcccaactcatctaggggtgatggggaacatgaggaagagtggattttacttaatttagccttgggtcatctgcttacacttcattcttccttgctgtgacagtttctctgctcattagaaatctggagagaaacagaagaaaatggaaggccagtccatttggttgctttgttgatgtctgaggacagtggtgggtggagaaggcagccaaagtcgtgctcttggcctgcatgatgtttttggaatttctgcgcatacctgtgcctcctgtttgtcaccatgtaccagagacagtgtattgcagggaagcctgtgtgctctctttcccagtcttcccttatcgtgggccagccatcattctttagctcacagctctgaggtcttccaggaacaaggcagctagactcttggttgacttatcttcaagtgactcctcaggaaggaatgtccgctgagatggcgattccgatttctgtttaaaaagcttatccttagttgctgagaaatgaaaaagaaaatattctctgttttggttggagccccacaaagctaaagttgtgcattctcatgctccctgggcagtggcaattaactaacaagcactatttagggagcagagccgaattctgccggccccctgaagaatactggtgcaaagatcaaggcacaaacaagagggtggcacagtgacggggcttattacatttggaagtaagaaaacatgcagctttgccaaatggaaaaggaacagccatgaggcaaaagagccctcctcggaacttgttgcagaatttggatcaaagtctcaggccgagtttggaagctccaagtagtttatcaggaaagtgggaaaaaccagaggggggatggtggcagcatagcactgttggatgtatcagaggtcaggagaggtcagaaggcagcccagggtcacacaggaacagtgtctgtcccagaacatggcatggataagctccacgttgctgctgctccagttgcggtccttgggtcagcagccccagcatgatacgtgaacttgttagcagagtcgtgggttccactcctgacccacccaatcagcaactgcattttttcaaaatctccaggtgggttatatgcactgccctgggaaattggagaggaagtgtgagaaaaaccatttcccccttccagcttgctgatgttcacttgagaagctgattggaggcgactgatcattgtgtgtgtgaagggagtgtccctcctttgcggctgcacctgaagcatccactgttgtgtttctttcagccatatcagcagtgacagcttcctgtgtgactgccagctgaagtggctgcccccgtggctaattggcaggatgctgcaggcctttgtgacagccacctgtgcccacccagaatcactgaagggtcagagcattttctctgtgccaccagagagtttcgtgtgcggtaagactgtctttgtaactttttctctccttcatgaaggacaaggaagccaggaggtactcttcattatgggagtaattcctgtgatcagagtaaaccccagcccgtggttacagatcagctgctggatgcaatttatttcttgctgaaaccacacacagtatttaccgtagagttgcctcattatgtggttcttggaggacatgcatttaatcagaagggagtataagttggttcagttacaaatcagaataatcagttacaggaagatagttctgttgtttcagaagggctctggtgcccgggtttagctgcgaatgtactcagcgtacgaggctggcgttttaatgtgtgtttctttccgaccccaagaatgaaaggttaaatacaggaagaacaagtctcaggagaacagttgctgtagtaaaaataattccttgatgttgacttgtactcttgctgtttctccaaaccactgaaatctgcacttgcagctttacattctttttgccttctgattcctggagcgtagctcttgccatctttttgactgggagtcgggatccaagtttggttgcagagagcacagaaaatgctgaacagctgaaaacacacacgcaggctagctcagacaggactgacacaggctcacggtcaggaagacatggtcaaaaaatgagatgaattttgagtttttcctgtttgcttgctctaagcaggagcaagagtgggattcccaggcctgactggaactgctgggcaggtgttaagtccctcctgccttttgtgctcactggtctcccttgagccttgagatccctgctgtgaggatcctaaccaggaactcacccatccatatggcaacccttgtgggccacttctgtctcctactttctggccacagcaatagccattgtgcctgctggagtagccagtgtgcctgctggaggcaagatgtgtgtgccctctccatgcatccacccctaccttcaccatcaccacttttgagaacaggcctgctgaacttcctctggatccagaccagggacacgtcttaaacccactgcgaacatggcagcagctctccaaactgacttttcataccgatctgtcttatggagccttctgtgtggaatctaatgctcgcacagctccattatccaggcacaaaatggctgtataatccattgttcattggcccattgtcatcaagtccttgacccttaaattgtttatagacctccctcaaataaagctttccatcgctccctcccctttcctgtcatagggcaggctttccctctgggtgagccaggtaggactttggtaagttcacctagcccccagcctgtggccctggcatattctggattgcaagagttgtttatttcacatctgtcatccccacccccacattttagctcaagcttccccccctctaaaaacgtcaggtgttaatgggtatcatgaaaacacttggcagaagatcaaggtttcaggctttatgggagtctcccactccttttttaaaaacggaaacataagcactccacatccactaggacagctagaatccaaaactcagataataacaagtgttgctgaggatagggagaaccctcctacactgctggtgggagtgtaaactggggcagccactttggaaaacagtctcggcagttcctcagttcaacatccagttacgacatgacctggcagttccactcttgggtgtatacctaagagaaatgaatgtatatgttcacacagaaacttcttcatgaatgttcatagcagcattattcataatggccaaaatatgggcacaacccaggtatcagtggatgactggataaacaaaaggtggtatagccatacaatggaatattcattaggctgtgaaagcaatcagtagtcctgcaacatgaatgaactttgacaatgtcatgctaagtggaagaagtcagccacaaaagaccattagattatatgattccattcatagaaatgtccagaatggggaaatctctggaggtagagattaggttagtagtagtttaaggatggggagggatggaaagagaggggtaatagctaaaatgtacagcatttctttttgaagtgatgaaaatgttgtaaaattgactgtagtgatggttgcccatattggtgagtatactaaaaaccattgaattgtatactttagatgagtgagttgtagtgtagatgaagtattctcaataaagctgcttttaaaaagaaatataatttatatatcataaaaatttacccctttaaaatatataaattgatggttgttataatagtcacaactgtgtaaccatcactattatctaattttagaacatttttatcaccactagaaggatccccataccattagtaatcactccctattctctgcccccaggcccttgatagcactaatctcattgtgtctccatcatttgcctattctgggcatttaatataaatggaaccatacagtatacggtctcttgtaactggcttttctcacttagcataatttttaagcatgtatcagtacttcattcctgtttttaatggctgaataaatgggtttacattttatttatccgtttatcagatgatggacattagattgtccccactttttggctattatgaataatgctgctgtgaaaattcatatacagggttttgtgtgattctcttgggtacaaacctaggaatggaattgctgggtcatacgctaactctgtgctcagcttttttgagggactgccaaactgttttccagagtggcttcatgattttacatgcccatcaccaatgcatgagaattccaatttctccccatttttgctagcatgtgttattaactgtcttttttattttggatgtactcgtgagtataaaatagagtctcatggtggttttgatttgcacttccctaatgattaatgatgttaggcatgttttcacctgcttattggacatacatatatatatatcttctttggaaaaacagctatttaaatcatttgccagtattcatttgtcttttcaatgtttagttgtaaagttctttatgtattctggatatgagaccttcataagatacatgttgtgccaatattttctcccagtctgagggagggctatttttcattttcttgatagttgaaatgcaaaagtttttaattttgatgaagttcaatatctctattttttcttttattacgtatgcttttgatgtcatatcaaagaaactatttgcctgagataaggtcacaaagatttcctcctttattttcttctaagagttttataaccttagtgttacaaagccctttgattttattctttttcaaaattgttttgtctattatggatcccttgccatttccttacaattttttggatcagcttgtcaatttctgcagtaaaggaaagtgggatgtgggttgcattgaatctatagactaatgtgagaagtattgccatcttaacagtattaagtcttcccaatccatgaagatgggctgtccacccttttttcttagcttcttaaaaatttctttcagtcatgttttgtcactttcagtgtacacatcttcaactactgttaaaggtatttctgtttttattctttttgctattgtaaatgaaatccttaatttcacttttggattttcaaaaatgaaatatttattgcaagtatacagaaatgtaattgaattttgtatcttgatcttgtatcctgcatatatgttgacatcatttattctaagtttttcagtaaatttcttaggattttctttatatgtgatcatcatgtcatttgcaaaaaggtagtttcacttcttcatttccagtctgggtggctttcatttctttctctagcctgttgcactggctagaagctctaatacaaagaagagtgaatttgtgagagttttggtgggaaatcatgagacatccacctaaaagtcctaatttggctccatctgacttctttttagttattatctttaaaaatctttaaagggcacccaattttcttcaattaataatgtaaaaaagactgcattgatatgtcccaggaccctcagttctttagggatggactaaatggctggtatcatcactcaggagagtttcaaacttgatggaggttatgttgagaaataaagtttataattcggttttccatgaactttttgaagtcccctcatagtgttgttgaagtcttctgtttccttgatcttctgactagttctatccgttgttgaaagtggggtattgaagtgtacaaactattattgttgcactatttcttcctttaatctggtcagattttatgttttgtggcgctccattaggtatatatgtatttatcatttttacgtgtttctgatgcattgacccttttacattataaaatattattctgtctctgtagtaaaaactcctgtcttaaagcctattttgtctgttagtagtatggacactttagttctcttttggtgactgcttatttgtatctttgaatccacactgtgtctcttgtaggctatagctggatcatagttttttttatccattatggtaatctttgccttttgattggagtgtttaattcattttcctttaatgcatttactaataaggtagagtttgccccttatttcttctatgtgtcctatctttttgtttcattgtttttccaatactgactagtttttttattgaaaagatattttctgttgtactattttaattccctgttttttaaatacacgggtattttttagttattttcttagttttgcccataggaattaaaattaacatcttacaacaatctagttcaaataaataatgaaattaacttcagtaatatgcaaaaattatgttcctattaagatccagttttattcctttgtgttactgttgtcgtacacattacattttcattaagcccatcaacacagccttataattactggtttatgtagttgtcttttaaatcaggagacgcgagttacaaaaatacacgtatcctgtgtgttgtattacctgtgtagttacctttaatgggattttttatttcttggtgtggattggagttgctatatgatgtcctttcatttcagccatactaaatactctcctggatttcttgtggggcaggcctgataacagtcaacttgctttgtgtgtgtttaaaataaaaacatcggaatgttttaatttccccttcatttttgaaggataggttttttaatacatagaattcatagttgaacgtttttctttcagtaatttgaatatcttcctactgccttctgttctctgtgggttctggtaagaaatcagccgttaataataatgaagatcccttgaatgtgatgagttgctcctcttttgcgttttcaagattctttgtctttggcacctgacagcttgactatgatgaatctgcgtttggatctttgaatttactctacttggagttcattaagattcttggatgtgtggctgcacatttttcatcaaatttggggccattgttttgcagatactttttctcttcctttttctttcttctccttcttggactcccatgatttgtatgttgttgtgcttgatgctgtcccacaagtctctgtggttcttttcattttacctcattcttttttctttgtttctcagactacataatctcagttgactgtctcaagttccctgccccctccttctgccagctcagttctgctgtcaagcccctctagtgaatttttcatttcagttattgtacttctaagtttcaaaatttctacttggttcatatctataatttctctttattgctataaaattttctcatactttatccttttttttttttttttttttttttttttgagacagagtcttgctctgtcacccaggctggagggcagtggcgtgatcttggctcactgcaagctccgcctcctgggttcatgccattctcctgcctcggcctccctagtagctgggactacaggcacctgccaccacacccggctaatttttttttttttttttgtatttttagtagagacagggtttcaccatgttagccaggatggtcttgatctcctgacctcatgatcctcctgcctcagcctcccaaagtgctgggattataggcgtgagccaccccacctggccactatccttcgatattttttttaagacatggtttccttgaggtgtttgaatatgcctataattgccgatttaaaaagtttatttagtgaatctaagtctgggctccctcagagacagtttctgttgactgctttttttcctgtttgagtgtttcataatattttgttgaaaattgggcatttaaaataaaataatgtggcaactctggaaattggatattccctttctcctcccccaggatttgctgctgttgctgtttattgttacagcttgcctagtgacttttcctggacaaaggctatataaagtccgtccccttaagtccctgcttgtttagtttagtggttagctaatggttggacagagaagtcaccacaaccactgtctcctatcctttaccgacggcttgtgtgtttgtgttggggtgtgccatcacttcctatttgtgtagacagtcatgctcagccacaggtgacaaatgaggaccccctcacgtctttcctgggtgtgcacatggccttgcacctgcatgtggctgtctagatccccaggaatgtattggaccttttcaaagcccaccattaacactgtattccccacattttcctttatagttttttggccagctgcttgtttgccccatgggtattgtcccctcagacagctgcgctgttgaacagtggctactgattgttgtagtcatgtgccctggggctagggcttctcctgctcggcaaactagatcagggcaaatcaatgcaaatcctgtgaatggggctttccgtgttgctgccagataggccacatggtgtcagttctgaggatggggcttttggggagcccattctgacccttgagtggttgctaggctgctgggtttcaaggctaccatggagctggggagggaagaatggggctttggataagttaaaataccacaaagctcacatttctgagatgttgctatttgcttgaatcaacaatccatggattgttgtaagcctttggttttccagaattctgaaaaagttgcttttgaccatttttccaggtgttttccttgttttaatggaggtgcagatttttggaggtccttattctgacattttggaagtgttttacaccccctccttttggagtaaggtttgtgggtaagatctctgcagtcatgaccagtggtgcctgactgttttgtgtgaaagtcagcaggcagagccagttgtcttaaggaaactgccggctggctggtttgagaactgagaagtggtgggttaatttctaatcaaggagtgtgatcataaaggtgatcagtactcacagacttctaattagatgaggtcagatgtccgtggtgcaactcttacggcatctggttggtggggctgaggatgcacagggacctcaagctctggttcctgcttggtgtctgtgtcagtttctgttagcatgaacagcagctggttcctctgtgtaccaagaacccagcgctttacagttgacccttctctccccagatgacttcctgaagccacagatcatcacccagccagaaaccaccatggctatggtgggcaaggacatccggtttacatgctcagcagccagcagcagcagctcccccatgacctttgcctggaagaaagacaatgaagtcctgaccaatgcagacatggagaactttgtccacgtccacgcgcaggacggggaagtgatggagtacaccaccatcctgcacctccgtcaggtcactttcgggcacgagggccgctaccaatgtgtcatcaccaaccactttggctccacctattcacataaggccaggctcaccgtgaatggtatggaaacaccatctttgttatagtaccagaatcctacaaagcacactcctgattgccctttcagctttccatgtagagatgactgagacaggacacacacatgcttctgtggggcactgttaaatcctattgttgcctgggtttgccccagagcaagttttgcagatttcaagggttattcacaatgagttacttgtttttggtgagttttaaaaatctagttattggccgggtgctgtggctcatgcctgtaatcccagcagttgggagactgaggtgggcagatcacttgaagccaggagttcgagactagtgtggccaacatagtgaaaccccgtctctactaaaaatacaaaaattagccaggtgtggtggcacatgcctgtaatcccagctacttgggaggctgaggcacaagaattgcttgaacccaggaggtggacgttgcagtgagccgagatcactccactgcattccagcctgggtgtcaaagtgagactgtctcaaaaacaaaacaaaaactagttattaagtcaaattgtggagagctaagccttgttttgtccagttcttatcctctataagccaagagatctggcttccaaattccaaataccccttagcctggggaagctgctgttctttgagtagatggcacagcattggagtcagaggctagctactgctccagagactgtggagtgcaaggctggtgtgagccctggcctgaaagacacagtgtcctggcagttgacaggtttttactcattaaccagccttggagcttgtcaaggggaccatgtgttattgtgtgtttggaggaggggggtggggagtagatagcttgaagagtttactgtcccaccccagtaacctaatggggttatcctgattactaactctctagttaaaaagaattggcttgagaatcatcagaatggtggatctgctttgctctttaagcccccacagatcacagcgaaacaccttctttaccacactgtagtggggttgtcttggcttattccaagtcctcacagcttccgaaagactcagctgtttgttagactctccccaaaattgacgttgacaggaactctggtggtgcctgacacgtggctggatgcgtcccactctgtcaggacatcgatctttaggctgagcaagctagcaagctgaatgcttcctgcctgggtatacggcagtgggcaggaacagcctgggtgaacaaccatccaaatggatgagccatcccattcatcccatgaacacccatccaaacggatgagccatcccattgctctcccaaggtggaggcatgcccaccttccctctgtaattccatctccacagcctctctcttggtgggtaaagcaggcaagcatcaggcctacctagtgtggatgggcaccccctgcaactcccgtataggcactgccatgtagagtaaaagcctttgctttgaagggactatagccagcctagggtgtacaatgcaaggctgatgggatggaagtgttccaactgtggtgggagaagctgggggttcctgattcacaggtggcaggagtggtcctgggcagacattgggagaaaagaagtgaactggcactgggcacagtgacaggtaggtgtttgccagaggacttcctggttttgcatctagctgtcccgtaacccgaccctgtatacgtatgttttccagtgttgccatcattcaccaaaacgccccacgacataaccatccggaccaccaccatggcccgcctcgaatgtgctgccacaggtcacccaaaccctcagattgcctggcagaaggatggaggcacggatttccccgctgcccgtgagcgacgcatgcatgtcatgccggatgacgacgtgtttttcatcactgatgtgaaaatagatgacgcaggggtttacagctgtactgctcagaactcagccggttctatttcagctaatgccaccctgactgtcctaggtttgcctattgctctactgtgtgtgtgtgtgtgtgtgtgtgagcgagagagagagactctcaaatgctctgtgtggccaggggtggtatgcgttgtgggcctttcgaccctgtttgaaatttggggctgctttttgagttgagttaatttttcttaaacaagtgtttctatctctttaaaagaaatgatagctggtgaattaagagtcttcatagggtttagctacagaacattttaagaattggacaggatggatgtgggcttggtcaagagctacagaacattttaagaattggacaggatggatgtgggcttggtcaagaataaggacacaggcctgacacaggacagttagggaatagcaggggcttttgtcagcagaggttcactgtccctgtggaagccactcccagcatggagatgactcagtcaatgagttgaagggtcttctccaaagcttgccactctgagacagaatctcagatgcatctcattgatatgttggattgtccgttgtccagaagaccgggcagagccagagcaacggaggccctgagaatgactaagatctctgttgctctcttgtagagaccccatccttggtggtccccttggaagaccgtgtggtatctgtgggagaaacagtggccctccaatgcaaagccacggggaaccctccgccccgcatcacctggttcaagggggaccgcccgctgagcctcactgagcggcaccacttgacccctgacaaccagctcctggtggttcagaacgtggtggcagaggatgcgggccgatatacctgtgagatgtccaacaccctgggcacggagcgagctcacagccagctgagcgtcctgcccgcagcaggctgcaggaaggatgggaccacggtaggcatcttcaccattgctgtcgtgagcagcatcgtcctgacgtcactggtctgggtgtgcatcatctaccagaccaggaagaagagtgaagagtacagtgtcaccaacacaggtcaggccctgccagcggagctgactttcaaggagggaggaatggcagtgatgctggggaactgggccgggttccagtggcttttgaaagaatcgcactgtgttcagaactcctgagggtttagtcccactaattccattttaactttgaggaacttaaccttaaacaggaatactctcaaatttaaccttaaacaggaatactcacaaatacaagtaactgacgcaccatgcagttttccctctccttgctaactcagaggccgcctatgcacaggccctgctgccacgtagtaggttgttcctgaaacagcgcggtacttctgtgagccccggctttccatcactggtctccacttcttgtggcgtctggcatctgctggctgcgctcttcacgctggtgcgctcttcacgctgggtgtagagtaaagctgagcaggctctgggagggcctgttgcgtacatggactccatgtcatctctctgcacagcgctgatggtcgtcactgggaggatcccctttctgagcttgacagtgaacgtgtgtctgcatttcttgtcactgagaccctggtgttctatttgttctgtctccttgcagatgaaaccgtcgtgccaccagatgttccaagctacctctcttctcaggggaccctttctgaccgacaagaaaccgtggtcaggaccgagggtggccctcaggccaatgggcacattgagagcaatggtaaggcctcagtaaccgtgaagcagagctctgctgtgactgtgtctctgggtgctggaggtggcctccaggtctttacagggcaggtacctggcattagatggggcaaacttggtgaagtagaaggcggtatgactaagggctgctattttggacccagtcttcatgagttctgcaaggttttaaagtcctgtcccctcaggaagccactggattgggcttagcatctccctggcaggataaagtaggcttgcctggagtagcagctggaaagggcattacggtgcatgaacccagccaacccattccttacatggggaacgtgcccaggtctgctctgtgatccagtcttacactggaaagctgtcaccaggatgaggtacttccaacggtgggggcctctgagcacttgcctgagactgtagaggctcaccctgagacagctgctcatttcacaaggccagcctgcctgctgggaagtagtagcagaaaacacgctgcttgccagaccagcagccccaccgctctgaagaactttttaaaaaaaatgactgttctagcggccttgctcattcctttcataaggcttactgtgaaataccaagcccagagtttctaatcgtgttggaatccacttgcaggtgtgtgtccaagagatgcaagccactttccagagcccgacactcacagcgttgcctgcaggcagccaaagctctgtgctgggtctgcgtatcacaaagagccgtggaaagcgatggagaaagctgaagggacacctgggccacataagatgggtatgagatgcttcccattggaagtagtttctttctgaaatggaaatttgggctgacctagtcactacatcaaagggggagacacattcctagtccacagctgtctccaaatttggtattcagtatatacaggggaagctcaggcctggctctcttaattccaggatagtttctcctaaataaatctacgccatggtaagcctgagcatgaattttctagatgtataagcaacttaaataaggggcaaggcacaaacgaagtatagagtttcagtcagcactttttcaccagggctatttcgaggcttatttctaattgttgaaaagacccaacactgcatggtacctaaggctaatggcttttcccccgcgaagcagtaagactacattgtctatgaaattcactgtaaacacgaaagaccccacagttcatgagtgacttggtgtttgcccagtcctttctctggggacatagttggggaaaagaggaagcatgcatacagtgtttgcagtcagggttctcaccttgcacagtggagctgagcagcctgtcctctgtgtggggacgaagactcccacagcagtgactctaacccatctttggcgctgtccttcagaacacggtggccgggtcgtatgcagtgactgcaacaccgaagtggactgttactccaggggacaagccttccacccccagcctgtgtccagagacagcgcacagccaagtgcgccaaatggcccggagccgggtgggagtgaccaagagcattctccacatcaccagtgcagcaggactgccgctgggtcctgccccgagtgccaagggtcgctctaccccagtaaccacgatagaatgctgacggctgtgaagaaaaagccaatggcatctctagatgggaaaggtaacttttgactgtcttctaacaggtgggttgggagctgcttaaacggtcaagtgggggtctgacaggttcgttctttccttgtaggggattcttcctggactttagcaaggttgtatcacccggactccacagagctacagcctgcatcttcattaacttcaggcagtccagagcgcgcggaagcccagtacttgcttgtttccaatggccacctccccaaagcatgtgacgccagtcccgagtccacgccactgacaggacagctccccgggaaacagagggtgccactgctgttggcaccaaaaagctaggttttgtctacctcagttcttgtcataccaatctctacgggaaagagaggtaggagaggctgcgaggaagcttgggttcaagcgtcactcatctgtacatagttgtaactcccatgtggagtatcagtcgctcacaggacttggatctgaagcacagtaaacgcaagaggggatttgtgtacaaaaggcaaaaaaagtatttgatatcattgtacataagagttttcagagatttcatatatatcttttacagaggctattttaatctttagtgcatggttaacagaaaaaaattatacaattttgacaatattatttttcgtatcaggttgctgtttaattttggaggggtggggaaatagttctggtgccttaacgcatggctggaatttatagaggctacaaccacatttgttcacaggagtttttggtgcggggtgggaaggatggaaggccttggatttatattgcacttcatagacccctaggctgctgtgcggtgggactccacatgcgccggaaggagcttcaggtgagcactgctcatgtgtggatgcccctgcaacaggcttccctgtctgtagagccaggggtgcaagtgccatccacacttgcagtgaatggcttttccttttaggtttaagtcctgtctgtctgtaaggcgtagaatctgtccgtctgtaaggcgtagaatgagggttgttaatccatcacaagcaaaaggtcagaacagttaaacactgcctttcctcctcctcttattttatgataaaagcaaatgtggccttctcagtatcattcgattgctatttgagacttttaaattaaggtaaaggctgctggtgttggtacctgtggatttttctatactgatgttttcgttttgccaatataatgagtattacattggccttgggggacagaaaggaggaagttctgacttttcagggctaccttatttctactaaggacccagagcaggcctgtccatgccattccttcgcacagatgaaactgagctgggactggaaaggacagcccttgacctgggttctgggtataatttgcacttttgagactggtagctaaccatcttatgagtgccaatgtgtcatttagtaaaacttaaatagaaacaaggtccttcaaatgttcctttggccaaaagctgaagggagttactgagaaaatagttaacaattactgtcaggtgtcatcactgttcaaaaggtaagcacatttagaattttgttcttgacagttaactgactaatcttacttccacaaaatatgtgaatttgctgcttctgagaggcaatgtgaaagagggagtattacttttatgtacaaagttatttatttatagaaattttggtacagtgtacattgaaaaccatgtaaaatattgaagtgtctaacaaatggcattgaagtgtctttaataaaggttcatttataaatgtcagtatagttggtggtccttcttttacaaacgcagtcattctgcctttaattatcttcccccaaaaaagaaaaaaaaaataggcgaagcaaaatcacatactgtttgtttgctccagggcagacaacactgctagattcctgacattttgttttgaatttttctacacctggagcttgttagtcaaggtctaaaatccctaagtgtggtgacctttccatttcatcctgccttttcaaagctggcccaggccctcctttcagtctgacatgagaatggcgagaatggctcacccaccgtgccctcctgcacgaagccagctgggcccacctagtcacttgagttgcagctgctttctctcacacaccacagggggcgctggacacatctctgtaaaataatacaattgtgcgtttttatgggtgaaatctgagggtaattaaaaccagcagcctagttacccagaaagagtgcttgctatgcacctgtagttcaatctttctttctttttcaacaaagcctacccttacacaacaggaattaactagggggagaaacacccacatacacaactcttccccaagtctccttttcccacaaacaaacaaacaagctattcttttagaattataaccatcttgccttctgctgaatccaccatcaggtggcaggaaatgaaagatcagatacagatcaaatgaaagctctaaaaggcctggcctcagcattaccaaacttatttattaagaggttctgaggaaattgttcagagtaccgccacagaccccgttttcttctcttagctctctggcatacaggccaatgacttcataccagccagcctataccacggatggcacaatctccatgccggtatcttagcacaactggtcttcagcactggggcctatagttcagacagctgctcagcggaagagggtttgcactgcaggcccctctcttgacagaagtggaggtgaggcttgtctctgcttcaaggactctttctgccaacttccaacagcaagctgtgcgttcggtcataagcccccagaaagatgaaacctcccagactgatggctgccattcgagggaagacacctgcaaataatctaggggaaaaaacaggatttttaatgttgtgcgtattttaaaaaaaggttaaattccaatacccacagcttgctcagctcaatacaccatgctcattagtggctaactaccaaacagcttgtgaacgctcccaaataaggcaagtaatagctgtgtcccaacagtagttctaaaactttcatgccatttttccctttgaaacatgaaattgattttttttaaaaaggcgttaaagagctgaatcctaggtaaggctggaaggcacttccagcccacacctctaaagtgatctccaggggttgctcagtgaagagatttttgggcaatgctgccgctccacccactgactcagttgcattttgtccttcgagaccccaaaacatgacgtcacgacaacgagttgaacctccatggattccctgtgttccttttctgtctaaaggcatgaaaggcaaatgggctgtggctgtgaagggggcagcatgcctccacctgcacagtccccttggtatcacagaaggtgctgctaaccagccaaggtgcaatgtagaataatcagagcaatgcaaagtaaaactacaatgccacgaggatacaaattggggattcattctttaaaactgccccccctccccatacctactcagatatttgttcaaaaattttcattgtggcattgctgatggtgatataagttatggcacagtataaacatacagtggatgattatgtagctgataaagatgaggaaatctacagatgccaacataaaaaaattacaaaacaggtttaaaaaactaagtccaaggactatgattccatatctaaaaggcaagccagggatgtgtcttaagccctaaactgaatgcctgctgcctgtggattataggacacattcctggcccacgcttccataacctttgaaccttttcaccaagagtacaggcatgactcagagatatttcaagtttggtcccaggccaagtttggccaccataatagtgaatattgcaataaagcaagccattcaaatttcttcgtttcccagggcacagaaaagttatgtttctactacagtctattaagtatgcagtagcaattatgtctaaaaattgtacataccttaattttaaaatgctttattgctaaaaaatgctcatgagcatctgagcctgcagtaaattgtaatcttctggctgatagagggtcttgctttgaatgatggctgctaactgaccagggtagtggctgctgaaggttggagtggctgtggaaatttctaaaaatagtaattgttgcattgatggactcttcttttcatgaaagatttctctgtagcacacaatacattttgcccacagtaggacctctttcaaaattggagtcaaccgtctcaactctgccactgttttctcaactaaattgatgaaatattctaaatcgtttattgtaatttcaacagtgttcaccgtatcttcaccaggagtagattcatctcaatagatcactttctttgctcacccataagaaccaactcctcatccgttcaagtttgatcatgagattgtggcaattctttacatcttcaggctccacttctgactacggtggtcttgccatttccagtacatctagtatgtgtttccctccactagtcagccatgaggattggaatcaacttcttccaaagtcccagcatggtcaatattttgacctcctatgaagccactaatgttcttactggtatctagaatggtgactcctttctagaaggcttccaatttactttgcccacatctagcaaaggaatcactgttgatgcagctgtagccttatgaaatttaataaaacctgaaagttaaagtaactccttgatccacaggctaaggaatggatgttgatagtaggcatgagaacaacattcatctccagcagaactccagggtgaccaggtacactgtcaatgagcggaaatattttaaaaggaatcttttcctctgagcactaggtcccagcagtgggcttaaaatattcaagaaagcatgctgtaaagagatgtgctgtcgctcaggctttgttgttccatttctacagcagaggcagagtcgatttagcaccattcttaaaggctctaggattttcagaagagtcaatgagcactggcttcaacttaaagataccagctgcattagcccctaacaagagagtcagccagtcctttgaagctttgaggccaggcattgatgtctcctctctagctaggaaagtcctagatggcatcttcttctaatcgaaggctgtttcatctaccctgaaaatctgttgtttagtgttagtgccttcatcgatgatcttagctagatctgggtaacttgctgcagcttctccatcagcacttgccacttcaccttacacttctgtgttacagagatgacttctttccttaaacttcatgaatcaacctctcctaacttcaaaccctgcagcttcctcacctctctcagccttcagggaagagagttaatgccttgctctggattaggttttggcttaaggggatgttgtggccggtctgatcttctatccagaccaaactttcttcgtatgtgcaatgaggctgttacacttatcatttgtgtattcactggatagcacttttcatttccttcaagaacttttcctttgcatttacaatttggttaactgtcacaagaggcctagattctggcctatctcagctttccacatgccttcctcactaaatttaatcatctccagcttttatttttaattaattaatttttttttttgagatagggtcttgctgttacccaggctggagtgcagtggcacgatcgtggcccacagcaacctctacctgctgagctcaggtgaccctcccacctcagcttcccaagtagctgggactacaggcacacaccaacatggccagctaatttttgtattttttgtagacagggtttggcatgttgcctaggctggtcttgaactcttgggctcaagccatctgccaccttggccccccaaaatgctgggattacaggtgtgagccaccatgcccggcccgagttttttatttaaaatgagaaaggtgtgattcttcctttcacttcaacacttagaggccactggaggattattaattggcctaactgcaatattgtgtctcacagaatagaggcctaagggagagagagagggaatggctggttggagacacagcccgaacccacaccacatttgtcgattaagtttgccgtcttcggtggacacagtgggtgatgccccaaaacaattacagtaacatcgaagacggctgatcacagatcaccacagcagatatgataatgaaaatatttgacaggtgagaattaccaaaatgtgacacagacacaaagtcatcatgtgctattggaaaagggctctgcaagactcgctcaacgcagggttgccacaaaccttcaatttggaaaaaaagtgcactgagaagtgcaattaaacaaaatatgcctgtattacttctgtaagcagaaagagttaatgaaggcaaaactagtgcatatgccagtgaaaagacttctggtcaggtctatggaagaaaactgaaaatggtcaagtatgccaacagtagctatgcatcctttaagatacaggaaaagcctccatgacaagcaagctggtggcctggagagaaacatggcaggaagacggtccctgcaggctgctcccagcacctgactgcatcctttctcccaacacctttgagctgttgggggaggctgagcagcctccctctgtttgcagcacttggcacttctaaggaaaatgagacacttaagaagagttttgtgggccctttttagttagctagctatgggtttaaatcattacaatactgcacataaaattaaggaccacgattacttgtccaaaaataaccatgaaaattgtattgaaaaccaaactacacttgcttaaaaaaaaaaaaaaatcagcatcatgcaaagggtgggtggtgaggacagaaacttataaattaccactatgtccttcctgcctgaaagacagatgagcctccctgctcctaccttacgaaggaaagagtgctagacaggcggccagcagatgccgagctgtgggagaccactctggccacaaagttctcccacctttactaccttacttatttctaaacgccagtgtcttgttcagcttctgccactcacaagctcagctgctcctggcaagacacagatggaagcagtttatggtttcaacagatgaccactgaatctattaacgtaattacggccttaacgtggagtaatttgtacagtgagggccccagccagtctcgcaggtgaagacttttgagttgagcaggagcgtgttctagtgcccacagattaaatgagagcaaacgtaagcacttacaatgccagacagaaagggatgctcgcggcagtggcagctactacataaagggcacagtcaacaaaaacagaaagccagctgatgagtgaagaaaaccagaaaggggccatccggggtgggcaggctccccatctgcctttggctacggggctgaatgaacacgcggtgtttgtttagtaatatatttctgtttatatgtgtactcccatatgcgccagaacaaggtcttcacctgcgtggaccacacggaaagataaaagtggtcgccacttgacttgaccccgagagggcagcaccattccatcctaaggtgaggagatggtgtctgctggaaaacccaagtagtacctagtaaacttagtgcacgccccggggaggagacaggaggtggcagcagcgctgtgtgcttggagcacagaggaagctggcagagataccttcaggctgagggtgcctgggacctctgttcacaacagccacccaggtttttctgtgactgttttttagtcaaattatttattgtctttaatcattaataagtggctaatcaaaactcccttaagtgacgaccgctgctgtctgtaatgctcttagggactacactgtacagactgactagagcccatgacttctgagactttccgaagatagataagcaaaaaaaattccacatgacctttacagagctgacaatggggacagggacaggcccttgacctgaggaagacacccctcctctgcctgtatttctggcactgcttagtattataacgtcaagtataagacatgccacaaccaggacagggaagactatcttcaatcatctactcaacataactcctaccagcttttggggccatggggttgccagtcgatcatgccatccccacctgccaccactgtctccagaaaaggctgaggggctgcagctctgcacagctccacaaagctaaggtcaattgaagtggtttgcccaacagttgccacagaatcaaacatgaactacactgaaatcagtaggacagtgaaatttggcagtttggttttacagtctaaaaaagccactgaatgtgacttctccatgtatgtagcccaattgctatttgaaacacagaagaacttttttgttgttgtttttttgagacagggtcttgctctgtcacccaggctggagagcagtggcacagttgtaactcactataacctcgacttcccgggctcaagcgattgctcagcctcctgagtagctgcgactacaggtgcgtgcgaccacaccaggctaatttatttatttattttttagagacagagtcttgccatattgcccaggctggtctcaaactcctaacttcgagcgaccctcctgcttcagcctcccaaagtgctgggattacaggtgtgagccccgcacccggcccctaagcaccttttacctgctactggctaagtagcttcaggactcattttttctcaccccattcctttgtttgctgtggaactggcagcagaattaatgtgccacagatagaagcacccctcacgatatggcagccctaagtggcaggctcccagcacacatgccccccactaggcccttcccacgctctcactagacgtcaacagccaattattcctctggctttgccccagttcttgtttcaaaaccgtgacacccttcacacccccaacgtcaatccctcagagttgtcacattcaacaaaaccatccaatatcacctacttttcaaacttccaactggaaaatttcaatctaggatgtgctgctctcctataaaaaccttaactgggtcctgactcacctacttcatgtcctccagatcatcaaatagctgagattaaaactgccaaaggtacacaaaaactacaatcacataagtgatccaactcggcatcaggatgaggaggtggcactgccagctgagacgcccgaagtccaggcagctgccgaccgaccctctgcaaagggaggccactgctttgctcttgcaagaaaatccctggtatatggtccctaagagaaaaatcatcatttcacatgcctgtaagatctcaacattcaggcggcttcacaagtttatggtgtcaaagcaatgttttaatcttgcagagagagcttttaggacatgaagctagaagtctgaggcacttctgtagcacaatggttctcaattgatgctaatagtggagtcatcccacctgcactatggtatgttcaaagtaatttgttactaataatagttaaaagcatcaaaaccacaaatgctttcttctaacaatgttcccttcactcccttgtatttctgcactgtgtaacctctgagaagcccattttatcactgctgcagcccagaccctggtgagagccacacatgtgaatttcatctaacatcaagatgggcaaggctgagaactgcctggctggaataatccgtcaatttgatttgctatgttatctcatatatacaacatcaactataatattttgcacaataaatagaaactcaaagcagaacataagcagaagggaaggagaggtgttcatccaaagttaggctaaaggaggaggagtggtggagaggaagaaaggaaggagggcattcctcgtcttaccctgccagcccctgtgaccgccagaccccatgcaggacagagagcacattcccatcagcagtgctggagccagcctgtgtgaacagacaaagagaaacccgttatcttctgaagctcccaatcacacacttgcctctcagatatcctcagacacacagctccccgtcaccctcatctagaacacagtgtcagataccagggagtttcttggcaatcaggacctggctcgctcgcccagaagtgcttacactccgatatgcaggcaagcagggatgtggcccatgccacacaggtggctgcttatcagagctcacgagatgactgatgaactatttaacagcagaaagacagaagcactatgaagcaatgtgaggagggcggggaatcattagtgtaaatggtacaactatgaaacctgcataagcagctaataagcatatttaatagagtgccgtttaaatgttccatttaaaacgtgattaacattcttaggttggatcctgccacctccatactaaaatttggcccattatttgttctacttttccacaaagataggacttttttgttttggttcagttcaggtatgttatacgtatggcattctttcaactctctatctagcagggttttttaaaacaatttttctcttaaacaaaatggtttcaacatttctgacaactgtcttaacccatccagttaaggccaaccatgaccctaggttcaaagcctgtcacttacctgccacatagcaggaggctcgtcaacctctctgacccttaggtttgtcaccagtaaaaacagagtttatttgaagatggtactgccaggcagtggctctaccagccctatgtgaaaatgactgtgaaatggtacaatattatgtagacactggggacattgttccatcaatggcagttttgttagaggttgcacaggcagcataagatgctattacaggtaaatggtagccatttgtgttcactttatacacctgtagtcctagtgctaacagatatgagcatctgaagtatctccattacattatttcaccacttacctttgccagcataattcttgtctttgccacgtctagaggggtggtgactgcagcggcaaatccacctgtacaaataatacccaacacccaagtgagatcctgtttactgtataattttgtaatttttagaattcctgactctgcccaaatcacttcgtcattatgtacacctggctgattgaagaacaggatgcacacatgcacaatctttatccacacgcttcatttcttttgcagcgatacagaactgcatgagagaagaaaatgctctacccactcaggtgaaaaatacaaggctccacaatttatcttgctctttcattaactagcaaactaatgagtgtgtatgtttacatacatgatgaatgtgtacacatgacatacatgtatgtggccagatgcccactctcaatatgtgagacacactgctcctaatggttctcaaagggttcatgactttctatgggccactgtctttttttttttttttttttttttttttgaaaagacagggtctcactgtgtctcaccaagactggagtgcagtggtgtgatcataactcactgcagcctcaccctcctaggctcaagtgatctctccaccttagcctcctcctgagtagctgggactacagctgcgcaccaccatgcttggctaatttttaaattttctatagagacagggtcttgctctgttgcccagcctggtcttgaactccttgcatcaagcactcctcctgcctcggcctcccaaagtgttgggattacaggcatgaaccaccacgcccagcctggaccactgttctttaaagtgactccaaaatgcgtctatcatttctgttttgcatatagcaaaatggacaaacagactcacatgtgacattgtggggattttgggtatacatggctggattctttgaattaaaggagcaaagctttttgtgtttcacgggctcctgacagcaggctagtcaaagttacctttctaagctctcttctacatcttcttagcctgagtctcgcttcagcacacattccacattatggcttccttcctaaccttctctctcatgtttgcgttatctgaatgtcgtgatggctgaactgtacacagattggactttttgaaggactttctgttttaacataaaccaagtttatggtgtcaatattacatttaaaatgcagtacaaagatatattctaaatccgaagaggccctacagagacagaaataataaaaatcctaaaaggcattacaaagattcagcttccatgagctaggggtaaagaggcagtgttataagggcaacaggacacccgtgtgtgaaggatactccagaaatagcactactttccttctcgcttttgtggcttgtggacaagaaggtcatctgatctctgccaaatatctaattatgatgctgaaataagattataccaagcctcctccatatggtaacactgattatgacactgactttttgaaaggtgtacctatttatgccctcatggtccatttctggttacccctgaatgtcacacaccttaggggtaatactatcaactgacatgaatatttgaatccccttgggtttagccatttcaaattatgactatgtaaaactcttcatctc

SEQ ID NO: 100 - DNA, 5719 bp, Homo sapiens
atggcgcggccggtccggggagggctcggggccccgcgccgctcgccttgccttctccttctctggctggttttggttcggctggagccggtgaccgccgcggccggcccgcgggcgccctgcgcggccgcctgcacttgcgctggggactcgctggactgcggtgggcgcgggctggctgcgttgcccggggacctgccctcctggacgcggagcctaaacctgagttacaacaaactctctgagattgaccctgctggttttgaggacttgccgaacctacaggaagtgtacctcaataataatgagttgacagcggtaccatccctgggcgctgcttcatcacatgtcgtctctctctttctgcagcacaacaagattcgcagcgtggaggggagccagctgaaggcctacctttccttagaagtgttagatctgagtttgaacaacatcacggaagtgcggaacacctgctttccacacggaccgcctataaaggagctcaacctggcaggcaatcggattggcaccctggagttgggagcatttgatggtctgtcacggtcgctgctaactcttcgcctgagcaaaaacaggatcacccagcttcctgtaagagcattcaagctacccaggctgacacaactggacctcaatcggaacaggattcggctgatagagggcctcaccttccaggggctcaacagcttggaggtgctgaagcttcagcgaaacaacatcagcaaactgacagatggggccttctggggactgtccaagatgcatgtgctgcacctggagtacaacagcctggtagaagtgaacagcggctcgctctacggcctcacggccctgcatcagctccacctcagcaacaattccatcgctcgcattcaccgcaagggctggagcttctgccagaagctgcatgagttggtcctgtccttcaacaacctgacacggctggacgaggagagcctggccgagctgagcagcctgagtgtcctgcgtctcagccacaattccatcagccacattgcggagggtgccttcaagggactcaggagcctgcgagtcttggatctggaccataacgagatttcgggcacaatagaggacacgagcggcgccttctcagggctcgacagcctcagcaagctgactctgtttggaaacaagatcaagtctgtggctaagagagcattctcggggctggaaggcctggagcacctgaaccttggagggaatgcgatcagatctgtccagtttgatgcctttgtgaagatgaagaatcttaaagagctccatatcagcagtgacagcttcctgtgtgactgccagctgaagtggctgcccccgtggctaattggcaggatgctgcaggcctttgtgacagccacctgtgcccacccagaatcactgaagggtcagagcattttctctgtgccaccagagagtttcgtgtgcgatgacttcctgaagccacagatcatcacccagccagaaaccaccatggctatggtgggcaaggacatccggtttacatgctcagcagccagcagcagcagctcccccatgacctttgcctggaagaaagacaatgaagtcctgaccaatgcagacatggagaactttgtccacgtccacgcgcaggacggggaagtgatggagtacaccaccatcctgcacctccgtcaggtcactttcgggcacgagggccgctaccaatgtgtcatcaccaaccactttggctccacctattcacataaggccaggctcaccgtgaatgtgttgccatcattcaccaaaacgccccacgacataaccatccggaccaccaccatggcccgcctcgaatgtgctgccacaggtcacccaaaccctcagattgcctggcagaaggatggaggcacggatttccccgctgcccgtgagcgacgcatgcatgtcatgccggatgacgacgtgtttttcatcactgatgtgaaaatagatgacgcaggggtttacagctgtactgctcagaactcagccggttctatttcagctaatgccaccctgactgtcctagagaccccatccttggtggtccccttggaagaccgtgtggtatctgtgggagaaacagtggccctccaatgcaaagccacggggaaccctccgccccgcatcacctggttcaagggggaccgcccgctgagcctcactgagcggcaccacttgacccctgacaaccagctcctggtggttcagaacgtggtggcagaggatgcgggccgatatacctgtgagatgtccaacaccctgggcacggagcgagctcacagccagctgagcgtcctgcccgcagcaggctgcaggaaggatgggaccacggtaggcatcttcaccattgctgtcgtgagcagcatcgtcctgacgtcactggtctgggtgtgcatcatctaccagaccaggaagaagagtgaagagtacagtgtcaccaacacagatgaaaccgtcgtgccaccagatgttccaagctacctctcttctcaggggaccctttctgaccgacaagaaaccgtggtcaggaccgagggtggccctcaggccaatgggcacattgagagcaatggtaaggcctcagtaaccgtgaagcagagctctgctgtgactgtgtctctgggtgctggaggtggcctccaggtctttacaggtgtgtgtccaagagatgcaagccactttccagagcccgacactcacagcgttgcctgcaggcagccaaagctctgtgctgggtctgcgtatcacaaagagccgtggaaagcgatggagaaagctgaagggacacctgggccacataagatggaacacggtggccgggtcgtatgcagtgactgcaacaccgaagtggactgttactccaggggacaagccttccacccccagcctgtgtccagagacagcgcacagccaagtgcgccaaatggcccggagccgggtgggagtgaccaagagcattctccacatcaccagtgcagcaggactgccgctgggtcctgccccgagtgccaagggtcgctctaccccagtaaccacgatagaatgctgacggctgtgaagaaaaagccaatggcatctctagatgggaaaggggattcttcctggactttagcaaggttgtatcacccggactccacagagctacagcctgcatcttcattaacttcaggcagtccagagcgcgcggaagcccagtacttgcttgtttccaatggccacctccccaaagcatgtgacgccagtcccgagtccacgccactgacaggacagctccccgggaaacagagggtgccactgctgttggcaccaaaaagctaggttttgtctacctcagttcttgtcataccaatctctacgggaaagagaggtaggagaggctgcgaggaagcttgggttcaagcgtcactcatctgtacatagttgtaactcccatgtggagtatcagtcgctcacaggacttggatctgaagcacagtaaacgcaagaggggatttgtgtacaaaaggcaaaaaaagtatttgatatcattgtacataagagttttcagagatttcatatatatcttttacagaggctattttaatctttagtgcatggttaacagaaaaaaattatacaattttgacaatattatttttcgtatcaggttgctgtttaattttggaggggtggggaaatagttctggtgccttaacgcatggctggaatttatagaggctacaaccacatttgttcacaggagtttttggtgcggggtgggaaggatggaaggccttggatttatattgcacttcatagacccctaggctgctgtgcggtgggactccacatgcgccggaaggagcttcaggtgagcactgctcatgtgtggatgcccctgcaacaggcttccctgtctgtagagccaggggtgcaagtgccatccacacttgcagtgaatggcttttccttttaggtttaagtcctgtctgtctgtaaggcgtagaatctgtccgtctgtaaggcgtagaatgagggttgttaatccatcacaagcaaaaggtcagaacagttaaacactgcctttcctcctcctcttattttatgataaaagcaaatgtggccttctcagtatcattcgattgctatttgagacttttaaattaaggtaaaggctgctggtgttggtacctgtggatttttctatactgatgttttcgttttgccaatataatgagtattacattggccttgggggacagaaaggaggaagttctgacttttcagggctaccttatttctactaaggacccagagcaggcctgtccatgccattccttcgcacagatgaaactgagctgggactggaaaggacagcccttgacctgggttctgggtataatttgcacttttgagactggtagctaaccatcttatgagtgccaatgtgtcatttagtaaaacttaaatagaaacaaggtccttcaaatgttcctttggccaaaagctgaagggagttactgagaaaatagttaacaattactgtcaggtgtcatcactgttcaaaaggtaagcacatttagaattttgttcttgacagttaactgactaatcttacttccacaaaatatgtgaatttgctgcttctgagaggcaatgtgaaagagggagtattacttttatgtacaaagttatttatttatagaaattttggtacagtgtacattgaaaaccatgtaaaatattgaagtgtctaacaaatggcattgaagtgtctttaataaaggttcatttataaatgtcagtatagttggtggtccttcttttacaaacgcagtcattctgcctttaattatcttcccccaaaaaagaaaaaaaaaataggcgaagcaaaatcacatactgtttgtttgctccagggcagacaacactgctagattcctgacattttgttttgaatttttctacacctggagcttgttagtcaaggtctaaaatccctaagtgtggtgacctttccatttcatcctgccttttcaaagctggcccaggccctcctttcagtctgacatgagaatggcgagaatggctcacccaccgtgccctcctgcacgaagccagctgggcccacctagtcacttgagttgcagctgctttctctcacacaccacagggggcgctggacacatctctgtaaaataatacaattgtgcgtttttatgggtgaaatctgagggtaattaaaaccagcagcctagttacccagaaagagtgcttgctatgcacctgtagttcaatctttctttctttttcaacaaagcctacccttacacaacaggaattaactagggggagaaacacccacatacacaactcttccccaagtctccttttcccacaaacaaacaaacaagctattcttttagaattataaccatcttgccttctgctgaatccaccatcaggtggcaggaaatgaaagatcagatacagatcaaatgaaagctctaaaaggcctggcctcagcattaccaaacttatttattaagaggttctgaggaaattgttcagagtaccgccacagaccccgttttcttctcttagctctctggcatacaggccaatgacttcataccagccagcctataccacggatggcacaatctccatgccggtatcttagcacaactggtct

SEQ ID NO: 101 - protein, 1110 aa, Homo sapiens
MARPVRGGLGAPRRSPCLLLLWLVLVRLEPVTAAAGPRAPCAAACTCAGDSLDCGGRGLAALPGDLPSWTRSLNLSYNKLSEIDPAGFEDLPNLQEVYLNNNELTAVPSLGAASSHVVSLFLQHNKIRSVEGSQLKAYLSLEVLDLSLNNITEVRNTCFPHGPPIKELNLAGNRIGTLELGAFDGLSRSLLTLRLSKNRITQLPVRAFKLPRLTQLDLNRNRIRLIEGLTFQQSLEVLKLQRNNISKLTDGAFWGLSKMHVLHLEYNSLVEVNSGSLYGLTALHQLHLSNNSIARIHRKGWSFCQKLHELVLSFNNLTRLDEESLAELSSLSVLRLSHNSISHIAEGAFKGLRSLRVLDLDHNEISGTIEDTSGAFSGLDSLSKLTLFGNKIKSVAKRAFSGLEGLEHLNLGGNAIRSVQFDAFVKMKNLKELHSDSFLCDCQLKWLPPWLIGRMLQAFVTATCAHPESLKGQSIFSVPPESFVCDDFLKPQIITQPETTMAMVGKDIRFTCSAASSSSSPMTFAWKKDNEVLTNADMENFVHVHAQDGEVMEYTTILHLRQVTFGHEGRYQCVITNHFGSTYSHKARLTVNVLPSFTKTPHDITIRTTTMARLECAATGHPNPQIAWQKDGGTDFPAARERRMHVMPDDDVFFITDVKIDDAGVYSCTAQNSAGSISANATLTVLETPSLVVPLEDRVVSVGETVQCKATGNPPPRITWFKGDRPLSLTERHHLTPDNQLLVVQNVVAEDAGRYTCEMSNTLGTERAHSQLSVLPAAGCRKDGTTVGIFTIAVVSSIVLTSLVWVCIIYQTRKKSEEYSVTNTDETVVPPDVPSYLSSQGTLSDRQETVVRTEGGPQANGHIESNGKASVTVKQSSAVTVSLGAGGGLQVFTGVCPRDASHFPEPDTHSVACRQPKLCAGSAYHKEPWKAMEKAEGTPGPHKMEHGGRVVCSDCNTEVDCRGQAFHPQPVSRDSAQPSAPNGPEPGGSDQEHSPHHQCSRTAAGSCPECQGSLYPSNHDRMLTAVKKKPMASLDGKGDSSWTLARLYHPDSTELQPASSLTSGSPERAEAQYLLVSNGHLPKACDDESTPLTGQLPGKQRVPLLLAPKS

SEQ ID NO: 102 - DNA, 34245 bp, Mus musculus
  misc_feature (1)...(34245): n = A,T,C or G
atgtccttgaatcaacaatggtggctatcatcataatagttaccccagccacctcaaggtgctccagccctctaactccatctaacagcctggaacagtactcccattccttaggctaagcatcctgccccatgaacacttcaactttcacttaaggcaaggctatgtccttcaggctgtctacagtgaggaaggcctctacctcccagctcctgttcatcatctgtgatgtcgtgacaattttgtagtaacggagatgagccaactacccaagggcagaactcatcagaggaatgcaagtgagctgaagagaggtagatagatatagatagatagattatagatagatggtagatagagatagatagatagatagatagatagatagatagatagatagatagatagataatatagagacagatagatacatagatgatagatagatagatagatagatagatacatacatacatacatatgtacatgatagatacatagatagatagatagatgatttagagatagatagatagatagatagatagatagatagatagatagatagatgtgttataaaaataataaaatctgtttttcctttcccagctcctgctcctaaaatgatggctctgagactaatttacgtactaataaatacctaagccatgagcttcagctcattcactgactagcttgtaacttatttaacctattctaagtcttccacatggttaggtacctctccttcagtcttaatctgcaccttctcagcatctcttcctctcatctttccccatgactctctcaaatctccctttattttctcgctatttcccagaatcctccttcttcctgccaatgttccatctcctatctcctgcctcagatcactgggcaacagcttttttattgacaggtgttacataaatgccaccacaatcttcagtttttcaatagggatggcatatacctcaccacacccacatgtctgagacagattaatctagccccaattcccaccccagcagcatctattccctgccacaactagactagcattggggaccaaatcaatcaaggctcaaacaaggcacattcatctcccagaaaccagcaggaggcctcccagccttttccacaccttcagatggtactgaaaatagccactgtccaggtgtccctaaaccaggctttcctgaggatgcagagcccagatgacagcaggcttcctctctgccatcagctaggcagatgtcctgcctcaagacatctgcctcaggcctgtccatgttgctactgggctctgtggaatagactgagggcttcatatactcagcaaagaagcatcccatatctaagtgacagccaattagatgccatggcaactattgtgcatcagagaagcagaaaagactgcagtgatatctcactggagcaacaccacacttgtgcactaacatacatgatcaccccacacccttgaagtttttattgataagaaataccaaagatttctattaaaatacctaaatcataaaggcacagtttctagaggtaaggaaatgagtgagtggcctggagtacttgctgctctcacagaaaacccagattctgtccccaatctcataaactcatctataaacccagtcccaataaatctcaatccaagtcctatgcacctgactccagcctatggaaatatgggtctcaaggggcaatgtgtcgaggggtaggactgatggagggagaagacagaaacaatagctggggtgggatcataaggtcttgcataagctggtaacttatgccaaacaagaaattatattatatgtaatataacatatattacatattaagaaatatagcatcttatatcatgaattcaaggcctatgccttaacatagtaaaagcaatatagagcaaaccagtagccaacgtcaaactaaatggaaagaaacttgaagcaatcccactaaaaccagggactagacaaggctgcccactctctccctattaattcaatagatagaactacttgtagttctagctagagcaattagacaccaaaaggaggtcaaagggatacaaattggaaaggaagaagtcaaaatatgactatttgcagatgatatgatagtatacttaagtgatcccaaaaatcccaccagagaattcctacagctgataaacaacttcagcaaagtggctggatataaaattaactcaaacaaatcagtggccttcctctactcaaaggataaacaggctgagaaagaaattaaggtaacaaccttcacaatagtcacaaataatataaaataccttggtggcactctaaccaaacaagtgaaagatctgtatgacaagaacttcaagtctctgaagaaagaaatcaaagaagaactcagaagatggaaagatctcacatgataatggatgggcaggattaatatggtaaaactggctatctttccaaaaccaatctacagattcaatgcaatccccatcaaaattctaactcaattcatcatagagttagaaagagcaattctggaataacaaaaaacccaggatagcaaaaaactcttctcaacaataaaagaacttccaggggaatcatcatctctaacctcaagctggactacggagtgatgatgaaaaaataataataaccctgcatggtattggtacagtgacaggcaggtagatcaatggaatagaattgaagacccagaaatgaacccacacatctatagtcacttgatatttgacaaaggagctaaaaccatccagtggaaaaaagacagcatttttaacaaatggcactggttcaactggtggtcaacatggagaagaatgtaaatggatccattcttatcttcctgtacaaaactcaagtccaagtgaatcaagaacctccacatgaaaccagatacactgaaacttatagaggagaaagtggggagagcctcaaacacatggccacaggaggaaaattcctgaacagaagaacaccaatggcttatgctgtaagatcaagaatcaacaaatgggacctcataaaattgtaaagcttctctggggcaaaggatgctgccaataggacaaaaaggcaaccaacagattgggaaaagaactttaccaatcctatatcggatagagggctaatatccaaaatatgcaaagaactcaagaggtaagattccagagaaacaaatagccctattaaaaatagggtacagagctaaacagaattttcaactgaggaatatcaaatgaccgagaagctcctaaagaaatgttcaacattctttgtcatcaaagaaatgcaaatcaaaacaaccctgagattccacctcacaccagtcagaatggctaagatcaaaaactcaggtaacagcagatgatggcaaggatgtagaaaaagaggaactctcctccattgctggtgggattgcaagctggtacaaccactctagaaataagtgtggtggttcctcagaaaattggacacaatactacctgaggatccaagctgcaccactcctgggcatacacccagaagatcgtccaacatgtaataaggacacatgcttcattatgttcgtagcagccttatttataatagccagaagctggaaagaacccagatgtccctcaacagaggaatggatacagaaaatgtggtacatttatacaatggagtactactcagctattaaaaacaaggaatttatgaaattcttaggcaaatggatgggtctggaggatatcaacctgagtgagataacccaatcacaaaagaacacacatgatatgcactcactgataagtggatagtagcccagaaacttagaatacccgagatacaatttgcaaaacacatgaaactcaagaagaaggaagtccaaagtgtgaatacttcgttccttcttagaatggggaacaaaatacccatggagggagttacagagacaaagttcagagctgagatggaaggaaggaccatccagagactgccctgcccagggatccatcccataaacaaccaccaaacccacacattattgcatatgccagcaagattttgctgaaaagactgtgatatagctgtctcttgtgaggctatgtcagtgcctggaaaatacagaagtggatgctcacagtcagctattggatggaacacagggcccccaatgaaagagctagagaaaatacctaaggagctaaaggggtctgcaaccctataggtggaacaacaatatgaactaaccagtaccccccagagcttgtgtctctagttgcatatgtagcagaggatggcttagaaggccatcaatgggaggagaggtccttggtcttgcaaagtttatatgccactgtataggggaatgccagatccaggaagcgggagtggatgggttggggagcagggtgggaagaggatataggggactttcgggatagcatttgaaatgtaaatgaagaaaatatctaataaaaggggggggaataaaatgctcacaggaggaaatatagagacaaagtatggagcagagactgaaggaaaggccatccaaagattgccccacctggggatccatcctatatacagtcgccaaacccagacactattggggatgttgggaagtgcttgtttacaggagccagatatagctgtgtcctgataggctctgccagagtctgacaagtatggaggtgtatactcgaagccaaccattggactgatcttggggtccccaaggaggagctggagaagggattgaaggagctagaagatttgcagtcccaagcgggagcaacagtgccaactggccagaccttcccagggctccaggggtctggaccaccaactaaagagtacacatggagagacccatggctctggctacatatgtgacagagtatggccttgttggccatcagtgggaggagtggtccttgggcctgagggggtttgatgccccagtgtaggggaatgccagggcagaaaggcgggagttgggggtgagcacactcatagaggcaggggaaggggagatggcatggtggagggggtcctgaggggaaacctggaaaggggataacatttgaaatataagaaaatatccaataaaagaaaaaagaagaaatatagcatcttatatactattttcagggagagaatagaccaagttcctcagatcagacagagaacacagaacaccacaagatcatctttcaccgggctgataaccacagcctttaggtaaggtttccaggaacagaacccttagctcctcaaaggcccagactccacccttagacctttctaagcctgctcctggacaaggacacagaactaaccttccctttgttccttcgtcaggaccttctaagaaagtcttgggctgactggctcccaacattcctcaactgccctggcaacatttggcattttctatgaccctggccatggtccagatgtattaaacaaaataactaatgtttatgcaaattaaaaataaactaaaataactgatagaggtataaatcaaaataaggtgttctgttgtgactgaagtcactgccatgttctgccaacacaaatgctgcaaaagttgttctgaccctcatccatcacagacgtcattgtggggtttgcctttaagaacacagtaccctgagccccacgacgaagggcatttctgaggtgctagcccactattggtcaccagccaaaatagaggactccttacactctttttttttttttttaatttttcgagacagagtttctctgtatagctctggctatcctggaactcactttgtagaccaggctggcctcgaactcagaaatccgcctgcctctgcctcccgagtgctgggattaaaggcatgtgccaccacgcctggcctccttacactcttaattggcttaatacgtgtgatgacatgtaactttctcacccatatcattccactcacaagtcaatcaaccctatgtgttctcatctagacagacagacagacagacagacagacagacagacagtggataaaaactgtacctaccaaaagcctgtatcgagctgtgctgatggacacccatcaggttggatgtggggagccatcatcagcaaactttagggatgctggccttgaggacaagctttaggagcaaggtatggatgggaatcctgtcctaagagctgagcagcctgctcataaacagctcacaatgagatgagaagggaagagcacagggaagaagctgttggggaagccaggtcaacttctgtactttcagccatctggcaagatgcccaagccctaccccagcccttgctctcgcctgctcaccctcatcctgtcttagtcagggtttctgtgactgtgatgaaacaccatgaccaaacccaaggcggtgaggaaaaaaggtttatttggcttacacttccatatcactgtttatcatcaaaggaagtcagggcaggaacgaaaacagggctgaaacctggaggcaggagctgaggagacaggagctgcatactgcattgctccccatggcttgctcagcctgttttcttatagaacccaggaccaccaggccagggatagcagcacccacaatgggctgggcttttccccaccaatcactaataaagaaaacaccctgaagtcagatcttctggtgtttttttaattgaggctccctcctttcagataactctaacttgtgtcacattaacataaagttaactagccctccactcagccaggggagtcatcttttcagtcctctacagctcagagcctattggctctgcaagctttcccagaaggcactgtgctcatcacatggccagatgggtgtccatctcagcccaactcggcttcaggggtttagtgaggctccgtcaccaacaaagggccagatgaagccctctgtgccaaagtgacaagactggaaggtgttcccacacataatagagacacacagggagcacatgtacacaacatacacataggcaacaaacacacagaaatgcacacttagaatttaaattcagatgcacatttaaaccactacactggagaaagttcaggggaaacaggagttagggatcacatgttttaaagaacaagtacatgataaagtgtgtggggagggggggagagagggcaagatggggggggaggggcgaggagagagagattgatgtcatttggatcttaaactgggcagataaattagtgttcctcctttagcttctgggaaatgtttcaaagcagggcagaacagagagtttttatttgcaaacactattaaccatttcctgtttcaacctcagaaccacctgtgaatctgcttgttacctgggctgcagggccctgtgcccccatgacgtttcactctacccagtaggccaccatgggtttggggtttagattctggccacctctctaccttctgtttcccttggagttgtttcaaaatgatcctttggtttcctgaacgttctgtgcctgtcccacctagatggaaacttgccattacctccagggtgtgggtatcccctctccccaactttccgactatgctgtttttgtgacacaatcttgatgtcagcatcctggaaactcatgcttctctgccctgtccagaaggaaggatggccccaggaggacttctgaggacttctgtccatgagccccaccaactaggatcttcctagttgccacagtgaatctatgccaccaaccctggctcagtactcaaagggactactagcaggctgacgtgtaacaagagaatgcttcagggaatgatgcccctcagagcaacaggcacctgctctgccatactgtgcaggcagctggcacagtggaatagcatgtctgttgggaattgtgtactagtgggaggtagtatgtgtgttggaaactgaatgtctattgggacatagcatttatattggaagatagcatatgtatttgaggaaggcatgagccctgaagattgcatgtgtgttgtgggatagtatatgtatttgaggctgtgtgggttctatcatgtgtattggggattgcgtgtgtgttaagagatagcattacgtaggactctattggggaatagagtgtgttagagatctcatatctgtatctgaagatagcatgagccctgaggattgtgtgtgtttattgcaggatagtatatgtgtttgagattgtgtgggctctatcatgtgtgctggggattgcatgtgtgtggctattggcatagggaaagtaattagggctaccccagcaacagccttgctcctcaccacactgctagggaggaaaggagaaagtaaggaccagaagaaggtacagcagaaggggaaaagagaaagataggcagaggtcctttcactctccacggaaagatattccagtacctgcaggcctgaggtgttgtggaaagcaatagggatgtgctgacagcctgctgctcgggctcctgctcctctccagtcctcatgatctgctctgtatagtctgagtcccataggaagattctagatagaacatcagagcaaggcagggtggaatctgtccagaattcacaataggctcatagccagtatctaatcacctagccttgacaggggtcttgctaccctgagcatgccagaaagacataaaggtataaaggaggctctgtaacagccaggcgtggggaggggatccccctagcttctgcccacaggccccatgctgagactggaggcggccagtctgtgcctcacactctttttccatttctgtgctgttcaaagtaatgtttccttccccaccaagctagtgcctctgaacctgggtggctgaggcagttgccagatggtttccaggcgggctgcctattttagggtggtgagacccacacatctcattgctaatattagcagtttcgttttccctttttttcccattcactgtggcgaaacacagagagcagaatgattaaatcatcagaatgccccagaaatgactagccagccaggtactatgcatgcacacaagtcggcccaccccacctaatcccagagagacaagcaggaggtgaggtgggcctccacctcctagggactgaggaaagttgactgggaaagacctagaaattgagtctaccccagcctggtgttaggtttttctcaggggaagagaaagatgcagggcagcagagctagcaaacctaagacaactatagaagcagagaaaacagtgagatccgggcagcagatccagcatcttgaaaggaagaaaagccttaagagaaagcaagaccaggcccagggtctttctgaacctacaggggtgtctggagaggaaaggcatcgtctcgggtcctaggaaatgttcactatagcccttcgaggcctcctctgacccatcaaacgggagcatgtgggatagctgggctcttgctcctcagtagtaaaggactaaggcatagctcagggcattcaaggccacgcatggcagacaaggtaggggagggtccagcttgccctcgctgcggccataggtaccaaagccaggcctcgacacccaccctccaaagggacaagagtctggccctagtttcagtctctctcagccctgggagctaaggctcgatcggggtaccaggaatggaaaagaccaaacctacccacaagaggggctagaaatggagaggaccccatagcaggacaagaggcaaggacagctagtcagagagaaccccccctctctgctccccaatctctcactagtcccttacctgctcctcccaggcatcgttccctcccactcccctcccccttccatgcccctcccccacctctagttgcctgttctcccacccttgtggaggtggaggaagagggggcgggagccaagaacaggtctcctccctccaacatgacctgggacagtttcctttccgctacagacaactctgcctgagcagcggggaggaggaagaggagactgctactgaaggcgacactgccaggggctctgggcatgtgggtccggcaggtaccctggtcattcacttgggctgtgctgcagttgagctggcaatcagggtggcttctaggtatgtggctcctagggatgtgggatcaattggggttggtggctggggcagggcttgaagaaacgttcaccctcggttcctattactggaggggaggaacacctgtgtccctggttacacggattggctcctggttacacagattggctttaggtgggttttacaggtgaaatgccccctggggctcaaaatccaccccctccttgcttttagacagacagaacatttatctaacgtcagttgatcttctgtgtccctctctgtgaagcgatggtaggtctgaacagagctctgacctcagccactgcttcaggattctggcaggccctggtatccttggcctttctctatgtttttctatggttggggacatccctacatggagcctgccctacacactgtatagatgactgaagatccaagagtataatcagctgtctaccctcatggacaagcttcccgtgctagcatttctgggggactcccgagttcatatccctggcctcatagcatcctgggggtggggggtgtgtgaaacggagaggtccaggaatcctgctcaaattcctcacagtgaaaacacagctccctgtactccttactcctcactaccctgtaccccttggcccctgcccaccctctggactgagccaaccttcactgagaacctggtcctgggaccagagggaactttgtttctcctggatgtcaacaaactcctaggtcagagctacacctgcggcgcatggaattgtggcctagacaagcttatactcttgtgctgccttaacatctttgacctgcaatgatgttcctttgctcatatgacgtcccagtcaccttcaccccagcctcttcactaccgtgaaaacaggatgggactgggagctgggtgctgggtgcttaccaccacaggccctctcctgggttgcaggctaaggctggttgggaagccagggacattttccctccacgtaccctcttaagatagcccatggtttgctgtcaagactggatggaggaaacagacctgaacatggtagatggtctgaggccctagggtgaaagatgtcccttggggaaaccttgtcaggaaacccacggagcaaagtcggaaggattatgtgtcattggagagaagcaactgagacagaaaggggactatgactcactctggtgacctggcacactgggcatgtccgcaaatgaagctttgatgagacaatatggagatacagatgtatttatgcaggcctactgtagattgtctctgacaaatgtctcaaagtggcatgcctccttcacgacctgaatagctcaacgtgggacacctcacaggccagtgccatttggcagccgtggacctttagtctagtgcatttcttccctcctgattggccgcccttctttctctctgttagtcccacagacagtccctctcatgctgactgttttaaaagtctcccaacctcaacagcggctgtctagtgtctaagatgagcaaaattcaggctcagaaatggatcatctcatactcagactaaagacagccatagtggatcgtgcccatcaaagttcaagaccagtctgggctgccttataggaagaaaaaaaaaaaaaaaaaaagttagtccataaaaccattggtgagcatggtgatcttgggcttgtctaatgttcagacagccctgattcagagtttatgggtacatttttcccagttgtgtctaaggaacactatcaacatgtgtgctggacctctggctcttacagcctgatcacacactcttctgtgatttttccctgagcttaggggttccattccaaatataccagtcagtctctttagcattttctcattcacattttttccttttgttcttttgttgttggggggcttgattgttttgttttgttttgtaccttatggtgtatggcctgtgtgtatgtgcatcatgtgtgtgtctgatgtctgtagaggccacaaaaaagcattggcttccctggaactagagtaataaatatatggttgtgaggtgccgtgtgggtgctggaaattgaatctgggtcctctggaagatcagccagagctcataactgctgaggtatttttctagcctataacttggtggaaacaagtattgccttggccatgagatttactcagaccatctgtcaaaactgccaaacatatcctcagacacatttcttaaagtcagatttgcttttttgtaatttatacctttgaaaaatatatatcatgtacatatatgtgtatacacacctgtgtgtgtgtgtgtgtgtgtgtgtgtgtgtgtgtgtatatatatatatatatatatatatatatatatatatatatataaaacttatgaaatccatctagctttgctcatgtgtacacatgttcagggttgaccgtttgggactggacaacctatgtgggaattccatgtctctaaggcaactgatcctccctctgtcattagcttcctatagctctttacatagggatgggaccatgtggtgttccctctgttcacaactgtgtgtcaagtgatgttataattatgtttatcttgtatttagtcaaccatgattcagaattcatgggtgcgctttccctgtcaagagaacactatcaacaggtgtcctgggcctgtggctcttagaaccttatcacattttcttctgtgtgccttaggcttagaggtttcatcccacacataccagttggagttacacaacccacggtcacctactctctctacattttgaacatctgtgtatctctgcattcatctccttatgctgcaaaaagagtcttctttgatgagggatgagagctagacttatctatataaggatagatagttggaaaacagttacagaggatagatagatagatagatagatagatagatagatagacggacagacagatagtagatagatagaaatatattagtttagaaactgacttttttcttttttgagacaatgtctcatcagatttcccaggccagtctcaaactcaaaattgtccagtaccagtttcacaagtgctgagatcccaggcacatacaacttcacctggtttattggttcagccttccttggcttggctggatggttgtcaccgagtaccacagttggcggagaggggctttaggaagcattgtctcagacttgaggttctttttattcccccaagccagtttctctgtgtggccctggctgtcctgaaacttgctgtgtagatcaggctggcctcgaactcacagaaatgtacctgcctctgctgggactaaaggtatgtgctaccactcccagcaggcttcaggttcttaagttggaactcaagagaagaggatgttcagtccctgtaggccagtgtgtgccaggtccccctcctgcctctgagtgttccagcaacctttaagtttcttggtatctagacacacctccacttctgccttcatccgcaggtgtcagacagtgtccgtaattccctttctatgcagacaccagtcctactagctaagaccttacccttatcttaatcctatagctagctcccactcctaccaaagttctaacctgaggtcctggggtaaagattccagcatgaggttaggaacaactcatcccccatctcccactttctcccatcactgtgatgctctggatcactaagcatcagtggcaagtgttagaaagccctttatccctcatcctccctagttctctggggacacatcctcccctggatgcagcaagagctctgacatcatgcttctggatggcttgcttctccctggctgggacccttgtgagagacggttttggctgaatgtctgtaggtcccctgcttctcctttggcttggtaagcctgtgcccttaacagcctaggcaggagatgtggagtgtctgaagcatcccacacctacttgatactatagctctcctaatccttctaggtgcccttctgggatcctcatattgaggatatttctccaggtggacatggggaatacaatccatttgtaacaaataagggaccccctgtcacccgcctgaccatcctttcacccagataagtcttgcctaaataaggtattgtgtgcgtctgtgtggttatgattgggccctagcactcaggagcctgtggtctgcagtgaacttgtcttgtggccctctagcctcaggctctgactaacaggactctccctctcaacctcccaatgctaaccagaacatgccacccacccatcaactcacctttgtacacaaattcaagagcgagctcagggaaaccaagaagctccctgtcatttctgatttctatcttctatgcagaacgtgtaaaggctaaaaagcccacgaaggctccctggaggagatagccttgcttagtgccttttctgttgttgtttttctgggtgatttatgaagaatgaggtttgatcaccacagggttctaggagttgggagtctggagtcaagagtggcctctggtgagacctccttgccagtggaaagattgcagagtccccaaagtggttccaggaatcatatcgaaggacagagctcagtcttacaaacccgcctccttgctagacagcacttgatccaacagtctgtgagtggctttccagtggcctctgcaactctcccttcccagtatcactagttagtatattactttggagttagtgttctggggtcagacattcactgatggcatgatccctggtgaaagctcccaaatcagttggacagaaatgaggctgaagatcagaaagctaacttatcaccatcaggaccccccactccggacctccaggggcaggagtcctgagataggttgggcaggggaaaggagatctttatcatcacaatctgatccccatacctcactaggtcagtagaaaaggggtgacttcaatgaggctgcttctgggtgcattcccaaaaggggtcccagccagtcctaggttctcataccctggttagagacccccaaatgagagacaatgtggcctaaatgtgaagagggagccaaatctcttcagtggcaagcacactgccaagcaaaagtcaggctgctctgttgatttttacaaatgaaaggagtgtctgtgcgtgtttgtgcatgtacatacttatcgcatgtatgtgtttatctacatgtgtgtgaactgtatgtgcaggccagagatccatatcaagcatcttctttaatttttctccaccttaatttttgagacagggtctttctctgagcctgaaacacactgacttgttggaaagccaggttagctcctcaacacgccccaggggtcctcctgtctctgccttcccaggactgggatatcaggcacgtgtgtgctgccacaacagccttaaataagtgctagcaatcagccttgtttgcttggcaaacactttaacaactgagctaaaaaccaaagacccatgaaacttacacgggtgtcagttttgatgtccatggggccagaggatgatatcctgcctcattactctacttctatgcaaattgtatgcgttattaactctgagtcaccaataatgaaagaaagagaagcatttctccttggagtcatttaaccaagagaatccagattagaattctcgacttcctgttccacagggtttccaccctctgtctgtctgtctgtctgtctgtctgtctgtctgtctgtctgttgtatgtctctgcctgcctgaagattgtcttgtgactctgtccctgtgtctcctgttctgtaaatgtcatggctgtctgtgtctgtgagtgttatctgtctgctgtatgagctcgctctctctctctctctctctgtctctctctctgtctctctctctctgtgtctctctctctgtctgtctgtctctctctctgtctgtctctctctctgtctctctctctctgtctctctctctctctctctctctctctctctcgtgtgtgtgtgtgtgtgtgtgtgtgtgtgtgtgtgtgtgtgtgtgtgtgtgtttgtccctagcaaagaggctctgtctgtattgaaaagcatcgtatggggaggtaaggggatacttgacagaaatctttaacagagttttacaaaggattaagtcactttctccaactgatctccactgacccagacaagcaccactatcaaccaatacccataactggaggttttcaacctttgtgatagattgtagaatattgctttcagcctttgtctctgctgttttcagctggatcagggtctggaccaacacctaacttaagattgctgccatgcattgcttatgttgtaaaaagccgatgacatgggaaatccaaggtagttgtttgttacattgttctcttggaggcaggttaaagcagggtttggtggtaccaggccttaatccaagcacttggaaggcggaggcaggcagatctctgagtttgaggccagcctggtctagggtgagtttcaggacaaccagggctacacagagaaaccctgtcctaaaacacttaaaaaaaaaaaaagtctgagtctgtgtacataaccttaagtgaattaataactctatgaggccctttatttccttgcgacagcattttccactaaacctgaaacctgtgtttttccatccaaaatgactggccataaatccccaaggatccccctgtctctgctgctacgatgctgtgattgcaggcatcctgtctgcccgtctattatctgggtgctgatgatccaaacttaggtccccatgcttgtgtagcaaatgctacacctgctgggccacctccccaactttccattctctctcctgtgaagctgctagttatgcagacagcatcaaaatagtggaactcacagttcagggacccagggaagtcctcacccactgtgcccagatagcaggattgtcccacctcctctctacccaccacctgtgaattaatcacaagtctgtctttttttttttaatccaggttctttttttttttatttattagatattttcttcatttacatttcaaatgctatcccctttcctagtttcctctctgaaagtcccctatacccttccccacacctgctccccaacccacccactcctgcttcctggccctgacattcccctatactgggacatagaatcttcgaaagaccaagagcctctcctcccattgatggcctactaggccatcctctgctacatatgcagctagagacacaagctctgtggggtactggttagttcatgttgttcctcctatagggttgcagacccctttagctccttgggtactttctctagctccttcattgagggccctgtgttccattcaatggatgactgtgagcacccacttctgtattttccaggcattgacataacctcacaagagacagctatagcagggtcctgtcagcaaaatcttgttggcttatgcagtagtgtctgggtttggtggttgtttataggatggatcagaagtctgtctttatcacagcgtgacagtttctgcctgcaatctccacacttaggaagtagaaggagagttgtgagttcaaggccagcctcagctacttagccagttcctgtcttttaaaaagaagctaccattatgtgttttaaccactgtgacacttcatttccatttgcctttatgttccacaggcatccacagcatgaaagggagactcagaggtactgtctggggtctcggccactgaagtagctatctcacattctcagaagtgcagggagcagggatcactgcagtagcttagtgctgacccctctagctgtcatcatactcagcccaatttccagcagctttcccaggggcctattcattactgggggttgggaggggggactttactctttatggatgaactgaatgtctgagggtattttccctatggtattactacctggtagcctctggagatagatgctctcttgccaaagcctgttccctcctgtccatccctctagcaaaacatcctctgtgaggaagccctcccttgatttcttcaggcccagcacaggcacactgagagaaggcacatctcagttctatggaagaattttgaggggagatggctaggaggagtaaagaggctgtgggacacagagagaacagggtctactctggggagggaggcaaaaccaccaggacctaaacagagccctgggatggacacaggcagagacctataaaaggacagagacctgggaagtcacaggtcctgccatcagaggaataacaaagagccagtgatagtgactcaaactgtcacacattcagataggaacacaagagatctggaagcaaacaacagatgagacaaggatctgccatctgttaacaaatgtctatacaagagctcatctgggacaacctaggggtcaactttgagaggcaggtagcagctggttctctgaggacacaccatggttccaaagccaagtagatgggatcccatcaaagggtatgggagatggtaactggacagaggtgcctagcatactcacagatcacaggtgaccttgggcaggtgtgacaatcctgcccaaaacaaagaaggggtattgtgccattttagttttctggggctcttctggtcccatgactctggaaagtcttgagactctggagattgggggttcagtgtggctgtagtagtggatttaggtggatcagagtagtgttgcacagactgaagacttcctggagtactggtaaagggaccccaggtttccaaggaccatagaccagaccacactgatagagcctaaaaggatgggatgtgtctactttgtcaaatctgagtctaaccataatgtagttgctggaggctttcttgaaaaaggcttatatgtttcttgagtggatgtttaaagaaaagagccattgacactactatgttgtgacctgctagctgtgtttggacacacaatttcaagccaaagaaagagtatttagaagtccccatcgtggttgtgttccctttaagatgaaacagaactttaaatgggaagacatcatactggcaacccctagcctgggcctagttcttccgaggccccctgacaccgctggttcttctggcccatagagaccaatgtggaccactgctcaccctgcccagaaccatatgacccagtcttcaccaactctgcatggaatctagggatcctggcccttgaggagcgccagacccagctcataggccacgcccaccctcaggtctaagtgacattagattatctgtatgttcatcatccatggtacagctgagaacatcaaggagggaaagtggcagtcctacttttcgccatgtggtgatggagaccatttctgggcaaggctacatggtgcggatggatgtctctgggtttgcctctgctgaagtctgcttgctcactgcagacagctctgccacgtatctctggcttcctttctgcgctggaagatttcacataccttgtttgccaggtgttttgggcctcagttctccccccatccagcttctccctaactggcccctcttctttgcctctgacccctgctttctgagcccataaccttagctgtggcagcacagcctctctctttgtacccctgggagggaaccatgcccggttagtattgtcaaataccccacatcagaggcgggtgtgaggtttggggtgcagtgccctgggccatgtaatcgggtagaattccctccctatatgactactcaatccgtgggaggagagggcagagggctggaaaggatgcagctggggacatgtctattcgcactggcgctttctctacgagccccagttgccaaatgactacatcggctaaagagagctggcagcccagacagagttgaggccagagcagcttcaaagatgtcttggtgcctgtttcctgtgtgcatgtcagtctcctctgggtaaggcccacatgtgtgtgctcagcaagtctgtatttccttgaccctgagccttctgaccgtacctacatacccaaccgcacctatatacccgaccgcaggttcaactgctgacatcatatgggtcccagtagtgggtacttttgagtgctggtggaatgttatgtgttatgtgtcagtgtgcatttatgtggcaagaagcttgccagtgcggcaggcatttcctgagaagagccatgagaccctgcatgctgcctgaccctggcagtaccacccagaacactttatttgggtgagcctagaccttctgtccacttgagagacaatgacacagctgatctttggaggcttcttgctgtgacctctgatctggctggaagacatgactgctaccctatgccttctgctactcagggtagctctgacatgcttggtgggctccctgggacaaaatactgcctggaccccaagcttactaaagaatccaccctctccaagtctgaggtttccatggaaaccctacactcccacctcactatcccactgacccttcagacagaactaggctagccaaccagaagtctaagactggaacattcaggtcaggcctggaacatcttgaacaggagtgggaaggtagagacatcttcggggaaaatatcccaaagtctcaaaggacagaatagtagcctccagaccctaggttcagttatgctgaaggaagagccctgcttgttggaggttacttattcacaacctacaagaagctacaagctcctaggtagggggaactgcttacgatattctgccctggaatgggtctgagagcacattcctctccagggggttcagaaaagatgtcagaaagggtgtacaggctccttcctcacagctctttgttcttctgcatttcagaggtccccaatgggccctggaggtccctcaccttctacccagcctggctcacagtgtcagagggagcaaatgccaccttcacctgcagcttgtccaactggtcggaggatcttatgctgaactggaaccgcctgagtcccagcaaccagactgaaaaacaggccgccttctgtaatggtttgagccaacccgtccaggatgcccgcttccagatcatacagctgcccaacaggcatgacttccacatgaacatccttgacacacggcgcaatgacagtggcatctacctctgtggggccatctccctgcaccccaaggcaaaaatcgaggagagccctggagcagagctcgtggtaacaggtgaggctagtagaacctacgtgggcaattccttcctgcccagagacctcttaggctctctgccatggctctgcctagagccttgacgacactgcccctctccctgtggaaatcctcagatgcccatttacctttaagggatggaagggcttgccaaagtagggtgggtggccagtcactgcccatctaaaatagtcccttgggacttggtgaggacagggtgtgtgaccctaaagaaaatacactatcggtgtcctagaactctattctttgtcatcctgtagagagaatcctggagacctcaacaagatatcccagcccctcgcccaaaccagaaggccggtttcaaggcatggtcattggtatcatgagtgccctagtgggtatccctgtattgctgctgctggcctgggccctagctgtcttctgctcaacaagtatgtcaggtaaggctcatcataccctgcttctgtcctgccaaaccttgtagtcactgtacttcacacatacgtagatcaccagaagggtggtcatgcaccacacacactctgaccactacaaaagcctgtggccgccccacccacacctagcctcaggctgctggctttcctaaacaactagtgagagctgccacctccaggaggtctggtcatcagccagctaagaggccacagctaatatctgctacatgcctaccctgtgttgtggtacaccaggaaaggggacactgatgcacctgtgcctgtggcaggccctactcctcaattcattgtcctaccaggaactccccgttagtaaatgggaagggtgcccgtggggatggaaaggctggtgcttgcccatggtgtagatctcttcagtgcctgacacgcccctcctgagcacacaaaacacacacacacacacacacacacacacacacacacacacacgagagagaaagatggagagacagagggaggacattcctccactagggaagatggctctgtagctgccctctaacccaaactgtgtgtctcaacagaggccagaggagctggaagcaaggacgacactctggtgagtatgagttttctttcttgagtgatctatcccaggccacccccaggtcttggtacaggtagagagaccatggggcctacagggctagagcctggagagcccagctcccattttctaccaggcccccagagccatatcctgttgttcctcccagcagctgaccccactgtgtgtacccctgtcctgtccaacgtggtcacgacttgttttcttctgtgcagagacaaggggcaaaagtcaaattttggaatcctaaacccgccaggaaacatttaacgatagaaactgagccagaaacacgaggctgcaccctaaatatcaagaagtcaatggggagcctatggcctctgtgggttctgtgcctgggcagctgttaggtcaggtcccagcttccatgactgaggtgaatttgctctaagaagaaccccaaatccagtgtcagtctggaaacccagcatagggaagggttgagattatgggatgcacacaccaccccccaactgactataacaatggctctttcttctcccccctcccctgccccttgaagaaggaggagccttcagcagcacctgtccctagtgtggcctatgaggagctggacttccagggacgagagaagacaccagagctccctaccgcctgtgtgcacacagaatatgccaccattgtcttcactgaagggctgggtgcctcggccatgggacgtaggggctcagctgatggcctgcagggtcctcggcctccaagacatgaggatggacattgttcttggcctctttgaccagattcttcagccattagcatgctgcagaccctccacagagagcaccggtccgtccctcagtcaagaggagcatgcaggctacagttcagccaaggctcccagggtctgagctagctggagtgacagcccagcgcctgcaccaattccagcacatgcactgttgagtgagagctcacttcaggtttaccacaagctgggagcagcaggcttcccggtttcctattgtcacaaggtgcagagctggggcctaagcctatgtctcctgaatcctactgttgggcacttctagggacttgagacactatagccaatggcctctgtgggttctgtgcctggaaatggagagatctgagtacagcctgctttgaatggctctctgaggcaaccccaaagcaagggggtccaggtatactatgggcccagcacctaaagccacccttgggagatgatactcaggtgggaaattcgtagactgggggactgaaccaatcccaagatctggaaaagttttgatgaagacttgaaaagctcctagcttcgggggtctgggaagcatgagcacttaccaggcaaaagctccgtgagcgtatctgctgtccttctgcatgcccaggtacctcagtttttttcaacagcaaggaaactagggcaataaagggaaccagcagagctagagccacccacacatccaggggggcacttgactctccctactcctcctaggaaccaaaaggacaaagtccatgttgacagcagggaaggaaagggggatataaccttgacgcaaaccaacactggggtgttagaatctcctcattcactctgtcctggagttgggttctggctctccttcacacctaggactctgaaatgagcaagcacttcagacagtcagggtagcaagagtctagctgtctggtgggcacccaaaatgaccagggcttaagtccctttcctttggtttaagcccgttataattaaatggtaccaaaagctttacgaagtgctgttctacttgtgggtgtgttggggcagaggcgatggggaggaagagttgcagggctggactgaggttctaggctaagtagggcaggcatcaccccgctcaagcctggcttgagtctgtccttaccatcactgaaatacagtcatgctctctccacatttacatgtcacccaccacccagggatgaaagacctcaagcacagacatggaggaagagacatgctccagacaccaggccttcctaggctcccacagctacacaccccaagcttcaccccagcaggaagatatcctgggctgtttgcctgagtcccctgccatgtcctttatgagtccttcccagcagggttgatgtcatgtgctgggagccatctcagtgggataggtgaagtctaccttgttgtaagagaggtatctgtgggttcctccccaggacacaggataggactttaaaaaaaaatagaaagaaagaaagaaagagagagagagagagagagagagagagagagagagagagagagagaggaagggaagggaagggaagggaagggaagggaagggaagggaagggaagggaagggaagggaagggaagggaagggaagggnnnnnnnnnnnnnnnnnnnnnnnnnnnnnnnnnnnnnnnnnnnnnnnnnnnnnnnnnnnnnnnnnnnnnnnnnnnnnnnnnagagaagagaagagaagagaaagaagagaagagaagagaaaaaagataaactggttcctaacccatcactgtcctggggtcttgacttgatcacagaggaaggcagacacccgtctccgacctctgtctggataacggagagcctggcccaaggcctttgggtgcttgggtgcttgggtgcttacggccacctattccctcactccctagcccttctagtccctcctgagctcactaccatcactccatgttgggcaggggagaaggagatgccacttcctggacaagcagggttagaggagagtgagccagggtgctggaaaaaaaaaaaactcacaggatcaacataaagaagtctggtcgcacggctcatagaaataaggtggacatcaagaaatgggtggctctccactgttcaagaagccctcttgggtagcaggtggagttccagcctgtccccaccaccaccacaggtgcagatgaggcattacctacagtggtcctcaaccttcctactgcttcaagcaaccctttaatatagttcctcaggttgtggtgaccccccccccaactgaaaagttgttttgctgctacttcataactgtaattttgctcctgttataagccgtaatgtaaatacccctgtgggggttcgagacccaaggtgagaactgatgagttagaagtatgtgaggtggctgcaggagaagcagggtacagacatgcctccccacagatcagagtgctgctcacggtggctccataccacaagcatggtggctcttcctattcgatctataaactcaacatcattctgactttaaaaaaaaatagcctcacccataactataatgtatgtaagaaagtagagagcagcctgcgctggtgttcagattcccaccacatgcaatacacctgctctgtcccaaaccagcagacagtatgggaaggaagcctgcaagattctcaagtaggtaagagcgaattcccaaacagcacaggtgtgaggcaaaccctagctattaagtacctcggacaaggaacacttcagagtaagacagacacattaggctcaagaaacaataaagtggaaggcaaaagccacaactcagtagaaaaatatcataagcaaactgttaaaacatttgtgctatcacacaaagatctataattacatctaaaattaaattagatctagaatacattttacatgaagatctaaaaactctagaaaggaaaaatctaaaaacacaatggaaaagtgggtgggacgtgtaaccaatcatctgttcaccgagacacgagaaggcacatacatcgatgtctgcttatgcatgcatgcatatacaatgtgtatgtgcatgcatgtgttgtgaacataaccatgtgtatgtgactatacacatgtgtatacagtgtgtgtgcacaatgtgtgttccacatgcagttcacacattcatagatgcatgttgcatacacgcgagtccatgcacacagataccacaaacaaggaaagagcattcagttttactcataatcacaaaaatacaaatgaaaaccacactggctaagaacaaacattggaaagcaaggatggctggaggggatcaggccccctctgtggcaggagaaggcaccaagcttatagcgttcacctttgcccatctgggacctgtggaacatggggagggaggtaagcacagggctgtcagtgctaagtctacaactgccccagccgtaggaaactgaactgactcaagtcctcttgtctccataagcagtgtacagtgtagcctcaacaacttgagcagactctgagtgtagtgcagtagggatgaccgatgtccgaaggttcattgtgtctgatggcaaagaagcaagctagggttgtgccaaaatgacagttgagccatgtggccatcaaaacattaccagaattaaaatctgattaatccactttgaatatgctgttacaaaaacatcgttataagttcaaagaacacagcagggagggaaagcgcacgctggaggagtactcaaaaaaaaaaaaaaaaaagaggcacagcaggcgggaggaagtggtcatactctcaacgggtctctgaacctcccgcctggctcaggggtgcaaggcgcttctgggccaagccatccggtagtggcagcccctgttcagataagaacagagagagccgcagggaccagtcagcacttcacatccgctttcccgtaaagcagcagctgcgcctccctgaactcattttttccatccgctcgctctgccccaggcacaagtgtcaccgcctggctgagacccagcgcctatcccctcccactgtggtgtccttaatctctcgcagaggctgcagctcttgatgtggctactccaccacaaaccagagctgaccacaggggcgcaggacccaggcgtccgagctaccaagcacccatgctgcgcctcacccaaaaggtttcttccctttgctctctcctctccatctcccaggtacgaatgccctccttaactggtctggaggggagaaccaggcttctgtttcagtctggccctgccggatggaggaggctggagatgcagcagggaatctgctagaaactcgccctctagctgtggaaggcagaattggcacctaggtccacggtgaggactagaggctgagtcctggtggttctcagtcatacaaggtcagtgggcggatgtgggtgaggcctctttgtatattaggggaactctcgatttcttaagggttcaagatgtggaattcctgcaaagggcaattagtccatctgcaacaacaggacatctgtcccagtcactagggtcaccggaacagatatatagtttgttgtttgtttgtttgtttgagacagggtctctctatgtgaccttggctggcctaaaactcagagatctggctgccactgcttccagtgtagtgggatcaaaatgtgtaataccacacctagcctataatattttgtaaaaaggtgcgtgtatgttcatcttcatgaattatgtgcatcattacatccacagaggacagagagcagttggtcccttggagctggagtttcaggcagttgtgagccacttggtataagtgctaggaactgaacctctgtcctctacaagagcagtacccattattaactgctgaaccatctctccagccattggatagaccttagtgtctctgacctggtcaaactctccctctcactaagaagatctcctgcatttgtccagcctccagaaacctggccccagggtgttgacagaggaggctggtaccaggtagcaagtgcctagaaacacctggtgggcataagtgcaccacagacctgcctgttacatacagtcaatggctgcttcacaaataatccaaaaactctaaaaccaaataatcatacaggcaaaatgttcttcagccatttaaaaagaagaagaaatgggtaggagagatggctcagcagttaagagcactggttgttcttccaaaagtcttgagttcaattcccaacaccacatggaacatagtagctcacaaccatctgtaatgggatctgatgccctcttctggtgtttctgaagaatatatatcatgtgtgtgtacatatgtatgtgtatatatatgtgcatatatattttaaaataaaatacataaaagagaagaaatgttttggttccacactcaaaggagcttcactcacaagagtgaatgtgggaattgcccatatgtccatcaggaacaggtggatgaagcagatatagtctgccagtacactggaacactagccttgagagggaaggaaagtctggcgtatgctacaccatgggtgaatcctaacactgtgctggggggcggggggtagtaagctgtcttcatgaaaagacaaaatgtcagaggtggcgagtcacagagtgcctgccagaacctggggagatgacaagctggcacttaatggggtcagagtttaggttttttatcttattttctggaaagggagatgtgagccttgaccctctgcctgctcccagaagctgtctcagctaagggaaagactgtccatcagtgggcatgtgaagcttggcactcctcactgaagtcaggggacactgaggccccaagagggccaccattagtagtcatagcttaccagggtgacgggatcaacagaatctaggaggagagatgtttagggctcacttgggatcaagccagatgtcaggccagtagatgttaccatgtggagacaagataaagctggggcttagaacttggcccttctggcgggaagcttcttcattcaagactttcttggctacattaaagctcatacacaacatggtccttggcttcatctatgacattgtagtcattaatcttatctggaaatgagttggagagccagctcagtggttaagagcaggcactgctcttccaggaggaaccaaacccacaccaggcagctcataactgcctgtaactacagctattctaatgcttctaacctctgtaggtctctctctctctctctctctctctctctctctctgtgtgtgtgtgtgtgtgtgtgtgtgtattaaaaacaaaattaagtaaaacaaaaacatccctaccagcacctgggctggtgtggtgtgtgacccacacttgggtaccatcccctggccacaaaattagccaacctggtcaaggcccaggtaaactagacgagtagggaccagggtatagactcttgtcaataatggcaggttcatgaaggtgagctaggtgtcatggggcaggcactccccagagccaaggcagcctagcctgtggttgttcccattttcaagtttgtgaaccatgtggataattaaagcaaatatgctcaagaagaatgtgctgtaatctcttttcttaacatcacagctttctcattgctcacatttaattgattgtagagagactctcttagaagccacacatgtcagtcaaacacctatggtcaatgagctgaggcagataggtgagacactggtaggaagggagaagattctgagaaacagtgagagaataaaggggaggttttccctggagactgaggtaagccagcaggagctgaattcaggatagaataaagagattcgccccagacttggacacgtgaagctgaagagcggtaaaccatgtgaaagacacacaattgtttgaatgggttaaataattatgctatgagcttgttgggaaatgagccgaatcttgtggcctaggcatttattaataaataattagtctcagagtctttattgttgagaactaagtgtccaggaggttaaaaaaaacgaatattttttaacaattgatagatttcttttttttattgatttgagtttacagaaagtacaaagctcacgtgtgttcctcctcccacttgagcacctagctgcagagtccctacacttaaaggggaggggttgcatctgctgctaccacaaaccgacactcacacaacgatctctgtcagagtgcggcttacatcagggtcccttgttggtggcactgccaggggccttgatggttgtcgtgcactgtcttacagggccctgttgagtgtcctcactgactaaaagtcccacggatgcgggaaagcaaggtcaaatgcatgactgtgagtccaactccaagttttagcagccaaaaaagccattccatgaactgccctagaactcccacctctccaaggattattaaaaaaaaaaaatcctcccacgaaggaaaaaaaaaaagatcagtcacccacgatagggggaaaagcctctggatgcagagatgcaatgttctgggaatatctcttacattcttagagactggagtctctgctgggcctcacagccagagttaataacaccttaggtacaccttgaagaacttaagacaagactattatcctgttgcttaacatgcctctaagagaacaatgtaacaaccaactatacttggatttcccatgtcatcagcttttacaacgtaagcaatgcatggcagcaatcttaagttatgtgttggtccagacccctggcccagatatagcaggtgtatcatttgcagcagagacaaaggttgaaagcaatgttctacaatctatcacaaaggttgaaagcctccatttatggatattggtttagggtggtgcttgtctggatcagaagacatcagttggagaggcttaatcctttgtaaaactctgttaaagatttctgtaaagtaccccctccccttcccatatgatgctttttatgctgctcaataaagacagagctcctttgttagggaaacacacacacacatacacacagctcataaaacagaaagacaccactcacaaacacagacagctctctctctgtctctctgtctctctctctctgtctctctctttctgtctctctgtctctctctcacacacacacacacacacacatacacacagctcataaaatagaaagacaccactcacaaacacagacagctctctctctctctgtgtctctctctctctgtctctctctgtgtctctctctctttctgtctctctctctctctctcacacacacacacacacacacacacacacataattcatacaacagacagacaccactcacagacacagacagccacgacacacacagaacaggaaacacagatacagggacagattcacaagacaatcttcaggttgagattcagactcatacaacagacagacagacagacagaggatggaagatacgtggagcatgaggtagcgaattctaatctggactctcatggttaagtgactccaagggaaatgcttctctttctttccttcatgtgacaccgatttattattggtggctcagagttaatcaatagtcatataatccacacacctggacctgaaaacggttcttgagtcttttgcttgttcaagcccactcccactctgtgaagcatacctatacttcattctctgtctgaaaacacctataatttatctactgcacgtccatgtcttattcaattatctgttcaagacacaaagaaccaggatatcaggtcacagaaaatgcccaagattctctttggtaacagtccgagttctgtgtgtgtatccacacacccctcattcaagcctgatcccttcaccccttggctttgccctttccagaaagccatatggttgggggtcacacagtaagagtctttccatatggcctttcctcataatatgcattcgaatttcgtcactgccttttcttaagcttaatagctaactattgggtgaacttttttttaatgaataaacatttttttcacccccaaaccaagaaaactatttcactcaagtctaacttggtgaaccaatgactttaaagttatttttttgtttggttttttggggtttttttttttgtttttgtttttgagatagggtttttctgtgtaaccctggctgtcctagaatgctgtagaccaggctgacttcaactcatagagatcagcctgactctgcctcctgagtgttaggattaaaagtgtgtgccaccaccacccggctgacttttcaagaacatggcaagttataaacaattacagcactgaagaaaatgtctttctcaggaagaattagcagtttgtatatcctgagggaggggtaaagctgtataagtcactcccaaaacaatcataggtgatgatagatagatagatagatagatagatagatagatagatagatagatagatagatagatagatgagaaagaggaggcagagagagagagagagagagagagagagagagagagagagagagagagagagaagatagatagtctcctcggagaagggcagggcccagaaactgttaacttctggtatcagcaaacagaagataggcctttaagtctctcttcccagaaaccattcactgtacatcctcaggaagcggcagagcttgtagcaccttcctctcctggatgaaggaacactaatgggcctacttttctgcaaacatcacataggtaatcatgcctgctaagggctccagtggtcaagggccatgtctgcaggacagcattccacagcgatgtacctctttttagtgttggttaatagtctaccatctagatggctgcaattggtgtattcatctgttctctggctggaaaatgtgggttggggttggggttgaagttggggttggggttagggttagggttggaattagggttagggttagggttggggttgggagggctaggattagggttgcgtttgtttcggttatggttaacagttgcctccaagtttcatcaattgttagtaaagatgctatacatgtttagtttttcatgaggacacaagttttcaacaactttaggtaaatactgaggagcataatcgctgaattatacggcagaagaatcctttctaggaaactgggatgtcttcccgtgtggttccacactcctagaactgaagaagagtacccgcagctctgcctcctctgacccctggtgaggtctgaaaggctctagcaggcccaagcttggcaaacacaggcccaggcataacaaacaaggctccaactgttttgtcttctacctctctctgccttgctacaccatgagatgacattcctaaagctcgccaccaaggtctagtcccttatttggccactgactcattcctgaggctgaccaccaaggtccaactagcaaagcaccaagttcaggaatcagaattcattattttgactaacctaattagaataccaaagcagaacttaccattaagtcctgactcattctaacacagacctccatctttccttcttaaaattaacccttgaaaagctgcttgcagctgtttctgccaagcttaggttcggtcgcctgtctctcaccttgtttaataaagaaaggacactttgcatttggtttgtgcttggagcatggtgtttggatgtggtctgtgcctaattcagagtccagaggggtgcacccttcaaggtcaatgttctgtatagtatgtctaaagagccatccaggtggacagccttgtatttgtaatctccctgcttcaaatcccaagtgttgggattacagatgtataccaccacatatgtatacatatgtgtgtgtgtgtgtgtgtgtgtgtgtgtgtgtgtgtgtgtgtgtagcaagtctgttcttgttcctatgagaaaaataaaggaaatacagtgtctatcaaagggttaagcaagacaag

SEQ ID NO: 103 - DNA, 1931 bp, Mus musculus
tgagcagcggggaggaggaagaggagactgctactgaaggcgacactgccaggggctctgggcatgtgggtccggcaggtaccctggtcattcacttgggctgtgctgcagttgagctggcaatcagggtggcttctagaggtccccaatgggccctggaggtccctcaccttctacccagcctggctcacagtgtcagagggagcaaatgccaccttcacctgcagcttgtccaactggtcggaggatcttatgctgaactggaaccgcctgagtcccagcaaccagactgaaaaacaggccgccttctgtaatggtttgagccaacccgtccaggatgcccgcttccagatcatacagctgcccaacaggcatgacttccacatgaacatccttgacacacggcgcaatgacagtggcatctacctctgtggggccatctccctgcaccccaaggcaaaaatcgaggagagccctggagcagagctcgtggtaacagagagaatcctggagacctcaacaagatatcccagcccctcgcccaaaccagaaggccggtttcaaggcatggtcattggtatcatgagtgccctagtgggtatccctgtattgctgctgctggcctgggccctagctgtcttctgctcaacaagtatgtcagaggccagaggagctggaagcaaggacgacactctgaaggaggagccttcagcagcacctgtccctagtgtggcctatgaggagctggacttccagggacgagagaagacaccagagctccctaccgcctgtgtgcacacagaatatgccaccattgtcttcactgaagggctgggtgcctcggccatgggacgtaggggctcagctgatggcctgcagggtcctcggcctccaagacatgaggatggacattgttcttggcctctttgaccagattcttcagccattagcatgctgcagaccctccacagagagcaccggtccgtccctcagtcaagaggagcatgcaggctacagttcagccaaggctcccagggtctgagctagctggagtgacagcccagcgcctgcaccaattccagcacatgcactgttgagtgagagctcacttcaggtttaccacaagctgggagcagcaggcttcccggtttcctattgtcacaaggtgcagagctggggcctaagcctatgtctcctgaatcctactgttgggcacttctagggacttgagacactatagccaatggcctctgtgggttctgtgcctggaaatggagagatctgagtacagcctgctttgaatggctctctgaggcaaccccaaagcaagggggtccaggtatactatgggcccagcacctaaagccacccttgggagatgatactcaggtgggaaattcgtagactgggggactgaaccaatcccaagatctggaaaagttttgatgaagacttgaaaagctcctagcttcgggggtctgggaagcatgagcacttaccaggcaaaagctccgtgagcgtatctgctgtccttctgcatgcccaggtacctcagtttttttcaacagcaaggaaactagggcaataaagggaaccagcagagctagagccacccacacatccaggggggcacttgactctccctactcctcctaggaaccaaaaggacaaagtccatgttgacagcagggaaggaaagggggatataaccttgacgcaaaccaacactggggtgttagaatctcctcattcactctgtcctggagttgggttctggctctccttcacacctaggactctgaaatgagcaagcacttcagacagtcagggtagcaagagtctagctgtctggtgggcacccaaaatgaccagggcttaagtccctttcctttggtttaagcccgttataattaaatggtaccaaaagcttt

SEQ ID NO: 104 - protein, 302 aa, Mus musculus
AAGRRKRRLLLKATLPGALGMWVRQVPWSFTWAVLQLSWQSGWLLEVPNGPWRSLTFYPAWLTVSEGANATFTCSLSNWSEDLMLNWNRLSPSNQTEKQAAFCNGLSQPVQDARFQIIQLPNRHDFHMNILDTRRNDSGIYLCGAISLHPKAKIEESPGAELVVTERITSTRYPSPSPKPEGRFQGMVIGIMSALVGIPVLLLLAWAVFCSTSMSERAGSKDDTLKEEPSAAPVPSVAYEELDFQGREKTPELPTACVHTEYATIVFTEGLGASAMGRRGSADGLQGPRPPRHEDGHCSWPL

SEQ ID NO: 105 - DNA, 29018 bp, Homo sapiens
  misc_feature (1)...(29018): n = A,T,C or G
agcgcctcgctgccccctgcctcacatcccacactcaaacctcaaacctcaccccccagccacccagggccgcggccaaggcagcctagcacctgctcctgcctgtgccgaggctctgaaaccaccagcccctcggccacacacaggcaaaagcaggcccatgcgcactagcccgcagccccctcatgtggagcactgagaagcaaagcaaacctcctctcagcagtttttcaacaaaacccgctccagcctggcctccgtgaggcgtcggcagcctgccacctgcgtggctctgctggtgttttgtgagttggggttaacacaggaagaggcaggcctgccgacacacttaggaggggaaaagcatgcatgtgggggctgtccctgggggctcagcaagtgggggtccctgtcctgactgagaggaggcgatccaggaggtcgcctgccagctgaggggaaggatgtcacggaggcctgcggtcatggcccgggcagccctgctgggcgtcaccaggcgaggagaggtttggggagagcactgggagggattggcttgtccatggcggtcatcagaccggtgaccatttgctagccacacaagcagctgtgagcttcagggaaccctgcatgagtgagaggctgtgattcagttccaggcagtggaagtttctggatgacagaatgttctatagccacactgccctgcctgcagcctccaaccacactggccacagagcccgtggacacgttcgtgctggaggaactgaactgctgactttatttaaatgggactgaggagccaaagccacgggcgctggggctgcatgttggggcagccgtcctcagttctctcccgccagctgggagccgctcagagccatctccacctggctgtgggaacagtgatgtgcttcccagcacttctcagaccccaacacgggttattactttcccagcttctgaaaaagctgggattctgcacacacctggccccaggggtctcaggcactgaggagctgtgtcaaagggcaggacgactccccctttgcccagggtgtctccacagagggacggaccagccagcagcctgggggcctgtcaggccgggcatctgcgaggatgtggagctgccccgcgcccctcccagctggcacccggccgagctgtggatgccttgccagttggagaagcgcatggcgcccgccctgctgcgctgacggcaccacaaccgtgatgacggcctgtgaggctcacttgtgacccacagccaccccgggcccccgatcagggccgagcaccccgctgtgtgcaacacagggccggatggtgaccacaggctccggcacgccccagggcccacctgtcagcactgatggctgcgagaccacggcagtgccatggaagcaggagatgagcctgtgtccaagggcagcgctggcccaaggagccgagtgagggaaaccaaactctccatgaggcacccgccatgtcttccccgggacccctgcgtcagcagccgtgtgcccagcatggcgaggcaggggctccggcgggagaaggagcacccagccccaccctcccgtctcggggacaagacgaggcccaacagccccacccagcctctgggaccacccaaggtcccgtggaaaagcaccttcagccccctgcctctcccagggtccccaacctctggccgcacctcgagagccccaccagcaggtactggacaccaccgccgtccaggcatcccgggaccaggctgtgctcaggtagcagaacccagacgtcctggggcttcctctcggccatggccagggtgaaggtgctggcccacatgtctgccccagcccggtccatgctgccgcctggctccgcagtgtgggctgagggctgcgcccgccgggggcccaaggaaacgtccccgcatcccgcgccggccaatcagccaccttgacaacagcatggtctccatggcaaccagatttgtctccgagaaatgggaagcagaaaggaaaaatacaatacaatgcaatctcccatgaccccgccccccagagagcatccctgtggcagcaccgtggtggtggtggtgggcgtgggcccgtggacacgcaggggcctccccagacccgtgcgtgtagaggcccgggtgttttcacacatcgcaccaaggaatcatccacagccctctctttctagtgcacatcaggagcggtggcccacactcatcccttgctgaacacttggtatttttccagcttgtggctatcatgtaacttattcactcagcttctctctgcaaacagcactaatgcttttcacacaaacaaagctgagaagaactttatagaacgtgtatcattgcagattgtcccgtgggtgtattctcttaaactttttactagtgagaaatataaaatatttacataaaatgcctaaaacataaatgcagagcttcacaaattattctaaagtcttaagtcaccacgtcctataggaagaaacaaaacctcgctctgccagcctccagagctggctgcctgttccctcccgatctcagcccgcggccccacccccaccccctgccctcctggcagaggtgccaccagcctggccgtgcctgcacagacaacgttgaggcttcaacacctatgatgcctccctcaccgagccctttagctgtgcagcttctgagctttacataaacaattcatgcatgtgcccagcttctcacgccttttcaggttgtttaatttctgagattcaacagcattgctgtgcgtggcagccacctgtcatggcacaacaagaaagggtgagctgagaaggagccgggacgtgcaggggcggagacagccagctgatccctgcaaaacctcagcacagatctgcccccgggaggctcccggccacccggctctcctcacagctcccatctcgccatctctctgccctgcacactgaacaatctcttctcatttttctaccacttcacacattatctcctcgtctctgtcgactctgcagctaatgctggcaagcgccttgtcatagttttcatttctgaaccttcttttcggccctttcaaacctgtgacatcttcccgccttgcagctaggtgtgactgcaagatagaagaggaagccagtgggacgcactctgggaaggggcctccatacagggccagactgccagggaaagccccgcgtttctcatcccagcttcattttcttctatccatcagtgctgggatgatggccgcactccagcctgtcttagacctgcctcaagcacagagctgtgagcccaaggagcaggaaggcgggagcccggggctgtggtgacagatggagtcgtcacaccactggagggtcgcccacctctgggtttcctgttcacacgagaagtaagccagctgccactgtggtctcgaggcactgttctctggcactgtggatgatcacacagctagccggagcaatcctaactcactcgccgggctgtatctaaggtcctggggtttgctggttggctccgggccactgtgcgtgtgtgggccccttgtggtcctggtcgtgtgcccccgcaggggtctaagagacacctactgtccacttgcctccaaaagcctcggtccacaggggtccctgcagaggacctcctcccaccacagccccccagagccagtgtttcctggctgcttccgtgccacgctggggccacagccctgcctgccagtcccacctctcaggctcctcagccctggaggccacacctggctctgagtttagggaaaagctttggaatgatgactgaccacagtcacccaaaataaccttttggatggcaattccggcccttatgaaatgcagggagctggttgcccgggcattattcgctcaagaattgttgagttttccttagacccatcccagaacacctccagaggcctgggcggcagacagcagagagggcatcctgtccacgcctctgtctgactgcccatttgtctgtctcccaaacccacaagccacgccctgcaagagctgcttacgtggccccctcacaaatcagccagccatgagcaccccctcttcttcggcggggatggatgaggcaggttgtgcacagcacccacgggtccctgcaacatgtggcagggtcctccttgggccttctgcatcagcgcccacctggagccggccactggagcctctctccaggcatgtgtggtccctccaaggacaggccctaggacccaggcctggggcagacgccttctgaccccgctccctgcccagcctccccgaaggctggtaccaggacagggtgagatgggggtgggagatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggccctgagctggggagacccccacggggtagggcgtgggggccacgggcccacctcctccccatctcctctgtctccctgtctctgtctctctctccctcccccaccctctccccagtcctaccccctcctcacccctcctcccccagcactgcctctgtcactctcgcccacgtggatgtggaggaagagggggcgggagcaaggggcgggcacccttcccttcaacctgacctgggacagtttcccttccgctcacctccgcctgagcagtggagaaggcggcactctggtggggctgctccaggcatgcagatcccacaggcgccctggccagtcgtctgggcggtgctacaactgggctggcggccaggatggttcttaggtaggtggggtcggcggtcaggtgtcccagagccaggggtctggagggaccttccaccctcagtccctggcaggtcggggggtgctgaggcgggcctggccctggcagcccaggggtcccggagcgaggggtctggagggacctttcactctcagtccctggcaggtcggggggtgctgtggcaggcccagccttggcccccagctctgccccttaccctgagctgtgtggctttgggcagctcgaactcctgggttcctctctgggccccaactcctcccctggcccaagtcccctctttgctcctgggcaggcaggacctctgtcccctctcagccggtccttggggctgcgtgtttctgtagaatgacgggtcaggctggccagaaccccaaaccttggccgtggggagtctgcgtggcggctctgccttgcccaggcatccttggtcctcactcgagttttcctaaggatgggatgagccccatgtgggactaaccttggctttacgacgtcaaagtttagatgagctggtgatatttttctcattatatccaaagtgtacctgttcgagtgaggacagttcttctgtctccaggatccctcctgggtggggattgtgcccgcctgggtctctgcccagattccagggctctccccgagccctgttcagaccatccgtgggggaggccttggcctcactctcccggatcgaggagagagggagcctcttcctgggctgcccgtgaccctgggccctctgtgtacactgtgaccacagcccgctcctggaccctctgtgcccggctggccctctgtgcccagccagcctgcacctggggatgccaaggcctggggagggtggtttcacccaggccaagcctaagacagtccctctgggccctgctgggtaccggggtgtgacaccactgggaggacaagatgaggggcacccctggggccgccctgacaccccctcgaggctcctgccccgggggtcctggtgccccttcactgtggcaggcgactgggggttccccacctcggcccctctcccggggcctgctccccggcacctgaggcagcatccttgtcagggccgtgccttcctgcctcagcgccacctcttaaggttggcccgtgggtcactcaggactcagaactggagattctgggcaaaaggcaaagagcaaagggccaaaaggcatcccagggagacgactgcgggggaaccagagggcagaggggcgctcgtcacaggggagggggagctgagggaggcaggaggggagccgagcctctccccccgtgtcccggctcttcaggcacgccctcgggacgccaccctccccgacccaggcgggaaagataagagcaaggtgtccgcagcctgacactcgtgcctcaggtgcccgcgcttgtgccggacaagactctcacaggtggcatgcctcggtttccccactggtaacagcacagggcactcagcaaggcgcagtgggcatgactggggtcctgtgggtcctgacccagatgtggccaccccggccgcagtggtcttcattccaggatgcctcttttccctcctgatctattcactgcgttcgccattcggtcattcccggggccaccactcccacctcaggtgtgtgcttcccttgtgttttatgagatatccccaacccggctgcttattggccccgtccgagggcaggagcataaataagagcctctgctttggcgtgggaccactgtgagctccagtcagcgctgccactgctgagctctgggccttcgacaggacttggccccttactgacttctccgtgtgctttgggtcatgggtgaggacgcctcctggcaaggctgcgtcctgaggattaaatcgggtcatctgtgaaaactacccagcccagcccctgacacttttttgtttgtttcttttagtgacagggtcttgctctgtcacccaggctggagtgcagtggtgtgatctcggctcactcgacctccggggctcaagcaattctcccacctctgcctccagagtagctgggactataggcacgtgccaccctgccaggctaatttcttccattttttttagagacagggtctcgctatgttccccaggctgggctcaaatggtcctcccacctcagcctccccaagtactgggattacaggcataagccactgcatctggcctccatgacacatatttttaaagtctgatttttaaagtcaaacttttgaagtcagattttaaacggactattttgaaaaatatacaaaaacgtttaaaaacaatgaatatccctcacctagaatcaataactaagaatattgacacatttgctttggggactgggcggctggagctgccatgacaaagctccgccgaccgagtggcttttaaacagagcctgccctctcgccgactgagggctggacgtgcaggatggagctccgcagggtcggctcccctgtgctctgaggggctctgctcagcctctcccggctgtggcttaaaaacagagcctgtcctcccgccgtggggggctggacatgcaggaccgaggggccacagggtcggctccctgtgctccgagagggctctgctcagcttctcctggctggggggttttgtggccaccctctgtgttcctgggttcagaagcatcccccaggctctgccttcatctctgcacgggtgactctgtacaggaagccaggcctgctggtcaatggccacccagccctgtgccctcatcttacctagtcccagctgccgtcaccctattcctaataaggccgccttctgaggtcatggggttaggacttccacataggaatctgtggggacacggttcggcccacagcccttcccacctccgcacacacacacgactgtgaggagttggaagacctcactcctcacccctgccaggtcctctagggacaagctcgctgtcctcatcccagcacagcccgtgggacggtttccttgtccctaatgggaccacggtcagagatgccgggtctggtctgggccagcaggttcctccgcccggggcaggcagccttcttctgtgcgcttctggaaagcaatgtcctgtaatgcggtctctctgcgggagcacccccaccgccacctcacaggcctgttccacagccccgggatgggctctgtctccctcctgaccctgcatagggcacagccctctctcatcaacccacgatcctacgtggatccgagagggagcacctggggaaacaatggaatcccatagaaacaccccaaatctaacttgatccaggaccagccagtggtcacttctgaatattcaccttcctagtagacactaccagccaagggaggccaggaagccttcctggaggaggtggcctgaggactggggtgaggcaggccctgcgtgggggtcgccacccagcacccccacactgggtgggagccagtctctgagactggctgggggaggtgggagagggggctgcttgaactgcagacaccgaggtctagcccccaccccacccagccagttggtggaggcaggggaggccgaggggcccagctggacctgctccccggggtggattccaaaataggggggttggggggggcggaacaggagcccagggtcctggcttgaggcccagtggctgagggctggtgcaagccagacaggaaaagggttgagcctgtcagcgccagcacagatcaagtcaggagcaggtccctccaccaatgtgtgcaaataaatagcagctaagtttccagttacaagaacaatgcacagatggtcccagggacattgcggtgtggacacgcagcggccattgtcctgtcgccagcacctcgccctacagctggggggtcccttagcacttcctagccatgcagggtccctgctcacagtacccgtgatgacttctgttcctcacctgcctgtctgtcccgacagctgcatggcagccctggcctgggagatggagaccccgaggggctgcctgcggtggtggggcccctgggtccccactgcattcccagaaacccagagggcagggcatttcccctgctctgtgccgagtccacccagccccagcctaggcccagtaagggctgcagcccaccctgtcccaggctgcctcccaggagccctcttggccctgatgccagaagcccatcttcctccattcaggcaggtctctgagtgccctggcctggctgcctgctggccctgagagtcacactaccccacagccctccttggtcaaaatccactctggagtggctggaagattccccgggcccacgccgcacacgcctatgcagggagcttcccctggccggccggcagacaagggcggtctcagagagggggctcacctcagcagccccttgtgtagctggccctcgcccctgccacctctgggaacaccaccaggaagctgggggacaggcacgcaggtgaaggaggcgagcgcttgtcagccgggaggccatgggcacagagggaacagggacaccctgggtggcctcaaggtcacttcaaacccctcactcgtcccctgggagggtgcccagtgaggttggcactaggagttggtcctggtcacatgacagacccacccacctctggtgtccagccagcacgccgtgggccagcctggctgcagggacacgagggcagcagccccctcctcctctgagctggttgctccttgagtcatcaccaccgcctgccacggaggccgcctgtcccaggaagcagagggaccgcagctgtggcaaccagggcctggtctctgtgtcacctcgctggggggccgtgcccaggcctgagacggaactgagtgacagtgcactgggtctgacagtgtggggctggcgccatgtttggggaaccctgtggcatgggacctgtgggtgagccgggaaaatcaccccgttgcatggcatctcgggcctggatcttaagcgcctgtgttggtgcctccgcctggcggaagagccgcgacccccacgttgccatgcgggtatcccaagccctgaccctggcaggcatatgtttcaggaggtccttgtcttgggagcccagggtcgggggccccgtgtctgtccacatccgagtcaatggcccatctcgtctctgaagcatctttgctgtgagctctagtccccactgtcttgctggaaaatgtggaggccccactgcccactgcccagggcagcaatgcccataccacgtggtcccagctccgagcttgtcctgaaaagggggcaaagactggaccctgagcctgccaaggggccacactcctcccagggctggggtctccatgggcagccccccacccacccagaccagttacactcccctgtgccagagcagtgcagacaggaccaggccaggatgcccaagggtcaggggctggggatgggtagcccccaaacagccctttctgggggaactggcctcaacggggaagggggtgaaggctcttagtaggaaatcagggagacccaagtcagagccaggtgctgtgcagaagctgcagcctcacgtagaaggaagaggctctgcagtggaggccagtgcccatccccgggtggcagaggccccagcagagacttctcaatgacattccagctggggtggcccttccagagcccttgnnnnnnnnnnnnnnnnnnnntggccggggaggctttgtggggccacccagccccttcctcacctctctccatctctcagactccccagacaggccctggaacccccccaccttctccccagccctgctcgtggtgaccgaaggggacaacgccaccttcacctgcagcttctccaacacatcggagagcttcgtgctaaactggtaccgcatgagccccagcaaccagacggacaagctggccgccttccccgaggaccgcagccagcccggccaggactgccgcttccgtgtcacacaactgcccaacgggcgtgacttccacatgagcgtggtcagggcccggcgcaatgacagcggcacctacctctgtggggccatctccctggcccccaaggcgcagatcaaagagagcctgcgggcagagctcagggtgacaggtgcggcctcggaggccccggggcaggggtgagctgagccggtcctggggtgggtgtcccctcctgcacaggatcaggagctccagggtcgtagggcagggaccccccagctccagtccagggctctgtcctgcacctggggaatggtgaccggcatctctgtcctctagctctggaagcaccccagcccctctagtctgccctcacccctgaccctgaccctccaccctgaccccgtcctaacccctgacctttgtgcccttccagagagaagggcagaagtgcccacagcccaccccagcccctcacccaggccagccggccagttccaaaccctggtggttggtgtcgtgggcggcctgctgggcagcctggtgctgctagtctgggtcctggccgtcatctgctcccgggccgcacgaggtaacgtcatcccagcccctcggcctgccctgccctaaccctgctggcggccctcactcccgcctccccttcctccacccttccctcaccccacccaacctcccccatctccccgccaggctaagtccctgatgaaggcccctggactaagaccccccacctaggagcacggctcagggtcggcctggtgaccccaagtgtgtttctctgcagggacaataggagccaggcgcaccggccagcccctggtgagtctcactcttttcctgcatgatccactgtgccttccttcctgggtgggcagaggtggaaggacaggctgggaccacacggcctgcaggactcacattctattatagccaggaccccacctccccagcccccaggcagcaacctcaatccctaaagccatgatctggggccccagcccacctgcggtctccgggggtgcccggcccatgtgtgtgcctgcctgcggtctccaggggtgcctggcccacgcgtgtgcccgcctgcggtctctgggggtgcccggcccacatatgtgcctgcctgcggtctccaggtgtgcccggcccatgcgtgtgcccacctgcgagggcgtggggtgggcttggtcatttcttatcttacattggagacaggagagcttgaaaagtcacattttggaatcctaaatctgcaagaatgccagggacatttcagagggggacattgagccagagaggaggggtggtgtccccagatcacacagagggcagtggtgggacagctcagggtaagcagctcgtagtggggggcccaggttcggtgccggtactgcagccaggctgtggagccgcgggcctccttcctgcggtgggccgtggggctgactccctctccctttctcctcaaagaaggaggacccctcagccgtgcctgtgttctctgtggactatggggagctggatttccagtggcgagagaagaccccggagccccccgtgccctgtgtccctgagcagacggagtatgccaccattgtctttcctagcggaatgggcacctcatcccccgcccgcaggggctcagccgacggccctcggagtgcccagccactgaggcctgaggatggacactgctcttggcccctctgaccggcttccttggccaccagtgttctgcagaccctccaccatgagcccgggtcagcgcatttcctcaggagaagcaggcagggtgcaggccattgcaggccgtccaggggctgagctgcctgggggcgaccggggctccagcctgcacctgcaccaggcacagccccaccacaggactcatgtctcaatgcccacagtgagcccaggcagcaggtgtcaccgtcccctacagggagggccagatgcagtcactgcttcaggtcctgccagcacagagctgcctgcgtccagctccctgaatctctgctgctgctgctgctgctgctgctgctgcctgcggcccggggctgaaggcgccgtggccctgcctgacgccccggagcctcctgcctgaacttgggggctggttggagatggccttggagcagccaaggtgcccctggcagtggcatcccgaaacgccctggacgcagggcccaagactgggcacaggagtgggaggtacatggggctggggactccccaggagttatctgctccctgcaggcctagagaagtttcagggaaggtcagaagagctcctggctgtggtgggcagggcaggaaacccctccacctttacacatgcccaggcagcacctcaggccctttgtggggcagggaagctgaggcagtaagcgggcaggcagagctggaggcctttcaggcccagccagcactctggcctcctgccgccgcattccaccccagcccctcacaccactcgggagagggacatcctacggtcccaaggtcaggagggcagggctggggttgactcaggcccctcccagctgtggccacctgggtgttgggagggcagaagtgcaggcacctagggccccccatgtgcccaccctgggagctctccttggaacccattcctgaaattatttaaaggggttggccgggctcccaccagggcctgggtgggaaggtacaggcgttcccccggggcctagtacccccgccgtggcctatccactcctcacatccacacactgcacccccactcctggggcagggccaccagcatccaggcggccagcaggcacctgagtggctgggacaagggatcccccttccctgtggttctattatattataattataattaaatatgagagcatgctaaggagttctgtcctgtctggtggctgtgggggcagtgggcaggagggagggaggcctccagggagggacaaggcggcagccaggctgaggctgtgtgtggagggtgctggtggctcccctggatcctggcctgagtcaggccttcccctcgctgtcccagaaacacacaggccctcctcgccctgtttgccccactcacatgtagagccctccggtgaaaaattcctccaacatcacggggctggggacaccatcttccccaagcccaggccttttaggggggtcccacggccccctggccccaggcttcctggccaggcatgggtgtccctgagtgactgtgcctgctccatagcccccgtgtccccatgcctaccagtccctccgggcaggggtggtacctggtgccagggcgtccacagcggggtgggagggctgccctgggctatgagggacacagcatctgcgggtccctccccaagtacacagggtgggggcagcgggggaggcggggtcacgtctgctggagccctatcaccctgctgcggtccttggcagctagcagcagggacggtgcagggaaaggagccctgccaggccctcgggcaccgcagccaaacacccactgacaccccggggctcattctctgcttgccatcctggagcccagtcctggaccccatgcctgtgtcagggacaggcacagagacctcgcagctctgggaactcccggtgagatccggcagatcaggcctggcagggaacgctgcccgggggctctgcacatgatgtgggtttccatccgcaaaacccgataggtcccatggaaaatgaccacaggcaatgagaaagccatagagtgctgcctgtgagatcagcgtccagaactcacagctctcaaacacccactcacagcgcagcgcgccagcgtccagaattcacggctctcattcatccattgacagcgcagcgcgccagcatccagaactcaaggctctcaaacacccattcacagctcagcgcgccagcatccagaactcacggctctcattcatccattgacagcgcagcgcgctagcatccagaactcacgtctctcattcatccactgacagcgcagcgcgccagcatccagaactcaaggctctcaaacacccattcacagcgcagcgcgccagcatccagaactcacggctctcattcatccattgacagcgcagcgcaccagcatccagaactcaaggctctcatacacccattcacagcgcagcgcgccagcatccagaactcaaggctttcattcatccattgacagcgcagcgcgccagcgtccagaactcacgtctctcattcatccactgacagcgcagcacgccagcatccagaactcaaggctctcaaacacccattcacagcgcagcgcgccagcatccagaactcaaggctctcattcatccattgacagcgcagcgcgccagcgtccagaactcacgtctctcattcatccactgacagcgcagcgcgccagcatccagaactcaaggctctcaaacacccattcacagcgcagcgcgccagcatccagaactcaaggctctcattcatccattgacagcgcagcgcgccagcgtccagaactcacgtctctcattcatccactgacagcgcggcgcgccagcatccagaactcaaggctctcaaacacccattcacagcgcagcgcgccagcatccagaactcaaggctttcattcatccattgacagcgcagcgcgccagcatccagaactcaaggctctcaaacacccattcacagcgcagcgcgccagcatccagaactcaaggctctcaaacacccattcacagcgcagcgcgccagcatccagaactcaaggctctcattcatccattgacagcgcagcgcgccagcatccagaactcaaggctctcaaacacccattcacagcgcagcgcgccagcatccagaactcaaggctctcatacacccattcacagcgcagcgcgccagcatccagaactcacggctctcattcatccattgacagcgcagggcgctagcatccagaactcacgtctctcattcatccactgacagcgcagcgcgccagcatccagaactcaaggctctcaaacacccattcacagcgcagcgcgccagcatccagaactcacggctctcattcatccattgacagcgcagcgcgctagcatccagaactcaaggctctcaaacacccattcacagcgcagcgcgccagcgtccaaaattcacggctctcatacacccattcaccccattcacagcacagtgcgctaggagacggagtggcgggcgatgtttcatctaggacagcaagagagaagatgctcccggcataaacctagccagaaacgtgggaaagctgccgcagaggctgaactcaatcaaaggcaccctgacccccgggccccgaagaggcgccacagctgcaaacatgcacgttcttccgatacaatttgtaaatttaatacgatcccagtaaaaaccacagttctggaactaccatgctcatatggaaaaattaacaagcaagtaacagccaaaaaaaccatgaaaagaaagtgaaagaggaccagctttatgagctcaggggaaacttactgtaatgaaaacagggtgggataagcaccagaagacacaggaacaggcccagtccctgcgacccaaatcagtgaggggaaaaacgactttttaaccaactgcccagggatagggatagccatctggaaaagtattaagttagactcatatgcacaaaatcccaaatgcagcagagagaaaagcataaaaaaagaaccctggccgcgcgtggtggctcacgcctgtgatcccagcactttgggaggtcaaggcgggtggatcacaaggtcaggagattgagaccatcctggctaacacggtgaaaccctgtctctactaaaaatacaaaaaattagccgggcatggtggcgggcacctgtggtcccagctactcgggaggctgaggcaggagaatggcgtgaacccgggaggcggagcttgcagtgagccgagatcatgccactgcactccagcctgggcgacacagcaagactccgtctcaaaaaagaaaaaaaaaggaaccctacaagaaacaagaaaccgtgggtgcattcttacagtgtgggaggggaaggcattcccaatgaataaaggacatcaggcaacaattaaagagaagactgatacactgaactccatatattggaaaacaaaaaactttagcttggcaaaaaaaatcataaacaaactgagggaaaatgtttgcaccaccacaaaagagcgaatatgccagtcgtaggaagatctaagagtctggaaaaagcaaggtcaaaaatacacgagaaagtgcaggagacataacccaacagctcagagaaaatgtgtgtgcgtgagcctgtgtgtgcacgtgtctacacgtgtgtagacatatgtgtgcatacaaatgtgtgtatgtacatacacaggggtatgtgtgtgggtgtgtgtgtacaggtgtgcggacgtgtgtatctacaatatatgtatatacggcagtgcctgcgtgcatacccatatcccttaaacaatgaaaggttgttcaggttctctcaacaaaaatacaagttgaaactacatccaccaggctgacagagctctgacaacggtgcggctgttggcgaggcagcagggagcaggcctgaggggctggcggggaagccgagctggagacgcaccggtgctgtctggtaagcggtgggcacttgccctttgccccctcaacccccatcctcgtcgaaacacttcccagaggtcaccggcaaacatgtgcagacgcagagcccacgagctcacggcgctggctcggcaacggcaaagccgtccaaagccggccgggggcttgagcccgccccggagcctccatcagctgagagctggggccgcgggagcagggaggaggctcagggctccccacagagggtcaggtcactcaagaccatgaggggacacacgcgcaggacagaacaactcgctgtccccaacttgctgtcgtgtgaaaatgacacggcagcagtctgagcatcaaacaatgccaaattaaaattaaaaacctaactgaggcttggcacggtggcactttgggaggccgaggcgggagggtcgcttgagcccaggagtttgagaccagcctgggcagcaaagtgagatcctgtctctaaggaaaaattttaaaattagccaggtgcggtggtcccagctcctcgggaggctgaggcgggaggatccctggagtcccggaggtggaggccgcagtgagccacgatggtgccactgactccagcctgggcgacagagcaagaccctgtcaaaaaaaaaaaaaaaaaaagcctaattgattgacacactttgagtacgttaaaaagaacatgagctcagatcgatactcacaaaaagagacaaggcgggcggggagggaggaagcggtcgctgtccccgggcgtccgcggtgtgttggcggctgagagaccgcggcgcagtcagcacttcgcctcccgccttcccgtcaggccgccccgcgccgccgcgcactcactttttccgtccccggctggccccgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatggagcccggggtccttggaattgggcggggtgggggggagtccgcccagggctcccagcaggagcgaaggtgagcggggggcctctgaaagggaacccaccctcgggctacaggagaccgggctggcgatctgggtgcagcgccaaggccctgggggctggtggggccgcatggggggctgcggtgtgagtcctggtggtctctaccctcgtgcgtcagggctccagtgtggacaaacctcgctctgagtctgggtgaggctcctgagattctggagagttcaggatgtggagggtcctctggagggtgaccgaggccgtgtgaccacaccatcgccgtggccccctcgactgtggcacaatcgctccccttcttgggtggatctccgcgtgttctccccatacctctgaccccagtcagtctgccgcacccaccagtgggggcccctgtgtttgtccagccttagaaaacctggccggggtgtggccggaggggcactgccggtgccactggccagggctgtgagagcgcaggatgcctgccccgggcacgggggcaccgtcgtccccaactgcttagccacagaatccaagattggtttggggtcttcagtttttatctcaattcaacctgcaaaaccaagttattacatacatggaggagtattcagccttaaaaagatggaagtcagtgcaccccattcccagcagcgcaattcacaatcagcggccatgtggaagcagcagctccgtgtccaccgccggaggaaggaacggacagcacggtgattccgcacagagggagtcacctcaggaaggaagggctcccacacccgccgcagcgtggaggaacctcgaggacgtcacaccgaggggcacaagccacaaaaggacaaacactgtgtgactccccacacacgaggtccccagagtgggccggttcataggcagaaaaagcagacggtggggcccggggtcgggggagccagcgggaagtgagtgtttaatggggacactttctgttttgcaagagaaaaagagtttctgtttctgggctgggaggtcagccgctgaaccgctgaaccacagttgctgggcggggaaagtgggcctcgaccactgcctggcctatgcaggctgccccggaatcaggggcaggggcaggagcgccgggtgtgagacctcagcccatggcagccttcggcctcgctgatggacagaaggggaaactgaggcccagggaggtgtagctgtagtagtgagagttctctagagaaatagaaccaataggccgggagtggtggctcatgcctgtaatcccagcactttgggaggtcaggacaagcagatcacttgaggtcaggagttcgagaccagcctgaccaacatggagaaaccccatctatactaaaaatacaaaattagccgtgggtggtggcgcatgcctgtaatctcaggtacttgggaggttgaggcaggagaattgcttgaacccaggagatggaagttgcagtgagccgagatcgcgccattgcactccagcctaaacaacaagaacaaaactccgtctcaaaaaaagaaaaaaaaaaaaagaaccaatagaatgtggagacagagagagagaaacttacttggagaaattggctcacatgactacggcaggcaggcaggctggggacgcaggaggagccgaagtagccactcaaatccaaagatgcctgcaggcaggattccatcctcctttctctcctttctctccggccttcatagactggatgagactcctgtgtcgcggaggctgacctgctgattcaaagtctactgatctcagcggtaattttatcttcgaaaaataccttcactgaaacttctggactgctgtttgaccaacatcagagtcctgcggcctggccaagctgacacagaatgaaccattgcaggccgaaggaggcggagcaggtggcacgcaggaccccagctcttccaggaagtctgggctcgtggggggaatggccggtgcggcagggggtccctcagccaaggcgggcctgcagccgatcacgttttcacaagtccattggccacgtggatgccctcaagattatactgattgtcatccactttcttccttctcttttcttggaatttttatagctacacttttttaaaaattaataggctctactatctaaagcagtttggggtttatggaaaagctgagtggaaagtagacggagcccccatgtgcccctcgcctcgcccctcacacacactctgcacccctattgttagcgcctttgccttggtgctgggtccttgctgtgcgacgaatctgcactgacctggccccatcacgcagggtccacagctcgaattgggggccagtcttggcgtcttgcgttccgggagtcctggcaagtgcatgaggtcaggtatccaccatgatggtgtcaggagaggcttccctgccccgaaattcccccgagctccactattcacccctcccttccctggcaaccactgaggattcttactgtctgggtagattgcctctcccggaatgttgtatagttggaatcatacagcatgcggccttttcagattagctttgagaactaaaaataaaattctaagctcccagtcaactaaaaggacgcctgttagccaaggagaccccagagaaaccttaacacctgagttcccagctaggacgggacaggaggacatatacagctcgttagagcccctcccttttgtggtttagacacaaatgcccagagtgaatgttgaaatagagaccataagattggcaggattgggccaggcgtggtggttcacgcctgtaatcccagcactttgggaggatgaggtgggtggatcacttgaggtcaggagttcaagaccagcctggccaacgtgatgaaaccccatctttactaaaaataaaaaaattagctggccgtggtggcgggcgcctataatcccagctactcgggaggctgaggcaggagaatcgcttgaacctgggaggcggaggtttcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 106 - DNA, 2107 bp, Homo sapiens
agtttcccttccgctcacctccgcctgagcagtggagaaggcggcactctggtggggctgctccaggcatgcagatcccacaggcgccctggccagtcgtctgggcggtgctacaactgggctggcggccaggatggttcttagactccccagacaggccctggaacccccccaccttctccccagccctgctcgtggtgaccgaaggggacaacgccaccttcacctgcagcttctccaacacatcggagagcttcgtgctaaactggtaccgcatgagccccagcaaccagacggacaagctggccgccttccccgaggaccgcagccagcccggccaggactgccgcttccgtgtcacacaactgcccaacgggcgtgacttccacatgagcgtggtcagggcccggcgcaatgacagcggcacctacctctgtggggccatctccctggcccccaaggcgcagatcaaagagagcctgcgggcagagctcagggtgacagagagaagggcagaagtgcccacagcccaccccagcccctcacccaggccagccggccagttccaaaccctggtggttggtgtcgtgggcggcctgctgggcagcctggtgctgctagtctgggtcctggccgtcatctgctcccgggccgcacgagggacaataggagccaggcgcaccggccagcccctgaaggaggacccctcagccgtgcctgtgttctctgtggactatggggagctggatttccagtggcgagagaagaccccggagccccccgtgccctgtgtccctgagcagacggagtatgccaccattgtctttcctagcggaatgggcacctcatcccccgcccgcaggggctcagccgacggccctcggagtgcccagccactgaggcctgaggatggacactgctcttggcccctctgaccggcttccttggccaccagtgttctgcagaccctccaccatgagcccgggtcagcgcatttcctcaggagaagcaggcagggtgcaggccattgcaggccgtccaggggctgagctgcctgggggcgaccggggctccagcctgcacctgcaccaggcacagccccaccacaggactcatgtctcaatgcccacagtgagcccaggcagcaggtgtcaccgtcccctacagggagggccagatgcagtcactgcttcaggtcctgccagcacagagctgcctgcgtccagctccctgaatctctgctgctgctgctgctgctgctgctgctgcctgcggcccggggctgaaggcgccgtggccctgcctgacgccccggagcctcctgcctgaacttgggggctggttggagatggccttggagcagccaaggtgcccctggcagtggcatcccgaaacgccctggacgcagggcccaagactgggcacaggagtgggaggtacatggggctggggactccccaggagttatctgctccctgcaggcctagagaagtttcagggaaggtcagaagagctcctggctgtggtgggcagggcaggaaacccctccacctttacacatgcccaggcagcacctcaggccctttgtggggcagggaagctgaggcagtaagcgggcaggcagagctggaggcctttcaggcccagccagcactctggcctcctgccgccgcattccaccccagcccctcacaccactcgggagagggacatcctacggtcccaaggtcaggagggcagggctggggttgactcaggcccctcccagctgtggccacctgggtgttgggagggcagaagtgcaggcacctagggccccccatgtgcccaccctgggagctctccttggaacccattcctgaaattatttaaaggggttggccgggctcccaccagggcctgggtgggaaggtacaggcgttcccccggggcctagtacccccgccgtggcctatccactcctcacatccacacactgcacccccactcctggggcagggccaccagcatccaggcggccagcaggcacctgagtggctgggacaagggatcccccttccctgtggttctattatattataattataattaaatatgagagcatgct

SEQ ID NO: 107 - protein, 286 aa, Homo sapiens
MQIPQAPWPVVWAVLQLGWRPGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLVVGVVGGLLGSLVLLVWVLAVICSRARTIGARRTGQPLKEDPSAVPVFSVDYGELDFQWREKTPEPPVPCVPEQTEYATIVFPSGMGTSSPARRGSADGPRSAQPLRPEDGHCSWPL

SEQ ID NO: 108 - DNA, 30611 bp, Mus musculus
  misc_feature (1)...(30611): n = A,T,C or G
aaacttccatttatggtctgtgctacacaggtagctgtgtctgggctagagagatggctcagcagttgagagcaccagctgagcggggcgtggtggcgcacgcctttaatcccaccacttgggaggcagaggcaggtgaatttctgagtttgaggctagcctggtctacagaatgagttccaggacagccagggctacacagagaaaccctgtcttgaaaacaacaacaacaacaacaacaaaaaaaaaaccacaagagcaccagctgctcttgcagaggtccagatttcgattcccagcacccacatcacaactacaaccatctgtaactccaggtccaggggattcaacactctcttctggcctccagaggtactgcatgcatgtgacataaaggcatttacgtaggcaaaatatgtccacacatgaaataacatgaaaaaataaataaatagcagttgtgttgcaaggctttataaatcatcaaatgaaattatgtgtagaggatatagcctgggacttttaaagtatctaattcaggctggagaatggcttagtgggaaagaacacttgctaccaagtgtgacgacccaagttcgatttccaggacacacatggtggaaaaatagagtcaatttctgcaacttgtcctctgaccttcacacgtggaacatggcacacacacactaaataaacacaattctttaaatccccgtcttccctgttgccattcccaagagaggtcattcggcacggtcaagttctctcttgaagcagttgatgcagagggagctggagaatggaagcaacgtatcaggagagagggtggggccaaaggaaacataagagaccagacagaaatgtctcagggtggtgaagtttgccgctagcgactgtcaggggcgtgggagaaagcaagttctcccacaaggatacatttcccaaagtggttgacgatctaagaggtgggaggtgggcgagggagcgaatctatctgcatcttgatcgaaaatcaaaacaatttctattcttgcaaattcccttagaaatgtagcctcttggggactgggaatggaatgtatttcttctcaaagcttaccaggcagcctggctcctggccatctggcagggctcccatcaggaaagttatggaagcaacgatggccatcatgatgctgcagtagcggacatgaggagctggcttgtggcttcagctctcctttccccacagctcccagtcatcttgagttgggatagggcagcatgtgagagctgtccagctgaggtgcacaccctaaagctatgctgctcaactctggggctcctaggggcttacagacccccagagaagcatagcgtgtctgattttattcaagaagatttttgttaaggaagtgttggatcctactgaaataaacatgagtgttctgcgaggcaggctcttttaacatcaagtgtgagatctggacttgaggggctgctttgggctgtgcccctcaatcaggtgtgtggccattctccgtccctttccagctgcttaaatgacccttcctttttagagttgagtgttaagtgaagattttgaggtcattgtgcccattccaaatgagactctatatccggtcacttgttgactatatgtagagaccagtagaagaccctctgcagtttcagtgagcagagtgggcctgggtgtgggtctttcccagagctggtgcaatggttccagtatacacccggggcagttccctctaccatggagctctgtgtgtagagcctggagcctttggtttgactgaatctccagttctgttattcttcctccctacccttagaagacagatatatgatctatgttgcttttcccataccaccactaacacactgactaaaaccagttccttcccagtctctccataggttaagacagagtcctccatctactcgatgtcagaacacacaaggtagacattttccaagcccctaacatatacagaggctgtgtgtgacaattatttcccagtgatgggaattaaacccaggcctgtgcatgccaggcaggcctcctaccactgagctacatcctgcctcactcaaaactccatttctttccaagacactggcattgccttcatggattcttatttaaagggaggtttcattggttagttagttggttggttagttaattagttagttgttcaactgttgctgaagcttttcactacaggttccaacagagaaactaggcaagagaaggaatgagagttactgagagtcattctttctggtctttattgagcctaatgcagctaactccccatcctcagacctttagatgcacctggggtaaccgttactggttaacaagaaacaaaagatacttgagtcttcagaatctcacatgagtacaactagcctccaaaggcccagcctagtaaccagccagcctgtccctttctcctgaagcctccacagactccaaatacagcaccgctctctggagggcaagtgttcaaagcatgagctatgagaacatttcattttcaaaccatagcaccacccagcagctcacggggttaaggtcattttttgtccctccttgtgctggagccttgccaacttgactcaagctaggatcatctgagaggagcgaacctcaactcagaaaatgcctccatcagatcggcctctaggtaagtctaggatgattgatgtgggagaggccagccctctgttgatgtggccacccctggacaggtgctcctgtggttatgaggaaggaagccaataggcagcgttctttcctggcctctgcttcattttctgcctccaggtccatgcctttgagttcctgcacatctgtacaactaaggtatagtagtacctgtcttatggttgtactgagaacctcaaagtggtatctgggctaaaggctgctctccatgcctgctctcacctgcagtgatctctgtgcttggtaacatcctatagacttctttgccatatggttccctttggcattagttcttagcttgtgtgaagagcaaaggtgactgccatgtactgaatcactaaatggcaggccagccagacttcaggttcaaggttaccactctgccttctttcttactgagacctcgttccttgaacagtcccctttcctatacttaatacaggttctagaaggttctccctctgcagttcttcttgttatcgccatgctaattgcatgtaacatgcagtgaatgtactgtgaaaatattaggtcaaagagcaaagccatcatattagggacagaatacatgcacacacacacatgcacacacacacactgatactcccactaaaaggtttttaaagggtgtaagggatttattgaattgacttacacaatagaggtctgggccacacactgtttcagacaatcctgggatacatagtggggctctgtggcaataaaatagaataacaagtagagatgtgcacaaagagactagagttaactgtgggaaaccagtattgctatgtgcatactggaaaaatagaactgagaaattccccctattctgaaagctcagctattctgatgctgaaagcctggaagctccctggagagctgctgatactgaggctggagtcagagtcgaatgtcactggaggctcttaccaccaccatcagtaccatcatcatcaccaccacaatcatcagcatcactgccattaccatcatcaccaccaccatcaccaccaccatcaccatcatcaccatcaacagcagcaatagacccactcactgagaaaaaaaaatgaatgcacactgatttttttcatcccgatctctgattaaaggtatctcacacattgacaagaggtcttcccctctactccatcaagcttccacatgccagttcttgggaactgctcccacggacacatgagcttcacaagtcctagacatctatcaacccagtcacactgacaaccaagaccaacaaacacagctgttctcgtacctgctccccactccactctgcctcccattggaacagctcatgtttaaaatccacgcaaggtgctacgtgctaggaggaaagccttgctcctcttccagagcagaggttgctcttgctgagagaagactagcctatacctggcttccgacaaatagagacctcaatgaccactgtcccagagacagcttgaagtgtctctctatgatgaggttcatcctccttgcctgggtatgcccatacccctcacgcccatgtctccaggaccctccttgcaatgacagagtgtaccctctctggggcatacagcggtcacttaacctgtgcttcttggttatataagaaatatgggccttgaaccaccagttattggttaaggggaggagtttctgttaagtcccatttgttcctaaagattttcagattcagagctgaaggagctaacatttggtctagggcatctggtaggctgtgaggcagcagaggaatctctctggcacatgccacacctgaggccaggcaatgtgaccactgcaccatcaaggcaggcacaaggctgctctaggccaggctgtcccaatcttactgaggagtatatattttccaaagagagtgtgtcagctcttcagattacaaacatagaagtgtcttttcctccaggggccaacattttgccaagggggaggggtggccatggacagagacatttttcatgcttgtgtggcactgaaaattcttcactgatacctcttttattgcaggaagatgaatctgtgaggaagggtggaagtcacaaccactgccgttcctctgggttcctctagggacttgtcatttaagcccctcagtcacagcagagaccctagggtacaggtatggatcctcactggcgtcagtgtgtctgtaggatttccaagcctactggttatagcaatgcaggatgcttcttagctgctgcccagggtccagttcacgtgtgctgtgaagctgggtacccttttatgcaccgtctgctcctacttcatctaggagaccacctactgccctaatagcttcagcatgtgttggatatgcacgtggctattcctgttgatgtggactgaacagcattcagaagcttcctggtgtcaatcatctctagaacttgggactccacagttagctccatgaagggtgtatggatgctaccacttgctggccacatcctggtgcatctgaagtgatgcttagagaaattcttccagaaaaactgcagagccccaaggtgtcctgaaatcaccctacagtcaagaagagggcagataggctcctcacacacaaggatctccatgccaaagaattgcaatgttcttgtgttcccaagcaggtaaagatgaacttggactgacaccgggcaaggacaggcaacgtcctactgagaacagtcttagatgcttcttgtatggccttagcttgggcacttgtgcataaaggccttcagaaaattctctgactctgcaaacactaagactccacatcctcccacaccgaaaccaggaccaaagaacttaattctcagcaaccttacaaggcgctggggacttctggtcatggagtttctaaatggcagtcagtgaaccacaaagatggtagggcatctgctcatagcatagtcatctcttcttgcagccagggtagactcagctccaacagctaaagtaggtggctttgctgaagtcgtagagctcacagatgttctcatgacccatgcctaccacttggtcaccttggccaaggaagagcagcatggggcactggccaggaggaatccgttgctcccttgcccggggcctactgccataccttacaacaactctgccatactatagtgtggtgggagcacaaggaagctcagggtgtctcagtgacccctggtgccacagccaagaccccctctgtcatctttcaaaggctggcagaaggatttctggaatcctcggagcatctcctaggacttagaactgaggtctttctcctcttccagatgaaggaatgccaagtctttccacagcttcagcatcacaatggtctaatccttctgggaagagcagatggtcagaaggctcttaatgagccctcagtgccaagccgatagggaaaacatctctcctggaaacttttggggcaccattgtttgctgtaccagtgtaatcgagactttccattgaaatatcagactagttaaattccctctatggcgtcaggagacttcagggataggcctggattgcgttagcatggccgtcttcctactgacccccttaagtctcgtcaagaatctcacttgcgtgcacttttagtctttcctccattgctgggctgtctgggatatcaaaggctaggtcattaacacgggtcccttgggaagtaaagtccagggtttgaagccaccacgtctcgactggtgagatttgagtcataagtaatttcatccctcctagacgggttggtccagcatcagaagcaatcagttgtgcctggtgactgtggtttaacctgaccttttctgggaaggaaggagatggcagtggtctgcacccctggaaaatctaattggctggaaagacgagagttttcctggcccggtcggtgatggttactccacccaggattgaatactgaagacactgtgggtagcccaaaattcagttccgaattactgaatgcttactaagccccttgtatgtccagctaggcggaggggacactgagtgactattacggacatatcgttagtttgcattaactggacagcattggctcaacaccttcaagagaacacctgtgtcatgcatggaatcttcacatgggagtctctctgcatcccaaggggcatatgtgtgctgtatttggctttctatgtagaggaaaagctctggggccctacatctccgagccagaacaacagagtatcagttcaagtagaggttagagcctcctctcggagccgcaacaaggcactttggacagtgcatggtcctcaggaattctacctcacaatcttctgctccaggcttcctgcaggccacctcagtgggaggctgaaggccgggtgcaaagctcagtgctcagacacttctttaacagagctcacgtgggaaagattccccttgataatctatcccttactgatcggcactgttagtaagtgtagtttttgttgggatgctgggattttatgaaataagcatttgtacttggtaggtagatttcccagagctatctgggcccatctaagaagtgtcaactgtctgggcgtggcggtgcatacctttcaatcccagcacttgggaagcagaggcaggtggatctctgagttcgaggccagcctggtttacaaagtgagttccaggacagccagggctacacagagaaaccctgtttcaaaagagagagagagatgagagagagagagagagagagagagacagagacagagacagagagacagagagacacagagagagagagagagagagagagaggtggaggaggaaaaagagcaggaggaggaagaagagcaggaggaggaagaggaagtggggataaaagtgtcaactaagtccagtcagcgagacccatgtccactgctgttctcattgatgagaaaatcacctgtgcgtttttctcctcacattgacaccattccatccttttctcttcatttgtgtgtgagtgtctgtgtgcgagctgtgcatgtgtgtgcggtgactacagaggccaaaaggaggtgttagagctcctagaactgatgtcacagctgtgagctgccagcggctgctgggaactgaaccgagatgctttgcaagagttaacaggcagtgctcttaacctctgaactatccttccaactcctgataccatttctgttttcctgacaaggtcagacatgcttttactgggaacatgcattatcctgaggcctctgtgtctccatcacttaggaccatgtgtgacccagggtggatgctgctctttactaaatgtaaataaaatatatgtctggacaggaagccctgtccctcagcatcctcttatccctccacgccctggcttcagcacagcagacagctatgattatttgagtgtcaccatacatgagcccagccctgagaacagaatgcccttcacccctccaccctgccgacctgccccggccctgagtttaagaaaactgtgtgctgtgaagtcgtgtagactgaactccacacccgtactctttgtgcctcttccctgacagtcactctgcatcaggagtcctctttccagcgtaaaatggcacagtgctcattaaaagagaagacaaatgcaaaacagacttaaaaaaaaaaaagacttacttatttatgtatgtgagtacactgtcactatcttcagacacaccagaagaggtcatcagatcccattatagatggtcatgagcctccatgtggttgctgggaattgaactcaggacctctgggagagcacacatgttctcttaactgctgggccatctctccagcccctataaagcagagcctttagagtagggggacacgccccttcctggcagccttgcactaacaacaacttgacccaaagtcccatctgcccagacacttctaaactttccaaactcagacattctgagagtttaacctctttgtatttctttaaattaaagggtgcttcttgagtgtggctatgagccagaatttgaggaaagagttaagagctcatctaagctaactagactcaatgtaagccacagtctcgtggttctcaagggctttcccccttgtccctcaattccaaattcagtttcagacgcagtggcctgtctgcctcttcactggaacttctaaatggcatctatccttacatacccaaagtataacttagatttttccagtcttctgtctctttccacattgtgtagtggtgctattgtccacctaagggctgaattaaaatccagacagtcctgtttgactttctccagctcagcaggtaagtgcactggctgctcttctagaagacctagattcaactcccagcacccacatagcagctcacaatcctctctgactccagttccaggaggtctgacgccctcttctggtgccgatgggcactgcatgcctatggtacacagacaaaacactcctcatacacataaaataaaataaaaccttgtcagagggtaaatcagatccagtgagcctcccttatcaaacactgttttaaacatttaagctaaaatcttttctgtgctcttaaaagcccttcactgtctaatgccatcccatccccctagcttcgtcttcccctggcttaggtattccacatccgtaaaggcataacagcaatagttagagtccctgattttccatttgttcccgtggcagaaaggtctcagtggtcgccatgaacttgagccagcccaagccctcctgcagccagcatgctctcccactcactagtctgacatctggctacaaggggtgcttgagccaagaaagataagtgcagactcccggaggggaccaagattgctgaaagagttaaaaggttctttctccaaaccttggccctccctctcctgtgtctactttatgggtttaatgagaaacccaggcaccgcacaagagactgcagaaataacttctggggcatcgctaacttattcagcagcaagagacttcaggctgccaatgctccagggaagataacccagtggaaagaaggtggtttttacagcctgggtcggacggaattttgcagagctgagtgtgagctccgccccttacaggactgaaaaagccagcttaggctcctcagcccctctttgagatatttgattaggaatttgggggcgggccctggcctggcacagacttgcacactctccgtaggcgctcactcctctcttccctctctgccacattctccaacccaaggagaccagacagaaggacgtggtcactctgaacagttcaacccaaggtaagtgcagccctatttctttaggtttgctcccttgcaattctataaagagaaacaagggggaaggacaaggctgggagaagagtgggcagagatgggttattaatcccaactggtccatgcctcccagggatgctgaagagatgcaacggcaggggctgcatgttccctgtctcctacagctccctgtgggtattgggggcctctctttcactgacataaaaacatgaagaaaattgcaaagtctcctggttgctacctatgagtctcaacatgctaggacttggggcactttggagaatagtctctggatgtcccagagatctcttagagaggggcattgtgcccaaatgttagagggcaagctttgtgtatgtaacatgtgttgctggagttaagaggagagaataaagaattgatccaaggagtcatggacggagtggtggatagaatatggttttttagtttgacctcacctctgatagagtttccccagactgaagaaacaaaatggtacatttgtagctcccgagtcgggatctccaagtctgagagaatcacttctggaaacttcacactgaatagagggtctctagcatgacaagaaacagtttaagggtgtgcagccctgaagtcacattctagatcaggtggggaaaggacgggcctgcactcctcctaagcccttccagcagtcatactctgaagggaggccactgtggctgggcatggagccccatggaaagctgaaccttgaagaggaaggtagtccccttctgccaaagtgcctagtctggaagagggacaaaatggacagaggcttagtgtgtcagtcttctctaaaaagccaccttggtcagtcctgcagcagcccagggctgtgcatggaaaaatgctctcttggcaatgggccgttccatccgtcttctctcctggcccaaatcaggaaccagtcagcatcttaggcactgggcagttgagtctgctcctcagaaacactggtgctctttgttcagggactgtggctgcccagggatgagccagagtgcctgtcctgagccatccggggagttgtgggatgaaaagtcataagggaactgtttcagggaacagaagggcatgacagagatgctgctcagaaacggagtagttggactgtcatagctgggtctcttctcatcaattcataggactgtcctgtccacagctgtcaatcccagcacagcccggcggtgagagcaccaggaaagattctaaatattctgtcttaatagttgtgacctgggaggtccccctcttcccggggactatgcagtgctctggccatagcaaccaggtcaaacacgacacccctggctccccaccatctatctacacctgcaggttccctcctggaggccccagcatgccttgcttgtcttgctagcaagctctaatgcaacagactcctcagcagcgtgggtgctaactgagcctggaaagccaagtgacatcacttgaaggaggtagcttagaagagaagaaggtacacctcgtatgtggtgcatgcctttaactccagcgctcaagaggcaaagacaggtggagctctgggagttcgaagccagcctggtctatttagtgagttccaggagagccaaagctgtgtagggagaccctgtctcaaaaaggaggagtaaatgccccttctggattccctccatcccttccatttctattccagttctcagtgtccctaattcatttcaatcgcctctcacatggctcctgccatccccatggtgggtgagaggagggtgaagtccttcagtcttcaggaccacagaagagagacgcagaccaggccagacacagtacagtcagcccagaagacaatcattagagccatactgggttcccagtctggaaagactgaagtctggctacacactcagccacaagctgctaaccagtgcatttttctcgcccagaagactcacaggccatggtcctctggagaatagcccagaccttgtggtggccacaggggagccacaccctcccacacactcaggaccacaaatccccaggctgcccatgagacccaaaggatcttcaagaagtagctcaactattccctttggaagtcccagtcctttctggaggcttcctggacacaggaagaaccaggagactcttgtccttggacttgcagaaaaaaaaattccctgcaagtccaaactagaggggagttcagacctaaaagtatcccaattggggggggggggcagacagacagagagataggctgcaaggctctcagtttcaacaacagaacctcagggtgctggaggatgctaaggacctgcccttccccaaactacagcccacgcctctcaggttcttctctaatctcagactcttttcatggctgcaagaccagaagctaaaccggtgaccttcctcagctccccaggtatgcagagccaggaggaggaggcacccaggtgagggggaagcacagtttctgccctccagtgcttgactgtagtcacagtgtcagtcacagagcctatggccagcctgagccacccaactgcccgcctgcaccttcattcatgccccctctcgctctgtcctctccctttctacagagacaaaaatgcagtgggcctccgtcctgctgctggctgggctctgctcgctttcccagggccagtatgatgaagactctcactggtggatccaatacctccgaaaccagcagtccacctactacgacccctatgacccttacccctatgagccctctgagccttacccctatggagtggaagaaggcccagcctatgcctatggtgcaccacctccaccagagccccgtgattgtccccaagaatgcgactgtccccccaacttccccacagccatgtactgtgacaaccgcaacctcaagtacctgccttttgtgccctcccgcatgaagtacgtctacttccagaacaaccagatctctgccatccaggaaggtgtctttgacaatgccactgggctcctctgggtcgctctacatggcaaccagattaccagtgacaaggtaggcaggaaagtcttctccaagctgaggcacttggagaggctgtacttggaccacaacaacctgacccggatgcccggcccgctgccccgatccctgagagagctccacctggaccacaaccagatctcacgggtccccaacaatgctttggagggcctggagaacctcacggccttatatctccaccacaatgagatccaggaagtggggagttccatgagaggcctccggtccctgatcctactagacctgagttataaccaccttcggagggtacccgacggtctgccctcagccctggagcagctgtacctagaacacaacaatgtctacaccgtccctgacagctacttccgggggtcacccaagctgctgtacgtccggttgtctcacaacagtctcactaacaacggccttgctaccaacaccttcaactccagcagccttcttgagctagacttgtcttacaatcagctgcagaagatccctcctgtcaacaccaacctggagaatctttacctccagggcaacaggatcaatggtgagctccaggggagggaggggactccttggatgctagtgggaacgctaataataataataataataataataataataataataataatattattattattattattattattattattattattattattattattattataagcatagagagccaaacaatcaagtatactgactgcaaagccctgtattcagccaggtacacactggtcctccagcaaggtaagagagctgactgcaaagttggttggctccaaagaccacataggagaaacaagattcagtctaaggctttcaaggtgagcgcatgggctgtggggaggaggaatgagaacagttagcatggggaattggtggaaagaacctgccacttaacaagtcacaggtcagagacagttggggatgcatgatttaggaccactgagaaatgagtttaaagaaattttagagcagcagttctcaacctgtgggtcacaaccccttgggggtggggacaaatgaccttttcacgagagtcacataccagatatcctgcatatctaattatgattcattacagtagcatgattacagttacgaagtaacaatgagaataattgtatggttggttaaagggtcacagcatgaggaaggttggaagccactgctccagagcgatattcaaggagaaggagacctggtgttctcttctggggtctgccttggggcgaggttgggctggtaagaagccaaggtccctgagcatccttaacagtcaccagaggatgcagattctgtcacacacacacacacacacacacacacacacacacacacacacacgactcctgcctgcacagctagtctcctgttttgctgtttgtttttcaaacttaacaaaaatgggcagccctcccagaactgaatgtgggacatcttgccagttctccctggagtccaaggaacccctggtggcaaggcaaaggtcctccctgaggtaacatgggcctggccacccagaagccttggggaaagaacataggactatgtgctttataagaacttccctgcataggtaagactacccctctgaaacagagagataaaaaatgaatctctgattgactagcgacctttcagcctctttctaacacgttaggatctcatgttcagagcatgcttactttaccccagtggcttttgatgccttgctcagctggaaagtacagggccagcatttaatttccctcccactgtggctcagtccttggctctggggaagggaggcctggaatggccaggcagtgggctctgaatttcttgcagcctgctgagaaggaatgagccaacaaagcacagggagaccctgtcctgtcctctctcctgcttcctctctcttctcaggggacagatcagtcatttaacaagatgttaacagccagacagcctacctcagggggaatagggaggttgcaatgggcctctgaagtcaaaagctatctgtctggtcctttcattttaactggcaaggcactgttacaggggtaagagttgcttttacttagagtctctcttttgggggaggagtcctgttagtcccaaggtgacaatgggagtcatttactctactttaaagatgtcacacacccagagtttggtgttttttctcccagctctatgtcccgccctacagtcgtctgccgcctactctgaatccagaagagctatcctatgagaaatgtcacactctctgctgtacctagtccaagtgtaactctgaacacgtggcagaaaggcactctgggagagccaaaacctaactttccagtcagagagaggtggcaaggatagacttgtcacagcgtctcgtcacccttatgtctttatgcagaaatatccaggcagatacaagggaagccctctcccaaaagccgatcagaaagtaaattactcactgagttaccctggggcactgcaaaagagctctctgttcaaacccctgggaaatgtcagcatctgccccaaatccctatgagccaggtttaggcctaattccttccctcctggttatcagtaaatccctctcccggcttctctgtaacaagcaaaggagcccccatgtcttgtctttctcgaatcagtaagtggtatgcggaacacacgatccagaggacctggtgcccagtgtcacagtcaacccctgttaacacagtgtcagttgccttcttgttgccttttggagagtcgacaggcatagtctgggcacttgttttctgaattgtcaccatggggacagtaaaagaaaagccgtgttccaggtcacccagcctaaggaaggctgaaacccccaactcctgctttttgtaaaggacctaaagccagacatctctgatggagaacagggacaacccggctctgatgcaggaaatggcttcttagcttgcctgccacacactctgggtaaccaggaaggaggaattcctgtaatggcagtcagtgaccatgttggggtaaggtgtggtaagggggacccaacagaacaggagctccaggccttcaggaaacaggacagcacacacgcgcacgcgcacacgcacgcgcacacacacacacctctccctccaatgcctccctcagtttttccaacctggcagaagaggaatgatggagcagacagagccacggaatgttagtcagaagctgtgggatccaatggcgtggggcgggattggaatttggaaagactcatgtcagtatttaatctggcctggaaaaatgtctgccggggcctcctgacagaagccctgacctactgtgggcttgaggaaggtgtgcggaggggtgctcttagagcccatgaatagctgatctagatgctgtgtctagtggctcacaggtatgggaacttggatgttagcacagtctgcaggctccatgtccagacctctggctcagtcccaaataggactgaaagtggcaaatgacgttcagccacctcgtgtgccccctggccctgtacacagtaacagactcaagccccacctgcactatacccactaaatctactcccgaggaccagaagggaacaccaaaaagcgtctcagagcttctgctcctcctcaaagtatatttcacagccccactctcccgggacctaactcttctccaggcctgaattctgtgtttgagggcagtgcaacatggtttgctacagcacaccaacccatctcgggcagttcttaacggagactaaaagcaactgatggtgttaattcaaaaccaccttcctccacagcctcggccttctgtgccgtctttcttggaaaccttcatcttcacactccctccttcccccgggaggaacccctattgtctctaaaaattgggttagctcctaccgatcaattctgattatagttccaggcacctgtgcaggatgagggacgtgtctgacgggacaaagccagccctgttctacacttggctcgaggctgccagcatgggtatctgtgaatgatggtcacgccagaccctgccccctcctgccaccttatctaaaccagttcacagaaaatgacaataagagtggtcttctagggagccaagtagaaggaaggcagccctgatggcttccggtgtgaacttctgttgtcgcttttggagtttgaactgggattttgaatgtcttcttttcctttcaagttactgagggtagacggtggtgtcatccaagaggacaacagagacagctgtgcgaagccttgtgttgagatgacccaaaactagaacatctatttcatggcttaggggaactcctctacaaaagagtccccagagacttctgagagtaaaaaagagaccacagcctagggggatggctctgtccctgtctccacctacccccaagtttaaagttcaaatcctcagaacctacggggtcttgtgggaaggatacccaagggcactcagggcccttgaagggcccgtggaagtggggagttaggggacaggctgcagaagctggaacattcccctggtggtggtgacagcttgcctgtagttctaacctcggaagacagatgattcctaaggcaagatagctacttaccgagagtagagattccagcaagctctgggtttgactgaatgtccttagctcagtgagggaaagcattgatgaggaaccctgacgtagccttaggcctcacatgcatacatgcccacatacacaggtgttgcagaacatacaaacatgctatatacatgtgcacaccacatacacatgaaaactgaaaaggaaaaaaaactaaataaaagaggcagactacaaggtgtggtggtacatgctggctgtgatagcccacactcaggaggtcacacaggaggatctggagtctaaggctgtacttagctacatagtaagtttaagagcagtctgaactatatgagaccctgtctcccgaagtaaaaaaggcctatgtgatcgtacaaggaggcagggggattatttgattttgtttggtttaggatttttttttttgagatagggtctctctgtgtaacgctggctgtcctggaactcactgtgtagttcagattgccctcgaactcacagagatctgcttgcctctgcctgcctagtgaggctaaagggcttctgccagcatgcctggctatttatttgactttggcatttctagcctgctctccccttccagtcccctgaaggctctggcacccagacactcagctctaaggccaggatttctctctttcacgtcctactactttccgtacctgcaaaatgacaggaaatgttcaaaaatagtgtaccctattcctggagtggccttcttgcagtgtgccgccatcagcaaagcggtccttccaggagcagccaaacctttagagaagctgtgagctccacctaccctctgcttccccctgctgcccacagggggaaaaaacaaggcccggtgggaaggacatccgggacatttggggagcaaagcagggggtgggaattaggggggtaagaggttgagctggggaggctcacacctccccagcgtgctctgttcccagcatggtccccaacggtgccaatccgtctgactccaatactttagcaccacccccccccccccgttcaactcttccactccacccccaccccagtctttattctttatttcagcggattcaaaggggccctctgtgcccattttgtatctgtttcctaagctgagcttctcccacccgccctccctttttgtcccgccagagttctccatcagcagcttctgcacggtggtggacgtcatgaacttctccaagctgcaggtgctacgcctggatgggaacgagatcaagcgcagcgcaatgccggtggacgccccactctgcctgcgcctcgccaacctcatcgagatctgaggggcctcgccttgggctcctggctccgggctccgagtaccgtgcaccgtgcaccgggctcggggtacatgccctgccaccccgctgcatgtttggcttttgctggatggtctgggacacgcatgtgacagaagtccacaggatcttattcaatctccttccaacaggcagagttaggtgggatcaggggccaggccagtttctgcagggggatgaatttggtggtaaaagaaatatagctatagagtctagccccaaaatcttcttgcttggacagtagcatataaccagttccaatttgaccttttttgagctgtgctcaacagcatggccagctgcttctgcagttgctctgggctcctgctctttgctcctcaaaacatcacaacacacctcttgcccagtcacctcctcccagccccagctcaccctctctgccctctttcactggggcctcttctaatgtcttaggcagtcaggagacacccacaccctaagggcacactcttatctgaggctaaacggatggctaaaatcacacacttacccccacctcacctgtttaaagtcaccatattgaacaccataatgatgagctgttaacataggggataaccgactctataatggaggatctatcagaggagggaagtgtccagtggtcattatcagtatccatagtaagatggggaagagacacacctcaggatagcagaactgaaggggcagccccctttccagtttcatctgacacaacatgatctgcaccccttcttgggcttttagtatcgaaggggcaagcgtggttttcaaaacatgagaaagagcctctgctcatcctttggtctagtatgaagggttgttacgcaaatggcagaggcagactccacccgccgaggacctacccactaacccagactagggggtgatctcaatagctcgtttgtccataatgctagagcatcaggaaccagccctgtggagatgctcactggggtgcaagaagccctgccaggcccaagtcctgccgacactagacctggcttcctctgcattcacactatgcagtccgccttatgcccagtggtgcctgtgatttgtagtttgtctaagaacagccccatcttctcctttttaaaggtgatattgcctaggtacaaccaacagcttcttctagaccccactgggatagagccaccagggtagcgagtggcaagaagcagttgtaagatgctagcctgaggtgggtccctgccttagacccctgactctgtgtgcacttgggagcaagcttctctggaaaggacagggtggggcggggtgcttagactgtgctacgggttccagaactgcaatccacaaaagccaaaccagcttgtttcaaccggggagtgccacctgcggagcaaggctgccctggccagggttcttgggaagcacctgcatgtatcaccatcctgcctctgaagagccctcagcatgaagcaagcatgaatggcggccaacctaaccaataaagttattttataagtgcatctgcaaggatggaatggttggtggcagccctcggcatcgcctcggggtacctagacacacaggccttgaaccgtgtcagctctttaaaagagtagccggggatnnnnnnnnnnnnnnnnnnnncacacaaacacatacatacaaacatacacaaacatataaacacataaacacaaatacatacaggcaaacacacatacatgcaaataaacacacacaggaaatacacacacacacacacacacacacacacacacacacatattctacatgcttttcttcctctcctgtcaaccgagtaattctggatctgactgaacctgggtattattgccttaatggctgctgccctctagtggcacctgtcagaaactgaacgctgcaccaccatgcacaacccacttggttctggaagaagtaaacctgagagggagtcgcctacctactctctgctcctctcagaacgggtctcttgaaacccttctggtgccaagtgccaggctaaacacttaacattgccttgaaatgatggaagctgcacgtgtggcttccagtcagggaaaaagggaagcggctgagatgaatatacgccaaattctgactgccccaactccagagtgagctgacgatgccctggagagtattctatgatggaatgtggagatgtgcgagtcttgaagatctggcaccagggggggtgctggagaagggggaggggaagggacacttatggaggggtctgcccaaaccacaactgcctttcaattttgactgttagcaactcagctacgtcaactgtactaattctttgggattgcttctacagatgccctatagaagcaacttaagagagggaggatttagtgtgcctcttggtttcatgggctctcactctaccacgggagggagaaactcagttcatggcacagagtgtgtggcgaaaggctgttcacatcacagcagaccaggaagcagagagcaacgcaggaagcaatatgtcgttcaaaggcacactcctaggacctgcctctgcctaggctctacgtcctgatggttccatagcttcccaaagcagcaccgccagctgcagaacaagtattcaaatgggagcctgagaaggacaatcccaaccagcacagcccgccccagcctccagagcccacccccagcctctagagcccacccccagcctccagaggttttcgggcttctcacatgttttaacccaatttcaaaagcctttaaaaaatatataattatatattttatatataatcatattatatataataagtatatatttatgagtgtgtgtgtgtgtgtgtgtgtgtgtgtgtatggtttctctgtgtagccctgactatcctagtactcactctgtagaccaggctggcctggatctcagagatccacctgcctctgccacctgagtgctgaggtgtgtgccatcccctgctcaactcgaacttcaagagtcttaacaatcccaagacctttcagaagaccaaagttcaaagactctcctgggactcaagacaaccttctagccatgaggccctgtgagtgaaaaggatgctgcccggtttcagtctatagtccagggggaacatcctgttcctaaaagaggaatggggatgtaaggggagaactggaactaaggcaaaaccaactcccagcagggggaatgtcaactcctgtagctgcatgcccagcatttaggacagcatacatgatgtgatttccaatggactttagctgccctggccatagtccttataatgcttgcagtgcatacggtctctttatttgagtcatgctccttagaaagtctatgttcctggcatctgcagcatcacagggtctccattgcagctcagactttctctccattgcttcgtgcctagacatccagacctcttccacagcataactacatgtcgcctggccacacagacttttctctggaaccttgcaggaaacctccatcaccccaaaactcttgcattcttcatacctagaaaactagcatggtgtatacaatgccgagttctactgctggcctgagtggtagctgggcttccttggattatggctacagaggtctctgagtgcctaggcagctgaacccaggaaaagctgcccttaggcacacccttgtgagtagggcaccccattggcatgctctctttaaagaagtctttcaaatgagtttgcagttttacaccctgaatcctgtttgaagtctcactaattctgcagcgccctgaggaaccgtcctattgtcttagtacaaagtgcccagtttcctctactgttgttgttaacagttagtttctttatctataaccttaaacagccatggctaaactatgtgcttcttgcatccttctgctctgaaattatttttaatcctgattttcactgtaaaccgtccccaaagcagccagccatgccacagcccgtatgctatcttgatatttcctccaccgaattatctattacatttcaccttagcctcacttcaaatttcagaacatgggaaaaatatacataaaacctttgccatcctttaatgcaaatggcttctagtccaaattccttgagtccctgttcacattcaaaacctcaagagagctgagcatgatggcacacgccttcaatctcagcactcgagaggaagtgtcaggcacatcactgtgagttccagcccagccttgtctacacagtaagttccaggacagccagggctatagagactctgtttaaaaaacaaaaccagccaaccaaacctcatgaaccagacctgcactgtttgtctttgcattggcacggggtgggggtggaggtctactgacccccccaccagagtcacccaccaaggtatcactaggggttctttagtctgcatctccaaacccctgcaaacgctccctgcaatccagtctgaaagatctatgcaccacacggtcagacttaatcctaacagtgtccccttttccctgacactaatgtgcagggttaggtaccttcccttgttgcgttggcacctgaaagacttaagaaaagaacgatttgagccgggcgtggtggcgcacgcctttaatcccagcacttgggaggcagaggcaggcagatttctgagttcgaggccagcctggtctacaaagtgagttccaggacagccagagctacacagagaaaccctgtctcaaaaaaccaaaaaaaaaaaaaaaaaaaaaaaaaaaaaaaaaaaaagaacgatttggttcagggtttcagtccatccattcagggcagtagcagggtatggaaggagctgttcacagagcagcagaccaaggagcagagggcagggtaggaaccaggcgctgcgtataaccttcaaagctccaccctaaatgacctgcttctgccagctagatggtcccttctaaaggttccacaagcatcctagaatagtagtaccaggtgaggggcaagtatttatagaatgagtctgtggaggccattttagacttaaaatataatgccaactaagacaggtaaagagaacaaggaaagccacacttccctcagtttgacactcaatccatcctgcttgcggtttttcaactaaaattccctctttgctattaaacgtgtggtgggggctgcgcggggggggggggggctttcttaccgtgacattcattggataacaacagaaacaacagcccaaaggccagacgttacaaactgagaaagagctggcaagatgagcacaggtctggctgggatgctgagggctatgaagtgggacacagtagtctagaggggggcagtgatcgggccatggacaacacccaaatatggaaggaagcttcagatatgctaggcaacagaaaatggccggaccacagagagcatttgaagcaacgaggcaggatgccatgcaggaatcaaatcacctactgtctggagtgagagtttggtttcttaaaaatccacctctgcctggcctggtggaccacccctcccatacataccctccccccgacaatgatagccgcacgtctgaatcttgtgtacgctcttctctaccaaccgtcagaataggccaccacggcttatcctaccaatcgcatcctcccccatcagtttgacagacgaacaccgtatccctggctacgcggtcccgttttcctgcgtcgccgccggtcgcccgtgagtagtctcccatctgtctcttcgcaccttacccgcttgcaccccccgcccttctccctaccgccgccgggcgcacattccgtcccccacccaacgcgcgcccctcccgccccctaaggatcgacacctcccaacacgagtcgacattctaccacccgtctgccagtcctggcccaaacactcgagccaccaccatccgatagatccgcgtcgccccccccactgtcgccccccctcgacaaccccgtatccccgtccctcgcgatactcatgcgcctataccccggcgtcctcgcgtagtgagacttccgctattttgccaacaacaagagcctgacaacaggagacgcacaggtttagacacgtgggcccgtgtctggctcgnnnnnnnnnnnnnnnnnnnngccatggacaacacccaaatatggaaggaagcttcagatatgctaggcaacagaaaatggccggaccacggagagcatttgaagcaacgaggcaggatgccatgcaggaatcaaatcacctactgtctggagtgagagtttggtttcttaaaaatccagctatgccgggcgtggtggcgcacgcctttaatcccagcactcgggaggcagaggcaggcagatttctgaatttgaggccagcctggtctacaaagtgagttccaggatagccagggctatacagagaaaccctgtctcgaaaaaccaaaacaacaacaaaaaatcccagctatgttatgggaacatgtttctgttttaatcccaggtgtggggtaggaggctgcttcagattacccacagcagcagactatttgcctcgtgatccaggagcggtgtggggggggggggggtgattcctgctagctgcagatagtttcattctggggattctagaatgccagagccaccagaggggccaggagctaaaaaaatggggtgggggagggggaggaagctgttgctgctgctgctgctgctgatgatggtggtcatggtggtggtggtggtggtggtggtggtggtggtggtggtagtggtggtggtggtggttgatggtagttcctggttgctgtttttgcagtttaacaagaagtttgagatatcctgataagatgaagatttgacttgccccaaggaactatgctcctatccagcaggaactagcataaacaagctatgccccctttcttctctaacctacctggtgttgagatgttggaagggattggagtggagaagggtgatagatataaaaatccaataaaatagactaaaaacaaatatgcctacactgcctgaattttctctttcagactcaagtagccaaatactttaactaccaccatacgaagggcagctctctgtagccacgctgttttgcctttggccacaaggggcagtatcgcactttacatggttcgactccagaccctttcaaaggcttccatggctgccagctatctcccatgtgtgttctaattcagcggttctcagttaggtcccttaacagcagcaaaatgacagttgcaacttggtaatgaaatagcaacgaaataatgctagggctgggggtcaccacaacatgaggaactgcattaaagggtcacagctttagaaaggttgagaaacactgtcaacagaagacccagtgtccccagtagccttttgtgcaggcaaaagcaagtaaggtctgtgggcctcagctcagaatcttgttctgttttgagacagtctcgttatgttacccagaccagccttgaactcccggcttgaatgaccctcttacctcaccgtcctaagtaggtaggattacaggaaccactattcccagcttttcagagtacttgtttgattgtctggtttgaacagcatcttaaatgcagtccaggatagttccataattaaacaaattagtgtgatatcaaaatgtaagccataaaatttacatataatgcatatatttcttcattactacaatttacaaaactcacctagaggcctattgactaaagttaacttcaaatatttgctgagtgcaaaaggcatgttgaggtcttttcaataaatgcagtgtaatataaaaatatctgtgatctcaagccatgtgttacagcacacatccatagtccaagccctcgggagataatagcatgatggtcaggagagcaaggctagcctcggagttcaaggcaagcctgggctacatgagagccagtctcaaaagagcaaaactcaaatccaggattttcagttcaaggggaggacccttgagtgcttctgtgtttgttgcttgagttgttctgtgttgtttctgtgttgtagcacagaaatgaaggctgtgttaaagtctgattagctacgtgaagctctgtcttctgatgcaaatgcacagaccttatctggggggttcaggaaaagcagagactccgagcacaggagagatgctggaagaaagcaccaggcagggactgttcctctccgtgggcacagctcaatcccttgacaaactggcgatgcgatgcacacagcagcccctgagtaaggtaagaaccttgaagctgctgcgcttcaactgggaaagagccagagagctctcagggtctttgctatggagtcaggtagggactcagagtcatttttgtcttaacaatgtaaaagatagtgctcattctaaaactcacaaggcagtttgatagaagtaccaagtaaagtatatggataaaatcttattttttatttctcctgcttctcctcctcctcttcttcttcctcctcctgtatgatgaggaccagtgtgaccaaggaagcaataggagtggcctgagcgttctttatttcctgactaagccactcattctactatgcacccaggtgctgatgccacccacagctgaaatgtcatcaggaaactaatggtcccatgtggacctcaaactttcccagaaggttccacctcagtcatccagataggagctaataaatgtgacttcagccaccagttgagaccctaggtatctcaagcccccaaatcgtgttcacacggagccaatacattgctcaattatgcagccgcacaagctttctctcctgaaaactagttcatgccctggggacaaagcccacaagaggagcaagaaggactactctgcagacagagccaaggctttgctgtagcacggccctgggagcagaggaagggagactacaggcaaatggctcggaaggacaaagggcccagcaaccacacccagccaccctgggccccaacaggaattgcgaacgcggaagacaaacaagctgtttccacctaagtctgggctgctgggcacacggcatggacaaagggcacaattacactggaaaatgggtcggagtccctgactggagcaaggaggaaaactgaatggcaagtgttgaatctccgtaggtccacagaggatcaacaacagctttggacttgtagtctatctcaaccccgcctctccttcccagctgtcctgttgagccttgggtcttgatgagattagattctagagacaggctgagaaaacagaggagtgccatgggcttcaggcttggccagcagttttaggaggagatgggagccagataagagccataatagctgggtactcagaaggtggaactaaagatgttgcatatcaagaaccagaaagcccaagtccccaagcagaacggagcatatcagggctcagggcacacagctccctgcctaatgataaaagtaattcaggagcagaggacttctgacaacatggacgtggatcctgtgcaacccagccgcaaggtcaccgtgtccatgaagatcatggtcccgcccccaactgtctgggcccatgcattggtcagctgtgctgagaactgtgcccagcttctgtgtggagtctggctactgttgcctttaccttccaccttcaccaggacaggttccaggaagcctttgctttctcacgtcactaactctgaggtctagatcagtctggcaagacccagtcccataccggtgctccagcagcatcagggattgccaagggagcagctgctgccgatctcacatcaatgagtaggagctgtctctgtctctcatggtgggacatctccataataaagaaaaggctcagatgctgagcagccaaacacatggcagataattttttttccaggaaatctctggatgggggttgcgaggtgccacccaaagggctgagtaagagacaccaccaggatgtagagaatccatatgggtgtggggagctgtcacctacaaattcctgcctccttgaagtgcagagacgattgcctctggtgggaactgtgcactgctttgaggctgatttcaaacactcatcagtgttcatctcccacggctggcctgacaaagcctcaacaaataaggtggtctagcaatgtttagaatttatctactctgttgtttatcctggaggccagaagtacacaatgtgcttgcagagctgtgctttttctggaggtcttggaatccatctcctttgcctcttccggttcccagcaggtcctggcagtgcttggtttgcagctcttctcctgtctccatctccatctagaatcttctctttgtccctctggtaatctctgctaagacacggggcacagcttcaaggagctccctgattcaggatgctctcatccaaggctttcggtaattacatttgcaaagacagtgtctccgatgagctcatgctctaatggtctgggtgactgtgggcacggagtcaggtcttatgcagcccatgataccatcccacaagaactttcctaaggagggctgaaagatctttgtgggggattttatatgtatgttcctacagtttgagcaccacaaacccaggctaccttctgctagctgacaagaaaaaaaaaaacgataaagtgggcattctataaccgaatgccgcccccctttgggttggtgtgcacagagagtgatgtccctgaacctacatctttctcttcatcaattgtgaattaccccaaaacatacactgaagcctcaagatcaatgtaacaagccccgtgagcccaccgttcaggtgtagtacacacttaatataatttcaaatttgcttcctataaatggaacagtgcctgaaactcctgctatccgccttctcgggaggttaagttctctctagtccacctttgccttctagtttaactttacgatagtgagagagcgagcggtacatagtcagtagaaagtgcacttcggagctttttatcttctccaggctatggagtgcaggacactgtgaggccgagctagaaagcccaaggtctgataaatacactttcaacttctggttggtttattaggttgggttgtttcatcaaccaaggagtgcctgggcttttattacatatttatagataacagactggctagagttgtctgtgctgattagcaccagagtctaaacagccgatctaatcggctacccaggttgtgtctttaaaccgtacttcacacaatgtccataattgacttttccccacagaacattgtgtattcaaggtttatccacattgacgtttaaagttcccatttctccatcccaaccactgtgcatttatctctctgctgtcgttgttgaagggcagctgtttttagtccattcctgttaggtacagctggtgcagaatctctttgtccttgcatttgggtgtctccggggtatccccctcccaccccagcgaacaccatcaaagtatcttaagttgccaaatggtcct

SEQ ID NO: 109 - DNA, 2713 bp, Mus musculus
agacagaaggacgtggtcactctgaacagttcaacccaagagacaaaaatgcagtgggcctccgtcctgctgctggctgggctctgctcgctttcccagggccagtatgatgaagactctcactggtggatccaatacctccgaaaccagcagtccacctactacgacccctatgacccttacccctatgagccctctgagccttacccctatggagtggaagaaggcccagcctatgcctatggtgcaccacctccaccagagccccgtgattgtccccaagaatgcgactgtccccccaacttccccacagccatgtactgtgacaaccgcaacctcaagtacctgccttttgtgccctcccgcatgaagtacgtctacttccagaacaaccagatctctgccatccaggaaggtgtctttgacaatgccactgggctcctctgggtcgctctacatggcaaccagattaccagtgacaaggtaggcaggaaagtcttctccaagctgaggcacttggagaggctgtacttggaccacaacaacctgacccggatgcccggcccgctgccccgatccctgagagagctccacctggaccacaaccagatctcacgggtccccaacaatgctttggagggcctggagaacctcacggccttatatctccaccacaatgagatccaggaagtggggagttccatgagaggcctccggtccctgatcctactagacctgagttataaccaccttcggagggtacccgacggtctgccctcagccctggagcagctgtacctagaacacaacaatgtctacaccgtccctgacagctacttccgggggtcacccaagctgctgtacgtccggttgtctcacaacagtctcactaacaacggccttgctaccaacaccttcaactccagcagccttcttgagctagacttgtcttacaatcagctgcagaagatccctcctgtcaacaccaacctggagaatctttacctccagggcaacaggatcaatgagttctccatcagcagcttctgcacggtggtggacgtcatgaacttctccaagctgcaggtgctacgcctggatgggaacgagatcaagcgcagcgcaatgccggtggacgccccactctgcctgcgcctcgccaacctcatcgagatctgaggggcctcgccttgggctcctggctccgggctccgagtaccgtgcaccgtgcaccgggctcggggtacatgccctgccaccccgctgcatgtttggcttttgctggatggtctgggacacgcatgtgacagaagtccacaggatcttattcaatctccttccaacaggcagagttaggtgggatcaggggccaggccagtttctgcagggggatgaatttggtggtaaaagaaatatagctatagagtctagccccaaaatcttcttgcttggacagtagcatataaccagttccaatttgaccttttttgagctgtgctcaacagcatggccagctgcttctgcagttgctctgggctcctgctctttgctcctcaaaacatcacaacacacctcttgcccagtcacctcctcccagccccagctcaccctctctgccctctttcactggggcctcttctaatgtcttaggcagtcaggagacacccacaccctaagggcacactcttatctgaggctaaacggatggctaaaatcacacacttacccccacctcacctgtttaaagtcaccatattgaacaccataatgatgagctgttaacataggggataaccgactctataatggaggatctatcagaggagggaagtgtccagtggtcattatcagtatccatagtaagatggggaagagacacacctcaggatagcagaactgaaggggcagccccctttccagtttcatctgacacaacatgatctgcaccccttcttgggcttttagtatcgaaggggcaagcgtggttttcaaaacatgagaaagagcctctgctcatcctttggtctagtatgaagggttgttacgcaaatggcagaggcagactccacccgccgaggacctacccactaacccagactagggggtgatctcaatagctcgtttgtccataatgctagagcatcaggaaccagccctgtggagatgctcactggggtgcaagaagccctgccaggcccaagtcctgccgacactagacctggcttcctctgcattcacactatgcagtccgccttatgcccagtggtgcctgtgatttgtagtttgtctaagaacagccccatcttctcctttttaaaggtgatattgcctaggtacaaccaacagcttcttctagaccccactgggatagagccaccagggtagcgagtggcaagaagcagttgtaagatgctagcctgaggtgggtccctgccttagacccctgactctgtgtgcacttgggagcaagcttctctggaaaggacagggtggggcggggtgcttagactgtgctacgggttccagaactgcaatccacaaaagccaaaccagcttgtttcaaccggggagtgccacctgcggagcaaggctgccctggccagggttcttgggaagcacctgcatgtatcaccatcctgcctctgaagagccctcagcatgaagcaagcatgaatggcggccaacctaaccaataaagttattttataagtgc

SEQ ID NO: 110 - protein, 390 aa, Mus musculus
RQKDVVTLNSSTQETKMQWASVLLLAGLCSLSQGQYDEDSHWWIQYLRNQQSTYYDPYDPYPYEPSEPYPYGVEEGPAYAYGAPPPPEPRDCPQECDCPPNFPTAMYCDNRNLKYLPFVPSRMKYVYFQNNQISAIQEGVFDNATGLLWVHGNQITSDKVGRKVFSKLRHLERLYLDHNNLTRMPGPLPRSLRELHLDHNQISRVPNNALEGLENLTALYLHHNEIQEVGSSMRGLRSLILLDLSYNHLRRVPDGLPSALEQLYLEHNNVYTVPDSYFRGSPKLLYVRLSHNSLTNNGLATNTFNSSSLLELDLSYNQLQKIPPVNTNLENLYLQGNRINEFSISSFCTVVDVMNFSKLQVLRLDGNEIKRSAMPVDAPLCLRLANLIEI

SEQ ID NO: 111 - DNA, 27499 bp, Homo sapiens
  misc_feature (1)...(27499): n = A,T,C or G
aatccactccctttccaagacaacaatgatacattggctttcctaaatagatccctctttttaagaggttttctttattttaaaaaattgtctaactgttgctttaccataaggactatacacaggcaaacagacaatggaagaaactagagttaaagaaatctcacacattactaggggtcattattctgggttttcactgaactccaatggaactagaatccaagttcttagacctttggatgggcacatgggatatgtcacgcttctcaccttgaagaaatgtccccacccatcccaggtaggagctaccctgtctctttagctccagggaattcataatgatgctactgcttaagtggtattcttggtcaactcttcccccaactccaaacttgatttttaaactgctaagactcaggacatctcttctgggatgctttgtacttggctcttggatgctgaccttttccatgacccattgtgatatggtctggctctgtgtccccacccaaatcttattttgaattgtagttcccataatccccatgtgttgtgggaggtatttcatgggaggtgattaaatcataggggcagtccccccatgctgttcttgtgacagtgaggcagtgagtgagttctcacgagatctgatagttttataagggcttttccccttttactcgggacttctctctcctgctgccacatgaagaaggacatgtttgctccctcttttgccacgattataagtttcctgaggccttcccagccatgtagaactatgaggcaattaaactgtgagtcttttctttataaattacccagtctcaggtatttcttcatagcagcatgagaatggactaatataccctgtgtaagtaagatattttcctatatatcccctgaagatatttttccatagctgtagacagttctgtaccaaccctgccctgctctcttgctcttgttgggggtttgatgattccagtcatcaaaagtcctgctctacccttggctagcttctctctggtttaagttaccaaagtagatttacttgcctctagtgaaagctaacttcttcacctttcatttattcaagtaagggttagaatgggccttctacaggccagcacttggccaagcactgtgctaacttttgaaggcacaatgacattgcctctttcctcagggagcttccagtctattaaaataaccaagagtggttgctgctgaagggccatcacatggcagcccctctgctagaagcctttattctttatctcatttcatcctcccaatggctaacgaggttacggttattgtccccatttatgaatgaggacactgagtctcattgatacttaagcaattagcccaaagtcacagagctaatcagtggtagggctggaatttgagcatataactacgttccaaacccatgctttttcctctacactggagattctatatagcatagtggttagaaactcaaactctgggaacagccagacttaagtttagaatcccaacttggctatttaattactatccaatattgaacaaattaattagcttttctgaacttcaatttcctcatctgtaaaaataaggtatgataatacctatctcagggttgtggtgagaatctcagaaatgatagctggtatttcagctaacttagagctaaactattttagagctaatatctaggactggcattttagagctaatatctgggtctgttctcccctgcagtcatgtaatttccttaatagcatcctgggagctggtctgtcttatgttggtttctttcaacagccctcagcacagtctgagggacaccattagttcttggctcatttgcagaacaaaggtgaacatcatgtacagagtcactgaatggccaaatcctctagccttcaggttttaatttatcccctctgcctccttccttattcaggtatctctccctgaacggtccccctttcctgactcaaatacactcataccttctagaaagtggtcttctgggatccatcatgtcatcatcatgttaacaatatcaagcatgcagtaaacacacagtaaaaataagagatgctatccattaaaagagaaaggttgttctctaccttctttttaagcagcttattgctaaaaggaaattataagccctcaggcatcttctagaacttggaagttgaggtctttctcctattgcagttcaaagaaaacaagtctttctccagctccaacatcttcatggctctcatccttctggaaagaggacactctccatgatgaggacttctaatggccctttggtgccaagggaataggagaaaatatctctcttggaagctttgggacaccattgttgggtgccaatgtagccaagaatttccattgaaacatcagactaggaaaaactccctcgctggcgtcaagagttttcaggatgggccagcagcggggtctggattatataatatcgccatggtcatctttctgctgacctctgtatattcaattcaagaaatctggttgggtgggttttcagtcacaccctcttgccctccaccttccctgagttatctgggatcagaggctggatcataaaaacaagggttgttgagtcttgtgggggatgaagaggaagaaaagggttggtggccacaagaacgtcactgtgtctttgctggtgggaacttgagtcagaagggacttcatttctcccagacagggtgggtccagcatcagaggcaatgagctttgcctagtgattgtggcttaacctgtacttttctgggtagggaggaaatagcagtggcctgaacccctggaaagtctaaaggttttcctggcctggttggtggtggtttttccacccagcattgagtactgaagacagacatactctgtggggagccaaaaatacaattcctttcataaccctttactgattgcctactaagtgccaacgcattgtgtgcccagctgggacaggggctacagaaatgcatgacattgcctttctctttagtttattttcagtctagtgactgcatagtgctggctagacaccccctagaagatactggtgtcctccttcacatgtggactccctcagcaagcaatctggtggacatcaatatctcattcttggcttcccatgttgaaggcaagctctgagggcctagatccaggaaccaggcaaacaaagcagcagtggccaaaatggaggtagaaacctccactaaaggttagagaaaagaacttttgaacagtgggtggttccctgaaactctgccttctgacctggtcccaatcatcccttccatccttccttcatcccaggcctgccttggaacaggatggatagctaaagacctggtgcacatctcaccactttagaaatggccaaaaaaccccatggagatactgtctttttggtggtgcccggttgggaagaatccagtcattatttggttcccagactttagtaactttcattgttagtaaatgcagaattagtcagcatgctggaatttaaaaaaataaacatctgtacccaatggtgaatctgtccaggctatctaggctcatttaaaagtgtttcccaggctcggttgccaagatcagtgtcctccactgaaaggtgactgctttctggactcaaaaatgactagaaagttatctgtgcattattcataagcattttcacagtaaggccattctgcttcactcatgaggtcagagtttgctacattcagatctgctttattataatcaggcattataccgaagccttctttgtgtctccaacacttaggatcatgcccaacacatagtagatgctcaaatttattaaacggaaatgaaatatgggtgggatgaggaagagaacccctataccccagccccatctcactttaaaacccccctgcccccagattcaggcagattggtcaatcgtaattaattaagcttcatcttagtcgaggccagcctgacagcagggtagtcattgcccctccactttgccaatcctctgtgctagagttagagaaaagtgtgtgggctttcaagtcatgtagaccaaggttcagatccttgttttgccacttaccagctagtcactttatatcactaaaaccctaattccttggctgaaagcagggtcaaaaataaaaaaaaaaaaatcctgacagaatgaggtgacataacagaggcaggtcggagccactgctgtcaccatgacccgcagtaaccagcatgagcttactggctagaaaaataggaaaaagcagagtgactcagttaagggaaaacgtcgagatgacgggctttctgctgctgcggcaagcagaggagctcagagaccaagcagcaggagcagaagaaggcaaaagagaagaaggaggaacccgagtagctttgtggcttcatgtccaaccctcctgcccttcgcctatgtgactggagccagtcccaccaccctcacgtttcctcctgcagtgcccgcaggtccccgcacccatggcctccttttgccctgagtctgcagcgggtcccttttgtgcttccttcccctcaggtagcctctctccccctggcccctcctggaagtggcgggtggggggttaccccttcccagtgttttttttattcctgtgggtctcaccccaaagtattaaaagtagctttgaaaaaaaaacactaattccaatgcaaaatatctactgttatcattgataacataagtaaaccacctagtctatagtaggtggtcagaaaaggctcattcattaggtttcatctttttgaaatctcttcttaaattctgagaatgggtccctgacaaggccctttctgacagcccacacgctaagtcaaaagctcaaacctattggagaaaccaaaaggaccatctgcctcgacacttctaaattcttcaaattcaagtcatctcagggtttctcagttggtatttttttaagataaaggtgtttctttgatgttggcataagccagttaacatacttgaggagagaacatttaggacacatgagtttatctaagctattgagattctgtgtgacccacattataatggttctcaaatgttttcttccagcccctaaactccagattcagattcatatgtccaacggtctacgtgcatctccaggggaatgcctagcaggcatctctaacagcatatccaaaatgtaactttggttttctacccaactcagtcccacgtcacctttcccatgtcaagaaatgttaccaccacctacccagttgctcaaactaaaattctaggaatcatccttgacttttcctaactctgcaagacttgtcagttctctgtctaaaatataagatcttctcttccattgcaccagtccaatctgccattacctctccttgaggctgggttggagcctccctgcttccaccctggcctccccttctccatacagcagcccctcctacatgcttttaaaatgtaaattagatcccatgcaaatcagatcccatggcttctcctgcttgaaacatgtttttttttttaaacatttagaataggccggaccggatggacgcacgcctgtaatcccagcactttggggcactgaggtgggtggatcacctgtgtttaggagttcaagaccagcctgaccaatatgatgaaaccccgtctctactaaaaatacaaaaattagccgggcatggtggcacgcatctgtagtcccagctaatcgggaggctgaggcagaagaatcactggaacgcaggaagtggaggtggcagtgagccaagatcatgccactgcactccagcctacatgacagagtgagactccatctcaaaaaaaaggcatatatgtggcaataagcatatgaaaagatgctcaacaccatatatcattacaacaatgaggtaccactgcacacctattagactagcataaaccctaagtactggatatcaaatgatggtgagggatatggagaaacaggatctctcattcattgctggtgggaatacaaaatggtgtagccagtgtagcagacatctggcagttttataaaatacagtgctgcatcacccgttcatgcaatcacattattaccgtgttatgttgtcagtttaacaagtccatacagacaccggcgcaccactgtgacaagcgactcgattacgaacaaagtagacatannnnnnnnnnnnnnnnnnnntcaaacaaacaaacaacaacaacaacaacaaaaacatttagaataaaaaccaaatcatttccatcgcccaaaagtcctttcatggtacagctcctgcccagctttctgatcttgtctttccctggctgaggaattctatggctgtgaaatgggtaggacacagtgaacctcagctatgtgccaggtcaggagcctcccacacatcacctgatacagtccttgctacaacccagcaaggtaagtgttattaactctgaatttgttgtgagcattaagtggaagtggatgatgctagtgcataagcagtgatcagcaaatgctggagtccctgcctttccttttgttccagtggtggaggtgggcaggacctgtagcctagaaaagtctacactgcttagggatagaactggaaccagagccggctgtcccttgtcattcatgctcccttatccactagcctgatgacctgtctatagggggagctgagaagcgcgagttctcgctctctggagggacatgtgggttgctgaaggagttaagatgtctcttaccaaaccctggccctccccatccctgcatctgcctttgtggctttaatgagaaatccaggcgcttcataagagactgtacaaataacttctagggcgccactaactcattcagcagaaagggacccagggctgccaatgtttcagggaagataagtgagtggaaaaaaggtggtttttatagcgtcaggcggacggaaggatttgcgtggttgagcgtgaactccgcccctgcagcagagctgaaaaaaaccaggatccgggttcctcagccccttttcacaatatttgattaggaatttggggcgggaccctggtctggcacaggcacgcacactctcagtagactctttcactcctctctctcttcctctctcacacgttctccaacccaaggaggccagacagagggacgtggtcactctctgaaaagttcaacttgaggtaagtatagtcgttttacttcgggtttgtccctagcagttccttaaaagaaataaaggaaaagtggtaggggataggggagatggggaggcagggagggttcattcctccttctccacatctgggccatgaccccagggatgctggagagtggcagagagggtgtataagggaggggttccagccctgtacctttctcttacagttcctttatgggtgctgaggggacctccaattctcaggcatgaaaaagtgaaggaccctctgtctagggaagcttcttccctgctactcataaatcccatcatgctgggagtgtgggcattttgaagggtattccaagatctggatgtccctgcaatctctcttatagaggggtttggtacataaatgctattatgggagagggggaaacttttgtttagaatgtgtgtgtgtgcgtgtgtgtgtgtgtgtttggagtggaagggagagaataaaaagaagcattgagaactggccatgtccggggagctgtggattggggtggggatgcaatccaggtgaggggatggcctctggcttgaccttctccactgataggagggagagatctttctctagagtggagaaatgaaagaacagcagtagctcctgagtaaacatcccccaactgatagtgtggcagtcctggaaactttcgaccttacagaaactctgagcacaggagggcctctagcattatgggaaacagtgtaagactatgcaaccctgaagcaacattgctaagagatgggatggggtaaggagaggcataagctccccatcaaaccctttcagcacccatggctctaagaagaggctgaagtgggcagggtgcacagcccctagaaagctgagtctgaaggggaaggtggctcttgtctgccaaggtgcccagtctgaaagaaggagaaacggagacagaggctcactgtgccagccctccagacagccaccttggtcctgcaacagcccagggctgtgcatggaaaaatgctctgttggcagtgggccgctccattcgtcttctctcctggccagagccaggaaccagccagcttgcccaggcagtgggcagttgggtcagcttctccaaaacactgtggctctttgtctgaggcctgaggctgcctgtggatgagccagggtgcctgctcctctgcaacctaggaactgatgggatgaagtgggcccaaggaaactgttttgaggggacagagaggtctgggatggatggtggtcaggaggtaactctgttgagtgtcatagttggggtctttcccatcagttcactggatctgatgatgttggcttttatactcctttctttcttctgtttacagttgccaaccccagtaggcccaacagcaatgtgagggctgtatgtgactcttccaggccaagaaaggttctaaggtttctctgtccaagggtgacactcaggaagatgcccactgctcacaggagtatgtcatgcattggctataggtaaccagggtagggtacccaggccacccctagtctcttaccttccatacctttagtttccctctcagatgacatcagacccacatttcctcttcagtctgccctgttcctatctcattagcacaacaggttcaaaagcaacaggtttccagcaatgtggggacctagacacagagcctggtcatctaggtgtcatcgctgggagcaggtagcttgggaaaggagaggagaatgtcagggtcctacctcaagctgctttcccttgagcatacacaagagtttccaatctctagctattcttttggtgtccctcattcatttctcttggccccacatggctcttgcatgatgcccatggtggagcatgaggagtgctaacaccttactaggcaccatggaagagagaagcagattaactcagacttcacacactgagtacctgctttagaaggcaagtgccacacccagtgccagggtcctcagtctggaaaggatttgtaactgctgcatgaagaccctgtcccagccaagttgcatgtgtagccacaaactgctaaccagtgagtttcctcactcagcagactgttacagatgatggcactttggagggcaacctgagccttgtggtggctgcagagggaccacactcctccccaaacactcaagaccaaaaactcccagcctgcccaagagaccaaaagattttccagacgtagttcagctcttccccttcgatgcgtcaagcggcttctggaggtctcccatcctagggctttctccttggactcttagaaaaatactatttccccggaacatccaaactggatttgggttcagatctgaagagcatcccactaccatccttaccaccacaccacaaacacagggattgctgtgggcttttcagctttcccacaggactttcagagtgctagaggctcctaagaatctgcccctccaaaaaaaaaatgcagccgttcccattcaaagacattctgtctgtgactctatgaccaggggaaaatgcacttagctcaccccaaatagccatggtccggctggaccaagtgcagaaccagactgggaggaggcaccgaagaaatgagagcaaggctcctgctctcagatgtttgacatggaagtcagctctgcatagctcaaagcctaaggcttgcctactctgcctcactgcctctgtggagtctcactcatgctggcttgctctgttctctcccgcttcttgcagagacaaaatgcagtggacctccctcctgctgctggcagggctcttctccctctcccaggcccagtatgaagatgaccctcattggtggttccactacctccgcagccagcagtccacctactacgatccctatgacccttacccgtatgagacctacgagccttacccctatggggtggatgaagggccagcctacacctacggctctccatcccctccagatccccgcgactgcccccaggaatgcgactgcccacccaacttccccacggccatgtactgtgacaatcgcaacctcaagtacctgcccttcgttccctcccgcatgaagtatgtgtacttccagaacaaccagatcacctccatccaggaaggcgtctttgacaatgccacagggctgctctggattgctctccacggcaaccagatcaccagtgataaggtgggcaggaaggtcttctccaagctgaggcacctggagaggctgtacctggaccacaacaacctgacccggatgcccggtcccctgcctcgatccctgagagagctccatctcgaccacaaccagatctcacgggtccccaacaatgctctggaggggctggagaacctcacggccttgtacctccaacacaatgagatccaggaagtgggcagttccatgaggggcctccggtcactgatcttgctggacctgagttataaccaccttcggaaggtgcctgatgggctgccctcagctcttgagcagctgtacatggagcacaacaatgtctacaccgtccccgatagctacttccggggggcgcccaagctgctgtatgtgcggctgtcccacaacagtctaaccaacaatggcctggcctccaacaccttcaattccagcagcctccttgagctagacctctcctacaaccagctgcagaagatccccccagtcaacaccaacctggagaacctctacctccaaggcaataggatcaatggtgagaccttggcaaagggaggcggggactggctgtctatttcacttgaaagacactattctgagtgctagtggcaaaacaaaagaaatagaaataggggaaccagacagcacaaatgaagcaacctgacaaccaagccatacccctgtacaaaagagaatacacttatactaaatagcagtgctaagacaattcagtggggagtgggttggtacagaagaagactttccaggagaggtaagtttcattccaggtcttgagagataagtgggcatgggttgggggtatgcaggatggagacattctgggacagaggcttgccacaaaggagccagtcattttcacaggtcacctgtcgatgtaggggacagctgggaaatgtcacgtgtctgagatgaaggggtcatgtgtcagggagcagtaagagatgagttcggagaagtttaggagggaatacttcaaagggagggagatttaagtttagcttctaaagtctgtttcaggagaatggtgggttgaagccctgtacttactcactgtcccagaagaggatgagctctctttttccacttgaactactcttgcgtctacagcctggtcttgtgttttggtgtttattctcagagctgaatgcggcacttgttctggtcagttcttcctggagtacaaggaccccctggtggcagggcagatatccttcctagggtaacatgagcctgactaccaccaagcctaggacactgggcttcctgtttcataagcacttccttgcaatgcccaaaggaaaaaaaaaaaaggctgcctccctgactctaagaaatattcatttcagatggaattatctagctgattttcagctccctttagtcttaggatctagtattcagaacatgcttacattaccccagggcttctgatgtcttaatcccagctggaaggtactgagccagcacttgacctcccttcctgtcagcaaagtcctcttccatctggagaagggaggactcattaacgaccactggcaaagggctttgaagtggagcctgctgagatagaaccgcaccatcaaagcgctgagaagaacagagtcgtcaccctctccctctcattcctttctcccctgtgctcagggaacagatcagtcattgagcaagatgttaacaagctgggcagccctctgagtgagagaggcaccagccccagagggcaatttgggagttgacagtcgggtgggcaaggcaaagaggcatctgtctggcacctttagtttgaagtgcctgacaccatcatgtacggcctaaactcttttttattaaaatctctctttctttggggtctttttattcccaaggtggggattgaggggtcctctaagacgtctttttttttttttttttgagacagagtctcgctctgtcacccaggccggagtgcagtggcatgatctcagctcactgcaaactccgcctcctgggttcacgccattctcctgcctcagcctcttgagtagctgcgactacaggcgcctgccaccacgctcggccaactttttatatttttagtagagacggggtttcaccgtgttagccaggacggtcttgatctcctgacctcgtgatctgcctgcctcggcctcccaaagtgctgggattacaggcatgagccaccgcgcccagccaagacatcttgaagatgttgcaagctgcagacgtttgacatttccttgtggctgtctatcatcacaccagcagttaccactacttacctgccacacactctgaatccaggagcagtcacatcagaaatgtcacacgtatgctgtgcttcacccaagtttgaccctgaaactgtgacagcaaagaacagctgtcatgggaaagaatctattagcacctacccatacaatcagagaaagttgggatggaaaaggcttcatcacaaccttttatcatcgttctgccttcatgcagaaccacatctgccactcaaatgggaggtggaccacctcttccagacgcttgtcagaaaataaaattagtgcagtttcctaaggtcccgcaaacaaattctctgttcaaacaacccccaaattttcggtgtctactcccaaatcaattcttgtgcaatttaagtccaagccccgtgactaggtatcacttagtctctctcagccttctttttagacaaaataatgctttattttccttaaagtagtgaattaatatatgtaaagtgctttgtctagggcctggcatagaatttaaaaaccaatgatagctattattattagcctttcttctcattgccgctttaaagttgacaggcagtttttgttgttgttttggggaaaaagagacacagagaaggtaaagccatctctcaaagtcctccagatgatgtagattagaatcctgacctaaaggacctagagccaggcatctccgactgagaatggtgaggaatatctctctgatgcagaccactagcaggaaaacagctccccaagctcagccccctctcctacagcaaacgtgagggacatctccctgcaaaccagtcagggacttggggatggggggtgttggaggtgggattgaaacaagcttctgagagaggagcttaaagaagaacaggagctcaggggcgcacaggggaatcagatgtggtcctctcctcgccacttccctcttccatcagtatctccctcagtttttccagcctggcaagaacacagctcagaatgttattcagaagctttgggattcagtggagcagggcgggtacaccagtaggaatttggaaagacttatgtcagtatttaatttgggctagaaaaatgtcctccagtgcctccacgcagaagcctgtcctattcatgggcttggggaagacgggggggtgctcacagtacccagtatgtggctagagtccatatacactgtgtgtctagctccccacaggtatgtcccacatttacctatccacagctgggatctggaattttagcaggcagtctgagggctccaggctgggaaagaatctatcacggagcctgcagctccatcctaagtagggctggaaatgatacttaagctgagccactttgcttcttctcctcaccccactgctctgcttgtacacagataacatagacccagccccggtctaggctctgcccccaacctgctcactcagaggccacttaatctagtccttgggaccagaaaggaaacatccaaaagtattccagaaattctaccccaccaggagtgttttccaaagacgagtatttcccagtttccgctacttttctcagtgtctaattttctttaggcctagattttctgtgttatgcctgcaatacaagttaatttgctgcaacctcacctcatcttatcttggtcagtgcttaacagagactgaaaaccattgaaaatgctaatttaaaaacacttttttcattagcctctttaagctctccatgctgtctttcttggaactgtcttcttcatacctataacctctcccaaggggagccctcatggtcacacctaagaatagagttagaaaagcaccccctgcccccactcctcgtgcctggccccagactgacgcacctcctgaccactgctgcaagccgatggatgcctctggtacaacagcaagccccagctctgggtctacccaagtattacagctgctagggatgtgtccatggacaatcctaccctcaagacccaatgggtaacttcattcaaaccccctttgcagagaatgacaacaggagcaagtttcctgaaagcctcattcaccatggtaaagacagccctacgaggcttcctcagctttcaatggtgacttttgccgtctctcctgaagttttagctgagttcttggcttttcctttcaagttactgacccagtagactggagacagagtggttgatttgtcaaagaggacaaccagagggacaacagggttaatagcaacagaaagatttatgctaataccatccaagcagaactattgtctctactagaattctgcggtttaggggaaaatcttaggagacttcttttcaggtttaaaaaagggagtagattgtaatcatattaaatgcaggaggcagggaaattatttatttgacttttgaggtccctagcagccccagtgctctatgagtccccagcttcctttaaactcagagccttgctcactgctctggcagtatttagaatggagacgtgcaacccactcaaagccctggcacacaaagacacttgtctctcggcccaggctttctctctttaatttcctgccactttttctatctgtaaagtattaagtccctccatttccccagtcttctttctcacagcaattcagcaaagccctccctctccaaaaacaatcaagtatttcaaggtgtctacggttggtctttggctaccctctgcttcccactgctgcccacagctgcccacctgcccccctatcctgctaaaaaaaaaaaaatgtcccagagggaaggacgcttaagaacattcctgggcctgcagagtaaagttcaggttggtggttaggaggtgagctgcagacgcaggcacagtcctcactctgtccctagttctgcccctagtggcgccagtaagtatgactccaatcctggaaaacatctgccctccatccccaacttccacccctttatctaagctgcttcacaaaggctaatctcactgtggcttcaggttcgtaatctgggcttctctccctgacccgtgctcctcttgtccccacagagttctccatcagcagcttctgcaccgtggtggacgtcgtgaacttctccaagctgcaggtgctgcgcctggacgggaacgagatcaagcgcagcgccatgcctgccgacgcgcccctctgcctgcgccttgccagcctcatcgagatctgagcagccctggcaccgggtactgggcggagagcccccgtggcatttggcttgatggtttggtttggcttttgctggaaggtccaggatggaccatgtgacagaagtccacgggcaccctctgtagtcttctttcctgtaggtggggttagggggggcgatcagggacaggcagccttctgctgaggacataggcagaagctcactcttttccagggacagaagtggtggtagatggaaggatccctggatgttccgaccccataaatctcacggctcttaagttcttcccaatgatctgaggtcatggaacttcaaaagtggcatgggcaatagtatataaccatacttttctaacaatccctggctgtctgtgagcagcacttgacagctctccctctgtgctgggctggtcgtgcagttactctgggctcccatttgttgcttctcaaaatatacctcttgcccagctgcctcttctgaaatccacttcacccactccactttcctccacagatgcctcttctgtgccttaagcagagtcaggagaccccaaggcatgtgagcatctgcccagcaacctgtggagacaacccacactgtgtctgagggtgaaaggacaccaggagtcacttctatacctccctaacctcacccctggaaagccaccagattggaggtcaccagcatgatgataatattcatgacctgatgtgggaggagacagccaacctcaggcttagatcaatgtatagggctatattttggcagctgggtagctctttgaaggtggataagacttcagaagaggaaaggccagactttgcttaccatcagcatctgcaatgggccaaacacacctcaaattggctgagttgagaaagcagccccagtagttccattcttgcccagcactttctgcattccaaacagcatcctacctgggtttttatccacaaaggtagcggccacatggtttttaaagtatgagaaacacagtttgtcctctccttttatccaagcaggaagattctatatcctgatggtagagacagactccaggcagccctggacttgctagcccaaagaaggaggatgtggttaatctgtttcacctggtttgtcctaaggccatagttaaaaagtaccagctctggctggggtccgtgaagcccaggccaggcagccaaatcttgcctgtgctgggcatacaaccctctgctttcacatctctgagctatatcctcattagtgaaggtggcttttgctttatagtttggctggggagcacttaattcttcccatttcaaaaggtaatgttgcctggggcttaacccacctgccctttgggcaaggttgggacaaagccatctgggcagtcaggggcaaggactgttggaggagagttagcccaagtataggctctgcccagatgccatcacatccctgatactgtgtatgctttgaagcaccttccctgagaagggaagaggggatctttggactacgttcttggctccagacctggaatccacaaaagccaaaccagctcatttcaacaaaggagctccgatgtgaggggcaaggctgccccctgccccagggctcttcagaaagcatctgcatgtgaacaccatcatgcctttataaaggatccttattacaggaaaagcatgagtggtggctaacctgaccaataaagttattttatgattgcatctacaagagtggagtcatttaaagcagactgcaggagggttactttaggaggacctggtgaggtcgcaggtcacacaggccttggactgatgagccctctttctcatctattctgttcgggcagatgaagctaagaggaaaaaaaaatgaaaaaaaaaagtcacttgtataaaagctgtagttagcaaactgtgttctggaagttcttctttaagtctaacttcaatcctctctacacattcccttccatatggtccccaagagatatagaataactggggtttttttttcaaccctttccaccatcctctcttgcaaagccggtaattcgggatctggctagtcctgggtattgttgtcttaactgcttctgccctctagtggcaactgtgcagatctgagggcagccaagcctgccaaagcccgttggccctggaagaggaaaacaaacctttaccccccatttgttttctcattcatcctgtgttcatatcgtgaaagcctttgagtgccagatgttgtgataggtgcttagcaaatgtcgcataagttaggagggcagactaggcttgtgccttcagaacaatccactattttctgatagggaaataacaactgatagttattgggcactaaattctgtaccaagcatgttgcaaatgttacaactccatcttaagccaaagtaaactaatttgactatacttctctgacgtgagagttaggcaggaatgctagtgtgtgaaactaccagaaagaaatcatagctctaatcacagtcctctcttcaaggacagcagataaggcccctctgccttggatctccagtacaggaagatgccatgtggaggagacagagatgtggcacatagggcaggaattatctaactataaggaggaatcctctgcctctccgtttttgcttctttgcagctcccatgagcatcccaaccgagacagagcagggagaggaatgggagccagccctgctgcaaggcttcccttgtttctaaacccagtgctttgtaagaaacagagtagcaagaatagactgtccctcaggctcagttgactctttttctttcagctgccatttgatcagtcttattatgtgctaagggctttacttatttagtattcttcaccattctctaccatggagattattattttcactattttacagaggaggaaactggaaacaaagacacagaggtcacccaggaaggacgcatcaaggccaggatctgaccctggccgtctgtctccccagcctgtcagttttgcaatattatttacactgtgctgtcctaaggatccttgtattgttggattattaggtgtatgcgggaggcttgtgggtcactggctgtcataaatagagaaagatcatcttactttttttggagatggacccaaatccattctgctagcattcacagttcctttatgaatttccaattcaaaattcacttttcatcagtaaatgtttagtgagtgccactgagcaggaactggggatactgcagagaacaaaagcaaacagcccctgcccttgggggcttgtagtccagtgcagtgacagtccttgaacaacggcaaaaaaatcacactgaggatcatgtagttagactgagaaagagctgtgacgatgagcataggtctacaccaggattatcaaggagcctggcctagatactctgagatacagagtgagagcatagtaatccagacgaagagatggaagggcaggtccaggcaaagatagcagcatgcatacacaccctaatgcacaaggaagcttctgaggctctagacagcgaaaatggctgcagcacagagagaaagggagagagtttcagttgatcacgctgatgcagtaggcaggggtcaaaggcagtaggctttgttctcttatttcagacccaagtacaaagaaacttaattaccaccgtcccaaaccccatgtcccagggcctgccttacatgcaggctcacagttctgccttctagccactagtgggcagcatctcatctcgcaccaccagccttttctgaaacctttaaatcgcagcccacttagcccactttttcccaacttcctttttttttttttttttttttttgagaaggaatctcgctctgtcgcccaggctggagtgcagtgccacaatctcggctcactgcaacctccgcctcccgggttcaagcgattctcctgtctcagcctcctgagtagctgggattacaggtgtgcgccaccacgcccggctaatttttatatttttagtagagacagtgtttcactatgttggtcaggctggtctcgaactcctgacctcatgatccgcccacctcgacctcctaaagtgctggaattacaggcgtgatccaccactcccggccttttttttttttttttttttgaaacagggtctcactctcacccaggctggagtgcagtggcgcgatctcaggtcattgcaacctccacctcctgggttcaaacaaccctcctgcctgcctcagcctcccaagtagctgggactgcaggcatgtaccaccatacctaacttttggcttttttgtagagatggggtttcatcatgtcgcccaagctggtctccgactcctggacataagcgatctgcccgcctaggccacatgcctaggcttacaaagcctttgtaaaggattacaaaggaaactaattacattgaagtacagttaccaaaatataaaacatatacatttttgatataataatatatatgtttctttattaagtcgatgaataacaagatttagcaacaggtctagttaattatagtcatttcaaactattgatgcatgtaaatggcatatcaaactattttaacaactgtaatgtgatataaaaatatcttggccgggcgcggtggctggccgggcgcggtggctcatgcctgtaatcacagcactttgggaggccgaagcgggcggatcacgaggtcaggaaatagagaacatcctggctaacacggtgaaaccccgtctctactaaaaaatacaaaaaaaatagctgggcgtggtggtgggtgcctgtaggcccagctactcgggaggctgaggcaggagaatggcgtgaacccgggaggcggagcttgcagtgagcggtctgcactccagcctgggcaacacagcaagactccgtctcaaaaaaaaaaaaaaaatctgtgggccgggtgctctggctcacacctgtaattccaacactttgggaggctcaggcggatggatcacttgaggtcaagagttcaagaccagcctggccaacatgataaaaccctgtctccactaaaaatacaaagattagctggacatggtggcgcatgcctgtagtcccagctactcaggaggctgaggcaggagaattgcttgaacctgggaggcggaggctgcagtgagccaagatagagccactgtactccagcctgggcaacagcgagacttcatctcaaaaaataaaaaataaataaaaatatatgtgatttcagctggtgacaaagcctcaggtactgctaataaggctgtggtttgttaccttcataattgaaaggaatgctacatttctgttagatgtatgaaaaacaaagataggatttcccatttctctctaagtcaagccaaggaaagacaagcagaaacatggatcatagagggaaggcaagaaaaataggcaaatcatcgtcttttctctctatgaacatagcttaatcactcaacaaatttttactgaatgcaaaccttgagctagataatgtgtcagtagttgctgcatttagtatgtgaaagttgaatgtaaagttctcaaggttcttgccatggcatgtgatagaaataataataactaacatttgttttaccttaacaacttaaaagacacctagttcattcaagaacccatgaggtagtttgctataagtgccaattaaggcatagggacaaaatgttcattttttttttccaagggtggggaatgatgaggggcagggtagccaggaatgctgcagaacagccccaagctccctctcactgggggcttgcaatgcacttctttgttagctttgtttgctagctcagccatttattctactaagcactcagatgcagggtccacagttgatgtatatcatcaggagactcagtatcctgtgtagacctcaaactctcccagaaattcttctgcctcagacagatgggagctagtagacatgactcctgttgccagctgagcctctgggtacctaggctagaaagttgtgcccagatggagcaaacacattgctcaatcttgtagcagcccaggtttccagagtaggaaacttttctggaaactaggccatgctcatatgtgctgcatgaaatggcacaataaactggacctaatcctttcctggaccgtgtggtccagggagcagaagaagggggaaatgagtccagaaagactggaatggacaaaaggaccaagcagaccatgcccagccatgctgggctccaaaagaaactgcaaacactaaagataaatgagctgtttccatctatgtgtccagattgtgagctacacgtaggggagaaagaacagaagtacatttgacccagtttaagaaataaaaacaggaaatgggtcagagttccaagaggcaataagaagacctacctacataagcaagagtattggaaatcagaggggtcagtcttgaactttcttacaacccaccagaaatagagaatcggcagctttgtccttgtattctaccccaataatccccacattttctccacaagtgttcatcagagccatgagttttggcaaaataggactctggaggcaggcagggacaataacagaagcatgctatcagtgccaggcttagctggcagtcccagaggtagatctgagtcagataacaagaccaacaatggcagtttgcacaagaaggtgtgcggaaagctattccaaggaaggagccagaaaactcaagtcccaaagtagaaacagatatatacaatcaaggtatacacacggtcaaggcgtcaggggcataagcagttccaagccctgtagcaagggtaagccaggagcagaggggatgtccttatggcagcaggggagtggacccagaacagccctgagggctttggcccagagcaagtgtcaggtggtgtttcctggcccgtcctcccctaaggggactctcagcccataggcaccttaaaattatgaaaagcatctctcattggcctcacttattatgttttctgagccaaaaattatgacacattttaataaatacctatgttttcataggacaataaaacagactttttttttttttttgagacagagtctcgctctgcaacctccgcctcctggggtcacaccattctctttcctcagcctcctgagtagctggggctagaggcgcccgccactgcacccagctaatttttcgttttcgtatttttagtagggatggggtttcaccgtgttagccaggatggtctcgatctcctaacctcgtgatcctcctgcctcagcctcccaaagtgctgggattacaggcgtgagccactgggcccggccaaaacagaatatttttaaacattcatgtcctagaagtccaagaaataatcatcaaggaccatttggggccagaccaccagctagaggctgggttgtgtcagtcccagttcttagtttgcaaacaacagaaactgaagttagctgatttaaaccgaacgagaattcattcgtttgttcgtttaaagggggatggcatatcaggtagttctgggagggctccagaccaagcttgagggcatgcaatcagaaacaacacccaaggacccaagttcatgtccataaagaccccccaccccgccctggcacagactcgggagctccatttatgagaactgctgctgttcctgcctatggaatctggaggccactgccatcactgccctaccgtcatcagggtgggttccacagggcctttgctttatcatgtcattaactttcaattccaagtcaaactggcagaaccaagtcaggtgctagtgccctaccagcaagtgagactgggaggtgagtatctggcaatctcatatttaataataggagtcaggctctgtctcacatagtggggaatttcccaaaataaataaagggctcagatgccgaacagccaaaaaatagaagattttcctttcaagaaatctgtggaaggggtttgtgaggtgtattcatctttttttttcccccttgatacagggtcttgttctgttacccagtccggagtgcagtggttcaatcgtggttcactgcagctttgacttccagactcaagcaatccttccacctcagcctcccaagtagctaggaccacgagtgcccgccaccatgcccagctaatttggttttcaatttttgtagagacagggtcttgctatgttgcccaggctggtcttaagctcttgagctcaagccatcttcctgcctcagcccttcaaagtgctgggattacagacgtgaaccaccatgcctggccttgcattcatccatataccagccgccaagacagctctgtggaactgggtaagagagacaccaacaggggtatagaatgaccttatataaattaggactgccacatacaaacacctccttcttaatccagaaacattacatcctggtgaaagctaacactgctttgaatctggtttcagatccacagaacccatttccatttgttccctagggctgccgtaactaagtacccacaaactgagtagcttaaaacaatttttaagatgtatttattttctcatagttccagaggccagaagtcccaagtcaagggttggaagagtcatgcttcttccaaaggctctaggaatccttccttgcctcattcagcttccggtggctcctggtgtgccttggcttgtgctagtataactccagtcttcacctgcctgtgtcttcacatggccatcttctccctgtctctgtgtcttctgcttcttataaagacaccagtcatagccggaagcggtggctcacacctgtaatcccagcactttgggagacccagctgggtggatcacctgaggtcaggagttcgagaccagcctggccaacatagtgaaaccccatctctactaaaaatacaaaattagccagctgtcatggcaggtgcttgtaatcccagctactcgggaggctgaggcaggagaattgcttgaacccaggaggtggaggttgcagtgagctgagattgcgccattgtactccagcctgggcaataagagtgaaactctgtctcaaaaacaaaaaaaaaagacaccagtcatcagatttcaggcccgccctaattcattaggatctcatcttttaaattatttttatttttatttattacggacacgtaatatttgtacatatttatcttacgatctcatcttgacccctaattaattataactgcaaagaccttgtttccaaataagtcatattgtaaggttccgggtggacatggatcctggggggacactattcaatgcactgtgccatctaacagggacttccataaggcagacaaaagagcttcatctaggatgtcagacagatgtttccagggccttgggaatggaataccagccaagcactaagtcccaggcacctgaaacccaggccttggtgtatgataccctgacaacagcaaaaacagcccaaggaaggcatcgtctattcaccaaactaaacagcagagaaaaagaaaaggggacatcctgggttggtgtatacagatgacaactcacatttatccttttcttttcttttcttttcttttccttttctttcttttcttttctaatagagatggggtcttgccatgctgaccaggctggtctcaaactcctggcctcaagccttcctcccatcttgacctcccaaggtgctgggattacaggtgtgagccaccacgcccagctcacttttattcttgagtctgtatctttccttactttgttaattatgaaacttttaaaaacctacaatgggccgggtgcagtggctcatgctataatcccagcactgtgggaggccgaggcaggcggaccatgaggtcaggagttccagaccagcctgtccagtatgacgaaaccctgtctctgctaaaaaatacataaattagccaggtgtggtggagcctgcctgtagtcccagctactcaggaggctaaggcaggagaaccgcttgaaccccggaggcagaggttgcagtgagccaagaactcaccactgcactccagcctgggtgacagagtgagactgtctcaaaaaaaaaaaaaaattaattaattaaaaacctacagtgaagcacagaaagcaatataacaaagaccaatgtatttaccatctagttgtttaccagagttaacaaatgttaacattctgtcatatttgctttaggtaaatttttaagaaaaaaaaagaacattggaactatattttaagtctccttttacctcttcccattcatctcccttcccctgcagaggtaaatgctcttctgagattggtgtatttttatacttttattacatatttatgtagccatagagagttgtttgtttctttagattttacatgtggcatcatacattatgtatcactctggtttcttccccgaacattgggtgtctaagatctatccatattgattctcatagttccagttcattcattctagctcctgtaaatttacttctctcttctccttttgaaggacatttagatagttttccaatattttactgttaaaaacataatgcagtgaacatcctttcacttctcttttgggcttgcatttgagagcgtttctaggatatataccagggcttctcaacagtggtagtttttggcatgtggtgctgaataattctttgctggtggagtgggggctgcttgtgtattgtaggatgttcagcagcatccctggactctatccactggatgccagtagcacccaccctctaactacaccccagtgggaacaatcagaaatgtcttcagagttgccaaatgttctctggaaggcaaaatcaccaccagttaagaaccactggcatatatgccaagagggaactgctgagtcatgaagtatgaccaatttacctttactcgatactgtcaaactgctctccaaagtggttgtacaaatgttcactcacaccatcagtataccagggtccccatgtccctacatcctcccaatgccaaatattgcttcagacttcagaaattgtgtgacactgataagtgggacttggtattgcttttaattttaactggcatgttccatcttttgttttcaaagatggtagcaattacactgatctattccttcccagaagttatactgaaactttgttggcaatcctcgaaaaaaggaaaggagctggccgggcgcggtggctcacgcctgtaatcccagcactttgggaggccaaggcaggtggattacaaggtcaggagatcaagaccatcctggccaacatggtgaaaccctgtctccactaaaatacaaaaaattagcagggcatggtggcgagcgcctgtagtcccagttactcaagaggctgaggcaggggaatcacttgaacccgggaggcggaggttgcagtgagccaagatcacactactgcactccagcctggcgacagaacaagactccgtctcaaaaaaaaaaaaaaaaaaaaaggaaaggagcagagtctgctggcccagcactgggaaa

SEQ ID NO: 112 - DNA, 2699 bp, Homo sapiens
acaaaatgcagtggacctccctcctgctgctggcagggctcttctccctctcccaggcccagtatgaagatgaccctcattggtggttccactacctccgcagccagcagtccacctactacgatccctatgacccttacccgtatgagacctacgagccttacccctatggggtggatgaagggccagcctacacctacggctctccatcccctccagatccccgcgactgcccccaggaatgcgactgcccacccaacttccccacggccatgtactgtgacaatcgcaacctcaagtacctgcccttcgttccctcccgcatgaagtatgtgtacttccagaacaaccagatcacctccatccaggaaggcgtctttgacaatgccacagggctgctctggattgctctccacggcaaccagatcaccagtgataaggtgggcaggaaggtcttctccaagctgaggcacctggagaggctgtacctggaccacaacaacctgacccggatgcccggtcccctgcctcgatccctgagagagctccatctcgaccacaaccagatctcacgggtccccaacaatgctctggaggggctggagaacctcacggccttgtacctccaacacaatgagatccaggaagtgggcagttccatgaggggcctccggtcactgatcttgctggacctgagttataaccaccttcggaaggtgcctgatgggctgccctcagctcttgagcagctgtacatggagcacaacaatgtctacaccgtccccgatagctacttccggggggcgcccaagctgctgtatgtgcggctgtcccacaacagtctaaccaacaatggcctggcctccaacaccttcaattccagcagcctccttgagctagacctctcctacaaccagctgcagaagatccccccagtcaacaccaacctggagaacctctacctccaaggcaataggatcaatgagttctccatcagcagcttctgcaccgtggtggacgtcgtgaacttctccaagctgcaggtgctgcgcctggacgggaacgagatcaagcgcagcgccatgcctgccgacgcgcccctctgcctgcgccttgccagcctcatcgagatctgagcagccctggcaccgggtactgggcggagagcccccgtggcatttggcttgatggtttggtttggcttttgctggaaggtccaggatggaccatgtgacagaagtccacgggcaccctctgtagtcttctttcctgtaggtggggttagggggggcgatcagggacaggcagccttctgctgaggacataggcagaagctcactcttttccagggacagaagtggtggtagatggaaggatccctggatgttccgaccccataaatctcacggctcttaagttcttcccaatgatctgaggtcatggaacttcaaaagtggcatgggcaatagtatataaccatacttttctaacaatccctggctgtctgtgagcagcacttgacagctctccctctgtgctgggctggtcgtgcagttactctgggctcccatttgttgcttctcaaaatatacctcttgcccagctgcctcttctgaaatccacttcacccactccactttcctccacagatgcctcttctgtgccttaagcagagtcaggagaccccaaggcatgtgagcatctgcccagcaacctgtggagacaacccacactgtgtctgagggtgaaaggacaccaggagtcacttctatacctccctaacctcacccctggaaagccaccagattggaggtcaccagcatgatgataatattcatgacctgatgtgggaggagacagccaacctcaggcttagatcaatgtatagggctatattttggcagctgggtagctctttgaaggtggataagacttcagaagaggaaaggccagactttgcttaccatcagcatctgcaatgggccaaacacacctcaaattggctgagttgagaaagcagccccagtagttccattcttgcccagcactttctgcattccaaacagcatcctacctgggtttttatccacaaaggtagcggccacatggtttttaaagtatgagaaacacagtttgtcctctccttttatccaagcaggaagattctatatcctgatggtagagacagactccaggcagccctggacttgctagcccaaagaaggaggatgtggttaatctgtttcacctggtttgtcctaaggccatagttaaaaagtaccagctctggctggggtccgtgaagcccaggccaggcagccaaatcttgcctgtgctgggcatacaaccctctgctttcacatctctgagctatatcctcattagtgaaggtggcttttgctttatagtttggctggggagcacttaattcttcccatttcaaaaggtaatgttgcctggggcttaacccacctgccctttgggcaaggttgggacaaagccatctgggcagtcaggggcaaggactgttggaggagagttagcccaagtataggctctgcccagatgccatcacatccctgatactgtgtatgctttgaagcaccttccctgagaagggaagaggggatctttggactacgttcttggctccagacctggaatccacaaaagccaaaccagctcatttcaacaaagga

SEQ ID NO: 113 - protein, 374 aa, Homo sapiens
MQWTSLLLLAGLFSLSQAQYEDDPHWWFHYLRSQQSTYYDPYDPYPYETYEPYPYGVDEGPAYTYGSPSPPDPRDCPQECDCPPNFPTAMYCDNRNLKYLPFVPSRMKYVYFQNNQITSIQEGVFDNATGLLWIALHGNQITSDKVGRKVFSKLRHLERLYLDHNNLTRMPGPLPRSLRELHLDHNQISRVPNNALEGLENLTALYLQHNEIQEVGSSMRGLRSLILLDLSYNHLRKVPDGLPSALEQLYMEHNNVYTVPDSYFRGAPKLLYVRLSHNSLTNNGLNTFNSSSLLELDLSYNQLQKIPPVNTNLENLYLQGNRINEFSISSFCTVVDVVNFSKLQVLRLDGNEIKRSAMPADAPLCLRLASLIEI

SEQ ID NO: 114 - DNA, 133462 bp, Mus musculus
  misc_feature (1)...(133462): n = A,T,C or G
ccattacaacagggcaacatgtattgtttcaacacaaaatctagagcaacctccagaatctaccaaagctaggtgtgaagtgccaatcaacacactaatttagacacacttagacagtctgtcccagggaatgaattgaagactgaaggcaattgtccagcatttcaagacgccacagtgattcctctgaatcaaagatttcatttgcttcaagtaactgaataactagcttgaatctttacatgactagaactgagctagacgactgtctcctgtcacttacactaagtacgtgttacttatatgcttttcaaaattccacacactttttcagtataagcatgcggtacaagtacttgacattatatcaaaaccttatttgttcaggtaatttctcaaaatatattttatgctgaaaagccatgccatgataattctaatcatcaatgtaaacatttaaaaatacatttttaaaacagagtttattaaaatgtcataataaattatgcaaaattcatatgaatatgttttactgaaaagcctgaaaacaagaacattacaaatgaaccacggtggagataaacaaaatgaattatggtgtaacaattattttttattcctcagaagaatttaagaattagagatcagttatttttttcagggtagtaactctcaaaggtattgttcagatctctcttgttttttaatctatgccatgactttgaaaattgatctttgatcatatcaaacttatgcttttcatgcgcagctctgttggtattagttccatcaaaaggttcttcaacacagacatatttatttctccattccatagcatcaggccttggtatggctttggctttatgaactgatatcactgagtgttctagtcaagttctgtagcataatatttaagaaagcccggtaagaggtctgcaagacttgattcattctttgaaaggtaaggaggagcacacatggggcatgatgaacaaagggcagaattacagaagtactaaaagattctgggtaaatggttttggagggatagaaggatgtgtttaggtagggtttgcaaatactcccaaagcattaatatgagactatagctgcttaaagtgttgcaactggcataatttattccatgataacttgcctgcttcttttcttattgttaaattattttctttatttacattcaaaatgttgcccattcctcttccccctccctaagttcttctccccctcccctttgcttctgaagtggtgctcccacactcctccacccacccaacctcactcccaccaacatcccttttccctggggaatcaagtttctacagaattaaatgcattctctcccactgagtaaagacaaagtagtattctgctatataagtgcaggagggcacaaattagcccatgtatgctcttggttggtggctcagtctctgggagctctcaggggttcaggatagttgatgctgttggtcttcctatggggttgtaatgcacttaagcttctttagtcctttccctgactcttccgtaggggtcccagacctaggtcaagtggttggctgtaggtatctacatctgtctcagtcagctgctggtagaatctctcagaggacagccatgctaagctcctgtcatgcatgctcttttgggtctaggttacctcactcaggatgatgttctctagttccatccatttgccttgatccacttggacttgagctttctacaaatatggataaatttgtattcttatacatggagattgccagttaaaccagcaccgtctgttaaagatgcttttgtttttccactgtatggttttggcttctttgtcaaagttcaagtgtctataggcgtgtgggtttatttctgggtcttcaattctattccactgatcaacctgtctctctctttaccaataccttgcatttttgtcactattgctctgtaacacagcttgaagtcagggatggcgattccccccagagaattgttttcattatcttgtgttttttgttcttccatatgaagttgagaattgttctttccaagtctgtgaagatttgtgttagattgcattgaatctgtagatggcttttgggaagataactatttttacttaatacttatgttaatcctaccaacccatgagcatgggagatctttccaacttctaaggttttcttcaatttctttcttcagggacatggagttcctgtcatacagatctttcatgcgcttggttagagttacaccaaaatgttttatataatttgtgactattgtgaagtcataatttctttctaagcccatttgccatttgtataacagactgctactgatttgtttgagttaattgtatatccagatacttttctgaacttgtttatcagctatagaagttctctggtagaatttttggggttgcttatgtctagtatcacatcatctgcaaatagtgataccttgacttcttcctttccaatttgtatctgcttgatctccatttattgtctaattgctctagctagaacttcaagtactatattgaatatatagggaaagatttgtccatgtttttagggagaatgcattgttttctccatttattttgatgttggctattggcttgctgtatgttgctttaattgttcttaggtatatgccctgtttccatgatttctctaatacctttaatgtgagggggtgttggagtttgattattccctgccatctattcctcttttatgtgtttgcttctttttgttctaagagctttcaggtgtgttattaagtttctagtgtaggatctctccagtttctttgtgaaggtacttagtgctatgaattttccttttagcactgcttttattgtgtcctataaggttgagtatgttgtgctttcatttttattgaattctagaaagtctttaatttctttctttagttattccctgacgaacttatcattgagaattattcagtatccatgagtatgtgagttttctgttgtttttgtttttattgagatctagccttagtccttggtgatctggtatccatgagattattattgtatctatgtattgaggcttgttttgtatccacttatttggtcaattttggagaaggtaccatgaggtgatgagaagaacgtatatcctttgttttaggatgagatgttcactctatataactgttaattccatttagtccataacttccattagtttcactgtgtctctgtttagtttctgtttcattgacctgttcataggtaaaagtgggatgttgaagtctccctactgttattgtgtgagtctcaatgtatttttgaactttagtaaagttccttttatgaacatgagtgcccttgcatttaatgcatgaatgttcagaattgagacttcatcttcgtggaactttcccttgatgagtattaagtgtcttaataccttccgcatctattttgatactttctggttgaaagtctattttgttggatattagaatgactattccagcttgtctcttgggaccatttgctttgaaaacttttttccagccttttactctgaggtagtgtctgtctttgcactgaggtgtgtttcttgtacacagcaaaatgctgggtcctgtttacatctccactctttttctctatgttttttaattaggcaattgaatccattgttgttgagagatattaaacaccagtgttttgttagttcttgtgcttgttgttcaagatagtattatatgtgtatgtttctcttcttttgggtttgttgtgaaatgtttaattttttgtattttcttgggtgttgtttccatccttgtgttgaatattttgttctggaatcttctggagggctgaattagtggaaagatattgtttaaatttgtttttatcatggaataccttggtttctccatctatgttgattgaaaattttttctgggtatagtatctctgtctggcatttgttttctgtagcctttttatatgtttttggccatccctttctttaggtttgaaagttttcttctataattttgttgaagatgttttctggcctttgaactggtaatctctactttcttctattactattattcttaggtatgttcttttcattaagccctggatgtattagatgttttgggtgaggagatttttatattttgtattttctttgactgttttgttaatatcttctgtggtatcttctatgcctgagattttctcttttacctcttatattaagttggtgatctatagctcttgacttcttttgtaggttttccatctccagggttgccattatttatgatatttttattgtttctatttctattttcaggccttagacctaattttttaaattcattcacctgtttgattgtgttttcctgtatttctttaaggggaatcacttatattccccttaaaggcctctatcatcttcatgagattggataggttagaatcttccttttcaggtatgttagggtatccaggattctaatggtgccaaattacattggcttctgttgcttatcttcttgtgtttgcctcttaccatttgcttatctttgctgttaactagatatggtgaaggtcctcaacaggtaactgactgctctgaggcatggtgacttatttcttggccatgggtggtttcttagtcactgttctattgttgagaagagacagtatgactaaaacaactcttgtaaaacaaagtgttcaactggggccttgtttacagtttcagaaatttagtccattatcaccatcacagggaacatggaggcattcaagtgtggagaagcagttgagagctgtagcttgtaacttgatctgaagtgtcagagagagattctaggattagtatgatttttgaaacctcaaagcccactcccccagtgactcacttcctccaacaaagccactcctcttaattcttttcacacagtgccactccctgatgactaagcactcaaatacatgaaccaatgggaacccaactattcttattcaaacaaacacaggtagacatctgtagtcacccctccaagccccaggtgtcattgctgaagaggaaaaagggccaggaagaatgtaagagagagagacagaggaagtgctggagtgtattgtaactgtttgctctgaaattgacacatttcatgcaacagggatgcttcctaagcagtaaggtaaacaactcaaaatagtttcaagaggtctctgaaactaaccagattcactaagatttgttctccaagagtatacaagccaatcagcaaagaagactctgacacaggggtacttcctggaaaatgtttagatgggaatcatttagtaagagcactctctaacctcttgagctctctgctgggctgggcagtatattcctggttcccagcttttgtgagctgtcaccaatgctgatctgggctttggtgatatagttgccattgagtcatttctgcttctgtaagtaaccctttcaaatgcattggttcacaaagttggattttggtggtatccatactatgatctactgtgggatccatatatggtttgagtagatgtgtgtattttgtgtctccccaggatggaggaaatcatcattaagtcaatttcccatacatttatgacaaaacctccaaagtttcaaatggaataaatatgttacacaaatcagattcactaggccccttccctgccagagtaagctatcaaagctgaatccttctctgacacagctgagtcaagctgcaaaagagattctcagaaagctttctctgattgatgatgggagcatatacaaagactcacagccaaacattaggtgtagctaggggaaacccaaggaatggggtcaaggtagggttgtaggagccagagaagctaaggacatcaggagaatgttgcccacagaatcaactaaacttgaagggctcatagagctcacagagactgtagcggcaatcactgagcctgcatgggtctacggtaggtcctctgcatacatgttgtggttgtttagcttgaggtttttgtggggttcctaacagagggagtaggagatgtatttgattttttttttttttttttttttttttgcctgctcttgggaccattttcctcctacctcattgtctctttcaaccctttatctgagagtttgtgcctagtcttgctgcatcttattatgctgagtttggtcaatattcttgagaagcctgctcttttctggagggatatgaagaagcagtagatcagatgggaaatgaggggtgagggaggctgggagaccttgacggtcagagagaagactgcagtcaggatgtttgtatgagagaagaatacattaaaaatgaataaataaaaaacaagactctcagactagaccagctgcctggaaaaagcaggaagcagaagagaaagtttagatcaacaaaggcacctggaagagggcactgtagatcttacttgaaggctgtgtagtgtgctccaggttctaagatttgtgagctgtcacccatactgaggtgggctttggtgatgaaactctctttgagtcatttctcttcctgtaagtaatcccaataaaactcacaaatttggactttggtggtatctgtgctttaatctgttgtgggatctatacctggattaattaggtatatgtgtgggatctcctcaggataaaaaggtcatgtgacacttgagaatagcctccctgtcctttttagtagacagtatcacagtagatgttttggtcctctggctcttaaaatctctctgttcctctcttttgagatattgcatctactgggtctgggctccccaaaatcagttgatctttgaactatgaccagttgatactatataatggcttcaatttcttacaaaaaagcttttctgatggggtggggtaagagttacatttaactataggcataaggatttgtttttagaattcaggagctaggacttatgttgctctagaaaagtggtagtaatagcttctcctctgagagctatgaccttccttgctccaggtggttggcaaggttcttaatatgatgcataatttccctcctgttgaatgggctttgaattcagttagactgttgctgatactatcagataagagtgccactattgcacctttagggatatcttgtcatgttgctcattattgtggttcataggttccacagctggcttgtcaggtctatttattgcttccctcccaaggcagatggtacaatgaaagctagcccacaggaagaaagctttcagattggatctagcttttcagattagatctgagccctatgtccaaagtgtgtggtaccttcagcaatctgggtttactttcagcctctggaaggcaaccaaggttcccagcaataaacagcttgtattattttgagagttacatggactaccctgaccagttcaaatggagggctctcctgtcttggaagatttatcagataatctacggatcttgtggagagactgtcagcccacgtgacatagtttatatatactatttgtaagtttgggcaaatatgaaataatatgattccttgaggctttagaattttattacctggaatttaagttgtaaggttatttccatgtacagaaagggggatgtgcaagtttgaccctgcagctccttgaaatcaaagtaagaggaaaacaaagttttaagcatcaaaaatgtatctgcagggtgctgcagagatggctgaatgggaaaagtgcttgcctgtacaggcatgagaacctgagtttggaactccagaacccattgtaaaagtgactatgcatgtgtgtaaccccaatcctggggactcagagacagggcttcattgatcacacagtctaccctaaatgctgagcacagcttcagtgagataccctaactcaaaaacatgtatagagtgatagaagaagacacctaacattacctttttgccttcaaatgtacacaggtggatgaacacatgtacaccacacaaacccacagagagacacagagatacacagacacacagacacacagacacacacacacacacacacacacacacacacacacacgaaaacacaagaccctatggtatttcataattagggattataatcactgtgtctacttgtctcccattatctacatatttcaaacactaagttatgtgtatattcttttgtttttaaatgaaagtagatagcaaaatattactagatccatttaattgtactgttgaattcacaggaacctttaaaatactgtaggcatgttcttattggcaaactccctgagaataccatcattcattcagtcttcttttggtagtagagggagaacattatagaaagccacaaccagtcaaactcagagaatgactgaccttgaggtttccaacccaatttgatgcatctgtaacacaaggcttgggaaacttactcaagctcagaaaacttcacagaagagggagtggaaagagtgtaaaagccagaggaccaggacgtctgctacaagatagtgtcttttaggtatacgggaagggtatcatcatgaaacctcaataaatggcttactaccttagcaagaccttaatggtgacaagatcagttgatatgctaaagttcatgagggaaatctcagaggcccccactcaagatgaagcatgaaaggtagttaaggactgctgaatataagaattagactttcgcatggtgagctccctaactagttatgtgataccaggtagtcaaccctatgtacacacagacaaacacagacacatacacacacacctacacatctacacatctacacacacacacacacacacacatacaccactaaacaaactcagtaggttataccttcaggtgtgtgtgtgtgtgtgtgtgtgtgtgtgagtgtgtgtatacatgtgtaggggtgtgtgtgtatgagtgtatgtgtgtgtagggatgcgtttatttgtaggtgtgtgtgtagcaataaaagttaaagaataaatggtatgaattagggatgaatctgtgtatttggacataggagggttctggggaaaagagagagtggggggaaataatgcaaattcaatatacatgtgaaattgatcagggatgtgtgtggtggggtggggaaatactatgatcaaaagaaacaagttaactttgtaaaagacaaggcttggttttcattgctcttctttcattggtaaatagcacagagcaaccccaaatgtaggggcactcctgtcttgaagcagaattcactgatgcacagaggagagtctcactccaccactcaaggagatacctgcataaaactcaatgaaaccaccaccagcagccctgaaaaacaaattgggaggctctttaaagccagtgaaggtagttttgcataggaaagccacatcaccgaggaaataggcataccatttgagtctgagctccttatggtaaataacaggagttggcagacataagcagaaagacagttggtttgggtcacttggtcgtcttcaacgaacttcagagcctcgtaccagcttagtcactgtgttatcttgccaacccctatgttgttatactcatgtggaagcttgtcatatcttgggtaagaaaattattgatgacttgggagggatgtattgtttttgaataaagcttccttaaaaagatattaaaaaggagcaatatttatatagtttaaaactgttttcctttagaggaaaattgagacgaaccgctaacagcataattacttgaattaaggaagtaagaagccattgcactgactttgaacgacctttttttttttttttttaacttcctgcaaagaggaccctttacagtatttttggagaagttagtaaaaccgaatctgacatcaccatttagcagtgcatgtagctagcaagtggtttgttcttagggtaagagagtaggaaacttgctccccatctgataagacagagtgcaaagtatgcgttcttttcttttagttttgacttagctttacagagacaaacttcaagagagataaccattattttgcctttcagggagaccctatttcttaggggcacagctgatctccagatatgaccatgggtttgtggctcaaacttctggcctttggatttgcccttctggacacagaagtctttgtcacaggtaagcacacccatattcatttttacttccttgtattttgttgattttgtggcaaaggctaggttgaaatggctatttttaaaagttgcgtgtgatggatattgaaagtaagaagattcgttactccatgttcaagtttgccgttgttcagagaaacaaggcctagtggagggcagcatacactgcttctgttcaaaatacataaatgtttcggggaaagatcacactttaataggaaagttgactctctttgtctctctttatttggaaactgttcaggaatgtagctaaagcaattgatccaacctgcatctgctatggttagaggaattgttaattaagtcagcttttaatgcttttgatcaaaatatgaaaggtttaaaatcacgagacagctttgcttgtgtgtaagccagtctcttcagacaaagggttgtttcctcaaatgttaatgattattaaaatagggttttgaatgctcagctacagaaaggctgaagagcacattaggtgctttaaaaactctccgtgttgtcttaccatcgaatgtgttttgaattaatcattttagttctgagataatgcttcctatgaattctgctgtggaaattctggtagagccaccgcccttcctgggtgatgggtacagagtacagccttgaaaaggtagacgtgtgttacagttcataaaattcctacaaatgctgtgtccttcaggacagggtgaccaggcaggcactgcttactgaaggttcagtccttcttacatatctggtctggtcaataattatttctggagtagtttctctttgagacatgagttgattatcaagttacagctagatggcatttctccttgtagtgtttaatctaagatacttttaaatggggaaaatagttaattgtatcagaattcaattttatttttttcctgatgttcactcctctcgtttccaaagaaatccctggtactaagccggctaacgtctgctctgtgttgtctgagggcctggaaaagaaatgcagcctcagatacttgtttgttgatgttatcacaataagtttgttttgctttttaattggaaagatggatttttttttcaaaagaaaatccagttaggtaagttgcgaatttgcttggatgaggtttatctggcataagatgattttaaacaatgcagggcaccacagaatcttgtcacaatgcaccaactacttcccaggtcgtgagctctctatgatttttgttataatgtaaagagaattatagagaagaattgaagattgtacattttatcatatattggcatatttccactgtaagtccccactcggggcaattttccgattttctttaaatgggtgagaaagaacattaaggtaccttcagattgtagagcaagtcacccccaaattataaattaggatattgatattttttgcacaagaaacatctttgaattcaccataaaaatgtacataaagggtcctagaaacctttaaatcaactttcctaaatactttattctaaaatatagattattaaccaatatatagataaaggatagttgataaattgctaacagatagaacggtttttataaagaccaagcttaatataatactgaggataaatatttttctataggactctgacagttttccttagagtgtgttagaaacttactgttagaaacacacacacacacacacatgatcatttgtatttgaaaatggtgtttagcatttcaagacacatttttatttagtgttgagaacatattaaggctttaaattatgtactttattaagcaaaaaatgactcagatcctacattttcttttcatgtgataaattaatgtggtatctacaggaaatgcactttcagggagcaacattttattatatgctttagaaaaataaattagtacagtaaaacactaatgaagcatccatggagagtacacagcactccagcattttatttagcttatgaaatccaaatgagaccaacgtcaaatttaaggtcttccagggcaactgtgatgctgtgttcccaaattataaaatgtccacgatcttactgctttgtgcctctttgccaggtcagttggactctgaaggcttgtttaaaagttgtaagtaattctatggcagcattataggtcagaaagtgcagatagagctcaggttttctacctctagtaaagtttaacactaggcctgtctaccaaacccatcacctaatggctggaaacgtctttagttgggccctgagcagcgtgcagtgagctaggttctgagtcaaaacagtgagaactcatttcctgggcacaattcttcatttttccatcaccattaaaaccatctcaagtaataaatatgcacttggccttgcacatcataaacttttggcacaaattatttgtcaaatttgataagcactcctattatactttaaaaataactggggagcctatgctgtggggatggggacttactactttaacttttattttcttaaaacagttttctgtgacccttgtcattgctagaatttgaaaagtactttgtgagtggaaagcaaaggcgggttagaaatcaggagtccttctgtcttgctcggcactctgaacacaggatcagagtagggacatgcaggcagctgcctactccattcaatttggtgtctttccaaaagtgacaagcagagagtgcaggacaggcccgtttctgcattgttcatgcacacatgcatacctatatgcaaatttgcagacatgacacatgtatgtagtgccttgtttccacactgtggttatctatcatgtctgtgtctactggatctctatacacacactcacctgttcaccactgagggtctaggaacacatgctcgatggcaggttcattttcctttggtctagattgattaccctctctgtgtccttgagcttatttcacccctccacactaatccttctaaatgggaaagccctcttcctatgtgcagtcatccacatgctccacagatagttaaacaaacaaaaccaaaccaaaaaaaataaataaatactgttcccatatctctgttgagatcatctcaattctcggccttcttctgtctgcagcaatatgacagtttgaatatcattctttctttatataactgaatggattaaaatggtgggggtgggcactcctgagatttcctcatcagctagaatctttattttaaaaggccggcatgcattcactgtaggcaatggaattcattgccttgtgcgcaaacagcagggctggtcttacttccctctcctcgtctcttcccacactcccctttcatgaacagccttcctttcccttcagctcccatccctcccccactcccttcccctccctttttcttttcttctttcttccttttctccatgacggattcaaagaggacaagtgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcctatgttcccgaggcctctaaggttttccataaaaaccctgtctccatttctggcattttctacctttccttggaatctgtcaaggattatttcaattattgtgatgaagatgaagatgaagatgaagataagaataaatggacaagtgtttttactgcccgtactccacatggaagcagaaaattaattgtgtctttctgaaattcagtatctgagtttagatctgagttctggtatttttattggtatctactggaacatcttcataaagctatagataataataataataatgactaaagaggaggaacatggggaggggtgagagaaaggagagaaagaggaggaggaggatgggaaggggggaaacttcgaggccagaaagagaaagcgagcaaacaaaatctattaaaaggcagattgggagagtggagacagaaatctggtcatgatttacataaatttatttttaattaatatatttacagtttgatccttttttgttatttacctctttcatacatatcatttggggagggcggggttgttattcctaacttcttaaaaactctcggcttgaaaatgtgttccttaattcttccttgaagggctcttgctaatgtcttggtggaagcagtcaggcaaagatgatgagaagggcagtcaggaagaaagggggaagagcatgcagcagctttcataggtggatcagggcagatttttcaagcactggtttagatgctcagttgctggtcctaagctcccttcaaagatgggtggaagattttccatcacccaacacagtattctttctagtcatcatactattaaattatttatatggaaagaaactgtgatggactccatttatgtccaagcttcagttatatatctttttctgtactaggttcccaaccccagagaggtcgcctgtcagtgaaagatcaggcatggcttctgctcacacatagatagaagatttaaagatgagatgaaataaaatattaaacattttggattattcacttaggaacatcatgggatatctattaatgtataatatccaaatatgcaaaaataaaaattaaactggttactgagttttgtatacatagccttagccaataattagattcttagaatatctaattactattgaaagacttaaatccatttctacttatatgttgatgagttacttcaattactatctgtcaaaaatactttagagatgacaattagaggaggaaaattacatgtttgggcaccacacaaaagagacaaagtaaatcaagataatatgtctcctcccctcttatcaagggctacaacaaatgtatataaaactgatgcgtagtttaaaaaaataagaatctttagtgtctaatcagagttccattaactgattgctttgtgaaagataataaataacattttcaatgttttttatttaatttttttattacagacccaagctcaaacagatggcattgtgctttctggcacttggctgtataatatgtgtaaaacatttctttcctgttcttcctaaaaagaaaggcaaaaacctaaagtgaaaatataactcactaactaaactgatcttatgtgtatcatagtcatgattaaaaattataattaagaggcaataatattcaagttaaatgactaacattcatataggaaaaataactatttcccataaaaaattgtagcaactgaaaaaaaaatcccctcacacagtccttaaaacagtgttcttttccccactggatgaaaggcaagagctgagagtaacacattcctcacctcacatgtattagttcgtcaggggaatgtatgggaggtcattgatgaagacagttctctacaattaactaacacactttttttcttcctattcaagcagtttagtgaatcttatttaaataacaattgtgccaagaaatgccatcagagttatggaataaattcattgtctcttaggtgtctgcacatagagaagaatccacgataatttaccttctgatgagaaggtatgaaacggaagccatcccgttttgggaaatgccgttatacttggagaagcaaatattttgaaaatctaactatatagattttgtaacactgatgtgtgaaaatttcaatttttggacaccttccttatctgtaaagtgtcatataagcactgaaaatatagcattcgctaaaataacttgaaaactatgcactgagcttgtcagttatatccatgtggtccagtgaaaacacagtgcatatctctttgacccacttctcattcagttgctttcaaagtagaaaagaatatcctgaccatataatcaaggtagtaagaatgttttaacttgatttttttaaaaatataaaataaatatttctttagataataccaacacaatagaattttctttaaactgtagaagaaattctcattagctcaacttaattcccagggcatttttttttatagcctatttatctctacaataataaatttttccatttgtattttcctgaatcagtattcaacagcataactttcacgtaaactctacattgtaccattacatccctggatcaactttactccattcaaattgtgatagctgtagcttgtacctctggggatattgcttagtggtctttatttttctaagtataattttgctaagcaagcaatacacatagtttaaaaacattttagttgttttttaaagccagaaacactatctacaggttgattcaaccactattagttttaaaattttcttgttgagtttcagtacacacgcaatacaacacaatctaagttttcatgttttctcgagcttgtctggggacaatcagaatactctgaagcatctgtttttagttcttggccatactatgaggtgagagctcctccagattcatcttgagattttattttaagaatgaattttaatgatatcttaggtagccaatgggaaagtcattttaaaaataggagtcagctaaacttagtttgatcaatgaccatgcatttgcacagtattctgattagcgtatgcaccttagtctagcttcttaattatcagtggaacaatgactaaagaacagggtccttgtacaatgatgggtgggaagtatcaaagcttcccactgtggctccttgtgtttagtaaaaatgaaagcaattaggattgcctgcacaactagacttgaatccctctacacatctgtagctttatctatagccatgctattgttgtaagtcggagttttctaagaacattttcctgcctctcagcagttggccatgttcccttttcatctgtgtgtattaattttccccaagtgggcaaattataattgcttatcaaaatttacctcaacactcaaatccctggagctgcttcacctctcactacattctttgccgtgagcatcctgtcttggggagaggtctctcagagtgctcctcctttctggctttccttcttccctagccctctgtctcagtttctaccatttttctctctgtactcacagagccctgtatctatcactggatgcattcttatttaccagtatcaactgttccccaatgcttgccttgtgaaggggtgggtggactgtgaatgtgaccctgccctgggtgtataaagcactcgccaattcatatgaataatttgaatcctatctttttattattgttgcttatgcaaagtactcaaagtgaaatattctacattgtaggaatacaaggaaataaaagaaaatgcagactctgaaattataatgttccttctcttgattacagactatggataaaatcttctaaatttttcctaagtaaaccattattgttttagacaaattgagaaatgcaaaaataaataaagagatgaagagtagaatcaaggtgagatttcccaaacaaagagaagatgcaggttattaggactcaagacctaaaatatctctcagtatctcacttaactatgtcaactgaatccacccactcatttattttgtgaaactgatgaacaagtatttgatgagtgatttcctcacatagcatccaggaactccatgccttcccctgatccacataaagtcagtgatctgcaatatgttggccaaaaggagatttaagtctttccagtttcccaacctggactcaaaagttcttcctcaatatagtaatacattttactgcaaataattattggtggtgattatatgtacatgtaatataaaatatatatttttaaaaatcactgttttaaaacataatactcaaaaaccaaataaactatctttttttatatttttataaactatcttcaggacaccagtactaatattttttttttctgaagacatttctgtggaagatgtttaggacttccaatgagctgtgcaggtgattatatatttaatagaaaatagttgtagatactacaaggatctgggcaatcactgtaatttgctttacttgtttttgatttcttttgaaaagaaaatatagggagaaaagtcttaaaatagacatttgtctatattaccatacaaacagctccttccttaatttgaatttcagggtaatgttccaaagtcatcaactagtcacaaattaaggctgggtcagggaaaggctcccagtttaacctttgtttatctttatctgttttttttttttgtatatttattatgtgttaactcagtcttcttagtattccacctagataaccagttacttagaggcgtgacaatgtttatatgtaaaacacagcaggaagaaagggcagatggccatctcagcggtgccctgtatgcaacatttactacaacccactcacttggtttatctccttttatgcaccattgttcactgagttttgcacatctttggcaaaatctaactcactagatattgtgtttccatgatgaaaagcaaacacacacaatctttgattaatatctgtgtgcctcaaatgccaatgtcaaccaagtgatacaaaagttgtatgtcaagaatttcagattctaaggaagcacagggtggcgtctgtcttaaggtgggtgatgtgaggaaaatggattttcccttaatttatcttgcttttgatattacacaaagcgaaaggtattgaatcattcactcaagtgtctaattctttttttttttttttgaagtgcaagggaagtaatttgacctttgctaagtactttgaacatagagaacacacggtgctccaggaagtacaggcatcagcacctctttccacagtcagcccagagcatagcagatgaatcccaaagtaacactgcccacatttccactcaagcaatgtacttactgatggcttaatacaataaatatggatggctaatgagaaagttcaaatcataagtgttgacccttctaacctctaagatgggtgttaacatatgcttatgaatcttgaataggtctagtttccaatgacctgggtatctatgctttgaattttttatgggtcctttagatatcaaaatatataatggctgaaagaacatttagtgatgcccaggctaataagttcagagtcttgattgtgcattggggtgacacacacatgaatagtagataaacaagggagacagagagtctgggacctgagcttgttaactcagagtagatgttagaaatgtcagattcagtcatgtcatgatgaaccagtcttaaaatttgactgagattcttttaggtctcctgccctgaaatactgtggaaattacacattagaatctcagtttcttcagatgtgaaatggagataataacaggaagtttaatcttgtcaccgaatcagtttctttcagagttatccctctgggttgggaattgttctataggctctgctttcatgaaaaaggttgctcatgtgagcaagaagtgattgggaaatagtcacatattactaagtgctatggagaaaattaaacagttactatgggaaaaggccagatccatgagtgtatattcctttaaatagaggaatcaagaggacaagtaattgagctatttgttgatggccatgaagaagtatatgatatgttgagagttaggcaaaggcaaaggacctatggttaaagcaaacaaagtaatgtgcataaggcatagaaaggtcaagtgtggtgtcatggtgaacaggaagatgagcaggagacaggctagagttcactgtaagactccatggtggtgcaggcctttaataccagcacttagtggcaggcagatctgtgagtttgaggccagcctggtctatgtaatgagtaccaggacacctagggctatatagtaagacactgtttaaaaagaaaagaaaagaaaagaaaaaaaagaaaaggaaaggaaaggaaaggaaaggaaaggaaaggaaaggaaagaaaaggaaaaaaagaagaggaaaagaaaaggaaagaagagaaaagggaaggaaagaagagaaaagggaaggaaaagaagagaaaagaaaggaaaagaagagaaataaaacaaaacaaaaaatagagttcactgtaagtatagtgagaagatgccatctaatcatatttctgtattctgtaccggtttgaatgtaaatcaatcctagcacaggaatcattggtgattgggggagtcagggtgggggagtagacatttacatagaatcaggaaaagtagcttcatggaaagtacaccagcatcattgaaaaggatcccgaagaggagtgatggggagatgagacagcctgtgaggagacatagatgtatttgcctcacatgagtgtgaaggacttagcatcttgaaaggtgaaaaagatgcatgattgtgatcctctctgtagtgtgaatgttaccttcaagcactcagatgaaaaaggtaaaagtaccttgtattcaacatgggttgacttggagctttgttgttgttgtttaaaaggctatttctaaatcaaattttaagccttcaattttgttgaaaaatttgaaagctaattggctatcaaattggcaggtattaggtagaaactaatacccctgataattataaatcatgttcatgaaaacaaatcctttaacaggtgactaaagtacatgtatcactatgacttcaggggcggtagatactttattttatttcttttgctttgttttgttttgtttgtagtttttattttagtacattttgttttgtcctcactggttaatgaatacaaagatagctttgtaaagaaataactgagtcctttaacatctcaacattctaccatgctacttcattgcctctaatataaacaattctaccaatggttacagatatgtaagctatgtacgaggaggatattctaaaaggaaatagctatatttaattttccttgttctaatattaaatagtaaagttgaggatgaatagataaggatggggaagcaacactgagtgtctgtgtgtctggtcctctacaagttgcttcatgtacttttgcagtctgtcattgctgggcatctaacctggttctttatttttttctttccatagctttattattatttttattggatattttctttatttacatttcaaatgttatctcctttcccagtttcctccccctcccagaaactccctatcccattctcttcccctgcttctatgagggtgttcctccacccactcatccactcccgccttccctgctctctattcccctacactggggcatctattgagccttcataggttcttatccattcttggcaagtattctactactgactgagctaagttcctaggcccttggtgattaattttaataagagaagccacatatttaaactcaaagaaagagtgatttggatgttttgggcacttattttgattattgtgccccccctttttagttgaaatcagacactaaatgctttgacatttttctgtgatgtctgtagtgagaaccatgaactggagagagaaaggaatgcagctttctcttcttgcctatgtctaatgttcatatagtcatgaagaagcaacctggcacatctgcttaagccctatttgcaagaataatcaggacagcaagtggaagaaggatgggggtagagacaaataccatggtgtttgagtatagatcatcagacatgtatgtagtctatgccaactgtgtaccaaaaaacccccaaaaatcaaacaaaaaaaaaccacaaaaaacatgattgctacaatgtagggaaacttacattgcataagcataaagtatatatatacataaagcttaagaaatgtaagtaatctattctcaaaaaggttaggccaattacatgcacaagcataaatttttgtttcagggataaaagtgtgaggcagagataccattctgtcgaaatgatagaggaatacaatctttataaatgtcaacagctgtggctggcccatgctgggtggcagtccttgcccagatggaacccacagacagaccatccagagactcgggagagaagggggttgtctcacagtggctaagatgaaagatacttacaggttgacgtataagaggaagtcaccaaagcctttgaaacagcagattttccccctttctgggcatagacagtggtttgtgagagcagctaggaagcatggaaaaaccaatatggaggttggccagtgagagatcaaagaccagcggaacctcaaagctctggaagtgaaacaagtcggatgcagcatgacgaggacttcaaagatgggaagccagatcataaaaatagtttgagttgtcaagtctaagatgtgtgccagtttcgtcacattctgtttccgggagggctgtaaaatggaaaatactttcgattcatgtcaatttaattatacatatcttcccatacttctcagccaatttataagagaaaaggtatatatgtacactcaaacgcaaatctcttttcttattttttcaatacaatacattctcttagcatcggttttaacatttatactttcaaatttggggtggctatagaaaatcagtgtgaaagcatttcatcagggcaacgaatgggacaccacaaggagtagcactgtatttaagtgtttggaagtttacaaaggggtttggaattcagccgttaataatatatgcaacttccatttggttcttcaagagttatggcataagttgaaatcttggcgctggacctaggcccactgcgcatatgtagcagatgagcagcttggtcttcatgctgatgccccaactattggtgcgagggttatccatgagcatatagcctgcctgcctgtagatcctgctccccttgtctgacctcagtggaagaggatgcacccaattcagcagcaacttagttcatgtggggagtggggggcgggttggaggagaggaagggtaggagggatgtatgtgtagagtaacatccagaggggccttccccttatcaaaagagaagaaggtggaattggggaggcctggcatgaggcttcctgggaggagggatggctgatattggaatgcaaagggaatatgtaaattaactcaaaatgaccattaatgcgttgttctttgaatcaaaatatagaaaaatgaaatgcacagccatttttaatgcagatttctactttgaaattatctgttttaaagtcatctgtgtttgccaaagaacaacagataagaaaaaaaaaatgcaattcataaaacacaattttgtgcaaagttgattctagttttctgtttagtcagtgtttataagtaagaaacttcccatagatgtgtcatttaactggagagtggaataattagaaggaaatgtttacataatgtatttgtggcaaaaataaaaaacaaaacaagacccccaaaccaaaaacctgaaaacaaaatcttgcacatgggcttctattttaatccaggcattattttatcccttatactaagttggaacagaaagtttaataattttaaaacaaaggtttcatctgtgaatttcctcagaccgtctacatttcttatcagacaccagaatgtgcttttactccaggccaccctcttgtgggctgaacacctggctctcatgggagtggacacgttgtccccctggcttttctaacagtcctcttttatagacatatttgcttgacacttgctgagaaggtagccagggtttgatatctaccattctaacacacaatcaactgtggcattttcaatggtttttcaaattaaatacatttataatttccttaaagaacaatattgagagctacctttcaaaacattagggctccagatgtttttctttactgtgttaattgatttgaggtccatcaaaatgttgttaaaatgcccaggagttcacaataatgatgacatatggatcagattaaaattctttttatgcagaaaaaaataacaagaaaatggtttattcttttctttcaaataaatttggtgaatagattgcagcagtcaagtcatagttaagtttttattcttaattatttattttcttaatttataataaataaaagagatataagggggtgtatgatatactgtaaacgataacaggttctcagtggaggttttggctttgtggagacacacagtggcaccttttctgttgccatttgttgctatgctttgtaactgtgccaatttgctaatcttttaaaatgttatttcttttcattttgagatgttaatataattacaccgtttcccacctcacctccttccctctcgcctacttgtccttgctgttattcaaatttatgatgtccttttttatatgacttggtattacatgcatatgtatatgtatagatataaatttctaaataaatccttcccagtctgtgtaatgttacttgtacgtatgttttctgggtttaccatttgatattgcaaaacctattggtgtactcgtctttggggaagactgtttcttctggcctcagtattctttagttgcctgtagttcctcgtgtggagttcagtccctgtgacctccaccccatcgactttgccatgtctgttattgtccttgttcatcttgtccttgtaaggctgacatgctggtgagaccttatgaatgtagcttcaattgataaaatacagcattgtatttcagtctcttagccttctctctagagatattttaatctcctcttacttcatttcaactctgcttccctggtatcagagatttcgataatatgctctataaccagagaaaaccatgtgaaggaaggaaggtctcacaatgtcgacatgaatgtgtgagtaacagtaatattttagtaaaattaacattgcatttttatagaagataaatgaatattaaaaggaaaatttaaatacttattattcctaggttaagttatgagttaaagttatgatgtgatgtacaaatatcaaagaaaatgtgcctaaggaaaaaccgcactggactggatttaacaaaacaatgaaattcactctgtaaggagtcttattttataagatttaatactctcttattgtcatggagtttatattgcatagatgtagtcaaaataaaagtttttttttggggggggtacaaaatataacaggctagcatggaatgggaatgcccttcatgggtaccactatttttaaatgacatatttccatgaagtttgttggatattgtacactgtgttcaaagggaacaacgtgtcatttataaaagtctccagtgatcaaaaacatttacaggtgaaaaatattgctagttgtaatgatatatggcctatttaaaaagtgaaaaaggggttagcaaatcattattgatatatgttcactctaaatgataattgtacatgtacttgcagatgcatgttctaaagacagtttccttgttgtttcagaaagagaaactccaagtcataggtatccattaggctgtcttctcctttaaaagagacccctgtaaccacgtcagtcatggcttaagataatgtgtttgggagagtaaatactaagcgttgtagatgtatttctactcttcgcaaatggaagaagtaggaatcccttagcttgggtttttaaattaaaagatagtgttgcttttctttctttcttacctctgccctttctacccttgccttttcctggacctggtacctgttgcttgaagatgaaggcctgatataaaggcagtcacctcctcaggggctactaaggcatattagatacccaattggcagttgatgccagaccaaagaaccagtctatagaactttgttccacagtacaaggctatcttctcatgcattgctccaccttccccaaggaaatcaactgacttggtgttttgcaagagagtcacgtcatggaggcgggttagagagtgggtacataagggaagtttagtttctatgaggtgggagttgagagctcaggcattgttcacagtcttccagatggacattaaaaccaaggtgccacatcctgtgactaagacttgttaaagggagtggacatgtatctcagaataacagaaaaggacattaggcaaggaggtgaaatcagaaaaggggaaaaagttgatttttttccttaaaatggaagttctgttgtttatgtttactggtgcagttaaaatcctccacgtgtctttgtgcattaactactctcatttaattttaatttaaaaataaatttcttgtagatactgcttgaaaatcacaacatacctgagaagtgtgtgtgtgtttcccatttattcggtaaaatcacttatagtgtcaacaaatcgtgatttcatttcacactccctagctgcttctggattctgagtccagaagcagaagttaggaaatattatgagaaatctttttgcttgtatttttctcttaattcccacccaaatggaaataacagaagtctgcaaacatccattgttgctgagttctggcccttagggtttttcccagtcactgtttcacagggaacctctggccagttctagtcgctgctcagtagctatagtcttacagctcagtgcttttcctgaatgggcacagatgcccttagctcttccacaccactgggccgtcttgtataccacgtaaatgtgtgtggtagcattgctttcacaattagacagaaacagttcaactattgctggtacttaaagaatgttcttaactaaatttaaactctatgaaataggggtgtgtgtgtgtatgtatgtatgtgtgtgtgtgtgtgagtgtccattccaatttctaagagttttagacctggaaaattagtgtgaaagactagaaaaatgtgaggcttcttcctacatggaggcagacagctttctaaaacactgtccctcaatacttgctgcacaaaccagaatttcctttcacattcagttgggtcattgcacacacgttgctttcataggtaaaaacaatcactatttgtttaattaattgctttgcatgtcctttaacctgaacttttgttggatcctattgtgttttgtatgtttcctctttgaggtgatgttgcctgagctcagggacctatgcttgctaaactcatgctctggtttgaactgtttctccagctgcagaggtatttttaactcgtgtattgtaattactgcttacatttcctcttctgtgaacatattacatgctatgttcagatttttgtatgaagttgtgaaagatgattatgtatctgaggaccaggtaagacagtcccatgataatgaccaaggtcacaaggttttctgcaatgtcatagccttaggcagtttgggcttgtgttctctttccttttaggaggaatcaatctctctctctctctctctctctctctctcnnnnnnnnnnnnnnnnnnnnaaattatttttattcactttacattgtaattgcagcccctgcttcctcctctcctcccagttccccctttacaaatccttcccccattgtcccctccccatcttctcagagaagtaggagctgcccttgggtaccacaccaccctaggacatctagtccgagcaggaataggtacctttaggagggatcttgacatagtttctgggatgctcagagaaactcataggggaatcttgactctgttctccttcctaagctgtgtgcccactgtaaaatctagatgacttttgccctggagcatcaaaaaaccaccatcttgaatctactgctagtatctgcactagggctctgcacctgcctctctaccctcaaacttccaccactaaccacatgcctagttgctaactttcacaccaggtctttgagaacagtacattcggtaaactccacccccacctccaccccaaccctccttttttgtttattccccttttcataatggcgtcaaaagacattttagaggtcagcctaaggtttctaagggccaaggtctgtaaccatccttccactcattcttacgtttcaatgttttctagagttcgttttaaaaggtccggttacaaaccttcaactttccaaatgaaccaaaatttgaattctaaaatcttacactgtccctaaatctgaggattcttcttgaacagtcttcaaaatagtttccatctttaaacccacttagaaatgatatagtttccatgtgcattgtgtgtgcttttataataaagtcgattaaatatactttaatagtcacaaaatagacccaatatgtgctaataaaaatgacaaacataaaaaaatcaggataaatagattttcagttcttacaagtccctggttatgtgctttggggtttccctgtgttgtcctgactgtcctggagttctcagtgtagaccaggctgacttcagactcaaagatcagtctgcctctgcctcctgaatgctgtgattaaaggtgtgcacagccatgcctggccttcttccaagttctttttaatgtctacttagaggagtgctagagtctgccacttgcctttgtatcctgcttgaaacaacttgagatgggttatcagctctggaaagtatttacaagggagaggatgagggagacaaaattgctttctggtatcaacgctaaaataatgctacctataatacacagtatctttatttacagtttagagattccaggttctttggaatatcacagggtctagaacatgttttgaaaacactgatgtcagccaacagggaaggatttttctcttcagagtagcaagggacacgtctccctcttgacagtgctgcacacatttgaacatgtctctaatatcctcaccgatgttgtactttcttagaacagagcatcttaatttcctcttctattctttctctatcatgccttctatgccttcatccccttccctgtttgactaattctggacactagatttcaggtccactgccagtgaatggcactctctactatagatttcaccttttggacctggtatttgcactcaaaaaggcaagtaagctaaaaaacaaacatgtctcttccccaaactggttactgagaagttagcatgtccacactagttggttattccttgtatacatgtaattatgagacatatttatgaaatgcaatgtaatggtttgattcacacgcaaatcatgtatttatcaaataagggtaaactaatgtacacatcacttcgtacagctacctagtgttgtgagaagcacacttacaaacgtcttttctgcttattttgaaaggtgtaacacatcaccattaattataatcacctcattgtgtaacagaacactgatgcttcgtctctcccatctacttgtgactttgccagtcaatttctcttctctgcccatagtctgatgctcgatagtctaccctgtccttttatggggtcactttttaaaaattctgtatatgaatggggccgtatgttatttctgtacctggcagaataggtcaatccatgctgtcataaattataaaatctcatcctttactatttttgtatgataaacacgtaatgtcactatcagcttatctagatttaagcaatatgtttgctccgtggtatattggttattttaataacagtgatgacatgaaaaataatgatcaagtcatttggcaataataaacattcactgtagtagaaggtgtttagtgaatatattaacccattcacccactcttaccatgacccagtgatgaatacacattatttttacttctgtgctacataatgtgtagttcatacgagctgtcagacagttgtgactgtataaccaataggaggtgaagatttgctctcaaagcacttttattaaagaatcatcagactgaacacttttacaagattgtattttgatgtgtgtgttcatgcataaatataaaagtacatatgtgtacaatttgataatacattttattttatagttctataaaagaatggatttcagactgaaatgtttaattggattggatttttgatataaatgagaagcatagagaaaaatggaaagatagaaaagaaaagaaaaattcattgtgataattgaaatctgtaccatttagctccctccttgtgtatggctggttctcagagctcagcctagatgacacaaccacagaacagtgacctcccccttcctcttaggactatgttacagacacagctgtccctctacctatttgtcagttatgtttctggtcttttagatgtctgtctgtgtaaggatagcatcaaaatatttcaatagggaactgctaaaatgaaggtttccctcttgattttgaagactgcatcttaaacccttgttctaggccaaccactcccactgtacagctggcatcgctgggcaacttgaacattgtgcacacttgtggcagacagcttgagtgagcctggcctctgaccacagcaagaactgtttgccaaggggtgtgtgtgtgtgtgtgtgtgtgtgtgtgtgtgagagagagagagagagagagagagagagagagagagagagagagagagagaacacctgtgtcctacttcctgcttctctgcacttgggaagtgtgacagactcctgtgcccaggatcaccttacccatgaatgaagacactctggcaatacaatggctctgcaggcaagactgaacttagcctacttcctttgtgtaattctgcagtacctgggcctgagccctgctgagtacacctgctcccttctgtacccagttgaattcctgttcctttcaggctattagcaaagccaaagcaagctgctagtggttacaattagaataataatggtctttaacttttttttctatttttttaaaatgtatagctgtcaggagcaccttggctatgagattccattatctaattaagtaagctttaaagtgactgaaatataaaagggcacagatgggtttgctgaaatagactcagtcagtcctcagtctgagcaattcgaggtaccagcaagtctctgggataagttgaaggagtcagtgaagtgagcagcttggtctaatgaacatggtctgagtaggagtgccagagtcattctgctgttctcaacccaggcctagtgtggccaccatagtatctaattttgttatgcagagtagtttatgaccattgagacttcaatagccagacatcttgaatcagagatcagctcagtctcttcatttctttggggaagttagttaaatgctttgtgcccatttcactagctgtaaatgataaaaatttgactgtcccttctcaagtactaaggggtaaagtgaatgcccataaaactacgaaatggattttacaaattattataactgctattatatttttagaattattcctttaagcattacctggccagtaatggagctcacatgatagaaaatttaggacatttgagaaaacaagaaaaaaaattttttttctattttattttgtgtcatctaaggaaaagtttgtgtaacagtaagaatacatgggggcaaccaaaaagtaaaataagattccgtaaaagattttctgctagagatttttatgtatttctatgaaagtaaaggcaaacatacatgcatccttgtgggtcaaggagggaagcgtggtcttttatttatgtctgtgggcagctgtgagaaataaggaacagacaatcttcccatatttaaaaggaactgtacggagatgagaaacatttgtctgaaatacaggcttgaaatgaactctgccaaaatcgtgaagtgtgtttacagcaataacatttttttttaactaggaagactaagtgtaagatgctgtgctgtgggtgagaaagattaagtctctacctgccctgtatagaacaagtctgtgcatctccataaggttgcaaccatgtccagagggaaaaggcagatactgctatttatgtctcagtagaaaacagaactgctttggccccttttgtgaaatatcatttttaatagtagttaagaagtggacatgcaagaaaccatcacatgacttgacacagtcagtcttttacaatggtggcctgagcatgtgttctgagagtccaggagtttctcagccacatgtgctctcgtcttctcttagacatctccttcagcctggcctatagaagctctctagtggctactttagaagatagcaaagtctcttcctggttactttcagctctgagtgttagcttgagaatcaatactccactcttcctctgctctgaccttggaactcctcatagactttagcacgttatggaatggttcttttagttttgtgcaatgcatatcagtgatgaaaagagaccatggtatcattgctctatgaagaatgatttaggcctctcatttgcaaaatatattttggatcggaagaggttggagacagtacaaaggagattttttttctagacaagtatgttgtgttattcgttataatttcaatgaatactgtttgactgtgggtactctgagggctaggtatgtaggatgtgatgggttgagcagtaggggtggcagcaccccaaatgcagctgctttccatggagactgcagcacccttaagtcagaccccacctgcaggtaaactgtaattataagcctgatccctccaggcaatgctgtatctcccagaacaaatgaatcatctacccattgaatgaaaccgctttccctggttcatcactttctgattggtaaacacaataaatcttcaagggtgaacagggcatagcaataaatacaacagcacagaagggtatgtatgtttggcagtgtgaggtaaataagttccgattgacatttattgaggaaactgtgagaaggcacaggcagaggatcatacagaggatcatgcatttgaggccagtctgggctagtataatgatatcttgtccttaaggtaacataaaattataacaaaaggtaatacacaagaaataagttactattcaatctgctcaaaacttcacatttaaaaagacagggactctgtctacacagacttgaatagtaaaagtaaaacacatgtatgtgagaagtgtgtgggagagagaaatatgtatgtaaaattgtgtgtgcatgcacatctgctatattcatgtaggaaatagagagtaggaacaagggagaggaacttttgatgaccataatagcctcgaacagattgcttactcctgatagatctttactgagctaaaatattttttaacagattatttgtaaaagtggtctattttatgaggaagctaaagtaacatcatttggtcatcttatgttggtgccatagtgaatgtaaagcaataagaatttgtgttactttattaactcaggcgaggctgtggtgtaggggcaatgttttagtgtgcagaggaaaaaatatgagaagatgctcaactggtttgattccttaacagtaagaccaggtacagaccacaaggcatatagcatcccacgagcaatgggatcttgaggtaatggactttctatatacttccaccatgaatatggttttaaaaatgctaggttcatttgaatctgccatttgttaaataactgtatttcaaaacattacaagacctcttagtaaagttctatagattactgtatcagttatctttctatccagatgtcatacaaagtaaaatacaaacggagtgatagaacctgagtgctagactgggcataagcccagtgttgccataagccatccaagcatcagacaccagagttccagactggactagaacaatgccataagccatctaagtatcagcacctctctttcactatattctatgtgttcttcccttctcgccttctatcaaacacctgaacctttcatcaaccttctagaaaaagagagaaaggctaaaacagcaacaagttttacctagtaaggctttatccttttatttagagatgcaagtcttctccagaggtttattgggctagaaatggattcagagacaaatcactgctagaaatagtggaagaggtattgagaaataaactatattcattttaaagattcaattttagagttaaaaattgaagagctaggttctgaataggttcgaagtgtctgcatattgccaaagccacatgtgatgacatctcttaaggttactttaaacaccgagtttcctaatgtacaatgacaaaggaaaatagaatggtgttgtcttaaatgggagtcattaatgacagaggaatgccaactcttggccacatgagctttacaatccagtgtttttgtcttagctgtattgctgatggccttgtgaaggagtgcccattcgtttttctgatccttagctatgctacgggttggtagctaccgaaaattaaagtcagatccagcaagaccacagaaaagaaaaatctggtctccatcttgaaaatatatctcttcacttcgtaggaacaagacctgtgcacatatatacaagccacaatgtacagcacaccattcgatgtacaacaatatttgtaataactacaatatccagaggagtgatacaacttaactcttacgactttcaaagattattatgttgcaggcattctagacattgaccagtatgagaaaatataaaaataaaattgatgttagagaagtgaagccattgggcctacatctgtatgcagcataagggaaggggtgattaaacaccacacaagaattatcatgttgctgatacttcatgcagaagtacaaattaaaatgaattgttctaagagcagatcactgagtgttaagctggtcagggatgaatatagaaagaaacattaagcaaaaacaggctgatatcatatataagtatatggacaaagtaccatagtggctgaagttgttgacatgtaggtgggctttgaagactgtgtagaagttggcttcattcagagagaaagagtctaggatacagaaaaaaaatacttaaacgttagaagagtggacttttctgtatacacagtaacatgttgtgattcatatgcagttagacagagacagtaagatgggtctgagtgtttcacaaaggccactcgctacacttgaaggcaatgagaaatgaatatcatcaaatggtttgggagaaaaacatatgatcaagatgaaggtgaggatgaataataaggaattagaaaggcccatacataccaggagagggtgtagaggatgtgggagaaagaggagtataagaggaagaggaagaggaagaggaggaggaggaggaggagcagttttcagaaaattcaaatacttttcaggttagaagacaagagggaatggctgagaatggaactggaggggcagagaaaccaatgtatggaagactctgtgaacactctaagaacagagaggccataggtagctcagaattccaaattatgtaggactatagctgttgttgctttgcttctataagaagtaagaatttccaaagggaaatgaagagcacagagaggaaaccagtcaactctgcatgaagaacagcagtagaatcatagtgggctgtggcagagctcactaggggctgggtttgcaagtaccgtagctgaaggccacgatccacaataggatccattttctaattccacctaaaaacatcagcctcagaagaacaaggataagacaagaagtggagaggaaaaggaagccctttgggtaaagtggtttcatcatttatgaaactatttatgaaaataacccccaaaggtaaatttttacatgtttaatagcttctaaaaatgaattaggcagcttgatgagttgcagatccagccgtgtggcagagcacactttatgagaacggaaggcagagagcataaaagaaggcactgggtgtcggtgggtgggtgtgagcctggaagaggctggcagacaaccagagccaagcacatggccagggacagagaagaatcttcagcctcagctctaagaattcgtcactgccaaactctcacatctaccacagtttgaaccttgataatgagcttattcagttttgtggttactatgcaaccatttgcatatttctttgtaacatctgcctagtgtgccagtttgagatgctatttcagccatggtatttgaagcagaacccatttctggtccaggatttttttctccacagagcaaatgatcagcatatctcttaagtatgtgtgcagagagacacaacaaagagagctataaaagtcagggtttgttttaagtgaaacctagagacatcgttgtcattgagtcttaaagactactaaatgattatacatgattatacttccgttctcctcagtccttatgctcagcatctcgagaatcttatttgtataaatactgcattttaattatctatgtacatggactttcttctacactttagtgaaaggatactaaccatcctccattagatgaccctgaatccaggcacataatgacagtaccaagtagactgagtgggttttaaaacaaaacaaatggctcatgaaattgggagggagtagtggagagacatcaaaagcaaaggagcaaacaattagcttgcatgtatgaaattctaaataacaaaaataactgatatgattttgtttttctcctgtaagagttttgatttagagctttcaaaatattttctccatgttaaaataacataggttttccactttgagttagcacttaagatttatttatctcaggaacttttctagaaatgtagacatgtgtaaggtggttctgcagagagagtaaccctggcatagctcagagagggtatgcagtgggcatgttctaaaatgtcaagtaaaatgttcctgttgatgttctcaggttttcttttttaaagaatcaacactgtcagcatagatctctgtgaaggaatatttataatcactgagcagcagcttatggtttagtaggtataaaaacacagtttcctaaatatagacctgcttagctcctgactgacggcttagtaattaaacagcaatcactgaaatatgtgagacaggaatgtaaaaaactgtgaacacccatgggtcttaaaacaaagcaaactggagcagagactgaaaaacacacattagagtattagttgagatataatatgttatatatattaaaatctgatttggggagagttaattataatggagatgaaaatagaaaataggtctttgtctactctttctttctttctttctttctttctttctttctttctttctttctttctttcttcctcttgttcattaattctttctttctctcattctttctttccttcttttttttcaacatatataagtaattctgggttcttttcattttttcttgcagttttggtacacagttaaccagggaaaattggaattagagaaggtgaaatatcccaagtggaactgcttgtcccattttttacttattacagttttctttgtgcattatagcatcaactctaatatttatgtacttatctatattcaacatgtagattttatataatatattccaattagagagtcccctcccccaatgcctcccagatcctctccacttctccacctcctaagtccacatcctttctttcattctcttatcaggatacaaatagtcattaaaaaaacaaactcacaacaacaacaacaacaaacaataagaaacaaaacacattaggactttctaactagtatctttgagctctttcttgtgcttcatagaatcagaaaaaatcttttgttcatctgggcacaatggcacattcctataatgttagcagccattataaggttatctgacaggcagaggtgagtgtatctcacatgtagaccaatgccagctctgtctacacagagggtcgcaggtcagccaggattctgggtgtgaatctattagcttttgtgctagtttccctgtctacattctgctatgcctgttactcacttgctttgtagctcctcctagcaggaccctgaaagtaccgccatgcacacagcgatagcatctcacctggatcctttctttaacacattaaatccagtgggctaagcataggcattttcttgacatcacctctcaaaagggtttgaccttactgataacctcctttctgaagtctgggctctcccagctcccacctggaatttttggtttttcctactgctggtcctggacttctgttggtatgttttctattccagagaccccatcctactcttcctcccacagtatctaaaggacatcacccatgccactacttagtttaattggtgatttctgtctgtctgtcttcagctctactctttcttctatagcaaagacctatttttattttttcagcaatatatttaacacatctgatacatgcccttgagataccatgaatttagctttatcaaaattgtatgcaaactttgtgttaatcttccttgctcacacattctgcccacagattctacccacttactccaatggaaagtcctggtcatgttccatacaccattacattatccctaaggctgttttaaggtgtaaagtgctattatttttttctttgaacatgcccatgtctactttcattgctgcaactctgacttggctacctgcattttgacagtcgtctctggggttgccatactccacagctttctttttcttgctaagcaaacctccagttatgaaggctaacaacttgtgtctttctctattgtgaaattcttgatggggtcttagtattttcttgaaacccgaccttaggttctgattagacaggatcaattctgatgagtgtgttatttttttttagaggtgctattgctcagactaatgagatactaaaacatcttgggaaaactgttccttcatcttgaaaacagacaaatccccagactagacagatggcccttctctgtgaatattctttgagaatgtgacagtcattttaagatcaagttagtggctagaccattaccctatagatgtcagaacaaacataaagatggaatcttaggttgaatgttatgggttaggatgaaattaacccagatttgtgagataataaattccttagagtttaatctataagttctttttatttcacctgctaattgtagcagaaactttttcataacactaaaccatctcatgacctcttgatccacagcctcacatctaaccttatactcctgacttcccctttccacaaaccccagatgttcatctacttcccggcagcccactgctgccaggcagacttttcagctgtgcctggaggccttttgtcaccagaatttcattttcttttctaaaacccgacaaagcctctttggcctcaagccacttcctcagttcaggacccagcagagagcctctatcccatctccatagtcaagtaatcagcattgactagccataaagaggatggcagagtttctaataccaccaaagataaactcaaagtagtgaatgggggattttataaagcagtcttgagtgtggaggatagaagaggctgcatcattgtgcttttgtccagagattttctcattccttaattgctggtatgtgacatgctgtcttctgcaatctcagcccccaccatgtttatggttaatataatgatgggccatgggtacaagcatgaccttaacgttctagggaaattcccaattgcaaagaagttagttcaaagggtggaaaagaaattgttgttgagatttcttcaaagtgttaacaaacacacatcaaaaaaaaaccagaaaatgtcaacctgtaatttggaaataacgttagattatagaaacgctccagagggtgtagattccccacactctgtctgctcagtttctgctgatagcaatgtttatcaaaatgcacatttgttagaaataaccatcagtggtacaacactgcaaactaacttagggtttctgtttgaatcccatgctttttttttttttttttaactgaatgaccttgctttccataaccttgaacctttgagttcctagtagatgtttggaatattcttgaatttatgttggtatagtaaacaaataaagcagtagtgtaggtgatgcccttcagatagtgtgggattagaggacgtgggtcctaagaatgtaaaacataccaacataagtccaagtctaacttatgccactggatgtttaagttattccttgaacatggatggtaattgtaaataaatttcaggatcactttgttatcaacactaatgtgcttcttaggattgcataagttcatattactaacatattgctgtatgttcacaaccaccctgaaactcgtacacacacactttctgctctactgctccacgaatacagtgagtggtccacacccacactatacaatgactcttggtgtgtgtttgcctgagcacaatgaatcatccacctcccacaccaggcaatgacagtagttgaatgtgcattacggtgtgcactcacgagtattaatgagtacacaattttttacaaaacaactttccagcagatgtttgtgacacctttctgtaagtggttgcatcctgctttcggtttgtcttcctggccttgacaatcactgtcatcctggaggggctgagtggtggctggttctctatggaatctatctctgatggtcaccacatgatggcaagataggctttcttcagctacccagtgctcagatataaaggaaaacatgctgttaggatctagtccaagcagtgttaagagacagtctggactaaagcttaagtgtcccagctcactgtaatctaaacagtctatagtctcatagaatatctattatagaaacagtaacctggaaaaaacaatagactgggcaggggggataggaggagggctaaacatttgtaatttagtaatagaacttgcagagagtggcaaaatgttatgggaaaggacagcatattcatgtgagtttaatacacttacacttcagcagattacgcccacaggttagcacccagcaaatcaatagacactaactacatcttttcagattctcatcactaactgccatcacttttgttgttggaggttccacacagtcctgttgctcacttacttaattctgccatttcatcttctatgtgcgtgaatgtgtcaccagtctttgcagttagtggactcagtagaaaaaacattccagtttattaaaatatggctatttgctatgtaggcatcttcaaacagtggctattgtacacaattcgtgctctaagggcaaaatataagggtaccctgatttttagtcccagttgtatgaagcactttattaaaaaatacacagataaaatatggcttcaaataatttttatagaaataaccaggattaattaataattaaagtgataaatgtattatagcaatttaagtaatcaggatagatgagttcaatgtacatcatttataaacagtaaatggcagttaatgctgatatgattacgtgtgttctccaagtggctacatcaaagcttctatctttaactcacaaaatgtatcttatcttataagctaaattgctagactacattttcaagactggagttacttaattaaaaagtcatcagtagccaaataacatgaatttcatttgttataactaaaatatgtctggaattagaagcccaaatgtcagtgattaaagattgaatataatatttcagagtcatccttgatatttctaaagcatttctcagtctctgacaccttatgaaatagtaacccacagctttaccttgtaaactgcctttacttcacggctaacgtaaagcttttattcttcaaaaagcacacagtactcatcaaatatcattaacaagaagaatctaactagattcccttcttacttggaaacatctagttaggattatcatgagacaacatgttgaggaaaagaaaaaagtccatgagttcttcataagaatctccctaaaaattctcacctgaatcggttattttatgtcctgaaagggtggactgtgctaagaacttgatctctattgtcatataccacacacaagatgtctttccatatcagtgagttacatgaaatagcactgccaaaaatttaatttgaacagaatcccagctttttcccccactccttcttttctcttcctgctttcttccttcctcctcatttccctcacctttcctttcatttttgagacaggcttttgctatggagcacaggccgactcatcctctccatcctcctcactcagcctctcttgtgcttcagctcaggaacattccacccctgtggtcaaaggatgtgtcgtcccccccatagattttattatttctaaaggaaggtaaaggtcctctttcttaatgaacagctttattaagtctactgccaaactgcttccccaggtgggggaatttctgtgtaaactgctgatttcatttgaaagagcaagtggaggaggctggaaacagggtgtcagaagtgcccagtgacaagaacaccactcttcctttagtgacacctcagaccacggctgtgggtgggatttgggattcacatgtggatgctgtggtgaacaaagacatgaatcgaaatagacagagagtgagcaattatgcctaggttaccctccagatgactctgaaggacaagcagttgctatgctgtttcattctctcagacgagtctacactgacattgatggggaaggttggtcctgggtaccaggatgcctgaaggaggcatgcttctgaagttttcctgcagctctcttatgataccatcaacataaacattaagtgtcctttggcatttgaaaatgcctcagcaaatcagaaggatgattagtaagtacgaacccaccaagaggtcttcacttttcccactcaactgtgaaaatgttactagaccattatccagcataagaagccagtggctggcaagtgtcagtaggtggggaaggttccatgatgacctccaggaaacagttccagagtctacctggcctggcattgctctgaggacatccagggggcctgggattcagaagtgccttcctgagggtagtaagtccaactgctgggagatggatttacatgtgacttaaagatcaggtagcttggaggactgatgcctctgttgccactcatcagtgtcatttttgatagcatttctttaaagccttccatggaacgaggggacacacaaaaggtatgtgatagcatacaacactgaatatgataagtgtgttcaggcctcagggcacagtgtgtactataatctgggaataccactcaggttgtctgcagttttgttcaacctgaggaaattaaaattagaagaatttttcagaaaccttattcaaatcttattaatgattattaatatataattattaagtgccctctgtaatgtaacaccctctcttagtgttcctctaaataataacccgcatccatactagacattgtgatcttaggtctatggacgaaaaaactcaaatattacttattttattcttaattcataatacgtgtataaatttatggatatggcatggtgatttgatacatgcattatatagcattgattaaatcggggccacgaacgtcttcagcacctcaatcagaataatcaaaacacttttctagttcacttgagttctatttcaaactctaatctctctgctgtcctgtttacccgtggctttgtatactgtgaagtgtcttccttctgcctctcccatcttcccactggtagctcataaccacatccctcactgtatcgtatgtcaagcattttagattccacatataagggagattaggaaggattggcctgtctttcctagttcacttcacttactcacatcctcagacttgatccatgcttttacccaaggcgggattccatctttttatgcctgaatagcattcttccatggtataactcactttctgtgttatcacataggctgatggacactcaagtttccatttcctggctactgtcagcagcgttgcaaagagcacggatgctcagatgggtacaaggcatgttgattccgtttcctgggtatatgtattcagtaataaggttgagattgctgggttttaaacttccacaggatcctgattgtctcagtttgggggtcaaaatcaggttagttgcacacactacaaagtccagttcatctctccacacaggtactgatgtttgggggtatcacttggcattttgttctccattgcttgaatgtaagtgtagatatatatggaaattcagaagtgcatgaaaatgtcaagagagaacgtagctgtatctgatagaaggagagtccacacatgctctttctcacagtgtttcaacaaaccgttgctgcaatattagtgctacatgactaaaggcacacacctaagttacatcagaactacttagtagttttctttcataagcctgacactgtgtggggcataaagaattctgactgtgccagcttctttcagagacacatttggagaaggcagaatgctgcaagaatcagtaagaatttctaaggattgttgagttcctacttgcggaggccctcaaacagcctcccaggatggtatcatcaaagcaagtagatatcgtaaccttttggtatctgaagatgaactaaagtaggtagcaaggaatgtcagaatttgctcctgaaaatattttaattttttattagatatcttctttatttatatttcaaattttatcccctttcctcattttccctccgaatccccccccccatcccacccctccatcccctgctcactaacctacccactcctgcttccctgtcctggcattcccctacactagagcattgaaccttcacaaggccaagtgcctctcctctcattgatgttccacaaggccatcctctactagtacgcagctgaagccttgagtccctccttttgtactctttggttggtggtttagtccctgggagctctgggggtactggttggttcatattattgttcctcctatggggctgcaaaccccttcagcttcttggatcctttctctagctcctccattggtgactctgtgctcagtccaatggatggttgtgagcctccacttctgtatttgtcaggcactggcagagtctctcaggagacagctatatcaggctcctgtcagcaagcacttgttggcatacacagtagtatctgggtttggtaactgtacataggatggatccccaggtaggacagtcactagatgacctttccttcagtttctgctccaaactttgtctctatatctgctcccatggatattttgatccctctttaaagaaggaccaaagtattcacactgtaatcttccttcttcttgagctccatatggtctatgaattgtatcttgggtattctgaacttctgggctaatgtccacttatcaatgagtccataacatgtgtgttcttttgtgactgacttcactcaggatgatattttctagttccatctgtttgcctaacttgatgaattcatcgttcattgttcatgaactccatgaattcattgtttttaatagctgagtagtactccattgtgtaaatgtaccatatatatttttttttgtatccattcctctgttgaagaacatctgggttctttccagcttttgactattataaataaggctgctatgaacatagtgaagcatgtgtcattcttacatgttggagcaatgcaaatcaaaacaacaccctgatattccacctcacacaaatcagaatggctaagataaaaaaactcaggtgatagcagatgctgacgaggatgtggagaaagaggaacactcctccattgctggtgggattgaaagctggtacaaccactctggaaatcagtttggtggttcctcagaagagtggacatagtactacctgaggacccagcaataccactcctgggcatacactgagaagttgcttctgaaaatattttaataggaaagacacatatcaggactctttagagtttggttgatgctgccatgtgtgtgtgtgtgtgtgtgtgtgtgtgtgtgtgtgtgtgtgtatgtgtgtgtgtgtgtgtgtatgggaggatgcctgagaaggcagacaagaacaaggaagtaacaggcctcagacttcaggagttcaagaactttgttccaaacttgaggatcttctattactaagtgaaacattatagagttttgtggaaatcaggttctttggattctgtatgacctgggatttaggtttggtgctgttgcttagtctgttatgaaacagattacttaagccacctatgtcttcctttctcatttaataacccaagaggaatgccattcatcaaacaaggctatgaccgtttattacagatccgcatgttaggtaaccccccatcataagattatttctgttgctacttcataactgtaattttgttactgttatgaattataatgtaaatatccctgtttcccgatggtcttaggctacccctgtgaaaggattgttcgatctccaaagggttgccacccacaggttgagcactgctaatctagagcctaaacttaagtagcatagacacctagtaaaagggaaagtctctcaacccttatgaatgacttccagagcgacaaatgtagctcagtttgtagtgtgcttgcctagcacgtataaagctttacatttgattcccaacatcacaggagtccaatatgggggtgagtgttggtaatgccagcaccagcatgacagaagcagggaaagaaggattataaattgaaggtcatcttggctgcacaatgagtttgataaccataagcaaccatgaagcttaggctacatgagaccctgtctcagacccacgaacaaataaaacgaatgtctgagaattggaggtctaggagccctgagtaggaaatctagatccaagtaggtgtttggggatttttaatttttacagcgtcgcctgaggccctgcattgtctgtgtagccaagtatgaggatggcctgaaacttctgagtcttttgtttccacttcctgattactggggttataggaagaagcgactacatctgattctggctcttctggggcttcatctcagggcctccttgatgttaggtaagggctagtacaactgaattgcagccctagacccaggcagaccttgaatagacttcctggaggaaggatggtttttgtaacacttaaatcagtggttctcaagcttcttaatgttgtgacccctttaatacagttcctcatggtatcgtgacccccaaccataaaaacgatttctgttactacttcatagctataattttgctactgttatcaattgtaatgtaaatatctggtaagtagaatatctgatatgagactcctccagcggtcatgacccacaggttgaaaatcagtgaaatcgaggtaagatgcaggccgcctgaaatattacaacaggtgtcaggattcagcatgctacttattttatttcagacagacaatatcctttctgctgacagaaagcctgaagaactggcccaagatgagtttttcttaagcaactaaataggcgatatctcacaaccccaatattgtttatgaacatcggcaggctattttcatatttttctttatcatggaacaataaggtaatcaacatgtaagagtgttagtaaaaatcctcaccatggaaaaatgtttccaacacagggcaaatgactgtccgttgatatgcccaggcagaggaaagaccagcatgcatctctccttcaggccttgctttcatggtactatcaggtgtaacatttaggaagttatccaacttaagtagtttagctcattggctcccaaagatggtgatactgtacttcctactggtaggtattattttagtacattataacagaggattcttcacaaatatggaaaaaaatcctgcctgattatctttgatcatttcataatcttgaatggaaaggaacatgttccattttctattagacttttcttattgtaatatgttcagtccgagtttcattacacaattcctgtttgtatttttaaatataagatgggatttaatattttgacattaaagtatcatttgtaagttaccttgcaaagggaagtgcctctgaaatcaaaccaatcattatacaaagttagcctcgttgttgaaatacgatttcactagagcaaagtcaagtcaacctgaaattcggtatttcgtagcagttaaagtgtgcagccaggcggcttcaacatgagctagagaagttgcggttttaccccgagatagggctgattatgctggtgctatggcaaccggttgcaccatttggaagctcttctgtgcttaaccgcatgagctgcgcctcttcctttcctataaagacttagaatgagaaaaacagaagtgtgcgaggagaagaaaccacaagggcagtagaggcactgctgcgagcgagcctttagcttttgcaaacagcagccgaacagcacaccgaaaacctctccggaggaaagctgcctctctcttgcttttcccattatgcctgtactgtaatgattttgaaagcgcgccaagtgtttctgttcagcactttcatgactgagagatgagaaaaaattagttgggcatttatcaaccttggctttgattatccgctgctctggggagattggaggactgggtgcaatcttgggggagacatttgatactcttcatgagactgataacagtttggtggtagatgtcccacaatgtagctctcattttctgtttattttttgtttaagctaacaccacacacacacacacacacacacacacacacacacacacacacacacgccatcgttttatttgttttgaaatcttgaaaatactaataaggacatattcaaacttgtttttctattttttaattttttctatgtttttctattattgtttttctatttttctctctgagagggtctgggcagtcaagccaagctgctctcctcattccagtatgcttcaggcttctcgttatgtgtcctttccctgtaaacaatgaaaattttccttttgtactgtcaccgtctaacaattttcacttttaccagcattttagttagcgttcacagtggtgagtgtgattgtggacatttttatacgtatgcattgttctttgtccttcccccagagcgctgccccctttcctccccttcaggccctcttcctcccctaagagccattccttctgctttcatgccttatacggtccattagccttttattatttcccttctcctcttagagttctttcttccatctcatcagccacattttattttatgccttttataagttacacacacacacacacaccacagagagagagagagctacagctccacataagaacaaaacatgtgatatacatcttcccaaggctagcttatttcattgaacattataatttgatctaatttcctgtgaatgttgtgacttactcttctttacagcagaatgcaattgtgtatgtgtgtcttatgtagagtacctggctaactgtttcatttttaatgataatgtttttgggggtgtgagagtacatggctataaccctatcacttggaagactgtggcaggaggagcattgtaagttggagggtggctcaggttgcatacctagtttaaagcatgactagatcttctctcctacaaaacacaatgcaggaaaacactactgcctttcactgtgtcatcctctgggtcccattttgatggtgcatataaggtattctgatcattgttaattctttcctagctgttcagcacaaatactgactttaatattaatttttttcttatcacagtgcagttaaataagcctttttatatcagacagattgtcagttaagtttaaactttacattctctagatttgcacctatttgtttatgatatttatctctaagtaagaagagcgtgttatctgctttaccgaattgctgtaatgttatataaagtataatttaacctcattcagcacctaatatttcataaaacatcactcagcaccgtgtcatacacctagtatttactggaaatagtgacttttattcttggccctgaaaacagtaaagcattttagcacgggtgccaacacgtgtgggtgcctctatataatccgttcactatgatcttactctatttcagaggaagtaaagagttataaaatcatacatagtaaaatgttaattagtacagttagatactttttgctacctggcacatattttcaacatcaggtttacacttctggataaaaaaaaatggaaaatagatagccaccgaagactaaaatagatattctaagtctaaaattaggtctatcctgggaactgtctcagacgagtgagtgggtggggaaatatcgccaccagcaatgcttcctcttctacccaaatctctactccaacgtaagaaaataacaagcacacaggtcgtgttgtggccgcctacagtctcatttttgtacagagtttgtgctgtgaacctggttgtcagcccactaatgatacaactacaggatttgtgttttatatcagtgactattacagtgctgattataccaaggcatatacacatacacagatgcacatcattgatataatctgggatgtgttaagatgtggcctccacagtcctgttgtgttcctatgctggggtaccttggagaatgtcaagggatgatgagcactttgaggagggggaggaggagaagggggaggaggagaagggggaggaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgatgatggtgatgactgcaacaatgatgatttttaaaaaaatatttccccattttattaaaaataatgtcttttctcatacaacatatctggattaaagtttttcctccctcttctcctcccagttcctccccatctcccctcccatcgggatccactccttttctgtctctcattagaaaagagcagtcttctaagtgataacaacaaaatgtaaccaaataaaattcactaaggtaaatcaagattcttcatatcaaagttggacaagcaaacaacagaaggcaacgagcccaaaggaaggcacaagagtcagagacccaattgtccacacactcaggagtcccataaaaacactaaactgaatgctgtaatttatatatatgcagagaattgggtacaggcccatgcaggccctgagcctgatgctttagtctctgtgagttcacatgacctgtctcagttgatttggaaggccttattatcctggtgtccttcatccagtttggctcttacactttttctgcctcctcttctgtggtctaatgggaaggaatgggtggaaacatcttatttaggactgtgtgctccaagctctctgtgttgtaatgtctgcatgtgagtctctgcttttgttccatctcctgcaggaggaagcttctctgatggtggttggatagaattttgaggtgatgatggttttcaagaaagcctctcaccatagcccaagatggcctcaaactcacaatcttccccctcaactttttttgccttgaacatggatcatttgaaaacatctgcatccagttcaaagactctgatgttgccattactacacattagtgttgccataaccacacaggaactacccatctatgttcttacccttttatttttattttttattagatattttctttatttacatttcaaatgctatcccaaaagttccctatatcctccgcccaccctgctcccctacctactcacccttaaattgaaggcatttattataagacaagaaaacaaaaatgggaaacaatttttctcacatggccacctggatttactttcacttttgttcactgagaatcttgtgcagctaagacttgtctggaatttgctctgatctaaggatgctcttgaactcaggagcccccagctttcctctcccagttgtgaaggtttcgctgtgttccacttcgtccagggtttcagtctttactttcctcttccttgcttacttagttaattaacataattgaaattgataacatgatacttttagccaaatataaaagagcgaaagcacatgatgtttattagtgttgcacgcatgttattagtactcaaatataatcacaaacagaaagctgtatttgatagtgtgagggacaattatctgggttcagaagataggtagacattgtttctgtattaaaatttttttttactatctgatcttaaagtgccttcattcattaaacatcttctggttttgtcctcagttgtattttgcaggctaacactgtccttatttttaatttatgatttaagcagattgggaaagctagggttgaatgtttaattgcactatatgcctacagtcaccgagactactattttgttcctaccttgactcctgtatctctgtcatcacttggaaatattattccaccatttttgaatggtatatgaattataatatttgatttacaaaagattttagacagtgtctcttagttgcccccacctccctccctctttctgactttgaatgcctgattttttttctcctgctctttgtttccagacacaatgtgtcccagttctgaggtcctgagttagagctagttccaattcctcttgctcttgtgttgtttctgtttgtactttgttgctctgtggtgtatcctgctgtctgtctgtcttgtatttctttgatgtccatttgaatgagggaagcctgagaaaatgtatgttgccactctctgagccttggtatagcttatacactcataggtctcatgagatggaaagacagccgaaaggcatgggctctctggcttttagtttcctttcccacaatctgaactccatctcaatagacactggcagggtattctgctggccagtgagcataaatcgctgtgattattttctagaggtaggcagccattcttttattctatagagtcaagatgcaatgctaacacaaccaatattttaacataatgctgatagaaagaactagggcaattatttttaaatacatcctacttcaagtctaatatgccctcatatgctatgtttgtcccctgcttaattacatagaaaatacagagaagaatggctgccttgtatggcttactgagatggctaaattaaaaacaactgttggccaagtgacactggcattgtctgattgtgataggatttcagtgagttgtttacactctgtgttccatcagtggatggaagcaagaaggaccacttctgatagttccctcattttttcttagttctctatttgtgtgtgtgtgtgtgtgtgtgtgtgtgtgtgtgtgtgtgtgtgtgtgtgtgtgtttgtgtgtgtgtgtgtgtattactggagaaggatcccagacgttctcacatggtagtcaaatgctctccacttcagaactcttaccttgtatgtttttccctcgagacacaatattaccaagttgcccaatctggccttggattcactctgcagcccagtctggttttgaaattgtgactctaactgggattacatggctatgctaccgtgcacagtttatgtaacattgatcagaactcctttgtcattacagaccagatcatatacctagaattaccattctagggtagaatataccatttataccatttatagaatggacatagtagatgcaatcctccatttttattgatgcccactgatattgccacactaagaagagaaagcgtgcatgctgctctggctgcctcttttgtgtttatccactggtcccacttttgtacagcctttgggctcatggagggaagttatgcagatatacattccaaatcttcaaaacactccctcttctttttaggctagtacccagagtaagtattatttcctctattctgctcccactcttctgtccttgcaaagcagacagacttaaatcccctcatgggatccacggggttctctttctttccttttgttttggaagggaggttggtggtggaatagatgatatttaaagcccaaatatgtcctttgaaatgtcatttccactcaaactgattcctactttttcttaaatctctgatggcagacttaggggtgtgacttcaaggtaactttgatttgcaaacatttaaacatttccagttgtaaaagaaacatattgggaaaggtaaattcggttaacaatacacgtgttagaataacagagctttgaagatcaagggctctgtcatctccatgttcacgtgtttaatgtatctagtcaattccgctggtaattcacaacaggattataatggggaaatgctcaccaggtgatgatttacagatttctggttctctggtgccatctactgaaatattgctaaagaaaaaaaaagacaggaaaattgtgtaaccagaagagtagaagattctgtaacacatagacacactgagtgtctatgcttgtgtgtagagtgccctgattgtgtgtgtgtgtctatacttgttgcatttacaaattttagaaaaagactttaaaatccatattttagaaaagtgattttcttccactttactgtcatctacctgtaaacgtactgttcttaatttacacgcctacttcatgtattttttcttcagctattgttattttttctaaattttgttcatacatatgggtttgtgtgtatgtgtttgcatatgcgtatgtgtatgtgtatatgtatacatacacaaaacacacatatacatatatatacagacattcatatatatatgtgtgtgtgtggagagagagagagaaagagagagagagagagagagagagagatgagatgttacttttactaacacttcatcctatttgcactggttatgagtcactttgcaaaggttttatttctcaataccagatgtattgacagcagatgggttgctttgggtggatagtgctgctgctatagagggagctgatcagaatgctacttagactcatttgctctgcagggccccagcaggttactctgtgaccctgtaagcagtcaaatggaaggccatgtgctaactaaatgcaccccccacccagtcatttcaggtttttctgtgtaacaataaggatcctcgaaggctatgtctacttatgattttggtgataatctattcaggtaatttagaaagatttccagaaacatgacagacacatctctaactgttgtagatcttaagtagcacaactcctataaatattcatgtgaagccctctgccttccagtgtatttgatatgtaaagtatccacagaggtagctgttagtatatgcaaaagatcttaaataacatgggcgtggatggctttcagatagtggctttataactaggctatctctgtagggcaactttactgcatttctgccttaagattcatagtgtttcttttgtgttttttcctttaatgggtaatacctgggagatatttatgtgtactttgaatctttattgccgaggagaattcatagtttcttaaagtgattagtttatactctagatgatttaaaaaattatttggagttatttttaaaagaatttttgacaggttaatctttttccatgctgtttatcatgtcgaataagagagctactggtattgaaaaatctacctggaaggactttgtaaacaaaacaagcaattttggtcttatattggctctaaaccgtagttctgaagtactgcaattttatttcaaataaggttaaggtgtgtgtgtgtgtgtgtgtgtgtgtgtgtgtgtgtatgtgtgtgtgtgtgtgtgtgtgtgtgtgtgtgtcctctgtatgtctgtctctgtctttgtgtctgtgtgtaatattttataaacaaaacagaaactaatggctcagccatgaaaatgctgccctgtaggtataaagacctgagtcctgagtcccagcagccacgttaaacaaataatcaaataagctgaatatagtggcattcagtcacctttaatcgcaatgtggggaagacagggacagcaggctccttaggcttgctggccaccaaattagctgaatccatgaacactaggttcagtgggggaccctgtctccaaaaataaggtagagagtgattaccattgactactggcctccatccatgcatatatacatctgtgcctgtgcacatatgaacacatgcatgcactactccccagttcatgcaaaggtaatttcatatagtttgtctacattcattatttactttttaccatgaacatatgataagtggtacgtttatagtctttttatcaaatgttttggcttagtattacacgttttggtggcaataagcaactaagttagtaccatgaaacagagtggtctcccaaatgagtggtggagttagtataacctactctaaaatgcccctttcttctatgaccaaagggattatttgcttgcttcttcttcatagtcattgatcctgtggtttctgccaccttcagaaaagcatccaatcccttgccagggtctccaacatctatacttgagttcatgtctgaaaactgtcatctgatagctttggcttcccctttatatatactctgtgttcaaagtcatccaaggatttctctgtcactgagtacctagtaagtaatacatacccccaatacagtagcttctcctccttctcctcttcattatactgtagagttctttgcaatcattatcagtccaaacagggtgcatatattacttaaatgtttgtgcagattactggatgcatttgtcctttgcattgctgacttctcaggggagggccatgcctttaccatgctcaactctcacttctaacagcagaccagcaaaacaatagctacttcctaaagataagtcaatgaaatggtgtgaacctccagggaaccacatggtgctactgagaaggggtatatcaaactctctctagatgtggaaaagtttgagaaactgtttgctatggtttcatatagtcaaagcaacttgaacattttaatcatgttggtacactatattcttcacaatgaatgcaagttattttgtctttttaaaaacatgatctattaatgactgatatatttatactttgtttcttctcattctctgcaaaccaacataattcttagaggtgaatttggaaagaaattagaatagatcagaggataggattgctgttaaaaggaatataaaaaagaataagaagtactagctgactagccaaaaaaaggggggacagtatttcaaataatattttcaaaacaatacagtcatacaacacataccgatgtcacagtcatgagtggaccttagttcttccacccagtgacattatagccatttttagttgtgaaaatatactctatggtgattattagcagtattagcataatggcaaaatcacctcattttttgtatatatatgcaatatccttctgatccgtgtcgttggcacataatttcagagaaacctttctccaaacagtctctgttcatttctttcctctgatgggaagtacctcattagcttcgtcagcttttaactcatttaactcctgcattcttagactcttgtgtcagctacagtgtctatttgtgtgctccaggcatgcgtagcacgagctctcccgtctccacaggaatgcttccaaaatgtgcaatcagcacccattcaaactcgcctctttctcttgagaggttccctcttttaattcagtgagaatgtccacacttcagcaactcagtaatatgcacgggactgcttcctttacttaactcttcattttctccttcaaggacatgcaaagtcttgggggctgccacctgagtgtttcagggatgcgtttcactccagtgtattcgcccattgagaccttcttattgagagcatcatcacgaatttgtgtgtgtgtgtgtgtgtgtgtgtgtgtgtgtgtgtgtgcgcgcgcgtgcacgcgcgcttctggtactctttgcattttttttttttttgcttctaacttagttctatcttgtgctcatttacaaaaatattgattcaaaattcaaaaaaagtgtctatagccctcccgttacaggaattgctctataggctgactccaaactgtgaaccccgcccccccacgccttcctcttcctttaggaccacatcttaggtcatccattaggtcagcctgtagctgtcttcaaaacatcaaaacattaacagaaagaaaaattgggaacttgctttcattaagatgatatgtgctgaaaataaatatgaataaagtatatgatgtatacttgcatgtatgctttaaatctcaaaatttctaaaagtgtgtttatttttttttcagggcaaacacctacacccagtgatggtaagaattaatatttgacttttaatattttatttttgttacaacaatcatgtagttaatatagataaagttttatacttatttggaaagaagtttaaagaagaaattgtataataatgtgtggttcctcactgtcacatgctcttaaaattctttctaatattaaatttagtgaatagttgaacattctttaaatttcataattattattgtgttcaatttaaagtttaacatttcattaaattgacaataaatggcatagagagtttctaatccttttaaaaatttaagactgtaaataaattttgaaaatctgtacatgggataagatttaaacagagagaaaaaaactgatcagaatatattgcataagaatattctttttttaaaaaaagcattgaattagaaatggggtaggaagcctaaaaacaacgtcacatgttttgttatataaggacaaatgcattatataaattaattggatctagagttcacttatatttagattttaataaaggttcacttttatttaaaatttcattttataatgttttttcaagagtaatttgccctttttaaagttatgcttggagatctaatattaagatatgctgcattaatagtttacaaagtttcctactgtaattcaattaatttttttctaaaagcttttgagaaaatcaatgtaaatagtgctcatgctgccagtgtgttaaaaattctttaatgaccaaatatagatgttaaaattctctaaagcctaaacacacagaggaagtgacctgcaggtgggtaaagggaagttagatcccttgcatgtttctgttgctgtaaatgcttgtttcctggttaatcatgtgactgacagtatgtcttaagaaggtaagtgagaccgtaaaacatgagtgttttaataacttaaatgcacatttcaaggggagcaaatctgaaatgctaaaagttgattatcctaggaattatttgtcattaaatgcaacactatgcagatacttacaaatcccactcctgagcctttaaaaaaaaccacattcttttattttttcaatgtctaatattggaattgtatagttttagtgtgtggcagagacatttgataaaacacttgctgcagagcaggttgtgattggtttatgccaatttcttaagtgaaatttgacattttcctttacaaaatattaagctactctcagctcacgtagacgagacattgttgcaggagaggaaggtgatgggatggaatgatagcttattctcttaccttgttgaaagttaagttagaattgtggcctataatacaaagaggagcagtgtccccaaatatcaccaatagaagataatcagtgaaaaactcagaatgttcaaaatgaggattcagggacactagagaattggcaaatttgcagtcatagattttactgctgagacttgaacttaagtgtctgcgaagatattaacacgagagacttctctgaagacatcttcatacaccaaggactgaatttgctttgctggaaaatgtcttgaggaaccacactcttcaaagcagcttgggtttttaacattgagggtttaaaatccaaaagccttttgtagttggtttactccaagggagtgtcagtgtgtttgatggacaacttgctgcaatattctctcaggccaggagaccattgcaacctttccaattagttgatctaaccaaaaaataaattgtcatctgtaaaagggcgctgagttaacactatgtgcaccagatttaaaaatccctccttccacctctcttctctccctctctgcttttctgtttcccacttcctccttcctttttaaaaaatttggtcttccttttaattcaatgcatagtgggtgagggacaattaggttagaagagtggtcctgaatatgagaggtatgtcttacctctagttcaatttgcaaaggttgttttagtctttatttgttaaagtgcaactagttttgaggaagtgaatcttcaaaaactgcgtattttaatactcaaagacgttaatacacattaagcaagggacaattaaaaataacatccctaataatccgagagagagaacatgatgattttaaaaactaaatttaggggactttggagatggctcagtggataagagaacaggtgtcctgagtccattccagaggtgagttcagttcccagaaaccatatggtggcttacaaccatctgtaatgggatttggtgccctcttctggcgatcaagttacatgcagatagattttatatatatgtgtgtatatatatatatatatatatatatatatatatataatatatatatgtaattaaacaaaactaaattatagattatatatatttatatatgtaattaaacaaaactaaatttgatttatttctcttttcacaaaaataaaaacattttaaataaaggaaaacagagaagtgtttgatttaccccatgtgcaaactccttgcagacagcttacatatccacacccactgaacagtattatctttcactcccttctgacacatctgccctttagaacagtaagttagaacaagtttatttcagcatcacatgtctctgattaaaaggcaaacacattttcatagttttataagagcagatcacttgcacttcagtttgtgagttttgttttcaggttttgcttatagaactctcccttggcttcatttgattgattggcttatcttttgaatctacacatgcaggacaatttgtttctagacaggggctcctgatttagttcaagctgcctagaacttgcagtcagctcttgagtgatggagctacagacatgacccatagaccggattcacccagagtttttcctttcctttcctttcctttcctttcctttcctttcctttcctttcctttcctttcctttcctttcctttccttcccttcccttcccttcccttcccttcccttcccttcccttcccttccctttcctttcctttcctttcctattctcttttcttttcttttcttttcttttcttttcttttcttttcttttcttttcttttcctttctttgctttattccacgtggaatccaaagtctcctaatgattaatttctggcgttatccttctccaccattgcttacaatctgtaagtcttttcaagtttcctttagacatttttacaaattaggtttcattcttctgaatccagttgctttgggtagctccccaacgattagattggaagagagctaagaggaactgcttcccagtcaattttcacatctttattattaacttttattatataatttgtatctatatatgcatatgtagttagaaatctatagccatgtgtgtgtgtgtgtgtgtgtgtatgggtcatgtgagtatatgtgcctatgtatgttgcctgagtatacttgtctgtatatatacttatatatttttctttgtgtatatatatatctatacgtatgtacatatggaagtatgtgtgtatgtatgcatgtatatttgtgtatgtatgtgtttgtgtatatgtgtgcagatgtggaagtatgcagacacactctatagcacataagcttggtatatgtgtgtggggttaggaagctgaatatgaacatgtatatgaatggacatttttgggacatgattgatatattccttctcttcttccatccattaacataacagaactgagcacaacagagaatgcccttcttctgcctcaaagtgaccccttacctgctcgcaccactgaatccacacccccaagcatctctgaaagaggaaatggctcttcagagaccacatatcatccaggtgaccactcaagccaggccctcccagaaacttggataatgctggtattcttattatgacaggttgacacacaaactttcctaaccaaaatgatattgggggtgaatttgcctttcagaatctttctaaagtgatcaatcatttacgttacatgtgcagtttcaaagtatttttcttcaagataataaaatacaggtgacagcagacattgggaaaggttgcttagtgaaaataatacagggatggtgctcaggagatggtaaaggtgtaatagaggattccctacaaataaccagggaaagtgccctaggttcactgcatctgtgtggctgctagaagactgctcggaactgcagcactgagcaggaaaataattctctggcacagcgttttgacacttttgagcttccttacagctgcctggaagtgggatattcccatttcttagttccattctcagttcacatcatcagaaatctaaagatagagaactattttgaacaggcctctcagaactgagatttcagttttgagacatgctattttcccagagattatgtccattcttaaaacaaaaactaacaattaagcaacccaaaatcatgaaatctagtggaatgtaagatggagctcgccccccccccccacgccaggcctgtggcattccttccaactttgacatattagaagtttcagcttctcttcaagtttagatttgcaacatagtcagtatctgcttctgccaacacgagattgtgcacacatttctgaaatcacatctgtaatgcagttttcttaggcaaataggtttccaaaaacacttcttaagacactgtgaacctcaactgcttagcagaactgtttatcttggtctaaaaaagcaacattcacacacacactcaggtcttcaaagttcctctttatccctgccaccagcagaggaatcgcttagaacctgggtcaacatctgaacatcacgtctgaccatctggtggcagcacacactttttcattattaatctcatctcatcacacacacacacacacacacacacacacacacacacacacaccacataaactcagcaaccttcccatccacaaattttatttgagcatgttaaaacctcagagcttcagatggaccatcccagggaaaggtttagggtggagtgaattagaaacacagatgagtaataccaaattgtctcttgtcacaactgcatggtgcaacttgcctgggaaacttctaatgcattcaaataaacgagcatgccttcttttttagaatagtattgctctctaatgatctttcaatgatgtgctggggaagattgtgtaatttatatttatgattgatcaatagtcttcaatgtaactaattttttttcttggttgctgatatacttggggtaaacatattaattagtttttctaatggtgtaaactattcagttcttctgttttgaaatccgttacactaagtattgccattcacacatcacactagagtatcaaatactataagacagtgtatgtataaattttatgaccaatgaagaatgatgtttatatatatatatatgtatgtatgtatgtatatatatatatatatatatatatatatatatacacacacacacatcgatagttaagatgtattatacagtgaaaatttcaccctctcaaatcatgtttttttaataaatcacttttgatcatgatttcagataatctaggttcttgggctttgattctctgtgagcacacatgtaaacatgcatacatacatgcatgactatctccacaagttcccaatgctggatgtcatgaatctgttaaaactgacagcaaggcgatttaaactgttttgtgcggatttttacaaatctctcatatttcacagagataaggatcttttcattttggccatcatacgtatttgtgctatctcctgttcctccgttttgattttgtaatcagcagtttattatttttagaattgtagagttttctactattcagtctatagggcaagcttgcccccagtctcagtctgtagagtgattcatgaatccaacaagctttcagggattaggaagtcaaagaagtcacctggacaggcgtataaacaggaacccaggatcctcctttctgcccagggaacttcgcaatcttaataaatggggtcacgccaccctgtggcacctttgtgtcatacagtcttagagtctagactgccagccacaggtgtgatcaacataaccatctcactttctaacctcaggtgtgttatccacgctgctgcctcacctgtccccacagcctgactcgcagacgccctctgccggaggagctgacactcagacattcagcagccaagctgacaatcccacactcacgcctgctcccggcggcgggactgacccaccaggtttgggggctctttagacatgggcaaatgtcaagagttctgagagtcgcctcactttgagaatggtgtgaggagctgtagccacttgttccatgtggcgcatttgctgattgatggatggtttagcagttttatagttacccataggatgcaaaacaaggagagaaaggttattctaatagagatgaaataatactcagggctgaggctacagcattgttctgtttctataggtgtagctgttgtttagtggagactgtattcaccggtgaccaagaatagtacatgtgaatcttttagaccttgagcttcaaacagctgttaagaatgaaaggctccttattgatgaaggagactcaaaactcattaccacagtgacattgtctttagggaatgagaagaatggaggtagacagtcacatttcccatgtagacttcaagattctcccttttttctgttcttatagcaacacaacctactcacttctcccccctccccaccccgaaaacaagagtgtaaataacttcacggtctcattttatatggaagaaatataactatgccctttctcaggtcacggttccataatattgtacctgtccattcagtggcctgggtgcttgacagtgagtgagacgtgtaacagtggcttgctggcttcaggatgcgtcaagcatggacagcaaagtccacacatgggagaattattattaggatgataacaatatcctcacctgaccctgttgccccagcagagcaaaatggtgttttgttttgtttgtgggtttttttttgttttttgttttttgtttttgttttgttttttttttttgttttgttttgttttgttttgctttaaaagcaaatccagactagaaatcggggaatggaggaagccatgaacaagaagcacactccaagggctccctttcacacaagccaacccggtctgctataatcaaagaaaccttcttgtcacattggttaattttgctaatgaaaggattcattctgtgtagtaaaagttaaaagtggtaaagatgtgtggcacgctctcatcaaagctgttcagataacagccatgggctactgacaaaagagaacaacaccttgcaccaacacgcaaacttactacacatgcgaacctattttctcatccctgaacctagaaatcttgacggtgaaatgagcaagtgagctctcagataggagctggctcatatttctgttgctttttccctggcaagctagtgtagtgctagtcatctgatggggaattagtgaccattcattgatggtctctcctggaggtcatgatgtatgggggaaacatgtaacaggcatgaagtactctgaagcctggcagtgaagttctaagcaggatatacagctcttttagctatattactctgcactctgccagcaattggcaaataaggggattatattgacataatgagaattgtgttgatataaaactaatctgatatctgcctggtatgggagtcttcttagtaaatgtagttttgggacaatcagacgataagaaggaaaagcctagggctcagatgctgtacaggcaggagattatttacacttcaattccagtgaaactgatgtacagtcccagtacatctttcccacccaaaaaggcacacacacctgagactctcagcaggtgatcgggccccatttcctccttggcaccattaaaaagacaacccttttaccctcagggttgggttactcttcatgtcattagtaccttcaagactgtctctttctcttctctttggagtatttttaataccgcccatggcagcaggagactggggcattgacttccaagctatttcccaaggccaatacattttgttcctgtcaactggtacctaagttgtacatttgtctgcttctgagttcatctttttccaagttctcatactgacagaacattctgtgaaataaggattatggaatgggttagggttagggtttggcattgtagtgtgctgtcgcaggtataccagatagctccttgctctgccttagttcagtactcacatccatggcagcatgtggcatgatggagtgatagtgttggtgacccttctgattgcaggtgtgccaggggagaggactgtaccggggaccattcctgcagacacagcctttcctgttgatacccccagccttgcacgcaacagctctgctgcctcacctacacacacctccaatgtcagcaccacagatatctcttcaggtgtgaccattatttagcatgcctttaaggatatggaggctccaaacttgaatgaggctcttctctgactccagatactattttcaaatttcccatctatttttcaatcttgataagaaagaaattaggcaaaagaaatttatgaaaaaacttttgggggattaatgtgattttactattattattgtacagtttatgacaccaaaattgataatgtacattaacagcttgtagctctaggattaatccaactgcttgaacttttctagacaatctaaaacaagtaactcagtttcccttttgtgaaagtgtcccctctaatactcatttcataaagctgatatgaagactctacatggaaagttttgacataacagatgtaagaaaataattcgaccagtggccaaattaatatctaaaataaaaagagcttattcaacaaaaagtgctagtttggggcaaattcttttttcaagtaaaaattatactaaggagtgaataacttccccttttcattgtgacataatatttaaaattacctgaaatgtgtgttatgtgaatggatttttatatgcatctttgactcactttgttatcttggaaacataaattcaaatgatcaattccaaagaatcacttagcaaattatcttgggtaaagatttttttctcacactttgagagaatgaaactaattaacttttaccgtttttgttcatttccttgcaggtgccagcctcacaactcttacaccatccactctgggccttgcaagcactgaccctccaagcacaaccataggtgacaatcttaccctcaggcatgcaggcctacctctaccactgctggggatgtccttacggacttcctggctttctctacctcaggtttccctctttgtggaatctagagttcaaatcctaatggtcatagagcagaatctagacattggtacagcaaagctgtagttgagacccctgggatataatgtcattgccatggcccccaagagttgtggtgtttatgaggaaccatgtaagcaatagccaagtctgttagaacttatttctttgaagagaagttgtagcgtgcaatagagtagtttttatcaaagccactacccttttcattgaggagaggcagtttcagttaattactgaggggcatggagatagatgaaggggagacacctctttgaagatctgtggcagtgatgtagtcattggtcatgaggttagtgctggcaatcccaccattctcccaaggttctcataactttgagaagattagcagaagttcatttacttctagggactcagacttcaagtttttcagttaaatcagtgttttgccctcaacctgtggttctcaacttgggggttgaacaaccctttcacatgagtcatcaaacattgtcagaaagctcacatatatatgattaataacagtagcaaaattatagttatggagtagcaacaaaaatgattttatggttgggcgtcattacaacctaaggcgctgtattaaagggttgcagcattgggaaggttgagcatcattgagcgaaaggactattaaaacatgatagttactttgagatcaactagctaccttggattttgtgcttcgtaagcatacataggttaaacctagaaacaaagtagcctttatctattgttatcagattaaaacaaagcaaaacaaagacatggtatcactttatagggattataattatggaaatctagtttgagaccaaaaaagtgaatgaagccttaaaatattttggtaacgtataaatttgttcctgtcaccatgctggcattagatctgtactgaaaagtctgcatatagctatggtcacagttgggtttattgtatactttaatgaaggtaatttgtagttagctcactagtgtataacatttccatgcttgagatgaaaatacaaaaattaagcaagctgtgttatgtgttaagcctaagtagatagacttgccagtttatggaaggtccatgaagatgatgaacatgccaaagatgaacacagcagacatattttaaaataatttctcaatgattttcctcttttttttttaatctcaattacagctaccacaacgaagcaaacatgtggtaagtttgttgacccagcagctgtctctgtcacttgggagcagcatcttaatcctgtccctcttcctgccagactttcagcctttattcactgtttctagttctcatggccagctctaaatcttaagagtccccatctctttcattttcttcctgcccttgtggtagaagccaagtccttctttgtgaccaccattactcttctgtacccttgggagtcacaacactccagacaggtccccattcactcgaggtcaaggtcatcctccactgatctgttttattaacatgatgtctcaagttcaagttctttccctctctgtctgcatcattcctcctcacttccactcttgtcttgagtcacatggaactgcctgtatcttccttcttggctctacctcccctgcttttcctcctctgcgtttggagtccctctagctctccttttgggtacttggttttgttttctgacatcttcttctacttgaaaaactaattcagatatctagagttcatctacccactctatctgaagagaaatcttccttttgcttttatattatttgctgcctaatattattttatatttttgcttagctctagtactttagtctgtgtctatctccatgtaatgcttcatttaaaagttaatttcatctgatttatctcaacatgcttagtatttaagacaatatttaaatgtaatgaagggcacatatttttgtaaaataagaacaaataaatagggtctgtaaagatggtggtgaagtgcttgtcacataagcagaggacatgagttctgatacctgctaccctgtaaaaaggtgagcttggtggcagatgcctgtaatcctattgctgggataaaggtaagaggatccttagggctgctggtgtgatactcttgacaattaagagatagactctgactcataaaattaaatcaaaagaaatagggaaagaggcctggtgttagtctctggtctcaatactcatatgtatatgtgtgtgtgtgtgtactccctcacatacatgcacagatgaacatgtatacatgtacatacatacacaacacacataaacatagaaaacaattttaaaatggagatgtaacttagcaattgtttaaatgaattttttgccagtcaatagaaattgctgacactaaacaatggggtttatgaagatttattatcatgtgtaatgatattctatatgcaatggaatgactgaaaacttatggtttctaaataattcatacttagataactaaatgatttataaagacatttgagaaaacaagagtagttataaagtaagaaaacattttcatacaagtttattagaagataaactcatttgtggtttaattcaccaagtattattgaattgttgataacagacagatatatcataaacccgagttaatgataatgaacaaaatagactagttatggttctcatggacttttcaatttagttggaaagatagataccaaaccaataattatcatagtataaactgggatcttttataggagaaaggatttcaaaataatgatgtaggggtacatgatacagttcttctatttttcatattcctggagatactgtgctacaacctacaatctgctttggtgatattttggtatattacctctgctatatgctaattattcttttacttctgcttgctgagtactgaatttgaaacccaaaatacacttatttcatcagatcattctctgtacaaaagaatatgttaagacatttgtatccaatgtagtatcattcattctcgatgatgattgtactaatttcctttttttttttttccagctgccatgtttgggaacattactgtgaattacacctatgaatctagtaatcagacttttaaggcagacctcaaagatgtccaaaatgctaagtgtggaaatgaggattgtgaaaacgtgttaaataatctagaagaatgctcacagataaaaaacatcagtgtgtctaatgactcatgtgctccagctacaactatagatttatatgtaccaccaggtgaatgtcaatttctctctatctgggtatttagagcaacagaaggatttcatgtatgtgttcctgtgcttcttcaagctaatgtggtcagaaaaaagaaccgagggaaagcaagtgagctttgataagagtgtgtttcctgctgagaaccccggagagcagagagaaatacacacttattccttaggaccaccacctggctctcttatttcttttataaagagattcccagctgggaagtggtgtccctcaccttcaatctcagcacttcagaggcagaggcaggcagatctcagggttccaaggcagccatggtttacagagcaagtttcaagacagcccaggatacacagagaaaccctgtctcaaaacaaacaaaacaaaacaaaaagcaaaaaacacaaaactaaaacaacataacaacaaaccatcaaaaagcagttcctatggattagaaacagcctattttgtattttgtgaaataattatacataagattgctgttttttcatttttttctttcttctttttggtatttctttttaaattcaaaatgttctcattagagaaaagaatgtagttaaacatctaatgttttctggaaaaaaaaatcaaagggggaattctagttatgttaataccaaagttgtgatcacagcacgtggaaggcaggagtaccttatgtgttcaaagccagtctatgctgtatcttgaattctgtggcagccttcacagtgtgagattacaccttgtttccaaaaccccaaacagatcaacaacaagcgtgaaaacagcaaagaaattgtttttcaaatgggaaaaatcagccgtttatcttgatgtttccttgagttgcatttataaaagcagcacacatttctactgaaatctgtggtacgaagaaaatatgttatcttccctaatgaatggcaaatatctgagttgataaacaaactgccagcaagtggtgtctacacatatagatatatcaaaacactaataatgtgcacatatttgtataattgtgcatcagctgaaatggagataaattaaaaattaggaatgtgactagatcatgaagaagcatcagaccttgggagagcttagatgtcccctagcgaaatctcctgcttgcaagactgtactccatgagtcttatttcagagttgagagggttcacatctccacaccaggaaccatcacctaagagcacctctccgtttcctccacagggactgacaagttttcgctacatgactgcacaccaaaagaaaaggctaatacttcaatttgtttggagtggaaaacaaaaaaccttgatttcagaaaatgcaacagtgacaatatttcatatgtactccactgtgagccaggtacgatgctgggcagagaagttctattatcagaaattattccagacgtggcttaaatgttctttctgtagccttgtcctcctcacccaccctcagtgatccgccataaattagaataaaataaccctagtatctctggcactgaaacaaattcacaacgtagataaatgaaaagagcaacccatggatgataaatattatgaaaaattaattaaaagaattttcttgagtactgttatataccagacattgttgaaagggtgatgagatgcaggcattataaaagaaagatggtatccatagtctgtagaaaggaagcatagtattatccacaccggaggttgctttctcagactttcatacatgaaaatcattggaaagttcaagaatctgcaggtagcaaggaaaacaagtgcttctaggagggaacatgggtttctctagaggttggatcttttaaaacatatatttgaattcagtgaggtggactctttctcctctaggcatacagctatgtgccaggacacacttgacaagacagagggaggtacatacacccagaggcggaagaggaaatttcactctgattgtaaacattgtgctaacaggaaattgctgggctaagatacaaataggatgttcacagctggaacaaatatatgttgagttaacatttttttaaaaaattttaaataagtcacaatactgatttctcaacaaaattgagtatagcaatgttatctgcaggatcttggtttattatttcaccattttcagagacttgaccttaacatgaagtcttaaacacatggtgccataaaagaagcccatttactatgtggcatttcatatactcatgtgcaatacttacttctttcagaaaataatacaaaatgcattagaagaaatacattcatacctgaaagatgtcagttggacaaccttcgtgcccaaacaaattacacatgtgtagcagaaatcttatatcgcggtgtaaaactcgtcaaaaatgttataaatgtgcagacagatttggggagtaagtatatcgtttatgtttataaaataaataaaatttctttttcttttatgggtttacttttatttttggagagtcatagaaaataatggtatagaattacagaaagcatatcagtgaagaaaaaagtttaaatgcactttaaggtcaattttaaaaactaggttatacaaacctaactaaagttctttttctgttgttcaaattgtgtctgccgtaagtctggtagaaacacttgaaatggtttacatagattattcccattttattcattttctcctcccttctttttataacaccatttgttctgtattctaacacttctttcacaattatgctctgcttctaatagaaataaaataagcaaagaaactaataaaactcaagcaaatctacatgtttaaacataaaatacggagtatagttatcaaattttggcaatagaattaataaccggataaaccttattaaatagaaaggggttctacttgggaagtcagatgtgaaattttcaaattaaatgtaacatttgatggtaaatgctaattttttaaaatggtgattaatgaataatcaaccataaagaagacaaaagatgtcattgctcacaagcagtaaagacatttttagaaggaagagaagagaagcagtaggaaaggaggaagggagagatagatgatagatagataatagatagatagatagatagatagatagatagatagagacagacagacagacagaaagaaagagagagacagaaacagagagacacaaaaaaagaggaaagagaagactgggagaaagggaaagtaagggatggagaaaaaagggagagagataaaaagaagacaaaaacataaatgaaagcaaggaatgatgatatatatctgttatgtcagctgcttatgagtctgaggcacagtgatcacaagttgaagacctgcctggacaacatagttaagaactatatagtgtgtgaaggctaccctgagctacatgcaatcctgtttttgcaacaatcattacaagaacaagaacgataaaagaaaactagcaaaatacattatgattttctagttctgtacttgttattgttgaatttacttctggttacggttctatttttcctgtaatagtattttttttcctaaatttcattttcacataaagatacacaaacatgactctgtttcatgctgaggacaaagggaatacccaaagccaagtccatcactaatcttccaaaataacattaagctacaggataaacaaaagtttaatatcatgtgggtattaaaatctttgagtaagaccaggaagattgttcagtggatgaaggcacttgctgtcaagcaggaatacccaagtgttcacaggatatacgtgatagaaggaaagaaccaatttttataatgaacacatggacacacacatacacataggcacacacacacatgcatgcttgtacacacatggatgcagataaaatcctaaaaataaatgaacaaacaaacaaacaaattaagattagtacaaccacaaccttctaaagtcagtcaacataggggaaatcctagaaaactaatggttatacttaataaataccatgtcatttgaataaattgttttagcgtctttatagaaaagtgctatcaaatgcccagcagtccaaaacacagatgttccatttctctaaaagctaaagttatgaaccatctaatcaaaacaatttgggatgccatttttgtatgttcagagtaggcaagttttcctaagaactctttttaaaagcaagatcataaaaagattaataattttgacttcatagttaaatatttcttgtctttgaagtgattgaaggaaatattatatacaatgtgcactacagggaagtatccataatttatttatttagtggacaaggacaatttctcaaaatacatcaaaagccctttcagctacaaagcaagacaccaaacattccaatttaaataacataaagcattttgactccgtaatttacaaaagatatagagatgatgactagactcatggacaactgttcctcctcatcattcatctgagaaatgaaagagattgtatacactagcaaagactaacagtattgatgaggttgtagctattcacccaggataggaagaaagagtctatctgcaaggcagagtagatccatgatatgcatccactcctggaaagtgatcaaagagtcatcaagtgcttgatgaaaaaaaatatcatagcaagttaatgaagaacagtgtttacctttcttttccctaatgggatggttaccatataaagataaaaaatgttttttgaactgttagtttggccgtttcagtctaaggctgcatgtccctgtgacactgggtctctgataggaacatcagataacagttgtaaggtcgtatcatgaagagaactactcctcttgtgtgtcatgaaggaaaaagaaaagagaagaatggggaaccaactgactccatttgaggatgtgtttgccatgatccaaagactttttttttttactagcccttacctctccaatagctctccaagacctgttgtggtattcaccatcaagctatagccttacttatgactaaaaggacagacttatgatatgtaaaaacatcaaagtgccatattaaatccaatataatcttttcaaaatattactgtttaattctattcatatatgatgaatacaaggtgacattcaaatcacagcagtagaaaacagatcagaggaaatgtgatatttctcaagaaggctcattttgatttgcaagtggcaaggcaggatgctagaaatattctatattaactgtgatggtagaatattgatgaataaactcataactcatcaaactattatcttaagcaagtagctgtggatataaactatgtctcattaattttattttaatacttaccacagcaatacctcaagataccaaaacacatggccaactgtgggaatattctgatagaagagaatattattgggtagtcttcagatcagtgggataactagccaaaaagaatctatgaaagaaatctaatctaaatgatccaggataggtctaagaacttcactgagattttattaattcacaattaatcaaaagataggtattcatgattcaagctggctatgtaaatacttcttttcagtgtcttatttttcccattataactttttctgtttttaacagttccagaaacgcctaagcctagttgtggggatccagctgcaagaaaaacgttagtctcttggcctgagcctgtatctaaacctgagtctgcatctaaaccccatggatatgttttatgctataagaacaattcaggtaatgtaaaattccactagggaaacaaaatcaagaatttttaaatgttgtaattattgttttagccagggagctacaaggcttttatgaaggtgatgagagattcatgtttgagtttgcttagatgaacacgcatctcatggagaagaataaatatctagatcatttattaaaaatagtggacaggactagagtcctttagagcaggttactcatcaggacattcctttatctctgggctaaggtgggaatgtacttagctctcatagaatcctctctgcctttggctggaaggagccagacataagttaccaagtttgaaatctaaagaaccatttttctttgtatattctcctacatttcaatgacatcattttgctttattcttaaaatcattatagtcaagtgactaaaagaaagttaaggggcatgttgcccttagcctaagtgttatggagaagaagtataaatagtgtatttgtgagtgtgataagtcaaaagttatactgatagaactggagaaataaaaatgagggggatggaacaaagggctacttacatcctctgtttcagtggacctgtgccactgaaacagaggatatctctgtgtagctttttcagggatacattgtttgttttcttcctgttttttcagcatcttccactagtccattccgctacatttatattctgatattttctctactgtactgtttgcatatcagaacatttggtagagttaagtatgtctattgtttctttgaaattttatagtctaaaaatatctgtatttgtactgaatcacagaattagggtaaggatgggatgagctattaacaatttgaagagttttgcgtgtctgcagctaggataaaatccttctcattgtcacataaatatagcactgtccaaatacgatgcttgcacgtggtttaaggagaatggaagggagcttgagtgatatcatgtatcttttattctccaaaactatgagctgataactgaattgagcctccactctcaattgtgttgagactgccttaaagaccagtagaagccagtccctagcccatgatctgtgacagcaatcaaaatgagttgtctgcatctgaaggctgctcaccctctgttttctcacccatgtctaaggtgtactgcagtgagacccagtctatctaccaaggagatttaacaggatcgtagcaccattcagttctttaaactatgcacactggtctaggtgcaacgcccaattcagaatgcacaggtctaaggtcttggaaatgaatgcttttaaatctaactctacatttcatctcattatttctccatgcaactgtttcagcatctccaacagtccgaaattaagagaagggaaatatgtctagtattcacttctcttgtgttatcaggagattttataatgttctacacaaagttttattttaatatggtctaatatctcaagagagctgttcatgtgatagaaatcagctagtgcaattgaagatgatttttcagcaaccctaggtgggctgcttgctattgttacattcatgttttcccacatgttatatttggaggagctgcagctttatgtgatactgactgatcactgggaaaaaggagttttcagctttgtgcattcaaatgattgattttgaagagctactaaaagaaatgtgcacattttgacactgtgatgatgttaggagtcattgtgcatatcttttaaatatgaccctttagttgtctcttttgacattgcaaaaatcccttggctactagtatgtgttcagtaattccattggggtgagcatgtctatactgtttgaaatagtgctcacaaagacactttagaggagattgagtctggaaattatcagtttattacttctgatattttctaaaaaaataataactggtgggaatactgctattactttgtgaaaaaagtaaattgaagcatttagtggaataagctttcacttgtcacatatagtttgattctctgagacctcaaagtatttgtgttcataaaggagccaagaatgtttatgtaaagtattatggaatgtgtttaagagggttcttcagtggaagagaatcaagagaatgcatgtaacattattagattagttaatacagtctgagactgggttgtccttcagcgtctatctgccagcggcagagccataaaaaaacagtaactgtttggtccaagaggtttgtaacctcggaaaagagggaccacgttccaaagctggcagcctaaatggctcctgcagagtcactcgtctatgctgtgttcaaatcttaaaagcaaggatgatggcaacagggaaaagcacgctcagactttcaaccaaagcttgaaatatttagtaatttgaagcaaatattccagacattctaagtactaaaaatctccactagttacttgttttaaaaagtatacagatttattgttcaaagctaaaataaaaaatcagtttcatgtttgttacagtaggtaaaaatttaagcttcattaaatgacataatgaagctatgttttgatgtacaatgcttgtgaagtcacatagacaagcacaggaatttgggtcactaagtaaaatccaagcagatctggaaatcagtacccttaactctgggatattatcccagtgatgaaggcattaacctaaaaaccaaacacctgtactggggcatatacagtttgcgtgtccaatgggcctctctttccagtgatggccgactaggccatcttttgatacatatgcagctagagtcaagagcactggggtactggttagttcataatgttgttccacctatagggttgcagatccctttagctccttgggtactttctctagctcctccattgggagccctgtgatccatccaatagctgactgtgagcatccacttctgtgtttgctaggccccgcatagtatcacaagagacagctacatctgggtcctttcgataaaatcttgctagtgtatgcaatggtgtcagcgtttggaagctgattatggggtggatccctggatatggcagtctctacatggtccatcctttcgtctcagctccaaactttgtctctgtaactccttccatgggtgttttgttcccaattctaaggaggggcatagtgtccacacttcagtcttcattcttcttgagtttcatgtgtttagcaaattgtatcttatatcttgggtatcctaggttttgggctaatatccacttatcagtgagtacatattgtgtgagttcctttgtgaatgtgttacctcactcaggatgatgccctccaggtccatccatttggctaggaatttcataaattcattctttttaatagctgagtagtactccattgtgtaaatgtaccacattttctgtatccattcctctgttgaggggcatctgggttctttccagcttctggctattataaataaggctgctatgaacatagtggagcatgtgtccttcttaccggttgggacatcttctggatttatgcccaggagaggtattgctggatcctccagtacaagggaacgccagggccaaaaaaaatgggaatgagtgggtagggaagtgggggggagggtatgggggacttttgggatagcattggaaatgtaattgaggaaaatatgtaataaaaatattaattaaaaaaaaaacaaacaccatgtaaaactatagcagggtccgtgggtagcaggatggtatctgacatttcttgtgttcagcattctcagagagaattctcattatgtttaaagcagactagaggagaaagtaacagcagtgtaccccaatagacactactagagaaactacttcctcacgtattattgagacttccattgtgatatttcacatagaaagtcatttaacagtaagtatgtattgaatcttttccaaacactgctcctgaaagcacaaagacacttctaaaaacagcaaacaagtatggtcttgaggcaaagatcaggtttaccccaccataggcattcatttcctactttgttccagagagcaggtgaagtggtacaggtagggctcaaagtctagatgtcaatttcattttcctcacatgaggtcatggcaagtggcttaatttctctatagctctgttttctataaaatcatatgatatgacaataccaactttacatccatgatgatggctaaatcaattaatttttgcatcatatgaaatggtgattgccacatgtagagagccattgatcacttttggggattattgttatagtgttacttttatgttattgttacttctgtctaataacatgctgcttaagatttctttgctatatttctttctactcaaaatgtcaatatgtgcctaatgatttttgatttaacacaaaccagctctttatatcttaaggtacattcgtgccttttactctcacctttatgtatattatgagcatctgctatgctagtcatgtttgtccatgagctcataatacccctcctttcaatttgaatgttttgtggcaattcagcttaatactaacgtgtttgtataatatgtataaatccatggattagacctttacaacacaaaaataactaaagttttctcttccaatctatttgatttcactcattcttccatgcaaagcctagattctagtatcaaaataaactcgtctctcattctcatgatcccatgaatcaccacagccttaaaataatctttaataggaaacctagttactgatgatctgatggcttcttccctgaaagtctatcacactagctcctattgatgctctaaggtcagtgtaaagtatcagaaagggtgtgaggaaaacatccattctaaaatattgcaacttaagattttgtagtattctctggggcttgtgttatgtcagaagagaataacttcacaaatagtttattaaatattcttttcagcacattagtgatataagtcataactctggataatttgaatttattatgattttttgatatatttgtactgttttcttatatatatatataattaaaatacattagatcatttcccacaaccctctccatctccgccctattatacctctcctatttgcctctcccaatttcacagcctcatcctctttaattgttgttacagttacatgtacacataaatgtataaacataaaatataaccatctgagtccattcactattgcgcgagtgcctgtgtgtgtgtgttttagggatgattaattgatatcagactatcagataaccaatcagaagaacattcctagtgaagatgggtcatcctgatctcaacagctgttaataacttgtatctagttgtttaaggttggacacaatgagatctctcccatacaggttggaatatcatctgttgttagaattgttcaagtctcattaggtagccatgttgttgagattttatggctgtaggattcctttcataactggaaaacacaatttcacagtagacttcatggtcacctagcttttacaatttttctgcttcccctcttccttgatggtcactgagcagatccatcaagtagagctgagcaatctcttgtcagttgtttcccacattttgactgattatgtctttctgtaatagtctccttatgctacaaagactgttctttgatcagaaatgagaactagtgataagctttcagaactcagttaggcagtagactggttttgggaagttccagaggtagcattcttccagactatatgaccaaactgaccaaattaacctcatgtacttgtgtgtgtttacagtaccaggtgtaattttcctcctgttaagtgggccttaagtccaacttaaatagctattacttactgccaagatatgagggccactattgtacctttagggatgctgtgctgtgctgctctttgttgtggttcataggtattcacagataggtaagactattgattaatttcctctcttagcagtttgcacatcaccatctggtatcatgaaagtcatccctcagggaagagacttctgggtcagttctagctcaagccctgactcctatgtccacagaatatggtttctttagtaataggcacttcccttcaacttgtgggtaaatataaagtactaattacctgtgttctcttcaaatttatatgtcccccatcctaccctattcttctgtattgtcttctctacgcacaattaaagccctctccacatttctcatcttcctcttcatgtcacctatatcctgcccttctgccctttccctctctagatgcccccttccctgtcctttttttttttttttttaatggtcctggtttctgcagttactctaggttgtatacacacacctgaagatttggagctaggagcacagactagagaaaacatgttgtttttgcctttctgtataaattccctcaatatttggagtctgcttgggatcatattatgtaaacatcaagttatctgcacagggatcctgactttcagaaacttactaactcaggctttctttttaattctagaaaaatgtaaaagtttgcctaataatgtgaccagttttgaggtggaaagcttgaaaccttataaatactatgaagtgtccctacttgcctatgtcaatgggaagattcaaagaaatgggactgctgagaagtgcaattttcacacaaaagcagatcgtaagtttttggctttaatatttcttccatgaatggcaaatgacatttttatgtgaaatgcattgctctttctacttctgctggcacgtttgtttacttctgaagttttaaataatttaatagaaaattatttaaccactgcaaatcaaggttcactgtatctatctgatagagtgacagagttgaagtaacaaagcaggaggcctcaccagccagtgtacttcctaaggcttcaaacacttaattaagcatctcagcaacttagattaaaaattctcactttagtatctagaaacacaaactgcagctagacacttaatgatgtcctacagaaccctgatagaacatttcataatataaagcatgttttggtacttatttcatgttatgtttttcgctggaaattttaatggtcttgcttctcgtgtggccttgctgaaataaggctaagttatgtctccctggtaactgcttaatctcaattagggtcagggaagaagaaagagtcctggagtaaggtggaatctgtgactacatgacctaatggacaccagattcctggaggaaagttgtcttcagtattacaacactctccatatcatctaggctcacataatcccatcattagctcaggaacatttggcatttgataactacaagaaaaaggaagtcaatttcctttaatgatgtgatctttgataggctgaccatgtactatggtgagccccaagcccaagaactagcttgatggggaaagaagaagcaaaggaggaatctcagagttgaatgggaatgggtggaagggcagagcagatgggaagaggaagggcttggctgtgtatgtatgaaaaggctcaaatatatattgtaagacattctcaaagaatgaatgaaaatattggaaaatttctaagtcctacagccatatgctcttgccttttcaggtttctgggatattaaaaccaaggaaagtgattagttgcttgaaaaaaaatctcacttggtgttgagtagaataaataggcacaagagaggaggagggcttgggccgtacaggagaacttaactgtttctcaagcatccttcccggtccccatccttctcacttctcacttcttctcactgctatttcattccacgtcctgttgtttagagattgtgcacatacttagcgcttcaagcatgtcttctgtgttaataatgaataagtgattttaaaataattttgaatctgtgtttgtgtgatgcagatcaaagttgagaatgctttacattgtactcatgcttcaaggtatttaaacttttacatgtcaaaatattaagataacaaatgtctctttattttgataggtccggacaaggtcaatggaatgaaaacctcccggccgacagacaatagtataaatgttacatgtggtcctccttatgaaactaatggccctaaaaccttttacattttggtagtcagaagtggaggttcttttgttacaaaatacaacaagacaaactgtcagttttatgtagataatctctactattcaactgactatgagtttctggtaaggtcatgtgttccttattcacagtcttcccgagatatattatagtgtttcatacttagtacttgcatggcattaatgatagtgctcacatggacttacggatctctgatgactcgtgaaatcaatgatttagaacatcagcgatttgatgccaagtgttttctctctggattgaaaagcaattctaaatggcaaacctttctcaggatatttgctacttcaaaatgacttaactgtaggggaaacatcgttcatgtgcctgtgaggaggcatttcctgagcagtggatgttcactttccgtatttattttcactaagttttcaactacaaaatcttaggtgtgctttgaggttagaaaatactaaaacaaattaaaaaaaaacatttgaacataaagaaccttaagatacctattatttcactgtgaattatatattatatagatatttctgttatttatttgaaaatttctatgcaaatcataaccattttaaagatagcctgacattttttctgtattgttttatcattaacatttttttgttatttaatttccaatagttacatggagttctaccatacagtttttactatatgctactaattacaactatactgatctataacataaacaacatttgggacctatgtctatgagtaaatagccatgtttctactcaatataaagaaaacttagggaagagaaatctggttttgtcttctagtttgaaggaaggcatcttggcaggagcctgatgtaactggttacattgcatctgtattcagaaaccagagatggatattaatgctcagctcagcctcttactattactccacttaggaccatagaccattgaatggtattttggattggtctccctaagcatttaacccttctcctccatacacatgcctagaaatttatcttttaggtgtgtccagatctgtcaaggtgacagtaagtactaactagcctaagtccacttgcaggtaacttttcataacctattgaactcaccttgtctttaccttccagcttgctcacacatagtctccaccaaacttcacattttcgtgtctctcctctctcttactggagatctgaataagagcagtagctgtgctgtagcctgaaagttgtgctgtcttgaaatttccttcaccaaagaagttaatccatttcttttgggttctcttttactcccagccatgggcagaatctagccagattctttgacaaaatgtatcacgtacatgatacactcagccctggactccctcccacctctgatagtcaatgaactgggtccttactatttgcctttctcttggcactatggtcctcgggttcctatcagaattatatattttgttctacttagaagcattctaggccttctctagaatgaaactctgaactcttctaccttctttgcataaaccagttccaaaggaatgagaatcatgtgctcaggcatatcacaacaacgcctccattccttgaaggcgattctctttgtaatttttactttatttatgaaggcacatgtgtatgtgatctgggtatatatgtgctagagtgcacatacatggaaggtaaaagacatatctggaaagtcaattttctccttctaccatgagatcaaggggttagacttaggttgtgagacttgtgtagcaagatattttatctgctgagccatctttttagttcctggcttcctacattagctacttgtcttgttgctaccactaaatacatgccacgttaaggtaaggatgaaagatcatatttttgctcacagttggagggacacagaacatcctggcgaggaagggaaggtgacaggaacatgaggcaactggccaatttttatccacagatgcaaagcaaagaaggaatgttaaacatagtttctctttattgttgagtctctttattattactactaataaataataaatattatatattatataatctagcatggattggtgctacccacacttagggtaggtcttacccctcaattaatcttgaaactccttcacagataagacctgagttctccccatctcccccataggtaattatagatcttatcaatttgacaacagcattaactatcacaatataatcttaacagtggacttcaatataatcttaacagtggacttcattgttttttcttcattccacatgtttttgtatatcaccttttgggattatacattttgggggagctaaaaaaatgtatttttaatttattttttacactccatattctattccctgccttctacccaccctcccactgctccacctcctttccaccccaccctgtctccatgtggatgggaagtcctctactgtatgtgtgttggatacctcatcagctggtgtatgctgtttggtggtctagcatttgaagatctcaggagtccggattaattgagactgctggtctttctacaggattgcccttctcctcagcttctttcagccttccctaactcaacaacaggggtcagcagcttctgtccattggatggatgcaaatatctgcaccagactcttccagctgcttgttgggtctctcggagggcagtcatgatgctccatagcctcagtaatagtgtcagggcctaggacctcggctgtagttggattccactttgggctcaggctcttcttctccatttccatccttgtacttctttcaaacagaaataattatgagtcagaggtgtgactgtgggatggcaacccacaggactcacttgatgtcttgtcttcctgctggaggtgggctctataagttctctctccctactgttgagcatttcatttaaggtcccttcctttgatcctgggaatctctcacctccaaggtctctggtgcgttctggagggtccccaacctcctatttcctggggttgcctgtttacattctttctgctggccctcagggtttcagtccttttccctcacccaataccagatcatgttcccctcttccctccatttccctccactgggagggaaagtggatgggatggattataaattttaacaagtagtagctcacaggttgtgtgtggttcagctagtctggtatccagtacatgctagaatcctgaagaagtagactctaatgccagagacagaataggttgttagcaagagggagggcaagcaggcaaagaacaaatgtttccttcttccttatcctttatatacatttccaccaaaaggctgtgattcatatttaaggtaaattttatcccctccaaaaatatggacttaaattgggtatttctacttcaaataattcaataaagaagaagaagaagaaaaaaaagaatccttcacaagtgtacctagctgcttgggttttagttaattctggatgtagtcaagttcataaacaggaatattcatgacaagtagtttggaacacacacacacacacacacacacagagagagagagagagagagagagagagagagagagagagcgagctgctttaaatggtgctgaagtggtatttacattgtatgacttactgatatggtgaattacagtaactgattatctaatgcaaaatgctcttcatattccaagaggaaaaatatttcctcctttcatagtacattattattttaatgtattattgaataaatatcttaatattttattaattccatggattcaccaaggaaattgaacaatagatgggtagatgatgtgattgacatctgtgtggtatgcagaacttttgttgcatcttggaaaaatttcactcttttttcagtgctgtataactttcaatagcacaaggatgattagtactgtagatatccttttagtccatttaaaacagaggcattctttgagaatcatctacattgcctttcacaatcattggttctagcagatatcctcttgactgagtgtgccttttctttcgggagagtattccatatggagaaacaatgtgctattaccaagccattctgcattctgttccattgagcacagcttccccagtggccacagagctcttggcacagtggtcctttagtcccacacacactgaagttttatcttgttaataactttacctgtggcttgcctctcttcctaggattctctttttcctcttttcaaatgttataagttattctgggatctatgagggaacattataaacataaaattcaaattaggagatgatttttagttagttattccttctctaagtgtacaaatagctctctggttttcttcatttcactcaccataacatatttccgcatccattaatgtccctaagacaacttgcacactctcatgagagtataatcatctctattcagtataaccagctccactaaaaatatttatacttgttttgttattcataatttatttctagtgatttgttttgaggtgtttttcttgttctagcttctttgtttatataaaaaatcattttgatcattattaccatggtttgggaaaaaaaattcctccatggcttgtcggttatatctaaaatcctgccaaaagaatttaatggattcttaaagacaatggtttgttctggaatatatatatatatatatatatatatatatatatatatatatatatatatatatatatatatacatatatatatgtatgtgtatatatatatatgcatgcatttgtggctcttaaaattttattgctgtgaattttattgctttgatatcaagttgattttcttttttatttgatgtttatgatcattttttcaacactgtaatttttcatgtgttttacccttaaaaacatttgcattctacatccaactcttgtagatagcaagtttactttagaaagcatgatcatactatatcttaaagtactaagccttggtttcattttctgaactttttcatttgttcctccatttttatttattactgacataattactaaggttgataaacatttttttctatctttttgacagcatacagcaaaataacattacagtttcagatttaactcagtttttgatggaaaaaatcagtgttctatgagaaataatgtacagtttataatatgccatacacacatatagtagaaaaccaaattcttttctttttcttaactgaaatttaggtctcttttcacaatggagtgtacgagggagattcagttataagaaatgagtcaacaaattgtaagtcatcctggcctattttttctacctctatatgtatgcacttgtttgaacaaaactgttttattttgcatccatagattgattcattacctgcttatatgtattatataaatatttgaaacttacaaaaattacagtatcataaaaatcaaattaatagatttgatcacttggtcaatatgtaaatgttgccttaattacaagttttaagaggatttatctgcacaaatatttttggtaacccttttgaatgagattgctttcttgactataatgttcataaatctgtgttgctgctgtgtctgctggttacgttcagattgctaagagactttaagtgtctaaggcatcattattgacaacaagacactaaaagcaggtttggggtcatgaatagctacatctctctgtgttctacacactctacagtttactggaaccaaactatttagcctcatttcaggaattaaggagctgaggtgcaaaagtggtgggtttctggccaaatttccttctagggagtaagacctaaggttagaaacttaacatcctggctctggggttcaaactgtggtgtcacttcacaggtgtagtatatttccatgaatgaaaaggatggtatgtaacacaggataaagacattgccaacagtactttgctctgttttccctatgagtgtgatgcacactggttctcagtgaaagctcgagctagggaaagcattaatcctcactgtcaaatgaaataaattttgtctcttggttaattggttttattccccagtgaacatgtaagagatttatctttgtgggatagaagcttttatgaatcccttaggaggctacctacttttgtgctgagtggtaaactataagttcctttctgaaaactgtaataactacattacctcattgattcctttaaaatgagtctctgaaagggaattaaatctaagtaatagttttctacaaaagtacattatttaatgaaaagacatggaagtactcatctatattctaattagtctctttaagtataaatgccttgggaattttgaaataacagagcctaaaactgcaaaatcaagattttaatgtgtttcattttattctataaatttagccttgacttcacaataaatgaaaaatattaaaattctaattcatgaaggttactcttgttctagcaaagtatttgaaataataagctcttttgtgtcactttctatttctagttaatgctaaagcactgattatattcctggtgtttctgattattgtgacatcaatagccttgcttgttgttttgtataaaatctatgatctgcgcaagaaaagatccaggtaagagacagttaattctgaaatagaaggcactggctgttgtaataatgtttcaaactggcatccaaaattcattgcccgagcaatggactagaaaagatagtataaacttagttcacatcttaatattgagtcaagtacttaacatggaattattggcttcctgtaagtacttatattctctatgtttgctaatggtagtgtaagcttgttttcacagtaataatcagtgtaaagaatgcatatcttttaatcctcagtggatgaaagcaatctgggggcaacaattgaaaaagagggaagttgtgggcagtgtgttcatttctttgcctaagaagataaaattttatggaaaaaaatgggagaattcacttaatttctcattcttctgaaatttgcaggcaattcttggtttctttgctcccactgctttctgaactctccccaagttcctgttttcccttttcagttttccatccttcatcctcttttctctgctacctctcccctccccctcttctgtgaccctcgtctgtacttgttgctccaccgagtgcatttataaattgatattttctcagttaagctgagtgccagctgaatgccatattcttgcaaagacagaaacttttattttattttattttattttattttcacagcaatttagatgaacaacaggaactcgttgaaaggggtgagtatgaataattttggctgatgaatattatttttctgaacttgtgttcacttatcttaaaataagggctgggcatctctaattcaacctgggctttgtccatcgacaaaatgaaacatatgtatctgttctgaaagtagacatctatgtgaggttttcaatcacaataatatcacaaatattatccatggcattgaaaatgccacagtgacaggccatggtctctgctcttcaagggcagaatagaaaagaggaagccaggtgtattgataagtaaaagagcactgtggtaaatgttgtagctctgcagcatgcatggtcctgcataaagataaaatatagaaaactgtctgtggggaggacaggaatttggtttggtaaggatgctgggaaacatcagaccatttagtgaggaaggaagatggtattccacagtgatgctatgatatggagtgtcttcaggttttggcagggtgtgatggtggatcctcccactgaaggcccagtgattactaagacactttatataaaaaggacacgccttcttctgattgttatataattactttagtttttaaagacaggatccaataaaaatcattagagatatttaaactgtgcttgtaataaagtatttagtttttctcttatttatgacactgaattttaaaatgtctctgtcttgtgttaccttctgtatgaagggtttccttcagacaacaggagataccacgctgtgcacaacagcttcagggcttgttctttggagctctgtagtttaggtccttgagactatatcacagcctgacatggctgtatttcttcacatatttgtttaataccctcccataacaaggctgcacacattgggaaggcagagaggttcctttttgtttcaatgttttctccccctgggtcaggatattgaaatcagtgcatgccaatgaatagaacaagtcatcaagatcacatgtctggaggagtgttagtcctgttagactgaggggagaggcaggaagaaaggtctagccatacctgggcagaaggtcaaatatagtttccagagttaaggtggattggaagtatagggtgttttctcttgtaattagtacaagggatactttagaacttacccactctaaacacagccaagtcagcctggctgaggtctagacatctcccatcactgagaggaactggccagagagacaattgtgtttgaaaaacagagtttattgtgagcagtaagataagtatgtcacactcatggacaacttctttctgcatctgacaatggggacagttaatatgatacccatagcaagaaccagaaacaggagatgggtgactaggagaaacatttccatgtgtgacagtacaactttcctgagtcttttaaaactgtggtttctggggttggacagacagttcagaggtgaagagctctggcttctctggaaaaaggctctgggttagttcctaacattcacttggccacttaaaattagcctaaaatccagttccagggaatcagatactttcttctgtcctgtgcgggcatggcacgcagatggtgcgtgtgcatacagggaaaacttatacacataactcaaatatgacaaacatatctagtaaaaactgttttgtcaagttttgtatgcaaatataacgtgttataaaaattctcataaaggacatgattcaatgggaaaaaaagggggtattcagtacacatctgtattgtttgtttgtttgtttgtttttctcacagaaagttatactactatctataatgttttttctttcagtttttattctggagatacaatgtgaatataatgaatataatttatttgtcagaatagggtaaccaaattaaggtgaatagtgggcagaatagtattaattattttctattgtcatgcgtgcaattatagtattcaacaaaagttaaaaataaagtctggggtagagttcctgtgtggatagcatgtctagcacccatgggtctgatggtgtgtgtgtgtgtgtgagagagagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggaaagggggagagagggagagagggaggtaagagggagaaggggagagggagagagggggacggggagagggagagaaggagagggagagcaaaaggcagaaatgaaaagaaagtaataatcatggcatacagaaatctgtcagttactacaaattgaatgtaatcaagcaaaataaatgaccgtctaacaatgataatatttggtcagggaccttttatctaggcataggaaaaataggtactcattctcatagagggaacagaacaaagccagaaaaagactggggtacaagatttagaagtccttaatttataggcaaatgtctacatatgaatgaaattccctgcacagatagggagaagggaaatggctgaggtatgaactctaagtgcatgcagatctgatggacagacagacagatgaaacacaggtctcacctctaacttgtttacagatgatgaaaagcagctgatggatgtggagccaatccattctgacattttgttggaaacatacaaaaggaagattgctgatgagggcagactgttcctggctgaatttcaggtatgagttgtccttgacagagggtaagaaagtccacatagtcttcaagatgattccgtgttgcatatatatgcataaccatttgccttaataatttatccaccgggcacagaaatataatatagtcatacgttactgcaatacttataggtgagggattcagagagggtggccaggccactcacaataggcagctgggagggtttatagcataatgctctggtgcattttatctgagtgtgaagtcctgtcgcaaactggcttggctcctttgtccttgagttctcgatgactacctaattatcagtcactaagttattttatattttccatttaacattaaatttcttttgaaattaaattaagtttaattgttctatcattaatttctttaaaaatatgtttttccccagcaattcataataaagttaattccaaatgtaccatgattgtcagtataaaggatatattatgttaccccatttacccaaagtgataactgataatggataaaactctgttttctctccctccctccnnnnnnnnnnnnnnnnnnnntccctccctccctccctccctccttccttccttccttccttctttccgttttctgcctcgctgcctcctttcttttcctcccttcttccctccctcatgctatcccacctccttcttttgggaatcttctgtaacccaaagaatatttgtatctttcagagcattccacgggtattcagcaagtttcccatcaaagatgcccgaaagccccacaatcagaataaaaaccgttatgttgacattcttccctgtgagtggactttggaactgagtttctgtgttttgacaccgtatggctactctttagtttagtattaatttctttttctttaatcagatgattataaccgtgtggaactctctgaaataaatggagatgcagggtccacctacataaatgccagctacattgatgtaagtaatgtatgtgctgggcttccttttggcttcttttgactgtcagaaatgtttgttttctttacatctatgtgttttacttagttcctcaactggttttgcaagaatttaaagaagttattataaatatttaaagttaagcccatggcatcactgacaccaaaaccaaaatccattaacgtttacgaagattgttagatgtattcttgctggtgctaggtgtaaaatagggttttctcctgatgaaaattaaaatctcctcgttgtgcatgaaagtatctctgcatggatttttcataagaactctgcatttgctgcagccgagcatgctatgcccactaatacatgagaactggagaactcgagtactttagttattatgaaactgtaatgaaattagggaaggcttaaacttgagatggagtttaggtctgcctaagcccaagctggcgtgcttctgtttactgagcatggcagcagtttctccattggtgtgtccatctctcccttgtagttatccaaattgaaaagatctagacaaaacttagtgatgacatttacaaatttgacatctataagtcttaaataaatgggtttcatgtgagttcaagaattttacaagataggaaaacacatataagttgagaacatgtctttagccaatatacccagtatctccttctttcaagagagtgttcatgtttgtacatgtttcttaacaggaaagtaaaacgccaaccttcattaagacttttatttataaatattatatccacaccatgatgtagcctgctattttctgaatatgcatataaaaacatacataccttagatgtgcatatctgtatacatataaatctatacatagtataagtggtgactctatagccatctaaaatatttatatacacatagatcgatttttctatacatagaacacatataatagtactccaaacagaaagattacagattctttctgtaatggcccagacagcaaataggcttgacttttcagatcagagttaacttttgtcataaatactcaagtcttgagtggcccagcatcccttgaaggtatgtatattggctagtcacaaaagactttaggtatgaagttagatcttgctagatttgctctcaggcttatctatttctttcttgttcgtgttacaaaatacatgaagaggacaatttaggctcatggtttgaagtatactgtatgactataaggaaggtgcatctgcaggagtgtgggtagccaatcacattgcatctacagtcaggaagcaaagagacaagcgctatgctagggctcctgtgttctttcattcagtgaaggacttctatcaaggcaaatgaccagtgttacctacaattagggtaggtcctaactcatttaatcttctctggatactcccctacagacatgtgcagaagtttgtctctaaggtgatcttaaatattatcaaattggcaatcaaaattaaacaagtacagggtaacgggagcttgaaagatggctcagcagttaagagaactgcctgcttttgcagaggatctaggcttggttcccaccacccataccaggaagttcacaaacacctgtaacttcagttacaagcatttgcacatatgttgagtgtgtatacacacacacacacacacacacacacacacacacacttgaaaaacacaaacttcaaaaagattaagcatcacaagctataatttgttccccagacccaacaaatttttgcatctttttaagtctgcttcatacatttctactgctacaaagaaagatgcagtgtgccatcttgactcatattattacagtgtgggttttaatttaatttatctatagagtaaatttctaaaagagaaatttcaggtccaaggaatccacataattatgtttattttttttaaagatttctacatggcagcagccctaacttacaatccatctgcaacatatgaatgtgtttgttcatattttttaaaaaatgtactattgaaaactaacttaattatcttgtatgtgataaagtgtgttttatggtatggtatttgctgattaaatttctctgtaattctcaaacctttttacaaaggatggcagttgaagttgaggccttttgttattattttgttttgcttacatgaatgtgtaaaattttattgaagtataaagtcaaatttcaatttatcataatttatattatgatatattacatatatcataatttatagatatttgtttttgagatctggaataaaaaaagatcacaaactagtaccatgaaaataacataaatctattctctgagtccttgagcttagaaatctcaaagcatgctctcaatataatcatgttcactagaggtctcatgggaaaattcctatttgtactttctggcttttggacgcttttagctctccttggttttgctggataatggctggctctctctactctctgcctccaccttgtggccttcttccctcttacagcccctgtaaatttcatgttcaccccctgtcacttaaatggaccctggtcattgtccttgagatatcctgttaactctcagatccacaaagacatttcatttaaaggaacagtctgcagttgcagctaagtagaaaacttgaagacaagaatttaatcaactgcacagtctattcaaaagcataaactaatttggaaatactttcttgttgaaccactcatgaagcatatacctttgtaatcgctgtgtttatcattaataaatttactttgtaagatatcttatgggtttccagagccaaattactcacataaatagttatgactctttgttaacaatactacaacctactaagtgcatttgttgtttctcgaccatcatttttaatgatttccacatattagttaaataacacccacaactcactgtgaaatagtcccactttctctgggagaaccagaattgtcactctatccttggtagtctctgaagacaacaactaaacctgtctctcatcaaatatttttgatatctaacactttttgtattatttttaaaaatgcatattcctgttttaattttaccattaatgtattaattttacatataaacaacagaccccctcctccccattcacccctcatacagaccattcccccatactcctttccccttctcctcagagaaggaggaggcccatccgggtaccaactttagcgcatcaaggcacaggactaagaacacctctcccactgagaccagataaggcagtgcagttaagggaataggacccatggggcagcaacagaaatagggacagcccccactccagttgttggaggaccagcatgaagaccaagctgcatatctgctacatattaatgaggggtgtgggtctagcctatgcacactttttggttggtatttcagtctctggaagaccttaaggaatccaactgagttaaagatgaacctacatgtgccaatgacttccataatataaactcctatttccattttacatgttatccgcaaagcttgtttccagaacaaagcaacactttcagatgtgcagaatagtcccccgaaataccataataactgttcctaattttcacctccattcgaactgatttgggcaagtgtcctctgcaggacagacaattagtggtgaacaagttttgtataagagtacacaagttcattttccaaatgtcttgttcttcaaagaaatgtaattgagagcaaaattagcaatcctagagatttttttcaggacttaggtagactctagaaataaatagctatacattctgttcaaataggtttgataattatggggtcaagttataattatgtttctccaactgagctccaatgccctggaaagcagatctcctcagctcctagacaggtagtaactaagcatgtattagatgaatagatatatgcacacaactgaaaccatcatgaaacttacaaaaatgaactagaggttcatataactgatatgcaaagtttcaatcaatggcaaagctagcacatcctgtggaattttcccattaataaagtaaatttatgctatttgagagagtcttgcaaggaattagcatatttcatatgcctctgtattgcttccttatcctaaccagtgaagcagagaaagcagtcattacagataatgaatgtttttattttcatatctggaatggcataaaaggactctagggaatccacagtgtgttccagcaatagttaatatgtggaaatgtaggtgtgctcccagagggatttagtgcaagaaattgagcagaactctgaaaaggaacccccatgactggtgaaaaggtctgaatagtaggtgattctgtggggtagggggtttatcagaaaggaaaggatgaatttgtcttgttaattgctgcaccatctcagatgagacaaagtgtaattataaaagctgtttggagtacttcatggcaaaaatatattcaggtcatgaatcctgtttggaaatggtagctaacctgttcagcaccattaaatgtcttgttgcacattaatcctccccctgcagcaacctgaaaatggccatgtgtttacaaccatgacagagctatatcagcttctgattcacagtattttgtgttaatgattaagtgttccataaatgactgttctctttgtgtgttttgatcagggcttcaaggaacccaggaaatacattgctgcacaaggtaattcattttacatcttgcagtttctcctagaaacttgttttatagcacttctgaggattggataacttgtacttaactcctagggccccgggatgagacagttgatgacttctggaggatgatctgggagcaaaaggccacagttattgtcatggtcacacgatgtgaagaaggaaacagggtaagaacccagaaggctggaagttgggggtgggaaaaagaaatgctgagctgcatttggtataatttatgcagacaattttctgctttgaccttgctaacattttatttcatgtgtgttggaaaacacacacacacacacacacacacatacacatacatacatatgcatatatatgcataaatgtatgtatatacgtgtatatgtatacatatatgtgtgtgtatatatatatatatacatgtatatatacatgtatatatacatgtatatatatacatatatacaaatgtgtgtgtgtgtgtgtgtgtgtgtgtgtgtgtgtgtgtgtaacttttaagtgaactgattttgaagctcatatttgatattgtaaatttcagacattgttatgtgacaacttcacaagtatttatgaatggccacagcaaaaactgatgttgcatagacagtggacactcaagtaattcaatgttggaagaaataaaaagcctataagttcctgaacctggaagtaaccacttgctagcatgtcacctgtgataatcctttttgcagtcttcttgtgacagctggcaaaggctgggcagatcatccttctgttacttagttaagagaaaccattcagaaacattaatgagaaataaaacacatttcagctcaaggtgcacgtgttatttaaaaagtgtgcaagtgtttgggggaatatcagttgaatacatttttggttattggtgttttgggagtaagctggaactgtattacaatagactagagtcattaatgattcttttaaactgtagaacaagtgcgcagaatactggccaagcatggaggaaggcactcgggctttcaaagatattgttgtgacaatcaatgaccacaaacgatgtcctgattacatcattcagaagctgaacgttgcacatgtgagtttgtctcattctataactttgggcttggtatggctttttctaagagtgcagctaaggaatgtaaaatgtgaggaactaaaacacatctgggaaaaattatttttaatgatcttcaggagaaagagtcaggtgaaaacaaccatgaaagctaacaggatcaaattttaattgctgattgaggcattgtttgtctgcaccaatcacactcttccactggtcctttgaagtagtaacaaacaggtccccaagatgtgctttgtcagggacaaggttgttaagtggaaaaacaaacaatcatggttctgagtagtctctctgaataatgggaagcatattttagaatatggcacattgtatgagcatattaaaacatactaagttataactatacaagggggagagagagggagggggaagagcaaaggagggagggagggagggaaatattttgttcagcaaaggaagaggtcaacatggtaagacttgaaatagaggtcatctcttattatgcaattcaattttctggaaaattctagatatgaatacatgaatacagaacatatgaatacagaacatacatcaggagttgccttaggctcagagtgtcagaatatggagtgagatgagctcagactttcactttgtagtgccaaaatgtttttccattacatagtgatgaggtaccattctggagtttttgattcaccatgtataccctagtaatgcaattgaaatttccacactttatctgagttaaacatttctttgaatcctacttttggaggctcggtaacctgaactttattaatacacgttttccccgggaaaacaaatcaaaacaaaacaaaacgccatatttgctgggtatttctcctaaagccctctttgctctgatggcatccccccctgctctgcttttggggatgaacaatcctgtctaaagccaatagaaaaatgcatgctgggcaagggatgctattgcatgtatatgggaactgtacagaagccaatgcttatctactcactgtgattattctgagctatctgttctaatgaatttatgtgttgtctattggaaagctaaaaagaaaatattatcttattagttatattttgaaaggcggtaattctctgggtgagaatctatagagcagaacacaaactaaataattaattatacttctccatgtgggaaatagtcctgcttgctgggaaaccaagtagataaattctaaagagctatgtggatggaatttactcagtatacaaaactccgtctattatggctctccgtgtcttagggttttttttatttttgttttgttttttgttttttaaactttgacttcatagcacagaaggtccaaggagtttctactttattaactctttctttatccgctcattactggtttactggtcagtgcatgtgattcttagtctgacttctcatgaactgttagtagtgggataggaaattcagttctggaaaagcaaggtagagagggtctgaggcaagggtttggagatacttacagaaggaacctattgtacaggtcttctgttttatatatctgcctcactgagtttgttttgaaagaaactttctcaaagaatgccttctctcttgagtagaaaaaagaaaaagcaactggaagagaagtgactcatatccaattcaccagctggccagaccatggggttcctgaagaccctcacctgctcctcaaacttcgacggagagttaatgcttttagcaacttcttcagtggtcccattgtggtgcactgcaggtaaagactctgtagggcaagtaggcctgtcagtgtgtccaaccctttggttgggcagttagggagatctttattagctagtgctattttgtaaacaatctgctaagatgaacttatatttatttctcaaatagttgtcttatgaattgacattttataattccatacatttctgggggcataaactgacatgttttgtcaattaaatagcaagctcctgaaagtaaaaatggaatttttaagataaaattgtactattgcttcttcttgatggttgtttcacttctcccttgtgaacatgactcacacattttttctgttattttttttaaatgcatgtgtgtgtgtgtgtgtgtgtgtgtgtgtgtgttatctgtgcctttgtggtagcggtggttttaggatggaggagagctttattgagcattatgaattcagttctttccttccacctttaagtggaattcagggatcaagttcatgtcaacagtcttgccattcaggttccttcacccactgagacatctggtatacctcacaccttacttttctgtttgttcccttagtgctggtgttgggcgtacaggtacctacattggaattgatgccatgctggaaggcctggaagcagagggcaaagtggatgtctatggttatgttgtcaagctaaggcgacagaggtgtctgatggtgcaagtggaggtacagtcttagtttatgtgaataggatacctgtcgtttgggtatttcaatcttctggggcagtagtgaggagcttaaaagaaatgcgtattatttacagattcaaatagtgaaagaagatgatgttttaatttttgtaagctaaaatgagctaattttcatcagaagctccttgtacttgtagaagtatataagtggaagcaaggtgaacttaatatagtttctaaacaattaagtcatttgcatgattgagcccgaagagaaagaacatagcattggcaacttttcataacactgagcagacaggataaaataaaagatgggagtatcttttctttatctttccagacatggtcagtccctgtcagcagtccatatggtcttaaatttgcagcagaaatcctgccctagcctctaaagtgctagactaacaccacacctgcaagaacctggctctttggattagagctcagaagttcaaataaaggccccaaattactcattttatgcatttttggatttcttttaatctttcaatgctccagataaaccacccataaaatgtaattagtgctgagataaagtcagtatttgtctcatataacaacaacaacaaatggttaaaaggaaattataagttgaagcacttaggcatctttggggcatgtgctgtgtgtggcattcagtaattggatgaaatagttactatagaaaatgtctgtttggcaacactacatgtttgtctgtgcaaatggccataaccagaaacaggtgcaggaatgctccctggattttagtagttagaataacaaaatattggaaatgctctaaatacctatcagtgggacgtgaaaaatcacaacaaattacttctggtgttgaagagaacaatcgagtgtgtgcctgtctatgtggtctgatgcagacatggaacccacaggggaatcaatatcagtaacatgcatgtatttttgtgtctgtagagaaccagtcatgagtgcagatcttgtcaaaataaaatgatactcacaaaataatcagagtcaaaagatatgccaaactggatatggcagtttaaaaggcttatcaaaaatattatcttttccttaaaaagaaaaaaaaagggctcaaatgagctaacaaaaacatttggagttgctgactttcagtttagcatattagatcttagttttctccattaggaaaagatgccataaaatctttgaataatatatatttgttttataggatatttacctgttttttattatagctttaggtaatacttaataataattaatttaaattaatagatactctctttgaaaagccacttctttgtctggggttatagtctaaaatgcaatttgtttatagtctagaaagttgtgactcaatttccagaatatttatgagttacagttatcaatatttttttatttcccaatgtgaaaaatgaatgtacgcatattttaattaagtgtgacatatagggctctgcaatacattttagttatgtgtgttgtttgatttttgcaggcacagtatatcctgattcatcaggctttagtggaatacaatcagtttggagaaacagaagtgaacttgtctgagttacattcatgcctacacaacatgaagaagagagatccacccagtgacccctcccctctggaggctgaataccaggtagcaatggtcacagcaatgtcaattgggataagtaattttgaggaatatagattatttttcagtccttgccagtacttggctacaaagcagtagaatggagatgaggaagctaagattccacaagtttaaaaaaatgtctatatttatacaattatatacgaagtttgcttaaatcttgaggtctgagtttacaactaatactcttgcgtccctaagcttgtatgaaaagtgtcaaaataatcacaatagccacatagtggtctgccacaggaaatgtaacatctcatctttaaatactgcatctagttttggtttcaaatgaaataattagaaggttttatgtctgactatgaagatgaactggctggagttggtagacagacataaaggataagtatttgcgtttccacctctttattaagtgattattctgaaagccaattgagaataaatttttcagtgatttcagtgtattgatacagccatcctcagacaacttcattgtcaaaagtggtgtggattttccccttccatctgtaatttccagctttctgagactttcagtttcacaagagatgggatgtgcttctcttttatcagatgtaggccatttgactggttatggtaaaagtggggctgagcttggaggatagcaggcagcatctaatgattttgagtatcaccatcttccaaagacttgacctataaagagtaacttgtaggtagagaaaaagattgaatgtcaggcagctttagcattatttcattacccttgacctgttggactgaccataagctcactaagtcacataggaatacttactgtttagtgatgctgctatatttaaggtaaacctttgtatgcttagtcactgaaagaaagaaagacttattttttcaactgagtagacatgattaaatttcttatgggtgccaaggacatttgtaggcacaagagtcaaagtgcttcacaagtggacaagagagaggtctgaaagagtgtcgtccagcactcaccagttataacatgcagagactggagacattcctccacccaagcagacagaaagagaatgaaggtagagaggcagagtggttggtgcatgtggtgatgggatgtcagaaaaagtggaagtagctatctttcctttagtaataatgttttaaaatgtttacttacacataactgtacttatttgtggggaatagtaagttgatccaaaacatgtttattacacatgctaatcaaatcaaagtaactgtcattgcattactcaattgcctttaatttatagaggatttgtgaagcaaaaaaagtggagagctgagaaaacctgggcaacaaaggcaacatcttagtgctcaaggaagaagacagagtaggaagtagttaacttaaagttaataggatggtcaaaagttattgcatgatcatttggtgtttatggccatgaatcaaaagaacataatttagtggttttgactgagatctctgggtataaaagttgtataaacccatgtaggtctgaaaattggttatgtggtagaagaacagcaaaggaactgaggatctttgcaagtgaatgtttgtagcagtggatgatgacatatgaaagggttacatagaaatcaagaaagaaaaccataagaacagtatgctggagacatatgaaaacacaaagttctaggaaaaagttactagaatagatgactaggaagaaaggtaattttcagttacatagatgattcaagtcattagtttagacatgatgtcatgtttgtaataaaacagacaaaggtggaatggtgagtctagataggtgagcagtacaaagagtgatcagaggaggcaagaaagatatcaagctatagcaagactgcatagattatgtcattatttttggcctaactgaggagatgagcatcttgtgggaaaatgcccattactacccaggcctaaaaataatgagatcaggtgatcctgaaattggtagctgatgcctctgagtgaatgacactgaataatgagcactataatatgagagaaaaaaaatgaaatccattgggttttgtgaataagaaattggtataaatgacttgcaagttgaaggcagaataaagacaaaatgtaatttttattcaaactatgaggctaagaaatgtaagcctgacaatgattcagtaggtatcaagtgatatctacttggtgtaaagggaatggaaagagattgctgggagaagaggatcaggatgtagtgtttgctgagaagacaatggacaccagaaagttgatagaaaggcatttgctgaaatatcacagtgctgatatagctttttctgtgtataaaagacaagacttcaagaggacacccaaagacaccaccaaagtcacaattccataagagttcaatttgagcaaccaggaagtttactggccttacttgcagaatacagataaaggaatatttacaatagtaaagacatctcatatcaggtggatcaatgcaaagctctgcaccatcatagatcgtgacctcaggaaagctgagtccctttccagctaatcttccatttcttatacaccccagcattattcaaggccatttgcagttggcatgggaccctactctcaattattctactaggaggtgtcagtagccttggtaccacggacctagttattactgtcctgacctgtacactggtcacctctcttagaggtttagattgggcagttgaaagaagcaaggattgaagagtaaataattctccatgttacactgatggaaggaaatctaccatttccacttagaataataggttctttctacttgaggacagtgtttgggtggtttctcacaaattgtgatgttttccaaggtagctgggtttctgtaatttacatttttcattgctgtgaccaggtatcaataaaaagaccatttagagttgagaaagatcaagagggagtgaaggaggagaggtttaccttggttcgtggcttgatggtttagtccattgtggaggagaaagcacagtggaagagaatgttctcagacttagatcacagaccatccagctcaccagaattaggccatactcctctccttgtagactgttctccagaaagagcctctgctgtgggaagtcagtcttgggttttaagggtaaagaaatcaagcacagtccatatcccttgcaactacaagatcattagcagtgttcaccagtgcctgcctccttagcacacagactaagtcaaactgaaaagctagtatagaatttccttccatattggaaaacctgtaaaagtaagaagtgtcctttgcttcttagggaactgaaggagctgtctctactttatgaaaccccgacatactagatagtatgcctagctctcccattgctggccttttccaggtttaaagccaaggctctgaagccccaccatgctgtctgcagtatgacgtcatattatgtgaattgctctcccactttaagacccaaaatcattgcactgcttgccatggcctcctccatctctctcctaataaagcatattctgcagggtaattttgtgtcaacttcttccccaaatgattctgctggtcttctttatggttgtggcatcgggagcatgtggctgctaaacatttccttggcaaatggcctatacttctgtcatcttcattctcctgaggtctccactgcatctcaagttttaccatcatagcttcacacttagaccactgcagagttccttgcagggcatctaaccatgctacacattgactgggctcagcagcattttggaactttactgtaaaattctgtaacatccacacccttgtggacacctagaatgtcagcatcaagtggataatgcctggtctctttgctggctggagatgtagactgaacttcttggatcacagctctggttgcctctctgtgtctccatggctgagatttagaaaacatttccctataaagccatgttgatgctcaatgctattaaggttttctttgttcatgctttctcttttcaaatgacagtttttcacatgagtttgaattgctatacttttgctctgtctctcaacagatgtagtcacttcctttgagtaccattttgttgaccaagacctggtcacttaaaataatttgccattccagggtggataataatgaaagtctattttgttgttgcacctaatgaaggaaaaagctatgcaaacttgttgtcaagtatctcttagctaagaaacaaactctattaggtacaaatgtcatttttcagtcccagctcagcaattcaaagctaacaaaagtctgaacagtaaaatggaaagcttcagagacaaatttaaaatctgtggactcagagactgaactagaagtttgaccatgctttaatgagtatgtgggcaacacaaattggacttggtgtatttttttttctttttccggggagggtgcatgggtgggtgggtggaagggtggacctagaaggaataggatgtgagtgtggtcaaggagcattgtatgaaattgccaaataataattttattatgttgagaaaaataaaaataataaatttaaaacaatttaaaaaaacctgtcacccatgggaagttacagaaattttataggcattcatgatataatggttcaagagatatctcaggctacaatactttaggaaatattggattttaaaggaggctttcttctttgtttttcttagagacttccttcatacaggagttggaggacacagcacattggaaatcaagaagaaaataagaagaagaacaggaattctaatgttgttccatgtatgtacctgacctttctttcttgtatcagatacagttaagccatctttgggcttacctaatgtaagacatggactatgaagtgacccttaattgacaatagataagtttgtgggcagctgggtggcatgcctttagtcccaacaccttggagaaagaggcaggaggatctttgtcagtttgaggccagcctggtctacagagtgagttccaggacatccaggactacacagaaaaactctgtctcaaaagccaaaagaaagatagaggaggaagaaagaaaggaaggaaggaattaatttgtttgctatctaaaatttaattttagcagattatttagatcccaagtattttcaattaactttaaaagatggaaagtatttagtgtgtccaccccaacctcaacacaggcatatttgaaaattcaaaaagcagaaataagttataagaagatgaaatctgtgagttggggcaaagaaagacttaatcttcttcactagttttatcttacctttattaaacgtcaaggtaatcatgatatagcagagattttaacggggttgagagctggaaaggtttgatacattgtcactcactaaacttaccacattggaaatatgaacaattattttaagttttagctctatgtaagaatactgataggatcacacctggtgctgttttgattgcatccagctgcatctaccaaaattagcatgagtgaaatataaggcaagctaataaacaagaaaaccagataaatcaaagcagtacatggctgacctagttaatttctgcaaaactttgttaatactgttaaaatatggcactgatagtaatgtccttaagtgcatcatcagccattattagtgatttaaaatattgagaaagaaggaatgctttagaactagataaaatttgggttaaaggggaatcattttgaaaaatgaacttaatagaaaattttaatttaatgttaactgaataacattaaaaacaaaagtctaagctctgaagttagatcagttcatttaattctgaatttcttcttcatttctacgtgtctgtcggtaggaaatttgattcgtttgcatttgagttttcagttaagcccaggaaagtgatcattccaagcatactgtctctaggtgagctcagtcctcagtccttaggacttctttggtaagacttgctgctgtttcttgttccatagatgactttaacagagtgccacttaagcatgaactggagatgagcaaagagagtgagcctgaatcagatgagtcttcagatgatgacagtgactcagaagaaaccagcaaatacattaatgcatcctttgtgatggtaggtacccacactccaaaaccagatgacggctgtgttgttaggtctctttcttaggcaatattacacttagataaggagctcaatgataatcgtatattcataggtgcaaaagttccaccagataatattttaaatgtatcaaactacctaaaagggttaaaatttaatcatttgattcagaacaaggaagtgctattgcttgtattttatgttaaatatattaacatacaagtttaaacaacaaaattacaataagtacaactattagaacgtattagttattcacaccagcacagctgaatctacatgacgatacagtgaagccttttccctcagataaccaggttagttagatttttctgaccaccctagcactgatcttgttaatcttgatggccacataacagtattttaaaaaatctctcagatgaatttatattataaaatatttggggtaaaaaaaaaacaaaaccaaaacccccaaaactaaaaccaaaccaaccaactaaccaaccaaacaaaaacccaaaaagactaaataagggattcagtagagacttacaaactcaattggatttatttattctccagatcttcccgcaactcatactttagtgagtactagcttaattgcattatttcaggagaaaaactatagacacaagttaaaatagatcattgataagaataactttgtatgattacattaattcattttcacaattaaaacaataaaggaaaggggttttagaaaaatatttttgataggtagcattgcatattgtaactgtaatttcacatcattaggtgagaatgaaatattttatgaatagacactgaacttttcttggtcttcagaatcttaactttgtctattaatggcaatgataccaaatcaattaatttttttctaaaagtctaagaggcttttgatctttctttgatggtagcactaacaaattccatctttgtgattttttagagttactggaaaccagaaatgatgattgctgctcaggggccactaaaagaaacgatcggtgacttttggcagatgatattccaaagaaaagtcaaagttattgtgatgttgacagagttagtgaatggagaccaggtttgtgctttgaagaatgctgctttaaaaaacccctgaccatgcagggccattatctattcttgcattcctttttattgctatgatcttcatatttgattcctctgctacacaatccaccttgttattgccttaagatctttgacaggttggcttttttgtcttatgtctgggttctgacattctcttaattcctgggcacatggtgggctgagggaggctacatgatagaagtttataccttttacttttctcctatattcatgtgtggaaatacactttccattctgggcaagtatgtttacatacagagccttgacaccccacccggcattctcaatacacaaatatcctatgttcctaaatgaccctcctctgtgcttcctaactccattcttctaggaagacaaaacagtttgaaattttcagctgcatctttctttctaatatgtcattcccatgggatattattgccacagaattctataattggtggtaaacttaagacatacatttacttcctaattaatccatgtggcatatgtttggtatttctcttagtaccctgagaaaccattaaaaattctcaatggtagatcatttgataggattttagttccgacatatggtaagtgaaatcctcataagaattcaccatgatccattacactctctcttccttacccctttctctgcttctacatctctcccctacaaatcccctctgctcagtccccttttctctcttctctgtctctgtctctcatctgtctctctctcaagctccatcttcagcttcctccccctacctcttgtcagcaattataggatgctagtttgtagagacctctggttcccttactctccagtctgaccctttactttcttgctgcctcaatgtagcttttcataaagttggccataaagatgctgggtgaaatcttgaatcaatgccaatagactctgttctcaaggaccagtgggggaataaaagagcccaggctattggaaaagtcatggctgatgtcagctcattctatagatttttgaaggggttgtataatcagggttttaaaagagaaacaaattccaaagacctcttccagagataataaagctactctggattactctgatcatttctagccaccatgcagtgaaactttttcactgtatttatttacttattatttttattttttaataaaatttatttaatttaataaaatttatttatttacatttcaagtgttatccctttaccaggtttccccacctcccagaaaacccctgttccaactccctccccctgcttctatgagggtgttcctctacctacccacccactccagcctccccaccctcgatttccctacactggggcatctatccagtcttcataggactaaggacctctcttcccattgatacctgacaaggctgtcctctgctacacatgcagctggagcaatgtgtactccttggttggtggcttagtccctgggagctctggggcatctggttggttgatattgttgttattcctatggggttgcaaacccctccagctcttttagtcctttctctaactcctccattgaggactccatactcagtgcaatggttggctgtgagcatccaactctgtaaggctctggcggggactctcaggagacagctatatcaggctcctttcagtaagcatttcttagcatccacaatagtgtcagagtttggtgactgtatctgggatgcatctccaggtgggatagtctatggatggcctttccttcagtttctgctctgcactttgtctccttatttactcccatgagtatttttcccctttctaagaaggacagaagcacccacactttggtcttccttcttcttgagcttcatgtggcctgtgaattgtatcttgggtattctgaatttctgggttaatgtccacttatcactgagtgcataccatgtgtgttcttttgtgacttggttacctcactcaagatgacattttttaggtccatccatttgcctaacaatttcatgaattcaccacttttagtagctgagtagtactccattgtgtaaatgtaccacattttctgtatccattcctctgctgagggacatctgtgttcttcccagcttctggctattataaataaggctgctatgaacatagtggagcatgtgtccttattaccagttggaacatcttctggatatatgctcaggagaggtattgctggatcctcctgtagtactatgtccaattttctgaggaactgccagactgattcccagaggggttgtaacagcttgcaatcccaccaacactggaggagtgttcctctttctccatctcttcgccagcctctgctgtcacctgagttttttgtttgtttgttttgttttgtttttaatcttagccgttctgactgttgtgagctggaatttcagggttgttttgatttgcatttccctgatgactaaggatgttgaacatttccttaggtgtttctcagcccttggcgtgctctcagttgagaattaatgtttcaattattttagaattcaatattttctatttagtacaaaaataagaggtaggaagagaaaagggggttctgaatacttcaaagaacaaagacaacacctaggtaaaacatggcaagtcatgttatttttttatctaggaagtctgtgctcagtactggggcgaaggaaagcagacttatggagacatggaagtggagatgaaagacacaaacagagcctcagcctacactctccgaacttttgagctgagacattccaaggtaggtaaacactcagaaagcatgtttgctttcaaaattatgatataattatcatgtcattgatccgatagcaaattaatataaactgtggtgtgtccccaagaccactgtctttataatggttccagaaaaaaaaatgtgttatttgaatgaaagcatctgtaaaaacaaccaaaaagcaactatcaaagttatgatagactggaccgaagttcatttgaactaatgttcacttcacctcggattgcagaggaaggagcccagaactgtgtaccagtaccagtgtaccacatggaaaggggaagagctgcctgcagaacccaaagacctggtgtctatgattcaggacctcaaacagaagcttcccaaggcttccccagaagggatgaagtatcacaagcatgcatccatcctcgtccactgcaggttaggaagctgatggggtgtactctaaggttggaaggctttgtcttcacttttatgaagatgtagatggtgtgttccagtgaaaatctccatgaagccattcactctcatgttatttatatgcagcatgactataatagtaatataaacaataaaggttataaagccaggcttttaggctggtagctgctgcctatcatttgatggcatctttgactctgctttgcccagcattagagctgcagtgctagatgtggtaaatgcgtgaaaagcagaaataatgtatgaatgggttggctggtggattccattgtggatagacttctgtgcattgcattcactctactggatatgacacaacctcatggctaaatggcttgcatctggtagatatatgttaagctacttatttgtaagctttttgtgaaatcgtgtgtgtgtgtgtgtgtgtgtgtgtgcatgtgtgcagaccatgttacacatgaggaggtcagagaacagttgtcaggaccgtatccttcctgtcacccgtggaatccaagaatcaactcaggtcactagaactaagcacaggcacccttatctgctgagccaggccaagtgttcttaccttaaacatgaggtgacatttcattggttgtcacttctgagcggattccccaaagtcctctcacaaataatatggtttaatgtcattagtccttgctgtggagacacttgggggtcactcgtagcagatattcacataaccctctcaagacatattgaaaaagaggtttaatatgaaaagtttacagtaaaggaacattaaaatttatggcaaatatttaaaaagttctaatatgaggtgaacactgtaaatctgaagaaatgcttttaaaagctgtaaaagtcctcactaatgtcaccaaagataaagaaacagcgccccccatgggcatactcttcccccagggttatttgaacatttcatttacatggaaaagaaaatcaacgaacagcaagttaggcttgaatttattgcttaggtgttttctcggtgaagtcgtatacaaagcacttgctgattatgtgaggttttaaaggaagccacgttgttgttttcacccttactctttttcctcccgtggttgataaattattcggatgtccttgctttagtgaataactctgtcaagcatcattttcacacgaatgtaaaaggagaacactgttaggaaatggcgatcaaagcagagcagggagtgatgcagggctaatccttgggcataatctgtatccggacatgttctaatccttctatcaaatcaagcgtggtatattaatcctaacgattgaggacctgaggacattagtaaagatgcatttaaaaacacaaagcaataaatgaaagaatgcaagctcttaaagctaaatctatgtctcattaaggcacaggaccagaagtcatactcatgtattgggaaagtctgccctcaaacgcattcacagaaactaatttggcctttaaaaaaatgagagcaaggtgcatatagtaggtgtgaaattaaaaaaaaaaaagcatatcccatctctctgtgttcatgctaatagccctttctctataaaacagtgagttaattcatgttctactttttaaaaaatccctttttcttttgacagagatggatcccagcagacagggttgttctgtgccttgttcaatctcttggaaagtgcagaaacagaagatgtggttgatgttttccaagtggtaaagtctctacgcaaagcacggcctggggtggtgtgcagctatgtaagtgtccctcgatgtcactctcaagtcctctgtgtttctatgtgggcacttccccttctcctccactcccatttccttcccttcccctttcttctctatttttctgatttcccactcatttttacatcctaatcctcaatgaaagatgatcaatataaataagaccttattagagttgttaacttgtcatgacaggttaacatggtcacatcctttaatgtccatttatcaaatagtcttattgtataacaaaccagtcccgaatttagtgacttcaataacatgattgtatttcagtgatattctattgatctactcagtttcccaggcatactcaatgagatccaggttcatatatctgctgtcagctgatgtgtctacttaggtctggttggcctaaaataatctctgctgccagtaaattggcaagtaactgtcatttacttttgacagtaggggtgagtggtcagtggtcatgtgtcagtggtcatgtgtcactgctcattcaagcttatacaagggcagagcatcaagaacataggcagaatgaggtgtgccaccccttgaagtccaggccaagaacggtcacaatatggcttccaaccaaaccaatcctgaggctggtgcagaatcaagaggcctgcattttatagtgcaaagagttgtgagttccatgaaaagcagtctgcattccatttatgctccctgtgtagcctctgtctgcagcaatgacagtcaaacatcactgacttagcattcactctcagtacaatttcttactgaaatacgcaaaggttttcatgaacacacaattcgagtttccatggatgggttttaaaaagtatttgaatacctgataaatgcattgactgtaaagagactcaaaggcaaataagtattaaatagtcaaataactaaaatgacagaaagtgtgagagggtgactggggacccttcattttaatcaatggggaattttgtaagctccttaaatgaggtgatttctgctcacattcataaatgatgtgtgcacatgaggtaggaacataggcacaaaaaatgacattttggcagaggtttgggttcagttatcacatgatgagtagcggggagtaacctggttggtgttgttcctaaggtaccctgcccatgatcctagggcgtggttaagtcagtgagagagcttctgatgagaacatgtcagaacatgtgttctagagttgcaaaaggaaatggttagtgcctggacatctcttctgggtgtaagaacgttctctatgtaagttcatgctgctttctttcaccaggagcaataccagttcctctatgacatcatcgccagcatctatcccgcccagaatggacaagtcaagaaaacaaacagccaagacaaaattgaatttcataatgaagtggatggaggcaagcaggatgctaactgtgtccgtccagatggtcctctgaataaagcccaggaagacagcagaggggtgggaaccccggagcctaccaatagtgctgaggaaccagaacatgctgccaatggttctgcgagcccagctccaacccagagttcataggaaaggagtcatgtgggacaacgcagactctcacattagttctttctatttttctagacctaatgaaagaacatggctgtgcagtggtttatggaatctgtgttcacctttgccactgtataaaaatatttaagtttgtcaaaacattttgtacagttttatgcttattttaaaagtgtatctatgtcattcagcaggaatgtatatgtgagagagggtgtctgtgtgtgtgagagtgtgtttatgtatgagtgactgtgtgtgtgcatgtttgtgcgtgtgtatgacatctaaatgtgattggagaatactttcaagccatttcaaatgctttcgagaaacagtgtgccttttctcctcttgaggaaactatacattttatatctaaactgttaatttgtttgagggattaattttttaaaatcccattgaaagtggattcagttgtaagaataacaatgtgtaccattctggaatgacctcaaggtgtcctccttgtcctgttgatgatcttgtagtttaagatgctctttttggatatagataagcgtatgtaagagtgctgtgggtgtgtacagctgatctgggacgtgaacaaaatcaacatgtgagacttatgttccatatactgtcatttcatcactatctcttaatgcatatttaatcaaacatgaaaatctcaagggagactatttttgtatccacatgggaagtagaacattgcaagtcagttgctgtctacacaatagataaaaattactagttaatgctcttggtcatatcgatatatgctatgaacctaaataattgcccttagccaaatataatgtatgttaaaaacacatagaataaaaacaggggcatgaaaacttgtttgtactgaatatttacataggtaacctcgtacagttagttctgttatggaattcaccatttatgggaaatgtaaaattgactatggccatttcctatgcttaagaccatctttgacttgcattactgtgtatttatcttgaatttccccactgttttgtttactcttactgagatataatattgataaccataataaactttcaactattatcttctttgcttatgtggcgtgtgttacatgtttgtaattgacagtgaagcaatttcttcttcaagctgagattggttttcccattttgttcattgatgagaaaaatgaataattatcagataggcgcatcagaaggggataaagaggactctgttttctcactagccactcacagatttctatctcatgtcatctgggaaaggttctgttgctctttgctggaaaacattgtggaagtttgcagttctgatgctgatgtaccttcaggctggtttttatgttgatttgtgatttgtgatttgcttcagaatgctgatcatcttcaatgatatcttttggaacacagtttacttagtagctgtttacttagcagcacatttgcaacagcatcaaaagctatgttactataaaatcagtgcgtgaagtctgatttacattttgctcaaggatctgggtaaagttttctaccaagaatgttgaggactcatgaaaatgtgaagttctccaacttctaaaattttttaggactttcaataaactataaaattattcaaaatcacatataagtaaagtgtttcttcagagattccatctgcatgtaacaatccccaactgtggatggtgtgctaaaatgtgtattttcctcttgacgctatttttttgaattcccaaaacaaatatttggaaaatagagccatgacaacttgaaataatgtaaaatgaaagctaggagcaattgtcctttgcaaatgggttggtatgaccaaggaatgggcaaatactgtctcagaggcaggttgttctgtgactcgagtactagaggattgaattccaactctgagttttagctaaaaaagaaattcgtatgtgggctacaaagccatgccttttggtccttggttatattcagagggaacatgaagctgccttttctgaagctaattgtcactgttacaaattctaagaccttgccaggaaaacaacaacaacaacaacaacaacacaaaacccaagagttcctacttttaaaaattcctagtccctttctgggatccaatacagggagccctgtcatatttttgctgggcagaaggtgaacatcttctttttactgtttatttctggcatcagaatccattgggagtaaatgattcatttagtaaccttaaaactcaacactccataattttgtatgtaagtgacacatatatagctatagagaggagatatgcattttcatatctcttttaaaaagttaaactgtggaagtcatcagccaaaaacatctttgcaatgtaatttcaaaaatataagctactgggctccagtagatgctgaatgggtagagtgaatgttcacaaggataaagacccacgttcatatcccgaacacacagaaaccttactgggtaggtggaagcagcagatatatgcccgggctctgggctagagatctgtggattctggaaaacagagggccagtcaatctagccaaagtagcagagactctgattcaagaaagtagaggattaactgaggaagatatccttgacaccaacctctggccacctcatgtctcctcacaggtgagtggactattgatgctgtgcatgtatatacaacacacacacacacacacacacacacacacacacacacacacaccccaaaataaaaatgttcaagttttaactacatgatggatgaaatatttttctacatctcccttaatcccactataatattgacatttttattgtgcctgagagctaaccagcataatcttaactttgataattgtatttatcagtgagttgttataaaatatctcattgtgttatgatatctgtaattgagttagcagtcattttccactgtgaaggccttgaaacaggcaacatccacagacatgagtaccagtgatgactagtctcatgcttgtatcttttattctcccctatgtagtttacaaatggactgatctgagattcttgcaaagagaaacagtcaagcctgggtttcttagttccatgttttaaatggacacacacacacacacacacacacacacacacaccttacaactcgtacctgaaagaacaaaatgcctatttcacttaaaagaaaagtgcacataaccataatttttaactttagaaaaattatgtctattattttcaaacataaatttcattgctaggaggaatatcctaatatgaaagcattaattgaaagcaaatgaacgaacttgtgaaagtaaaaacttaagccattttgatccaaagagtatgttctgtatcaccatttataaataaactctttataactggcatttgggacatagacactatttctctgtacttgtttctatagacaaatattgaaccacaaatgtactttttgtttctatttctaagatgggaactgagcctttgacaagttcaatccatgatgctgcattaaacccaggcattaccctggctggcatctgaggcagttcttgctggcacccgtccttcattcttcatagtatcaatgccctgccagtgagaatggcagctttcaatttatcttcctgattttattgatttcattatccaaacaaaactgtgtgtaacgtgtgtcctccacaaagctacatgagataataagcttagttgaactcatccacaaaactgaatttattacacacacacacacacacacacacacacacacacacacacacacagagagagagagagagagagagagagagagagagagagagagagacaactatgggaaattttgttcccatgatgcatgtaaacaaatattaccccatcattaaagtagtgtcaggaattaatattaatcacaagtgctaccatttcattatcgtatcatttggacatcaaatacttttactgtttagttcagtggttctcaaccttcctaatgctatgagcctttaataccaaccataaaattacttttgttgctacttcataactaattttgctatgttgtgaatcatagtatacatatctgtgttgtccaaaagtcttaggcaacccctgtgaaaaggttatttgactcccaaggggatcaggaccacaggttgagaacctctagtttacaacctattttctatttgtcagctgtttatcaaccagcatttaaaactagcactataaaacacaagccaggtttatacatagttgagaacctaggtggctctgaactttcaaggccagggaagctgaaaagtttttatgagcaatatcaaaaccatctaatgggtaaggacacttgcacctgagcctaaagacctgagtttaactcctagaatcaagatggtctatcctctgttcacagactgagcacggggtccccaatggaggagctagagtaaggacccaaggagctgaaggggtttgcagcctcataggaggaagaatacgaaccaaccagtaaccccagagctcccaaagactaaaccaccaactaaagagtacatatggagggacccatggctccagccgcatatgtagcagagggtggccttgtggaacatcaatgagaggagaggcccttggccttgtgaagggccccagtgtaggacacacacacacacacacacacacacacacacacacaggacagggaagctggagtgggtggtttttgagcaggggggttgggggaatggtatagggtggttttcagaggggaaatgaggaaaggggataaatttgaaatgtaaataaagaaaatatctaatagaaaaaaagatggcctatcttctgacctgaacatataccataacatttataaaccttcgcatggatcctctacacaaaccaagtcaataactaaaccaagtgtgcttccctggttcatttaagttccccttttcctgtattaaaatttaaatgtttaacatagctgtgtattctggaaaaggaagacttactgaattgaataacatttatttcatgtaggattcaaatcagatttaaagaacctggtatcttttcaaagaacacaaatcaaagaacataaatatagtcttaggttcgtttgtttgttttgtttgtttgttttttaggttgtaaacaggtgtagtgactcattcttgtaaccccagcgtttgggagcctgaaaaatcttgaatttttcaccagtctgaactaaaatttaaataacaggttgcataaccttaaatgaattttttatgcatcctatgtaaagtgggaaaaaaggtcctgcacagagtttggccacctgttcccactggctaactcaggctgaaaccaatgtatcctcatagtgttcttagactaaaatcttgaaataatgggtagtaattcagatatttcatccattcatgctataatagccattgtagattgcaattcggggattgtgctctacaataaaaatataaaatgagttattatagacattgacatgttttacaaaggagtttccatttatatttaattacatgttttgttgcattcattagttaaagatagagatagaaaaatgaaatgcaaaagattggaagctaaacacatttgatatttttgtcataattagcagaaagtaaaacagctgaactttttcagtggccatctggtgtctgctttaagttagagttgactttgccaattaatcgcccagtttcccacacctgtggtgcctcctcttaaacagtagcaggattgttatctgcatcagaagactgataatgttgaatcgtctttttgagtcaactttaaggctaccaaagagttttcccactgtatgtgttctgatatggctgccaaaccttgactacccattgggtttccatctcacttgctgactctgaacttccattccaaaggtcctttgcagaagcttggaatcctaaatgagggcttgcccatattgaataacaagggtcccatgaagtgtgtatgggtgactttcacatatagagaacaattgctgttcaattcctgcatcatgtgacttgatgtcccatctgtagcatgatactgtaagccatagattatatttctcgggcttcttctgcaagggtctactttttctcatctggactcacagtcagtttaagtcttataaaatgatttatgcaaaacaaattaatttgtacataaaacatgctttggcagatttctctccatgtcaattgtgggtgtcaatgttctctttgatgagactctgggaaaggcattttacttctttgacaagatagcaaagatatttgctctcaatacttgttcaaaaaatgcccagagcttttacaaagctcagtttagtcaaataaattacaattcagaaaatgtagttgcaacagctcatgaactctccctctacattttttatagtgtattttaacccaatgtcctgtagtcacttaaggaacacaaatttcagaaataaagtcagcttgacaaaatggttaaaaagaaagaaaaattcaaaggtattagagatgatacacattttgggacattcttgatttagtataacgttcggtatatttacatgcagggcatcattttagggatgcatgacatgtatgttctgaaatttcatgtagttattataattgttacaaatgctttaaagttaacttttacatagcataaagagcttccatgttcaagaattttaagtcattttttagagtgaggaatattaagtcagtccctagagtgaagaatttcaagtcatttcgtggagagttctcctatttctaccgttgtctattttatcaaattccatccaatcttttagtggcgggggctgtcggggggggggagttggagaggacaacagcgatgatgagaaagagacttatttgaatttctttctctccacattcacctagaccagcaattctcaacatgtgggctgccaccctctaggtatttcagatatttacattgtacagtgtaacagtagcaaaaggacagttatgaagtagcaacaaaataattttatggttgggggtcagcacaacatgaggaattgaattaaagagccacagctttagggaaggtgagaagcactctcttcacttacgattttaatgtttattttagacttttacttaaaaatttaaaacatgtgtgtatgactgtcttgcttccatgtatatgcatgtgcaccaccacgtgtgttcctagtgtttacagaggtcagaagagggcacaggatcctgtggacctggaattatggatggatgattatgagcctccatttgaatgaaggggagtgaacctggggcttctgcaagagcaatagtgctcttaattgtctagccatcgctctagtccatagtattctttgaaatgagcacatttttatgtgaaagtaacacagaaaataaccagtaagaaaactgaagaccattctaaattcaattgaaaagcacccaaagaaaactgaagttcgcagggaagaactatgaaaaactctcccacaagtcaggggctccattttcactcacacaagagagatgcaaagtggaaccaccgtcctataacagctcttgatggcaaacacatagatgctcaactgtggcgaatatcttcactaaggttggagggaatgtttacacggacaggaacatagtctttgaaatttcaatctatgaatttactctctcttttaaaacaaagacattttacagtcttgaacaccagttcagatatattattgtattttgatgaacatttttcatatatatgtctcacatacatacagacacacacatacacacacacacacacacaacacacacatatagaaggatacacaaaagcaaaaaagagacagagatggggggtaaaattttaagtctaaaaaaggacatgttaaaaagaaattttttataattgacaaagccaggaaaaaattcagaattataatacttcataaaacataaattacaacacaaatgctcctttattttttaacaagtaattatttaaataatgtgaatttgtttaaaaaatgaaattgtagtaaattgagttttaacattagtaaaatttcttgagcctcagcagcagcagtcgccatcttggttccgggactccgcagaacttaggaaattagtctgaacaggtgagagggtgcgccagagaaccggacagcttctgggacaggcagaggcacagagccgctgaggcagcaccctttgcgggccgcagacagctggccaccgtccggaccagaggacaggtgtccgcctggctcaggaggccgcatcagcctcagcagcagcggtcgccatcttggttccgggactccacagaacttaggaatttagtctgcacaggtgagagtctgcaccacagaagctgacagcttctgggacctgccaaagcaacacagcttctgagaaaggtcctgttttggtccttcttctttggccaggaggaggtccaaacacaagatatctgtgcaccttccctgtaagagagcttgcaagcagagagtgctctgagcactgaaactcagaggagagaatctgtctcccaggtctgctgatagacggtaacagaatcaccagaagaacaatctctaaacagtcaactataactactaactccagagattaccagatggtgaaaggtaaacgtaggaatcttactaacaggaaccaagaccactcaccatcatcagaacccagtactcccacttcacccagtccagggcaccccaacacacccgaaaacctagacccagatttaaaagcatatctcatgatgatggtagaggacatcaagaaggactttaataactcacttaaagaaatacaggagaacactgctaaagagttacaagtccttaaagaaaaacaggaaaacacaattaaacaggtagaagtccttacagaaaaagaggaaaaaacatacaaacaggtgatggaaatgaacaaaatcatactagacctgaaaacggaagtagacacaataaagaaaactcaaagtgaggcaacactggagatagaaaccctaggaaagaaatctagaaccatagatttgagcatcagcaacagattacaagagattggaagagagaatctcaggtgcagaagattccatagagaacatcggcacaacaatcaaagaaaatggaaaatgcaaaaagatcctaactcaaaatatccaggaaatccaggacacaataagaagatcaaacctacggataataggagtggatgagaatgaagatttttcaactcaaaggaccagcaaacatcttcaacaaaattattgaagaaaacttcccaaatctaaagaaagagatgcctatgaacatacaagaagcctacagaactccaaatagactggaccagaaaagaaattcctcccgacacataataatcagaaccacaaatgcactaaataaagatagaatactaaaagcagtaagggaaaaaggtcaagtaacatataaaggcaagcctatcagaattacaccagatttttcaccagagactatgaaagccagaagagcctggacagatgttatacagacactaagagacgacaaattccagcccaggctactatactcagccaaactctcaattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 115 - DNA, 4654 bp, Mus musculus
ttgttcttagggtaagagagtaggaaacttgctccccatctgataagacagagtgcaaaggagaccctatttcttaggggcacagctgatctccagatatgaccatgggtttgtggctcaaacttctggcctttggatttgcccttctggacacagaagtctttgtcacagggcaaacacctacacccagtgatggtgccagcctcacaactcttacaccatccactctgggccttgcaagcactgaccctccaagcacaaccatagctaccacaacgaagcaaacatgtgctgccatgtttgggaacattactgtgaattacacctatgaatctagtaatcagacttttaaggcagacctcaaagatgtccaaaatgctaagtgtggaaatgaggattgtgaaaacgtgttaaataatctagaagaatgctcacagataaaaaacatcagtgtgtctaatgactcatgtgctccagctacaactatagatttatatgtaccaccagggactgacaagttttcgctacatgactgcacaccaaaagaaaaggctaatacttcaatttgtttggagtggaaaacaaaaaaccttgatttcagaaaatgcaacagtgacaatatttcatatgtactccactgtgagccagaaaataatacaaaatgcattagaagaaatacattcatacctgaaagatgtcagttggacaaccttcgtgcccaaacaaattacacatgtgtagcagaaatcttatatcgcggtgtaaaactcgtcaaaaatgttataaatgtgcagacagatttggggattccagaaacgcctaagcctagttgtggggatccagctgcaagaaaaacgttagtctcttggcctgagcctgtatctaaacctgagtctgcatctaaaccccatggatatgttttatgctataagaacaattcagaaaaatgtaaaagtttgcctaataatgtgaccagttttgaggtggaaagcttgaaaccttataaatactatgaagtgtccctacttgcctatgtcaatgggaagattcaaagaaatgggactgctgagaagtgcaattttcacacaaaagcagatcgtccggacaaggtcaatggaatgaaaacctcccggccgacagacaatagtataaatgttacatgtggtcctccttatgaaactaatggccctaaaaccttttacattttggtagtcagaagtggaggttcttttgttacaaaatacaacaagacaaactgtcagttttatgtagataatctctactattcaactgactatgagtttctggtctcttttcacaatggagtgtacgagggagattcagttataagaaatgagtcaacaaattttaatgctaaagcactgattatattcctggtgtttctgattattgtgacatcaatagccttgcttgttgttttgtataaaatctatgatctgcgcaagaaaagatccagcaatttagatgaacaacaggaactcgttgaaagggatgatgaaaagcagctgatggatgtggagccaatccattctgacattttgttggaaacatacaaaaggaagattgctgatgagggcagactgttcctggctgaatttcagagcattccacgggtattcagcaagtttcccatcaaagatgcccgaaagccccacaatcagaataaaaaccgttatgttgacattcttccctatgattataaccgtgtggaactctctgaaataaatggagatgcagggtccacctacataaatgccagctacattgatggcttcaaggaacccaggaaatacattgctgcacaagggccccgggatgagacagttgatgacttctggaggatgatctgggagcaaaaggccacagttattgtcatggtcacacgatgtgaagaaggaaacaggaacaagtgcgcagaatactggccaagcatggaggaaggcactcgggctttcaaagatattgttgtgacaatcaatgaccacaaacgatgtcctgattacatcattcagaagctgaacgttgcacataaaaaagaaaaagcaactggaagagaagtgactcatatccaattcaccagctggccagaccatggggttcctgaagaccctcacctgctcctcaaacttcgacggagagttaatgcttttagcaacttcttcagtggtcccattgtggtgcactgcagtgctggtgttgggcgtacaggtacctacattggaattgatgccatgctggaaggcctggaagcagagggcaaagtggatgtctatggttatgttgtcaagctaaggcgacagaggtgtctgatggtgcaagtggaggcacagtatatcctgattcatcaggctttagtggaatacaatcagtttggagaaacagaagtgaacttgtctgagttacattcatgcctacacaacatgaagaagagagatccacccagtgacccctcccctctggaggctgaataccagagacttccttcatacaggagttggaggacacagcacattggaaatcaagaagaaaataagaagaagaacaggaattctaatgttgttccatatgactttaacagagtgccacttaagcatgaactggagatgagcaaagagagtgagcctgaatcagatgagtcttcagatgatgacagtgactcagaagaaaccagcaaatacattaatgcatcctttgtgatgagttactggaaaccagaaatgatgattgctgctcaggggccactaaaagaaacgatcggtgacttttggcagatgatattccaaagaaaagtcaaagttattgtgatgttgacagagttagtgaatggagaccaggaagtctgtgctcagtactggggcgaaggaaagcagacttatggagacatggaagtggagatgaaagacacaaacagagcctcagcctacactctccgaacttttgagctgagacattccaagaggaaggagcccagaactgtgtaccagtaccagtgtaccacatggaaaggggaagagctgcctgcagaacccaaagacctggtgtctatgattcaggacctcaaacagaagcttcccaaggcttccccagaagggatgaagtatcacaagcatgcatccatcctcgtccactgcagagatggatcccagcagacagggttgttctgtgccttgttcaatctcttggaaagtgcagaaacagaagatgtggttgatgttttccaagtggtaaagtctctacgcaaagcacggcctggggtggtgtgcagctatgagcaataccagttcctctatgacatcatcgccagcatctatcccgcccagaatggacaagtcaagaaaacaaacagccaagacaaaattgaatttcataatgaagtggatggaggcaagcaggatgctaactgtgtccgtccagatggtcctctgaataaagcccaggaagacagcagaggggtgggaaccccggagcctaccaatagtgctgaggaaccagaacatgctgccaatggttctgcgagcccagctccaacccagagttcataggaaaggagtcatgtgggacaacgcagactctcacattagttctttctatttttctagacctaatgaaagaacatggctgtgcagtggtttatggaatctgtgttcacctttgccactgtataaaaatatttaagtttgtcaaaacattttgtacagttttatgcttattttaaaagtgtatctatgtcattcagcaggaatgtatatgtgagagagggtgtctgtgtgtgtgagagtgtgtttatgtatgagtgactgtgtgtgtgcatgtttgtgcgtgtgtatgacatctaaatgtgattggagaatactttcaagccatttcaaatgctttcgagaaacagtgtgccttttctcctcttgaggaaactatacattttatatctaaactgttaatttgtttgagggattaattttttaaaatcccattgaaagtggattcagttgtaagaataacaatgtgtaccattctggaatgacctcaaggtgtcctccttgtcctgttgatgatcttgtagtttaagatgctctttttggatatagataagcgtatgtaagagtgctgtgggtgtgtacagctgatctgggacgtgaacaaaatcaacatgtgagacttatgttccatatactgtcatttcatcactatctcttaatgcatatttaatcaaacatgaaaatctcaagggagactatttttgtatccacatgggaagtagaacattgcaagtcagttgctgtctacacaatagataaaaattactagttaatgctcttggtcatatcgatatatgctatgaacctaaataattgcccttagccaaatataatgtatgttaaaaacacatagaataaaaacaggggcatgaaaacttgtttgtactgaatatttacataggtaacctcgtacagttagttctgttatggaattcaccatttatgggaaatgtaaaattgactatggccatttcctatgcttaagaccatctttgacttgcattactgtgtatttatcttgaatttccccactgttttgtttactcttactgagatataatattgataaccataataaactttcaactattatcttc

SEQ ID NO: 116 - protein, 1153 aa, Mus musculus
SPDMTMGLWLKLLAFGFALLDTEVFVTGQTPTPSDGASLTTLTPSTLGLASTDPPSTTIATTTKQTCAAMFGNITVNYTYESSNQTFKADLKDVQNAKCGNEDCENVLNNLEECSQIKNISVSNDSCAPATTIDLYVPPGTDKFSLHDCTPKEKANTSICLEWKTKNLDFRKCNSDNISYVLHCEPENNTKCIRRNTFIPERCQLDNLRAQTNYTCVAEILYRGVKLVKNVINVQTDLGIPETPKPSCGDPAARKTLVSWPEPVSKPESASKPHGYVLCYKNNSEKCKSLPNNVTSFEVESLKPYKYYEVSLLAYVNGKIQRNGTAEKCNFHTKADRPDKVNGMKTSRPTDNSINVTCGPPYETNGPKTFYILVVRSGGSFVTKYNKTNCQFYVDNLYYSTDYEFLVSFHNGVYEGDSVIRNESTNFNAKALIIFLVFLIIVTSIALLVVLYKIYDLRKKRSSNLDEQQELVERDDEKQLMDVEPIHSDILLETYKRKIADEGRLFLAEFQSIPRVFSKFPIKDARKPHNQNKNRYVDILPYDYNRVELSEINGDAGSTYINASYIDGFKEPRKYIAAQGPRDETVDDFWRMIWEQKATVIVMVTRCEEGNRNKCAEYWPSMEEGTRAFKDIVVTINDHKRCPDYIIQKLNVAHKKEKATGREVTHIQFTSWPDHGVPEDPHLLLKLRRRVNAFSNFFSGPIVVHCSAGVGRTGTYIGIDAMLEGLEAEGKVDVYGYVVKLRRQRCLMVQVEAQYILIHQALVEYNQFGETEVNLSELHSCLHNMKKRDPPSDPSPLEAEYQRLPSYRSWRTQHIGNQEENKKKNRNSNVVPYDFNRVPLKHELEMSKESEPESDESSDDDSDSEETSKYINASFVMSYWKPEMMIAAQGPLKETIGDFWQMIFQRKVKVIVMLTELVNGDQEVCAQYWGEGKQTYGDMEVEMKDTNRASAYTLRTFELRHSKRKEPRTVYQYQCTTWKGEELPAEPKDLVSMIQDLKQKLPKDEGMKYHKHASILVHCRDGSQQTGLFCALFNLLESAETEDVVDVFQVVKSLRKARPGVVCSYEQYQFLYDIIASIYPAQNGQVKKTNSQDKIEFHNEVDGGKQDANCVRPDGPLNKAQEDSRGVGTPEPTNSAEEPEHAANGSDAPTQSS

SEQ ID NO: 117 - DNA, 138363 bp, Homo sapiens
  misc_feature (1)...(138363): n = A,T,C or G
aatattttgtggttattcattcaactcaacaactaattgtagtacacctctgcctatgggctagagtattagacttcatggaatgtatgattttctgaaagcaacaaaaattaatcaaacaatcccccaattaatctgacaagtgccgtaaagaaaatgaaaaaaaaaaagctaggagacccatggtagggtatttggtctaatcagagaagtacaaggaggacttcttggggacaggaacaactgagctcatacctgaaggattggaagaatattactagatgattatgggtggtaggggcagagtttttaaggtgaagaaggcactagacagaaaatcaattaccttcctaggaccatggtaaaaatcagggtctaagccaacacctgtgtgacagggatgaggagccaagaaatatggtgaaagttggggcttcactgagagttcagcattgatgcagaccctttgaggtcctcttaggcatttttcttttaatcctaaattcgatggaatggggtatggtacacactatatgattttatttagaaaagacttcttaggatgaaggtggataatggattggctagtgagaaataatattagaggaaatatgggcaaaactgttaagaggctgtttcagttgtttatttgagatgttggtaacttggtctaagatagtgatggtctagacaggaagaagttcataaacttaagatatgtttagaaagtaacatgaagaggtattagtgataaattggaggaagtaagtttcaagaatgatacagagtgatgaaaagagagttgaaatagctgcaagaacctacctaactcagcatactggctgctgcttttaagaataaaatgggtaagaaaacctccttgttacattgcattttgtcaacccagagacagactcaagatcatatcgaactaaagccagcataatcagaatttatatgataaaaactttaggcaaatcagagtagacaatgaatctttttaatgtgtttattggctaaagcaatatataatgactttgagatgtcaagagtgtgatcgttgagacttgcaacaaattgaagttctaggaatacattatatcaaaattatacattcttacatgtgtttggctctcattttatttagttcattcttatttaccttttttttttttttttgagacagattcttgttctgttgcccaggctatagtgaagtggcatgatcaatctcggctcactgcaacctctacatcctgggttcaagcgattctcatgcctcggcctccccagtagttgggattacaggtgtgcgccaccatgcctggctatttttttgtatttttagtagagacagggtttcgccatgttgcccaggcaggtcttgaactcctgatctgaggcattctgcctgcctaggcctcccaaagtgctaggattacaggcgtgagccactgtgcctggccagttttatttactttagattagtagggttcaatccataagtaacctgtcactgtttaccttgtgactctgttacaaacttggaacatcagtacatctatgttctttcaattttgagattcgctttagctttttcaaagaagcttttgtttttttgtgtgtgtgtgtgtgtgtgtgtgtgatcattttctattggaattaattacaagatgaatgccgaaattttaatttgaaagtacaccctttgcagcattggtaacactgtccactgattagttattgatgttatgttgctgttccacagtgtactcaaaccactgtgtgattcagagatggacttctagaaattttttttttgtggataaaaaaaaaaacaacaaaaaacacagaccattatattttcaagtaatcagagctaccaaagaagaaaccactatgaaatacagcttcacatcaaattgatgacaaagagtatgtgagttgtatgacaagtgatgaaaaactgcacatgaaggtaaacaaattcatgcaggtgagcagaacaccagctgggtagacatggtgtgagaaaaacatcactgacagcagagatacagtgaagtgtgcatgatgttttgtttttattttctattatgttgaaaaggcaataatactatcttagcattgtcgtgaaatctaaattagttaattaatcaagcattcgataaatggtttaaacacactaggttataattaagcatatataatagaccatggatggatttatgacatctattttatactgttacattttccaacattatgtatcctcatagaatttggaagctattttaaaccctctgctatacttgctccatgctgtctttatgcatcaagatatgcaaatggcagaacccagacaggaaagtcattgccaaaagccagtgcagaaagagatgcagagacagagagagacagagagacagaggtttcagcaacctgcagccatcaaaggaatcgacaaatgttatacatggcttgtaacactgaatgtgaggcctgaagtaaaacacatacatctcagcttagacctcatggaacaagaaaaatatgaaatccacagaaggccactccagagtggaagactcccttcatgtgtgaaaagttacaagactttctcagtaagatggatttggaaactggtctcagagttcattacctatgctgtatagttctttgtatttattactggcttattaagcagtctggattcaatcaggtataaatattaaacatcatatattatcttgccactggtcagctatgcttctgtatttcattgattctaagatgcacattttataaaacatattttagggttgccgaagtcaggatgcatcttgaaaccaacaagtatctttaagttaataaagctaagaatatttaatttcctctttccatcttttaacaatatatatggcaggtcccacaacttcctagtaacttttgagtaaaaacaacccaaagttcatttcaggccagttgaatactttactttcatatctagtttaactctttcacctcttctttatctttagtacccatcaggactttgcctgtgacatctgcagaagggaacacatatttcttttctacttatctttgtatttgcattttacacaaaggcagagagatatgttttatcaagtactacatatttcttttctcaatgcctaaattttcaaaatacaaaatggcagaacgcaaaaatgtttcctggtcgggtcctaggggaactcttctccctccctatatttcttctgttggggttagaaagaggaataggatgtatgctatgttggtgtatgtttaattataaccaagtgtgtttactttataccatttattgaatgtttgcttaatatgcttagttctcatggcaacacttaaaagtattattatctccatattagagagatgagatcattgctagaactaggatttaaccatgtttcttggccactaggaaaaatattttcttaaaacaccatattaaagaactacagtgttggcattgatcattgagacataggtatatatgcactgggtgtatctaagatgaccaggaaagttaagattctagtgctcaaaatgagaaaaactttcaaagcagcaccacctcccaccttggtcaatttgccagtggtaagacttgtctttgtctgtatttgcattttacccaaacacggtaccacatatttctttcctcaatgcctatgttttcttttcttttttcttttctttttttttagatggagtctaactctgttgccgaggctagaatgcagtggcatggtcttggctcaccataactccgcctcctgggtccaagtgattcttgtgcctcagcctcctgagtagctgggattttggggacataccaccacaccctgctaatttttgtatttttaatagagacggggtttcaccatgttggccaggctggtctcgtactcccaacttcaagtgatctgcttgccttggcctcctaaagtgctgggattataggcgtgagccaccacgcccagccctcaatgcctaaattttcaaaagacaaaatgacagaatgcaaaaaatgtatttctagaacaaatcttagagatgtagaagtagtctctcctttgtgcccctatattttcattcattgataaggatgtgtatacaattttgtaattgctagagttaagtaatttggtaatttatttaactggtaaacacttctactgtcatcattctttgcctgtgcaacagcacaagcttctccaccgttctcccaattcttactcttgccaacccccaatatgttgaccacgccacagcttcatgtgtaaatcttctcattcattcttccatttatttaacatgtatcacatatggcaaccattatattaagtactgcctaagcctcatggtctatcatccggaacagtggtccccgacctttttggcactggggaccggtttcatggaagacaattttttcatgggctgggtcaggggatagttttcagatgaaactaccccacctcagatcatcaggcattagttagattctcataaggggcatgcaacatagttccctttcctgtgcagttcagaatagggtttgcactccttagtgaatctaatgccaccgctgatctgacaggaggtggagctcaagcagtaatgcgcaatggcttgcaactcacctcctgctgtgtggcctggttcctaataggccacagatggataccagtccacagccctggggttggagaccccttatctagaggacaggcttgtgttcttggcagggagttggatatgaacatacagatatatcccagaatttggagaaaacaaacaaggttctgagaaagaaagtaacttagagaggcttcttttatgtaggatggtcagggaaactccattgaggaagtgacatttatgctgttaccagaaggaagttatgtagagtggttggtgggggtgaaccagaaaagcatcttgggaagaatgaagagctaaagccctgaaataggaaagcatgacatttctaggaatagaaaaaaatcagtgtggccagatcataacgtgaaccaggtggaagtgtattaaatgggttgagaaataatacagaggttggattttattaaaaatgcaaataagaaaaatactgatagattttaagtagggacttatcccagcttgatttgtatggacagaaatcggtttgatttctctttggaggaaatactgaaggaagataagatggaggcttggaagttagtcaaaagcctgaacagtgatgatggtttgattctaagtggtacaattgtaaacagaacacaagatagatggtggagagagtatgaatgggatttgttaatgatttagtagttgtaacaggaaagaagaaataaaaaataaaaattaggcttctgttgcaagttactgtgtgtatactggtgcatttacagatataaataagattgagaattgggatgggtttaaagaaaggatgggtcaagacttctatgttctgttgagttggctctgagacaatctagtagactagttaagaatgtggtagcaaaatgtgaatctagagatctcaaatatatcatagatctgattggaaatataaattcgttagttattcccacgaaggagctcacacagaaagagagaggtgggtacagaattgagcttgtaatgtatcttagtagtacttaaaagttaggtagagactgggcaaggtagcccacacgtctgtaatcccagcactttgggaggctgaggcaggtggatttcttgagtccaggagttcgagaccagcctgggcaacatggcaaaactctgtttctacaaaaaattgagctgggtgtgttggtgtacgcctatagtcccaacttctcaggaggctgaggtgggaggatcgcttgagcactggaggtagaagctgcagtgagccctgatcgcaccactgcagtccagcctgggtaacagagagagaccctggttaaaaaaaaaaaaaaaaaaaaaaagtcgtctgggagcggtggctcacacctgtaaccctagcactttgggaggccaaggtgggcagattgcctgagctcaaggagctcagaccagcctggacaacatggtgaaaccccatctttactaaaatacaaaaagttagctgggcatggtggtgcgtgcctgtagtcccagcttctggggaggctgaggcagaagaatcacttgaacccagcaggcggaggttgcagtgagctgagatcgtgccactgcactccagcctgggcgacagagctgagactgtctcaaagagacaaaaagggcagacagaggaagaggacccaatatggcaactgttgaggaaaagccaataagggttaaggaaatttaaatttgtaggtaatgatgttttggaagctgacaaaacataatggttagagaaggaaagattttgtttaatgctactaagaagtcacataatatgagggtagagaaacaaatgatggtataaaatctggcaacatggagacgattggtaagaaaattcaagaacaatgtttataatgcttcataacttcctcatagctcttagggtaaatacatattcttggaacctgcaaggcctggcaagatttggccatcatctccctctgaaacctccttattttccaggctctgcttctttctacatcagcctcacatctcttcctgttccttgaacacagtctcctcctttaaatttattatttctgcctagaatactttccttctcctcatactcatttaacttattttcttcaggtctagctccattgctttttattccaggaaaacttcccaacctccagaatagaccaaatatcctattatatgcttaaatcacagtgtggaagtattgcctttgtgatgaaagtgtcatgatgactggataattaattattgtgtcttccactaaagtgtagataggaaagaaagcatgcctgtttttgctcaccattttttcctcatgtcaggtaaaatgactggattacattaggaacttgctctgtatttgttgaatgaatgagtgaatgaatgcatgaacaaatgagtaacatctgcctctgtagttaacttgtaatctgtttctgtctttatataacctctactgtaggtagccttaaaaatctggaaaatgactttattgatttaagtaaatattaagtttttaagcttttaaaaatctattgtaagttgattaactatgattattttgaaattttcttcatcaaaatttgagatgactttggatacatactgttttcagctactcaacaagtgccattgtatttactatgtatgaaatctggtgttacttcctgcccatttcctagactcagttgttctttgcaaaatacccatttatcagcaaccagcccaccctccctctgggaatcagtgagagtggatcacatcagtatgtcataaatactcctcctgttttctttgagagttttctgctgatgcaagcggaaggcttggatgccaggcctgtatgtgatacagtagaaatttccccagatgccctgtggaaagacaagctgctacccggagtccttcctggatgtctggcttagtgtagtataccatcaaggacaacctggctctgtctcctaacaagctgctagggccttccctcttgcctaccctcctgacagcctggacctcaggctaacaaacctctgggttgccactgtctccattctgagccatcagaattgtatatacattcatctgctgatgtctctgtatttcaagctgtatgtctttacacctttataatacacagtacagattttgctgcttaaaattctagtatttcctatagacactaaactcaattttaacacaatgaatatgttaaaacattatatatgtgttggattaacacatataatgcaactcatttgttgctaatctatcttggattccttgggtagaatctgtcttctcacctgtctgaaatggaattgaatctcctaacttcttactatttttttaaagccacaaatcccttttaaaatgtccgtttaaggctgctaaactcacattgttatagagtatattttatatacttttcttccttttaaaagatcatatacacttttctcctggcctctaattttgccaaatattctgccataacagcaagctcacagaacacaagtatttgcttaaagatatttaaagcaaatccccaaagagttttctgttgcaaatgtattttaagacataggctgaggagctgagtattcaaatccatgagttctgacactgatgttttattaggcctacccacatgaaaattagtgcttacttgcacagttatcttatttaaaaatacatttgcaaaaagagaataatttcattttcactgattcaaaggtctatcttttcgagtattataaacttacatagtacaaaaagattggtaaaagggatgagaaaaataaagggcaatagtaaggtgagtaaggaaagcaaaattaaacttggagacttgggttctaaatatagcttgtctacatcctagctgcaagatcttaggcaactcaactaacctctctgaacatcacagataaaatggggaataataacattatctagctcaagggtatcgtacaaattatacaatatatgtaaagtgcaaagcatagttcctgcacatagtaagtgctccataagttaaatataataataatcatagtaaaataatattcttaactacaatcttattaaaaggttattacctagagtttaagctgtggggttatttccatttgcacaaagtgtgatagaaatttggctctgtagttcctagcagccaatgtaagagtaaaacaaaaaagtttgtaagtatcaaaagatttatttacttaaatataagaaccctacaataatgcttccaaactagggtttgcagaattaccacaagggctctgtctgtctaaaagtcccccaagcattatctattgttcaaataaatgagttgcacatgtgtgtacttttatttttaaaggcatatagatattgtattaataaaaccaattcatctaattgtattgttgaatttatactttttgccagtaagcattttcctaatagatggacttaactaagaacatcagaatggtgaagagcattgtgttaatacaattcattgtcttatttgttaaaaaagttgaaaaagtattgctgagaaaaaggaaacaagttaacttttgttaaaggtatctcttggttttcactgtcctttccctcatcagtagcgccaagaacatcttaagtcacagaaacattagtttttggaagcagggtttgctgtaactatagtagaaatgacattctgattccactcctagcttcacaaggatatctgtgaaagatttggggcaaaactgttaagctgtctgaaagtgcttttgcataagaaatgggttttactgctaaaactgtcatattgctgagttttgaatgccctaatggtaaatgatactgggttgccaaaaataaccagattagtagttttttcattcatttggccgtctcagtaagtcaaatattgatactttctactaagtcatcttgccaacacccattttgttatacttatgctgaatctgtttgtcatctcttaagtaagaaaattattgattattttgtggggatttaatttaaaaaaaatggtaatggatactgtaaaggagcattatttggatggtttaaaaacatcttccttgatgggaaaatcttttaaaaggctttctaacttggtgtaattacttgaattaaggaagtgcaatgccattctactgacttagaacaacttttttgacttcctgcaaagaggacccttacagtatttttggagaagttagtaaaaccgaatctgacatcatcacctagcagttcatgcagctagcaagtggtttgttcttagggtaacagaggaggaaattgttcctcgtctgataagacaacagtggagagtatgcatttatttatttacttttacatttttgattcgtttttacagagaaaaacttctacagagataacaattattttgcttttcagaaggacgcatgctgtttcttagggacacggctgacttccagatatgaccatgtatttgtggcttaaactcttggcatttggctttgcctttctggacacagaagtatttgtgacaggtaagtacaaggatattaatattttttaaattattttttctcttttggaggaatgtttgaaatagacataaaaataatttaaatgtgttggtaactggaagtgagaagcctgctgtaaaccatcaagattgttgtctcagggagacatagctagttgtgtgacagaatacattgtttctgtttacaaagacataaatgtttcgggacaaaaaatacaattttaaaaggaaagcaatgtctatctgtatctttatttacaactgttcaaagatattacaaaagcaacattattacttaacttccaaagtgacaataacacacatttataaaagcctgagaattttttaatgataaaataagtgagtttttattcttttaacaaatttgatcttttaaaaagtcataaaacagctttggttgtatgtaagccactccctcttttcagacctgaagtttgcttcctcaaattttgaatttaattgacatattttattgaatacttgggtatataatagttcaaaaatatattgagatatttagtaaaatattaactttctgcaatttttatcacagaatgtattttaaatcaagtttttagtttcttgttaatagttttaatacatttttgctttagaaattcttgtggagccaccgcccttcctgggtggtgggtaaatattacagccttgatgagatagaaatatttaaactcttaaaaatcatgcaaatgctgtattcagtaggaaaatgcaactagttggacttccagtgcctattaaagtttgaaatctttgcacatttatggtctattcaatggatagttcttgagcggcgtcaatatgaatcatgagtacatttcaatagattatagaatgtaactaataattaatatttaatatttctctttatgatgtagtatctaaaaggacattgaaaataaaatttttgtagaaattccaaaaagtataaaaagtattttaaaacaacttgcttattacaattcactttgaagtctttttttgacttttaccgttcttctttcctctgaaagtcagggaagtagctacctcttgagcatgttacattgacaatttctatttggagaggaaagaaagaggaaagaaaaacaacataagatttttgttgttgttgttgtggctgttttgctttttattgcaaaggtgaattttttaaaaatctatatatttgcagcatttgtcttagtacagaaaatgtttatcaagttaccatccctttaaagcttatgataataaaaagtaaattataaagaataataatctcaatgaagtgatatatgtatattatcacaaatcagaacagattttcatttaaaattcccactcaggaaatgtcgaaaagcatttttaaatgagcataaagaaatactgagacattttgtaagccagaatatttttcttctcttcatattcatttaacttctattattttcttcaggtctagctccattgctttttattccaggcaaacttcccaacctcctgaatagaccaaatatcctattatatgcttaaatcagagtgtgaaatatttcctttgtgaataaaaattcaactcattctattacaggatgtttttttaaccataagacacatctttgaatttataattgaaataatatgatggggtctagaaacctttatatcaactttgctgaatgatttataccatagcaaataaatggatatacataaatttattttgaaaactcaactttatcttcagttgctcacataaatattgagagcaaacatttttctaaaagacatttgtagactccctgagatatatgcttatttgtggaaaaacatatacagatataatcatttgtatctgcaaatattgtttataatcctttcaagttgcaagaaacattttgtgatttaatgtataatttggaaaattcttaatgctttaaattatttatttttcttttttagcaacaaatgagttggattctatgtttcattttaacgtgttaaaattagtttagtgcctacaggaaataataaacttttggggaacaaaatttatattgtatgctgtaaaggcataaagaaatagagccaaatgtagagagccatcaatggtaactctatgcataattcaaatattttatttaatatctaaaatgcacacacggacaaggccaaagttaatctttgccacggcaacaaccaggcagggttcagttttactcaagacttcctaatcctcttgctctgtgcctctttgccatggcaactggaagccaaactttgtttagaatttctaaataatgttaggggacaatgatggttttaagaaggcaggtgaaggtgagtgttctctggttctaataaagttgtaatgccaggcagatctaccacactatagcatggcagttaggagtatatgagttatggtatgtgaggtatatgatgagttttgttatgagtcataacagttaagactcatttcctggacataattcttcatttttccatctgtattaaaaatatatatctcatgttataaacatggactgtgccttgcacatcacagacattcaatgaaaattatttaattgaatttggtaagcagtcctattaagttctaaatactccataatttagagatttgggaatgtgattagaattacttattaatttgaaaaaaaatgtcctactaaaaacctgcctgtgacctttatcattgctaaagtttgaaatgtactttgttacaggaaagactacggctagggcctatattatctttttctcttttgttctgtgtaagtaagtataggggcagagtagttagcttgaacttagttctttctttgttctggactatttgctatcctctcaccagtgacaattaaccagtatagaaatatagatgtttctacattgttcatatacttgaacatatatttctttatgtagatactcacacataaactagttatatatttgtgggttatatatactagtcaatctatctatctatctatctatctatctatctatctatctatctatcagttctccatgtttgtctatttggcgttcccatgaacttcagaccttcgcctgtgttctcttttctccatttggttacgtatcattgcctactatgtgttgatcactctgattctccatctctagactcatccctcagaaacacggaacttactacctttcctaaatccagacattaacatgctccccaagtcctgaaattttgctttgtaataatctctaataacttcttgctttgacacctccattgccatcatcttaattcatggctttattatttctcacctgtaaaattgtaatagtttttttaatcagtctgaagtctcatcctttttttaatgtaatctacagcttaaaaagtaaaataaaaagtgaagggttactgatttcttctcattgcctttggtataaattctaatcttttttgccagagaaactggttccactaatgatctgggggctaggcctggagctgggaagggatcttttttcttttctttctttctttctttctttctttctttctttctttctttctttctttctttctttctttctttctttcttttttctttctttttcttctatgattgattaaaagaaaacaaacaggaggtagttttaacacccacctctatactttctcaaggtgtttaaggttctgggcaaatcctacttcttctattatgttctcttatgtcacttttgccacaaaatatttccattgaattgcacactttttatcaccttttcttggcatttttcaagtcatttcaatctgctcttttttgtgatgatgattgatgatgatgatgacatgtgaattagtggatttcttgacattgtaacctacatgaaatcaggtataggagacacaaaaggcataaactcatagttcccatacctaatttttcaccagacactgaataaatcatagattaaaaaaataaaactgcatattgtagtgacaaaggaaaggaaaattttcaaagagggaagtcaaaaagagggagaatatgagataaaaaaattaaccagaggcgaagtgggaggatgaagacagcaggactattttgtccagattaaattaagttgattttggatctagatgtttacagtcttgcctttttgtttttgtttgtttgtttgtttgttttttctttgctccctttcttactctccttatctcacctctcgtctggaaagagcctcctgacttcctaaaagttcatagtttgagaatgtttttcctaaattttctttgatctgctctttggacattctaggtaatgtaatttggagggtcaattttatttttcagatacacatacccataggagaaaaagcaaggaatgggagggaaatacaaatgtagcggagtgataacacaaacagatcaggtccagtcatggcaattgctggtttgaacactgatgctagtgctctgggattgcttgcaagggcagatggaatatggtgcaccctaggtgttgcattatttgcacgacaaaagtttgtagagagctgggaataatttctttacagacagtgtggtgatgaatgtcaatctgagtaggtaaggggcagagatttgtactgaggttgattcattctcttggtaaatacacaatgttcacaaaggcaaggtttcatcttcagaccatgtgtgtatatgtcaccttggtgcagagagagaaatttttcatcagtgctgacctttgatttttttttctagacatcttatagatttatgtagttatttacatgggaaacaattagaatggaaatttaacatatcttcagtttaaaattaatttctgtctagtctaaatatctttgtaagtactagatactcaatcccatagcagtggccttttaccaaaggcttagtgctatgacttttgcatacataaagacctcactttttaagatatgatacaccagaaaaaaaatatggcaagactttagcaatatgatttgatgcctatttctatataatacccaaatatacaggaataaaaattatggcaatcactggattttgtgtacctggctctaaccaatatttatattagaaaatatctaattattgtctaaaatatttaatcttcattcctgtttgtatgtcagtgtgctacttcaatatcagtctgttaaaagagtctaggaatgactactataagcagagaattatatgttcaggaatcacaacaaaaaacaagaacaaatagagaaacaaaagctttcctactctttcatctaggacaagaataaatacacataaagtcaatattagtgaagtaaacaagcatcttctatatccattcatagtaccttcaattgattgatttcttaacagacaatcagcaaaattatcagtttttattagagattttagtagagaccgagcttaaacaaatatattctatggtgcttaactctatagtatttaaagattcaatatttatttcctctaaaaatgagtcaagtgtctgaaaggaaaaagccacctaactgaaacttcagtttctactatacagggtatttattataaaactgtaattacaatgcaattatattgaagtataaatgatcatcattcatttatttaagaatataatcaaaatttgcatacctggaagaaaaccatccaccctccaaaatagggatttgctaatgtaggagtagaaggcaaaagttgagggtaactcaggtaacacactcatacgtattaggatatgaacagctggtatagcaaacttgatagaaatcactgatagacaagaagacattctctgcattttaaattaaagtacaatttgtctgtggtcattcaagagatagtttagagaaacctatacaaataacaatgatgctaagagacaatatcaaaatcacaataaatatcatggcaatacagtgtggccactatattttaaacacatccacttgatgaaaaatataataatttactgataaaacatattaagcataatagaaaatgaggcagaaaccactccaagctgggaaacatcatgacatctgtagtgataaatattttgaaaatctaactctatgaatcttgtgatttttagctaaatcaattttcacccttgagacccaatttcctcatctataaagtgttgtaagcattaaaagttataatatttgtgaaaatgctttgaaattatgtgatactctgagaagtaaattttttcatgtgagcccatgaaatcagagcacatagccttttagcataaacttgattccaaatgatatctcttcctttcagacactgtgagcagataaagggatagtttaaggttaagtgatagaggcataatcccttataggcctttgaattcttttaactttgcattctttatttcagagatttttcaggcttctccagattctacagtctaaatagtttgtaaatccacacacttctactttgccagggatttcttagtgtaaaaatatcctgaagtctcacctgccttcaatccttactgtgtccatacccaccattaccaggataatctttgtaaaaggcagaacttacctttgtccattcctcttttaaaagctcctattggtagaaaatatactgaacccgtgatttgataccaagtatgttttggctcaacttttatgaaaacaaatatttaattagaatataccaacatttatgagttttccttaaagataaattttggaggaaaaaaactccattagaccaatttaattccctgatgattatatatatattacctagtgaaatccttggcagtttttccattttaattttaattttactgaactaatgtttagcagcatcactttcatttaatttttacaataactattagattcatgaatccattttacccatgtcaagttctactgaatatagcttatgcttggaattttcctttgtgattattacttttctaaaggtaattcttcttttcaaacaatacagatctaaattttccaaaaccatttaaattcttctctttggccagaaacattttctgtgtgtagttttggctaccgctagtttagtttttttaattggttttgtgtctcaatgctacaaaaaatataatttatgtaatttttcatttttgtcaaacttaaatcgggcaatattaaccattctcaattttttgttgtgttgaaatttctatcagtgacattaatgtggagattgacagctctttgagctagattcattttgaaattttaagactttcgattatttcttatctagccaatagaaactttagaaacacttttaagactgcttgatagcctggaattattatgtttgaattctcattcatttgtatggtattcctcttattagctttcacacttagtaccaatttcttattcattattggagcaaaaagtaaagagaagaatcaaggtgataagtttaaaatcttctcaatgtaaaatagtgtgtggggaaagtgtcaaatcatcctactttggtctttgtgcatttaggaaaaataaaagcaattagcattgcacacacatatgtaattgaatctcttcagatttgtctggctttatctctaaccactttgtgactctttttgtaacttgcatttttctaaaaatgtgaccttgtttggtcttcctactgttggccatgctgtttttccttctctccacatctttttatcaatggtgcaaattataaattgtattcaaatttactgtaaagatcatgtcctctagacagcccctatcccacttgtataacccttgctcttcagcccctttcacacctgcataggtattcttctgctgtgatgatcctttgaataattctcttggagttctctttaccaggctctcttgcagcaactggtgagctcatgtaggctatcactgggtctctgcttatttgccagtgcctgcaggtcctcagtacctgtttgctgaacaaacgaatggtctgtcagcttaacccaactctgtatgtagaaggcacttaataattcttaaaaacaattttgattctgtccttttattgttatttatgggaattatttatggtaaaaatttctacataatagaaaatttggaaaatgtcaagaaatagaaggaaaaagaaattgcttagagcccatgctaacattttgtttttcttcctctatcttttgatcacatgctgtgtatgaaatttcatgttcaattttttcccaagtaaaccttgattattctagacaatttgaaaaatatagaaatgaatagaaaaataagaatttcaggtttccagttctcaggatctaaaaactttttgagtatttcatttgactaggacaactagatctattcagttatttattaacttattagttcatttgataaacaactattttgtgagtgttttccatgtaatttgggctgaggacacctatcccatgaagcccgtattttctatcagtggcttcttggagatggtgttttaaatcttccaaaatcttcatcagcaccccaaaacttcctcctcaaagtaacaacataccttgctacagataattattggtgttatcaatgttttataaattataaatttaaaaatcactatcttaagatctatatataacatattaagtaaaacttatattcttacaagacttcctccaggtccctgttacaaccagattttctttgcagacttttaaattatggaagttctggtgctgccactgagttgtgtagattattattagatattcaataaataaagttggtagatgtgaagaggtactagacaatagtcctattttgttttggtttgtttgttttgtaatttattctgaaaaaatgtttatgtggagagaaaagggaaaacatacagaaatacacagcacacaaacaaattcttacttttttttggtagtctttctaattttccaaggtcaccagctaatagcaaatgagagttgtagggggtggggtgaaggctggggtcttaatcggggtctatctgattctagatagaccagattctagattttccactcggttactcaatcttcttagtggtcagtttaataacctggaatttaagacatgactgtgtgatgatgggcaaatcacagcaggactgaatgggagctggtaatttctcagaggttgtttgtgtgacatatgcatgtaagttcattcacctgatttagctacttacatgaaccattgtgcactgagctgcttctatatctttagcatattctgtatctatgtaaaattcacataagattgtatgacttttataaaaaacaaaaagacatctttgattaatttgtcttcactatgaatactgatgtgatgtgttacaatcatcctgaaaaggaggctaacaaaggacaggactgagtctgtcttgaggtgagtgatatgatggaaagaatggattttcccccacccaactcatttttgatattacataaagtgaaaaacattaaataattcaccaaagtatctagatttttttttgtttttgaagtgcaagggaagtaacttgacctttgttaaacactttgatcatggaaaacacataaggttctcatcttattccaggaagtgtagacactagataatcttttcatagtcatccaaaaagcatattaagtgaaccaggtaaatccatcctacactttttattccagagacaagttggctaaactttgaggagactaaaacaaaacaaaaaaaaattattgtttggttcatttgataaatgtggattccaatcatataatttaggccaaatattatactttgacttcttagacttagatttccagatagtctggtttataaaataagattttaactatgcttactaaactctatgtatttctactttccaatgacccatgttcttattttctgaatttacttattgatgctttaggtatgataaaggtatgtaatggctaaggaaacataaatgaagcataagacatcagttgagagttttgacggaaaggaagtggtgatatgaaggaaacagataaaccaaagaaaaaggaaaaggtcagggagctgataaaagtaacttgaagaaactttagtgcaaatgttggattcagacaatcgctacttttaaagtacttaaagaagtcagtctttgaaatcttgcccgtattccattccagtttcatcattggagacttccaatgatgaaaaattggggaagaattaccttccaaagcctcagtttcctcgtgtgtaaaatggaaataatagcaagagatattaaatgagatgattcactcatcgattcatcaattgtttatagagcccctgctaagctaaaaactgttttaagtgttgacacagtggtaaagaaagcagaaagtgtaactacttttatgaaactgacttcctagtggtgagagataacaagaaaacaaacaacaaattgagataacttcagttatagataaatgctgtgaagaaaattaagtagtgtaatatggtagagtttaatctggccagacccagatttaggggtgaatgcacttttagacagagtgatcggggaagatccttatgaagaagaatcattgagctacctgttggctgacaagaatatggggatccatgtgagggagactggcaagagtaaaggttatctggcaaaaccaaacaaattggtaggttcgaggcacagaaaggtcaggcatctgtagtatggtgagtaagaactgagcaggttgtggtgaggctagaaagataagcagaaggcaggtcccacagggccttgatggaaatggaaagagcttgaattttacctgaagtataaagggaaggaaccattttaagttcttaagtacagaataacctaatcttctttctgtgttgaagagatcactttgactgttatgaagagaatagattggaagtaaggcaaagcctggaagcagttatgaggagactgaatgggaggatggagaaaggggatggtgatctggaccaagtgttggcagtgcaggtggaaagaaaggaaagactgacatagaattaagagaagtggctgcatggaaaagacaaagacattttagagaatgactttttttccccatgagcactgggatgggaaagagccaaattagggggtcagaaatccagagttatgtttgggctgttattgatgtctgattttcattaggtggtagagaggtcaagaaatccgttggagataagaggctgaggcccattcagtaggtctcaactggagacataaacataggagtcattgcattcagatggagcttaaagctaagggactgcatgtgacagtgtaaataaacatgtagagagtagcagatgactggtttctgagccttgggaaacttcatatttggaagagacacaaggaggagctaggaaaagatagtgagaagaggtagccagtgaaaaaaagtagaactatactttgctttgaatgttgaaaagggttggcattatagtgagaattcagtaaattccacataaaaatctgaatttatgtctcccctagaaaggttggttgtgaacatgcaattggtaaatatctctattaactttaatattgttacaaaagtaatattaaggaatttataatatttggaagaattagatgtctttacctaatatatcccttgctagcttaacaattagaaaaagaaagaggtacatcttaacataatttgttttaataaaaactacagaatatattgagagactaaagaattagaaatttaactgaaaatttcatgcaaaggtaatgctctgttgaaccattttgtagcttatgttttgttttgatacatattttaaaatattgtttaagacaatacttgaacagattgggattgtgtgtgtgtgtgtgtgtgtgtgtgtgtgtattggttaaataactggtttatttttaaactgaaattaaaccttccatttctttgagaaatttaaaaagtagttgttatcaatgtggcagatattaggtagaatctaatatcgtgaaaattaaactgcacataaatagatataaatccttttgtcagtgtgtgtatatctctgtgtgtaattttgatctcaggcttggcaggtttccttaaaacttttttttagagctacttaattttgtacttactggtggttagctaataagaaaaagctaataaaaaatagtgcttactctgtgccaggcacttctgttaacattttataaatgttatctcatttaacaagctcatgtcattgtatagtctagcttatacttgtctttaacataagcaaatttgttaatttgtgtttcctgatattatcataaaatttactggttgtcatatcctaaaagggaatagttcaatttaattttccttgttctaattttaaatacagtactaaggttgagaaagaaggggtcaggaaagggaagtaacattgagtgtctcgtgtgcctggcactccatatgatgcttcaatgcacaccaggctattcagcctcagatttgtttctacattgcttctagttctacagattattcaacgaatgtacaatccttggtcactagtcttaatagggaaaacagaattatggttaaaacaaaagagtaagtaacttaaatatgatctatcggtatttattttgtattatgatattttgcttaagttgaaaaaagggcgcatcaggtgttttggcagtttactgtgatctcaatagtgagaatgtattgaaaaatctcagtacaggagaaagctgtgcagctttctcttcctgtcgctgcttaattttcatgtagatataaagccgcagtttaagcacatctgcttaatccttatttaaaagactaggagagaactagaaagggagggagggagaggaggggaagggggaagagattgagagaaatctctcccatataacacaaacactgtattagtgtgtgagaagcagataatcgtgcatgtaggcactatcatttgtgaaatcagaaagcataatttactcccaatgctgaataatctagttgtgtgtaagcaccagagagatatttaaatacctatccaataaaagataataaaagcctagcaaacctaagtaatccattttcagatgttaatccaattacgtaaacaaatattacccttttttttttttggtcattgtttcaaggataaagtgtaaatgaaagaaatagcattccatctaggtaaaagaggaatcagcatcattgaaatgtgaatagctgtgattcctccttgctgaatggtaactttagaagagagggaacccaggagtccatccagaggctcaaggaataagaggttctcacccataggaagatgaaaaatactttcagggtgacccatgagggaaaatcaccaaagcctttgaaataaaagattttcccttttctaagaataaaagatggtgttatgtcaagggcggctcgatggtgtggatgaaagaactattgggaatggctactgaaagatcaaaggcaagtggaacctcaaaattctggaagtagaacgagtcagatacaatataagaagtacttcaaaggcaagaaaataagaataataaaaatacctttagttgtcaaatgtaaaatttgtgccagttttgtcacattccatttttcaggaacactgtaaaggtattttctattaatatcaatttaactgtacatatcttcccatctatcttaattagtcacttttcaagaacaaatgtgttatgctcaaagcatccaaaggacttttttgttagccttaataaaatgctttctcttaaactaaattttaatttagtttacatgtctacgtataaggtggttatagaaaatgaatgtaaaatcacttcattaagtgtaacaaaacaaaataatatgaggaattgttatactgtttaagcatttgaaaaacgataaaggagtatagaaattttgttaccactactatgattagtttctcatttggtttttcactttaagaattggaataaaagttgaaatcttgattaaaaaaacaagaaatgattcacaaattattttacaaattgaaatactgaaatacagaatgttcaaccactgtcaacatgaactcctattctgtaattaatctattctataaacatctgtatttgctaaagagcaacagatcaaggaaaagaaaaaataatccttgccatccatagagccatgatttttgtggaatcttcgctccagtttaagttttgtcagtgtctggaagaaaatacttcccatggatcatctttttgctaaagagtattctttacattttaaaacatatgaatatttacataaaggtgtttgtggaaaaggaaattatgtgccttttattttaattcacccattattctattccacatgtaaagtagaaaatactactttaagacaaaagtaaagcattatttatttaaagatctattttgtccatgaattttatcagaggtaacgcttcttaatgttattcagtgccataacttgccttttttctaggcctccattttatgaactgaacatctggatttgatggcaagaaaacatttccttccgctggcttttctaataactccctcttacagatatgcatgcctcatgtttgttaataaaattgacgtgattttaatatctggtattttaacacactgtgaattatggaattttcagtggctttatttaattaaatgcattttaaaatccttacaaaaaaatattaagagtaactctaaaatgtattagagccacagatgttttcctttatagtgttaattgatttaaggtccatcaaaatgctgttaaaatgtctagaggttaacaataacagtggcacatgggtcagattaaaattctttttgagtaaaataaataaataaatgacagcttattttcttctgatttaaaaaaattagctagtggattgaaacaacaatgtgatagctaagatttcattctctcactttataatgaaaggagatttaaaattagggattatatggtacacgaaaaatttatatacacagattacaagtactagtttttttagtgaagaaaatacaactatatattttctctttttatctgttgtcctattttacaattgtagcaattaatctgccaaactctttaatcaataaaatatggtatttaacaaccaaatttggcccctccctccccttaaatatatttccaatgctccttgctccattttaaacctgctgtcctttataagagaataatatattttgtaatttgagaaaatcatgcaaaggaaagtttctcaaaattcacattaatatgtaataatagtaataaatatgtataaccataatatcttagaattttacaatattttatagaaaacatgaatattaaagtgaaaatttaaacacatcaatttttcatgttaaaattactaagaatgaactacagattcatgaatactaagggcaacttttatctcaggaaatatatcagtggactgaaaatgtcaaatcaattcaattaaatcagtaataacactttgctgtttatgtggctgttttttcttctatttttattgtcttagattgcatggatacaatcaaaataagttaatttgtatacaggatataaatggaccagagaatgtgtcttctattaaataataacaaataagaataccttttattttgtgatggtctttactatttactgagagacaagtattgttcaagttgccgtttttttttaattagctgacatatttcctgcttttatttgagttagaattcctgtaccaaacattttaaaaagagaaaaaaaattaaagaaagagaaaaggaatttggaaactactataatgtaaagtagcattatttatacaacaattaattttagagaagcaagagaccttagaaataatctatttcaacgcatctattttacaaaaaagaaaattgaaactcatagatatttagtgacttgtcctttgttacaccaaaaatgagggaacttggtctagaattcctccagcatattatgaggtatttgttctgtggcctgatacaatgaaatgaatgttggattaggcattttgggacaagttttgaatcctaactctattactaattcctcttcactagactgagattctggtatgtggtattcaataagtgacttgacttctttaagcctggtttctttttcagtgagatttacagcttagactagtttctgaatcttgaccctgtggacaatctagttggagaactgagatgacctgggcattgtaggatgtttagcaacattcctgcctctgtaaactagacacagcagcacatttacccaacctgctctgactgtgacaaccagaaatgtctccaggcattgccaaatgtcaactgagggcaaaattgcctaccctagccaccttaactgaaaactacaaacttcattgaaataatttctttatggctcccagcagtaacactgtgctattctagaccagttggttaaactactggatgcttcatcagaaagcacccactaagcatcactcaccatgaagttcgttgggtactctatacaatgaacaaaggagatatcacataatttttaaaaaacttaaaagattcacaggtgagaattttgtagtaacaattaagtattaactattagaaaaatttaagaagttttaacaaaatgatataaaaatatattcactataagtaggatgtaatttttgtcctgtaagagttatccatgtatttacgaattgtacctaccagaggttacaaaaatttggtcattatttgaaagattaacagggacttatttccaatcatagatgttcactatactattctaagacatttgcaactgtgtaaggcagtcatttccagtaagaattgctagaacaaacattaagcatttcacagtgaaaagggtcataggtatattttcatcctttgcatatagaagaaatagcaatctattattctcagtttttgacttaaaaggtattgttgcttccctttctttccctcccctactcaagtttttgcccatggatccagatacctacaagggcctaatacagggaaagtgcactgtgtatgagctatgaaggcacaatggaagcttgcctggcaatcagtgccagaacagacagctagtctgatgaattctgctacacatcacagggctactagttttttgttttttgttttttttttttttgtcatacattactgcaagttccctgaggaagtttactgatctgtagttttacgagaaatgcacgtcatggaggtggcgtgggggagcgggtgaacaaggaaactttagttgctataaaacaggagctgagagctcaagcaggttggttatgttctgccagatggagataaaactgtggcagccacatcctgtgactagaaattgtttaagtaggcagacctgttggaggactaaagaacattaggcaaggagattaaattagtgtaggaaaaaaaatcagttttgtttaaaacgaaatatctacttgtgttaatagaacattctaactccaccataggatggaatcaagaggttttttttttaatacatatagtgtatatatataaatatatatatacacacacacacactgtatgtattcctatgtagattaaatattttgatttacctctttctagtaaagcaaagttcattctgaaatccaaaatattcacttactagagcagaaaaaaattagctgtgcatttatgctgatcacagtgtagataattaatctttaagaaagtaggtttttctgtttatagttgataaagtgttagtggcaagaactttttctgttattgaatattatcatcagattactcgtgctttccattttattcctttaaaaaaatccaacttttgtaagccaccactattttctgaagattttatttctctctaagctaagaaaggatgtcaagaataaaccattttctccttttaaataaaaatgcattcactatagatattcatttgaaatctcaaacatacctgaattaagtatactcagttttgtgagtgaaaattaattattatttaaaacaaaacaaaacaaaaaaaatgttcagtgttttcattttacttctcttgctgcttttgggctctgactgggcccggaagcagaagttgcaaaacattatgagaaaacttttgctcttttcttttttttcttcaatctccacccatatggaaataccagaaatctgaaaccccattcttgctaaatattcttctcaggattgtatctctactgcaggtcttctatgacgttttacagctggcctctttccattcagaattgctgttcatctttgaatgtctctgctttactcctgaatgaacacaaacacattttttttaggtttcttgttgacattggctttctttatagcccataaaaaatgcatttgtggcatctcttccacagacaaaaatagtataattatgattcaatactcgatgaatgtgtgttaaactaaactgtgcccaagctctgtgcaacagtacaggtttttcacctttccaggggagagatgtggagcacatatacatttcagccatcctacatgcccacagggacatctttctggtctgtctcattggaatacccttccttatttggtttttagtttctttctgctttaagcacctttcagagagagagagatgttttcctttgtctttgtataggcagtgcctatcgttacagagtagcctttaaatacatatttgttgaattaataatgatacacatgaactgatgaggctctataattctatgagataatctggtatcgtgggaatattttagcatgttttgtatagatagactgacactatgactggtaatctgatagtaaaaatggcaaaatattgagcctgagtattattttattatgttgctttcttatacaaggagggaataaaataaagtgatgtggactgtaattgtgctcatgaaagacacaatgtatacatacctccttgagacggaatgataaggataacgtagaatgtttaccatgatttatcaatctctcctatataagaaaaatatttcttgtcctgaagtggtaactttggtgaagtcttttgcttgctcttttacagactaattaacaagttttctatgccggctctgtcctttcctctcctctcacccctgaaaagtggttaaaagtttggcatttgttacccagaatactaaatgtaacacatatgtggcaagatttgatggaattgcacttctgttcttattatgttcctttctggaaaattatgacaatttgtgtccccttagagagtgtagcacagttttctggttgctcctcatgataatccaaaaaaaaaaatccagctaacccttaccttttagagtaagaatctttagaagaaagagtgctttcatcaaatcatttgagaacgttaagttgaataactgatacggtactaccctacagacatgcgcaggaagtatctgcatttctgtggcgttctgctaaggaaaagaattttctttccagacaagatttttcaaaatcatattttaaaaatatcttaatgatgaatttgaagttgagaaccaacttatttcaagtaaaattaaaattttgagagataagagaatatactttttttaaggttagaactcagaggccattatgacaattaatgggctagtggagacacctggtctctaagaaggagacaccagcttcttcatgttttgatttctgccttgttctcttgtctgtcaccactagacacatactattttatagtaattacttgcatattttgtagaaaaggcagctgtgttttctacaaatatttcacaaatgttagtattgctctatgccaaggaacagaagacaaatttgtggaaaagatacatgtggcccctccccaggtgggatttcttgtgtaggccccatgcagtggagggacagagggggccagtgctcattttgaggacacgatagttcggactgtctgaggaaatcgacagtgtgtgtttaatgaccaaaccaacatggctttgaagaatacatatatatttttttttttgctttttttttttcattgcccaggctggagttcaatggcatgatctcagctcactgcaacctacgcttcccaggttcaaggaattctcctgcctcggacttccgagtagctgggattacaggcatgcaccaccatgccttgctaattttgtatttttagtagagacagggattttctatgttgttcaggctggtctcgagctcccaacctcaggacctcaggtgatctgcccgccttggcctcccaaagtattgggattacaggcgtgagccactgtgcctgaccaagaatatttttcttaatttttctgtaaaactagttgttttagttttcaaagaaagatattttggtagtttttctttaaaatgcatatcatcatacagaaatcattgtccacgtatatggacatatatatctatataaatagattatatctatataaatatatagatatatttgtccatatatatgtccatatatatatatgatcttttttttgatatagtgtcctagacctggaattcctgtgttaaaaaatgaaaacattttcagtctcttcatatatattgacaaatggctttcagaaaagttgtttcctctattctcttcctaacattgtatgagtttcctttcacatacttttgtcagagtttaattttatcattttcaaaagtgttacttttataaaaactggtatttcttcaatttaccattttgtgattaatttaatttttactgtgttcagggttttatcatatgcttattatttacatttcctttgtgaattgtgttcctatgatttgcacatttatcttttgtgcagctgtgtttaaattttgaatataaagttatatgaaagaggaaatatgtaatttacataaacacacccaaatatatgttgtgtgtgtgtgtgtgtgtgtgtggtgtgtgtgtgtattctgtgttgaaataaatggtagaaccaggacaacaggtagaggttatgaggttgtcatctgtgacacagtctagaggagaaactgtgtgggcatctatcaacttacctttttgaaagaatcttaactattagtttctggaatattcagagaagacttgtaaggccaacatggactctagtttccatcctcctgagaagacattccattatgaaatctaagtaactttgacagcaaacccttcagtcttatcattttcattagataatctaccaccaacacaatgatccaaaaatgcattatattcttgcactggagttcttcactttttgcttcaccccaaaactgccgctcctaaccacatgcttagctgctaactttcacaccaggcttatgagaacagtattttcagtaagctctcttttcaattcctttcacaatggagctgcagaatctttgagttgaaagaagccttagaggtgactaggatcaatgtatatatatccctcttaccacacacactcactgaatattttctaaaaactacattaagaaaaaaagaaaagcctaatttagtgctgaactgctgaaatattttgaaatttgtggtttcaaaatcttaacactgttaattgaaaccaatgtttctcatgccttttagtctctggactcctttttaaacattcttaaacataaacctaatttttagcataattgtggaatataaagaggttttgtctatgtgggttatatatatttattgtaaaataaactagatagaatttaaaaatatttaattatttattaaataataataaatcaatatattaatataaatagcacatattgtatgaaaaacaaccagatattataaaacaaagatttaataggaatagtgtcacttttttgcatttttagaaatcttttaaatgtctgtctgaataatagatagctggattctcatatatgctttaatattctctatctgttgtaatattatataccatatagtttctggaaacattaattttctactaatgagagaatgagagagaagaagaaaaataacttcttagtactgttaggtaaataataatactcataacacttaattaatattattttgaccttgaagaatctttaaaaggttcttggggactatcttgagtctccagaaaacactgagaaccactgatacgccaacaagataaaattcttatccttaccgcagcatggaataggaccatactttcttccttataataatacttcaagtatttgaatgtatttattgtattttcatctatactattattttttaggacaaaatagacttctttaagttttccgtatttgacacattatcttgctcccttccccactacctacctccggttagcctcctctgaatactcttggatttcaatttcatttataatgtgtgatattctggactggacacagcacttcagggacctggtatcttgaatcaacaaagacttgtcttccaaacgatggtgattaagaagccaccatgtccaactggtcagccagtttttatattgtacaaatcagcaatctcagagtcaacctaaccagatttaggcaaggcacttccatgatgtattgatgtattggctattttattaatagtaatatcaataaaaataatcattaagataactgataatattcaggacttcatatgtgctagatgctatgtttaatgcatacatttattcactcttctaattcttaacaactttataatgtatatgtatttcttattcttattttatagataaagaatctgaggcatggaaaatgtaggcaatttatttgagattacagagctaataagaggcagagccaatgtttgatctgaacaacttgattctaggatcattttggctgggaattttctgagagctgtgtgtgtgtgtgtgtgtgtgtgtgtgtgtgtgagagtgtgtgtgtataaacatgagaccatattagtatatacacaaatgtcaatatatattttaaactggaatgttttaatagagtggcttatatgatagaaataagagaaatagaggaggatggaaagggacaaaaaaagggaaaagtaattaggaatattgaaaaacctaaaatgtagttctctccatattctggatactcctgcctttttcttccactttccacacattgaccagtattcctttctcctttcctaaaatagttttacagatactatagatacccttagctatttgacagttatgtttctgttcttttaacatgtctgcttctataactgtcacacttaaatgttttcataggaatcatgaaaactatagtttttcctccaacgtaaggatctcatatcacgctttcattctgaactaaccattccctctctgcagttgatgtaactgtgccatgtgaccattgtacacatgtgggagggaggagctgaattacgcctgacccctggccagagcaagagctactggccaaaggggagattgagcatctgtgttgtacttcccacgtctcttcacctaggaagtgcaatagatttctgacgagtctatgattacccactgatgaataaagacaatctccctgcacaattgcactgcaggcaagactgaacttatgaccaccacttctgtgtaattttgaatttcttagacctgaaccctgctgagtacacctgcttccctctattccttgctgaagttcattcttttcagtgcgttaatggagccaaaccaagctggtggtggtaacaatttgaataataatagtctttaactttttatcttttgaaaaatagaattctcaggagcacttttagctataagattccttcatccaattaaataagctttaagcttcatgaaaagtgtaaaagggcacaggtgcatttgtggaaatagaaggaagcaatcttgagcctgaatacattgaggtactggcaagcttctggaagtagttgaagaagacttcagttagaagcttggtcaaatggacaaagccctgacctggacattggagacctgtagccaccttctgaatccacagctgacctagtggccttgatatataatattgattgcaggatagttttgtgatggttaagattgcaggctttaataactagatttcttggatttaaatcccaactctgccacttactgcttttctctgggaagagtgattaaccgctttgtgcctcagtttccttatctttaaatgaaaataatttgagtgcatacctcacaggtactaaagaataaatgattggaaaataaacattattgaatatatgttagtaattattattttcattgttatgctattattatttttattattaatgtatgacatcatgttacctgcctaacaacagagtattgagacaaaagcaaaatattttttctatattaataatcataataaacaccactaatgtttccaaactatacttttttttaaccctacatgcctttagttcatggaaagaaaagtatgttaaagatgctatgggggtgaagagaatgataaatattattatttaagacaatgtttgctataatttttatatatcaaataagtttatatgttctcagaaaattggtctttgaataattgaggacagtgtgggtttttattctgtttctggaaggcggtgcctgtggctgtgagaaataaggaacagaccatcttcccacatttgagagggaactatacaaaaatgggaaaatatttgttttaaatatcttttggatgtgaattttgtcataattgcaaactgttttggcagcaaaacgaattatttcggtagcaagaagagacttaacgatgctatgtgggagaaaaactaagtccctactatctttctgagagcacgtctcagaggacatgatgtgatcctgtaagtttgtagcaatcttattgtgccccagtgcagacactccttcctacttccctgtagaaaacagaactgtttttttaaaattctttctcaactaccatttttaatagtcatgttacttgatgacaaaatctgatacagtggcctttaatactatatagtgaatgatttttgaaaatttggaaaactctaaccgaaatataccaggaactgctctcctcttcatctcagatgtctacttcctcttcagacctgtgtgtgaagctctagaataggctgtttgggaagactacaaaatctcctctccgaggtcccttataaccctgatagttgctagatttgaaatcaaggatttattctccccctgccctgagcctctcccttatgtccacataggctctagcattggaagaaatattttaagatctctttctttttgactttgtgatactcccatattaaaaatggcttatgacaggaaaaggacaaatatgctatattttttcccttaaggctaatgttctcgggactaccatgaaaaatccaggtatcctaatctggagggttaccctttggatctgaatgggattggagtcagtacaaggggtggggagtgtttttagaacatcccggcagcatttttttttttttttttttttttttgagacggagtctcgctctgtcgcccaggctggagtgcagtggtgcaatcgcggctcactgcaagctccgcctcccgggttcacgccattctcctgcctcagcctcccgagtaggggggactacaggcgcccgccgccacgcctggctaatttttctttttttttttttgtattcttagtagagacggggtttcaccgccctgctgccttttaaagcaatttaatacatgagttaaatatcatattttaaaaatagattttattttttattataattttgatgaatgcatttttgtcaaagttgtcaaagtcaagaagtcattattgagaccctgagggtaaggcaggagccaagtgagaacaagcagatgtcaaagatggtgaaaaaccagaacagccaggtcccccaggcatatacagagaagttttgcaatggcaggtccccgtggttgtctgacccagacttccaccttgaggtaactggggtaactataacgatattttcatcctgatctcttcatgcagttatatgtttccaagaacagataaactgtgaacttaatacaagtgtctcctttccttggattctcaccatctgggtggtaaacatgacagaaacattcaagtatgttcaatgtagtacatggtaacaaatgctttagcacagactagggagcatgtctggcaacatgttggcaaataattaaattggcacattcaggataaaatgagaacatggaaaaacagaatatgattctcttcccagccctggaaagacatcccaagtgtacgtattgtttatattatgttattagtatatctttaccagcaaagggcaggtcatcatcattcaatatgctcaaatactcacatttaaagacataggcactttgagaggccaaggggggagaatcacttgagcctaagagttcaagaccggcctgggcaacatggcaaatcccatctctacaaaaaatacaaaaattagctgggtatagtgcctgtggtcccagctacttgggaggctgaggtgaaaagattgtttgagtcgaggaaatggacgctgcagtgagccatggtcacaccactgcactccagcattctagcctgggcaacagagcaagaccctgtctcaaaaaaaaaaaaaaaaaaaagagagatgtagggagcattgtggacatctattcatggagggttaaacaatagaattagacaaccatgtgtatgtgtggaatcatgtgttttttccacacatgtaggaaggagaaggtaggaacaatgaaaagattcttttagtgatcatagtggctccaaaacagatgctttggtatatgtaatacccatttatcttataaagaaaataaagaaataataaaagcatttgctaaccatgttagatgctatagtaaatgtaaaaataaagggtctgttaatatattaactgagcttaatatatgatgtgatataacagcagccttcaaatatgcggagggctataacagagatcatgatgaacagacttttattctggcttagaaagactagacacagaaattaaaggcataaattactctacaagcaaagcaatcttaacataacactcctttcaaggtagactatgaatatttccaccaataatatatttattaaaatagattccttttcatttgtctttttaagttaaacataatcttgcttgaatgaggatgagtataagatacctcagtcatgaccttgtagatcactgcatcagccagctttgtattcagctatcaaacaaaataaaatgtgatcactagtggttcaaatacattggagttctacaactaaagatctaaaggaatgaaatccatgactagtacaaagacataataatgccctaagcaacttacgatattttgatgtttcttttctgacaccccattcgataggcttttgtcttcatgctcagcatctcctatctcatttgggatgctatgcgtccacacctttcatcacattccagcaaaaagaaagggaaggcaaagtggtaatatatttttcctagtgaggttttgcctctttattcagggatggaaaccttccccagaagcttttgtctacacttattggccagaaatttaacatataaccattcattgctgtcagaggtgggaaggagtccctgagaaagaaattattcttgttttccagcctctattgtagcatttaacaaggaagaatgggattatgaatagctttggaatgtttatcatgtcttctagttgccatagctcatagtcattttatatgattgaatctatattaggccttttatctgacaagtttcccaatgtacaaagactgaaaaaaaataattttcctcagatgggaataaagaatgtcaactggtctggccaagtgagtttggaaagctaagatttagccttgggtgcattattgatggacaataaaggagtaggtggcactcatccattcattcagttattctagctgtgctattgaatacttgctaactgcaaagcacagagctagatcctagtaagaatatagaaaagaaagtcacagtctctgccttgaaaacatatttattttatttctaggacaagacatctacacatatacaaactgtcaattcataacatgtcatggaaacataaaagaaggtatcagtgaaagtggagtgtttaaggaaatttccatgcagttgatagaattttaatcctataatttcaataggtagtagctgtgtctcaggcattctaggcagtgcacagcaagagaaaagattgagataaagataaaaactggaaagaagtaggcaatcagtcatatttctgcaaagcaatgttagaaaattgcatgtgttagcttgtatacacaacttagcttacaatgttagcttgtagctaactgaatacagatgtgagagttaaaatatactctcctaacagtagaataatgattgttagagtggcagggatgatcttatagaaataaacattggacaaccagcaaaaacagtgaaagccagccatatggctatctggaggaagagcattccagctactcaaatccaaagtggtatcatggtgtgatgtctttttttttatttttgttttagagacagggtctcactatattccccaggctggtttcaaactcctgagctcctgtgattctcctgcctcagcctcctgagtatagtcacatgccaccatgcccagctaagttatatataaacataagcacagagtaacatggtagcaaaaaataatgtcacccaaattagggttttgaagacaatacaggagttagatagataaagaagagagggaagggcataacacaaaggaacaggaagtattaaaatgtgcgtgttatggacttgcatacaaattgagtgctttaattttgccaagcatctttcataacactataaggaattaacagtatgagatagcataagtaagggggcctgagaacttacataaacacccttggtacatggaaagtaaatataaaatggtgctgataattctaattacatagtttatagaaaagatacatgaccaagcttgaagcaagaatgattgataaggaattaggtaggttctgtataaggaaaggtgatttcagatcccaaaagggcatggctgaatgtttagcctttcagagttggggaatccatttcttcctgtggaaggattagtctttaggtgaatagatatgtatcgaagggaaattaagagagcataagaaaaccccactttacctgccatctatccatggaagcagcaataagaccacctgagagctatggtacaattaaattgaagatatttgaacacataaagtaggtgtaatgtaacatataggctcaaacatttgaaagtgatgatatttggtcattgctggcctacaaaagaaatgattttatgtgattcagtctaatggtaatagttacaaaggattgacttcttcgcaaataaaatggttgaaatagtacccaaaactagcagattgggcaaaaattacaaagaaatatctaagtggttgcatagtaaccacaaaaatgaacacacttattttcagagttcaaaccgtggtagatttgagagtatgtttggaaatgactaatgcttagtgttgtttaccctgtcaccacattcctgcataaggctctttatctctgactggtcatgctcacatctgttttctgccagccttttctggtgcccgcaggcacccacctgcacccaatgtcctccttttatgctttctggcctcctttcatgtactgtgtggtccaccatactacctaatctgctatatactcacaaaactatttacttcttttgaaaaaaatgtattattagatttaaatatatgtatttatatttcccttcactttttaaagttttcactttatttttatactatgttttaagcttccctaatatcccactgctgaatcccaccgacatggaatccacggcatggtgaatccctgacttacccattcctactagaagtagagccagaatctaatccagacctcctgccagccactcccagaccccttctttcccccaaagaaaatgaagaacatattttttgtgcaaagagatacaatcaggaaatttttttaaaatcagcttttattttaactgaatagcttacttagtcctggggctgtaaagtcaactgaatgatggagtcatttttttcaaaatgcgacatcttcttacccacttctcttattactctcatcattatgaaaatcacatttgtgaaaggaaatgaatttatatcaggttttctttggcatcacccaaaggaccttagtaaagaaaattaatactaattttattttctattgtgagcaccttaatacggaactgtaagaataattactatttttaatgccaaatgaagcatgtaagtattactagcttcttttttgtattaacttctatacttatctcaggagtttttatagtgatatagacattttgtgaaatagatcatgagtgaaacatagacctggtatagcttgactggggcctactttacagatttgtccttaagtactgaatataaatgtttctgcttcttattttccttagcatttttaaagaaagtcctggaagccaaaaatctccatgatgaaatatttataattattaatcactgttatatgaccttattatgtatgaaaactatattcaacatcctaaatatgaaatgtgattagttctgattttaaagatttgtgataaaacaagacaccattgatgaaatacatagaaaaaggaagacaaaatagcttgggacacattaataacttacacaaaaaattttaaaaattaaatcttctaatagatttgatatataatataccccagaaatatttacattatattttcaaagtctagagcatttcttccatagactccaaaactatttgtatatattatcatcgaaacacaattttgagagaagttggaatggcagtgcagttagcagataaaaaaaatacccacttttctttacaagtctctatctaattcatactccctattgctctttcctgcttcacaaacttcttaaaagattttttcatgtggtgtgaatatttaaaatctgtcttagcaattttcaaatatacaatatagctggccatctgtatttgtgggttttgcatcctctgattcagccaaccatggattgaaaatattaggaaaaaatgacgaaatacaacaatacatcataaaaataatacaacttaaaagacaatacagtataacaactatttacatagcatttattttgcattaagtattataagtaatctaaagatgatttaaggtatatgggaaaatatacttaggtgatgtacaaaaactttaatcatttcatagtgtatacatatatcaaaatgtcacattgtaccttataaatactcataatcatttgtcaattaaaaataatttaaattttttgaaatgtaaaaaaaaaaaatttttctagcctcccagtctacactctcacttttcactaacccatttactgctttcttgcttgttctcccagcacaccacaaaaacaacttccatgcatacaccagtatcacccccctcacccccctgtttccaataaattaaacccaatggaccaagctaaagcatttattatacttcacctctcagaggcatttaacgctattgacaacttccttcttttcaaaaccctgtcctcccctaattttcatgaaacatgaaactaccttctagttctcttatttatctcagccatctggctcctctttctctattcccttgttacctattggtgttggtatgtattccattctagaactttgtctcctctactgtgatgctatcatttagggtgaaatcaactactcccattgcttaatttgtcttttataaatttgtgacttctacatctatagctccagttctgctgtcttttttgtattaaagaccaatttctccaactatgcactagacacttccaactagtatcccactggtatctcaaattcaacattattgaactcaaaaacttcttttgttaacttgccttgctgtcatatttcctgtattggtgaattatatcagcttccatagacttgcctgagccaatataacctaggacatattctccttttcccttaactcagcattgactgacaaagaacatgctaggaagtctgtattcttcatgtcttaaaatattcacctctgcttccattgccacagctttgatttgggccactcacatttctgcagtagtctctgagattgttatcatccatatctctgcatttttcttgctaatgagaccttcattaaaattattttgtaagtatttaattatttagcagttcatgcctttccatatgacttaaaattccattgggttttgcttttttcctgtaacctaaagttacatctgggttggtcaaagtgaagcatagtaactacattccctttgatagtgctgcaattaagaccaatgaaatgtgaaggagttttagggaagctttttcctcagtcttaaaaagagacaaaaggaaacaatacccctctcctgtctctggttcatatttgatgagaatgtggcacctagtctttttgagaccagtggggtagttaggcccacaccctgtggatgtcagagcaaaaatatggaaggaatctgggtcctgataccatcatcaaaccattgagctaattccgttttgtaagataataaattccttactgtttactctgttcgagttccttttttttctgttagttgtagctgaaaccattttaactgttgttttttgtttggtttggttttgtttaatacggagtcttgctctgttgcccaggctggagtgcagaggcgccatctgggctccctgcaacctccacctccagggttcaagcgactctcctgtctcagtctcccaagtagctgggattacaggtgcacgccaccatgcccagctattttttttttttttgtatttttttgcatttttagtagagatggggtttcaccatgttggccaggctagtctagaattcctgatctctggtgatctaccaatcttggctacccaaagtgctgggattacaacccactgtgcccagcaccattttaactgtattctaaaagcattttacagcctgctaatacataacctcatctccaaccttgcttcctaagttccactctgtgttccacaaatgggattaatcacctactgaaagctctataataattcctgtcacctgaggatattgttaaaacttctcagtttgtagaagagggccttcattatcagcatcacatttattttccagaaagatatctagcacccctctaccttacatcttgcttttcagccaggaagaacaactttttctttctgaaatgtactagaatctcagtgttgggccacattgcttttttttttctaaaagactaatcgtcttcctttcccacctaactcaaacatatccctcttaacttagacattacttattttggggaagtcttccatgattaccctaagaatagggtaggcattctttctctctgcttccatagaaagtaggaaactattgcacttactcattgtaatgtggctatattttgatcaaaataattaaaaaatactgtgtggattcaaatttttctcagctactcacaagctgaatgatctcacacaagttatttattgcaccttattgtgctttctttttctctgaaatagaggtaataattatacatacttcatattattacaatgattcaggaagctaatgtatatggtatacttacatatatatatgacctagtataacgcatgatacataataagtgctgtgtacatgctcagtcaaataatggtcatttgaaaacatttattgagtaaatgaagaggaaagtgtttattttcaatacattcaaagatattgttttggttatttccattacagaggcataatcagtttactattcagaaaaatgcaagagtacatttttactgctcctccagtgatactatggaaaacaatgttttagaaaaataaagaaggtgtgaataatgattaaagaatcatacactctcaaagtgaaacaatttcccaagaaatgcggtagaataagccttttggtttctgattttttttcttaactttgcttgtatgttgtagaaagctaatctaaatttaagaaattgaaattttgaagtattaataatgtacttctctcccaaaattgttttaatgtaatgatttttgccatatggatgaattatatatgcatctagaggctaaaaaccataaaaacaagcttcttcttagtagacttttgttgtttattttgtacagcataaagcagcagtcaaaaagttttccaaacaaattatcttatgtattttgactaaacccagatttatcttcttaaaatgaagacctttgttgtagttgcatttgttcctcatatgcagtagaatgacccagcctctttggcttagaggtagtgcctcctttttacgacacttggagcggcatctgatgctcatcacttcagttggataaggaatgctgtccagtcacagagactcatgagatcatgtccaatgaaggcatttaacaataaattcacaactagtgagtgagaattttataaagcagtttcaagtattaagtagataggtaggtaagctttattatattttttaaatgtgaaattttacaattgtgaaaatttacaattttacaattttacaatgtcaggatggataacattgcctttttagtaatggtagccttcactatctgcattatgactgtacaataataacatataataatatatatagcatatatattttatatatataacataatatataacatatataataacatataattataacataataactggggctatgattgcaaacatttataagatgtggtatgaaaatgtcccaatcacaaaaacactcaatttaaaaatgaaagaaaatgaatctatgctatgctttgcttcatctttctctgaactagttacaaacaaaccttttaaaaataagctttcaatttgggaataattttagatttacagaaaagttgcaaagatagtaaggaaagtccccatttgctcttcatttggcttcctctaatattaacatttgccaaggttacatttgttaaaactaagaagtaaccatgggtacaatgctattaaccaaattacagctttcatttgaattttgcccatttttccaatattgttcttttcctgctacagcatccaatctaggacctcatgttgcatttatttcttatgcatctttagtcccctaggatttgtgacggttttctgtcttttttcttttgaagactgttcattgcctctgttagtttaatgatcctctgagatgttattcacagtaaaatagcatgtgaatttcacctaactaaaaagtttatttgatccaaagccctgattttaagaatttgaaagaaaaaaatgactctatttttcccagttctaaacattttactagaataataattgtattctttcaacatggaattaatgttgatgagaagcaaacatctaaatttaaaagaaaatatagtttgttgagggaggtaatagacaataaaatgtatttattatagaaaaaattcccaaaactttctcattaaatgtgctttatctttacttcattactaatatttagcttttattcttttaaaaagcatatgccaatgataatatctcattaataataagaatccatctaattttagcttgatcttccccctgactaggtttgattggattaaatcatcataaagagacaaaataatgcaaaaagtgataaatctataagcctcccctaaggtttcccatagaatgatcaacccaaatgtgctctttattttatgccatgaaatgacatactgtgtcaagaactgaatttcatcatacatgagacgtaagactatttttatatctctgtaaattgggtatgaattataaaagtatgctggtaaactgatcacttgagaacataaagtcaactttccctggaagagtttctcattataaaagaaaggcaagcatcttcttcctaatatctagctttatcaggtcaggggctatattctcggaagggataagtaatttctgttgtatctactaatttcatttaaaaagataactagagaatattggaagcattattgtagaactgtgtcaaagaccgaaatatcattcctaccttagactgtacctcaagatcgaagctctggatgctatctggaattaaaatgtttgcattaagtttaaaactcagtaaaataaatgtttgaaatgaaaaccagaccaataatgaataattttacttagacctactctccaaatgtgctaaaagacttgtaaaagttgttgttgttttaataactaagtcaagccagttttatttaattcaatacatggagtattaatgcgctgtatgaatgccgaaggtagtattggacgccacaatctttaggaaccatgcttctgagttttaaaatggtgactagtttagcatagattcaacataagcattaggtgttcttttgacatttgggaatcagccaatcaacaggaggaatagtaaattgaatacgaacttgaaagagaccatgtctttttttcatccaactgtgaaaaactttctttgtacaattgttaaacttaagaaacagatggtagatctgtatcagtcagtgaggggtttctgaagtacttttctggatgaatgccaagaaaatgggtttctgagacttgcatggctctggatttgttctgagctgtttagtgaagtgagggctggcattcagaacccaggggagggggagtagtcattcccattgccttgcatagagatagaatcacaggtgacaggtcattggaaaatcacttcttgagagtgggtatctttattttgagttggtatctttttgagagttggccactcataagccttgcttttgataacatttctttaaattcctccaaggaacaaggggaagtgcaaaaggaatacgataaagtgcagcattgaatgagataagcatattcaacttaaggggcacactaaatactgtaatctgggagcataactcagatttcttttcttctttgctcagtataagttgcatgatcatagaagatttatgtagaagtcagaaatcaaggtcaagagggtaggcatatttagattcttaccctattcataattaacaataaaataagattttgtgtcctgattcagagaatggatggctcagtccttataacctcttaaattagttttatctataactggatttctgaatctcttttgaaaattactaccattgatggtcactgagtgaaaaaagcagaaggatagactggtgttaactgtaatgaacatttatccaacattacccgtgggcctgctatccattttaaattctaaaagcactttacagcttgctaatacatagcctcatctccaaccttgcattcctaagttccactctgcattccacaaatgggattaatcacctactgaaagctctataataattcctgtcacctggggataatgttaaaacttctcagtttgtgagagagggccttcattatcagtgtcacatttattttccagaaagatttctagcacccctctaccttacatcttgcttttcagccaggaagaacaacttttactttctgaaatgtactagattctcaatgttgggccacattgctattttttttttttctaaaagactcatcatcttcctttcctacctaactcaaacatatccctcttaacttagacattacttattttgggggagtcttccatgattaccctaagaatagggtaagcattcttcctccctgcttccatagaaagtaggaaactattgcacttacacattgtaatgtggctatagtatgatcaaaataattaaatctaaacaatactgtgtggattcaaatttttctcagctactcacaagctgctatccattttaccaagcctcctgcatgtattactatgtctaatcctcatatcaactcatatataaactagattttatgattatggctctaaaaacaaggagactaaacctcggaaatatcatttaacctgtacaagaccttacttggctgagctaggattcaaaactaggtcattccgaggagaatataaagtccagcttttttttttccacacagggatgtatatttccaggtacagttttacattttgttctttattgtatgaacataaatatagatacatatgaaaattcgaaagcacatgaaagtgccaagaggaaatgcaataccatcttatgaaatgagaaattacacatatcttacagtgagtttcaaaattatattgctcaaagtatttttactgtggaaccataggcacaaactatagcaagagtaaatccaaaaatgtttattgttcttctataaactaactactgtgtaggatacaagggatgctgatttcaccagtgcctttaagaaggacaaatcaaattaaaaagtcaaaatgactgaaggtgataatccagatggtggtaacaataatgactaccatttatagaactttttgatgttgttcactcaacgtttctatttttattcaattataagcaaacagcagaattaacccaacattcagcaactccagatcagcttttcttacccccatgaagagctatcaatttaacaaccacagttgtaaggattcttaataagctgtcaatgagcactgctgccggtctagatggccatgccccaacaaaagcaaagccactctccctaatgctttttccaggattgctttttaaaggcaccagagcgagatactgacgcctattaaggcatctgagatgcaccgtgttggggtttagcctccatgccagccagcctctggttgtctaggtgagcgacagcaccataaaaacacgctgcgtacaattctggtattaggatcacaaaggcagagaggtgacaaatcctttttctttttctttttttttttgtaacctcccttaaagattctttgatgctttgctctattactgtgggcctggtctttttttcccccccagttttttcttctttaaactctggattgctattttcatattaatttgatgaccccatcacagtaccagaatattcctgaaaatagagttccaatttgatcaaaacataaaccagagtgagtgagtgagtgactagaattataaaggccaggcagcaggaaaagttaccctaaaccatctgactgctcaggtcttgcatgtgcaaaggggagccggaagaggagaaatctattatacatgcaacactgaactggagaacacggcttggggcctctgggacagttcaggtccctgagctgccccctacttcccagacagctgctcctgcagtttgggcacatagtcgtcccactcagcctggtaacgctttctggccactggggccacgagcacgagctcgtacttttttttttttttttttgagacggagtctcgccttgtcgccaggctggagtgcagtggcctgatctcgcctcactgcaacctctgcctcccgggttcaagcaattctcctgcttcagcctcccgagtagctgggactaaagccgtgccaccacgcccagctattttttttttttttttttttgtatttttgtatttttagtagagacggggttttaccatgttggccagcatggtcttgatttcctgacctcgtgatccacccgcccccgtgatccacccgccccagcctcccaaagtgctgggattacaggagtgagccaccttgcccggccaagctcgaacttttgacagaaggatgccattttgaatttgccactgtggcctccagatccattgctgaggatgggctcgtcacacttcagcagcctgtcctgtttgtaaaccagccagacatagcggtggagatctgtgccctccggaggcccgagcccacgtaatggagatgactgggccactgctaacgtcattacccttcatgttgaccaccaggaaatgacgccattcagtgtattggggcttcttcctgccgggagcgtccgggtctgttaggaccaaggtgtagagtttccttgactcaagatcatcccatgaaatgctggtgggtctgttaacctaggtgggcgtcagcactttgcccagctcgtccaccgtcgccctggcgtaggcgacatgcagcgagtgctgcggctgcccgtccacttcctgcaggctcaagggcctggaccgcttgctgaggtccctggcatggctgtgcaagaacgcagcgcgcagctgggagtgccactaggcaaggcgcaggcgcagcggcgactcggcagcctctgaaaactagccagggaagccggggctcatttataggattttaaaaatattattaaaggcttcacaaactgtcttgtttaatagccacaacattgggaggccgaggcaggcggattacctaaggacggagttcgagaccagcctggacaacatggtgaagccccgtctctactgaaaatacaaatattagccgggtgtagtggcgcatgtttgtaatcccatatactcaggaggctgaggcaggagaaccgcgtgaacccggcaggcggaggttgcagtgagctgagatagtgccacggcactccagcctgggccacagagcaaaactctctcagaaaaaaaaaaaaaaatagatacaacaatctccttttaactgaagaggaatgatgtaaagttatataaagttcagaggaattgatgtaaagtgaatcgtaaagactttggaatctcctactaaaatattttaacaggaaagagacacatcagtgcattttacaagcagatcaatgtggcggtatctagcatgcatggggaagggatggaggaagttgtcagtttagaaactgagtataaacattattgaaataggacatgataagtacctggaccagggtaaaggcaatggaaaggaaaaggaagccacagaccacagataggaggaattcaaggactgtgtaccgaaattcaggagaatgatgtgaaatagatgctctgaatcctctattcccaggaggcagcattatggagttaggagaaaatgcaggagctttggattctagtagacctgggattgagtttttacactgttactctatattcgaagcaatatatttaaaccagctgtgtcttccttttgtcctttataaaacaagaataataatgcttatcacatagagatattatgaggattgtataagacaatgtatcaaatagtaggtattcggtaaatgttccttctttactaaagatagagaaaccattttctgatgtacaaagggatgaagagctggcccaatatgaattttcccaaagaagttaaatgaaaaggatctcatgatccttttcaggatttattatttacgaatgttaatatattattttaatattttctatcttatgaaataattatttggtcaaaacataagacaattgataggaatatacagcatggaaaatggttaccaactagagctgcagggtatcagggaatgtgacaaggcagcaaaatgtttctacacatgtctgttttttcaggcattatctttcttgagactatcaagtgtgtatttaaggagccattcaacttacttcagtgcatttgcttgcaaagggtgcaatgtgatgtttcctactggtagggtcgtatttcatatgtggtgatagtgttgctgaacaaataggaaatatccttgcctagactatattttatcatttcattatctagtggtaaaggaatgtgagttctatttacaaataaacattttgtcttacttttttctttgtgatctattttctccaagttgcataatgtaatgaattaataaagcttagttgctggccaaatcaatggtgactttttatgtttttaaatataatattaggtttaacttatttttgtcattaaaatatcatttgtgagtgcttttcaaaatgaagtgcttctgaaataaatcacataataaaactaaccttacttttgaaatacatttttattgaagcaaacacaaatcaatctgaaattcagcattttgtagcagttaaatgtatagtcaggcagcttcaacgtcaactagagaagttgtggttttaaccccgagatagggctgattatgctggtgctatggcaacctattgcaccatttggtagcgcctgtgtgcttaaccgcatgagctgcgcctcttcctttcctataaagactcagaataagaaaaacagaagtacaccgaagagaagaaaccacaagagcagtaaagacactgctgttagcttttagctgtgcaaacagcagtcttatgagaacaacacattgaaaacctcttctatttgaaagtgtagcttttcccattatgcctgggttcctttaatgattttgaaagtaagccaagtgtttctgttcagagttttcattaaagggaaataagaagaaataagcagtgcatttatcagcctttgcttttattgtcctcagctttaggagtgggaggcttttgtgcagcctcagcagacattttattctgtttgtgagatgggagattagtttctattaggtggactccctataatctagcatttattttctgcttttttttattatattgtagttagttcacaaaaaaaagtacaattttaattcatctcctggctcatttagaaagggttgtggttggtgctgtaaacacgtttctacataactagattaaattcacagacactcactgtcctagcactgtttattttctatggggagcttcatttacctattctttccctcaccccacttcttttacaaggtataggttgatcagcaaaggcttttgtatgttttcctttgtttcaaagtacagacataatataatcataacttttttttgcatgttctactatttttccttccttaaagatttgggtaaaaatactgaaggacagacaagttcatgctaccatttttgttaggcataggcctgttcacttttcttcccatttttctgaaaaataagaatctaccccttttgtagtcattgtccagcaatttacactttttaacaataagttttaatgtgtggtactctgaatcccattttgatggttatacataatatttactcatttttgagtccctaatagctctttagcacaaatactggatttagcattaaatattttttccttacagtgcaatgcagttgaacaagcatgggggtttttacagtcagacagatctgcatttaaatctagactcattttgctacaagttctttatttagccttgcatacacgtttttatgattttgagctttcatctgtgaaaagaagagaataccatctactttgtaggatttctataatgattagataaaataatatgtaacagtatttaggacagtgccattcacatagtacccgcttattaaatagtaaacactgttgatagcaccaaatacactaataaaagatttcaccacttatgcaaacatcttttgatgattctttgttctttaatgatgatcgtaacctatcctagaggaagcaaagagctacaaaaacatacacttactaagggattaatataattaaatggtttttgctatctgaagtatattgcataaatcaggtatatatccctggatttaggtaaatgaaaacagacattttcataagaagcaaaaagataattaatatgggaacaaacctattctggaaaatgtttaaaaagagaatatgggtaaggaagcatctttctcagttgttcttaacccttgtttccatcataatcaccatcagagctttaagaaaataccagtgcacagatcacgttaccccacaaacctactaaatcagattttccagcgctggagcccagaaatagtcacctttaatctaattcccagtcaggattaatacaaataaaggattgatattttttcttcctcaggataataatactggttacacacacataaatatacataactgataacaagccagaattttgtaaactatgttctcagaaacattgcagttacattgtacaaatgtcctatagtatgtccatgggaaaaaaatgggtttgtggcaaatacttttaggagatcttgagctaaacgaagtgacataagtttctatgcttttaatatattaacacactttataaatatctcaaaagggcatgtagcatgaattacttctgaaacaaatttgactatgggacatttaaaggcacacaaatctaaatcaaagacttcaatttgaccatcattgcacaggaagcgataaaattttccccctgacttgtagataaatagtttaagacagaaaaaaagcagtgtaactgattgttcttaaatggttatctagtagcctttattaatttttttgtcattaattgtttcgttaatcaacatgcctgaaatatataacatgatgttttaaaccaaatataaaatacctacaaatgcattcctagttttgaggtgtgtgtttgcaaagtcatatgtattcacaagcaaaaaacattattgtaaatattggacaccataagtcattgggagacagctagatatggttgctatctttaaaattttttaattatttgattttattcctctcatggccacaaaaatttgccttctttatcctcaatactgctttacatactgatatttttctttattatttgcattattatttaaaagtgtgtatataatttgaaagtttaaatagtaccataaggcctagagtaagtaagaacagtcttttgctcccacgactctcccctcccttgatattttgtgatttttaaatgttatcttttattgtagtgctgtttctttaaaacaaaaaaaaagatttttgccagtatctattgacttcttctcttgatcttgagatgttgctttttataacctcttgctctttgttcatgggtgcaatgttttctcatttctgaaaatatgaattgtagttggttatcctctcttttgctccttgcattgcctcattctcccaagtgcctcttttgtttatttgagctctatctttctttcttattagaggctttgttctagtgtttcttggatgtccatttgtatttaataaaaggcctcaataaagggatgttgaaattctttggacattggtggagctcataaattcatgtgctttaactagattgaatgaaatcagaaaggcactacactcactgagtcttagtttccttatatatcaaatgaactgcatgtcaataatcactaaaatcctttgcttctgtctgagtagaaatctttggaattattttctgatgataagcagaaagtcctttactcatgagattccaaaaataatattaatatacccaatattttaacataacgtctacataaagaataagaaaattattaaatagacactatttcaaatctagcactttcctcgtgtgtgcctgtgagcaatttactaaactcttttaggtcccagtttcattccctataaaaaaggataaataatgctaactcattggcttactgggatgcttaaaagaaaaaaaatacatatatattatataaagaggtgtgcatagtgtctgctacataacatttcagtaaactgttgccatcattattatatttactgataagctaatggagggtagaaaagactgtttcctgtggttctctgaaatcataatacctggcttgtcgctgcccagagtgcttactccataaatacttaataatttaatatgatttgttagatttattgtctgtggaccatatagcagatttctagcataaaaaaagtgcaattctcttatttttattgtgcactttattattatcatgcattgctaagaaaggaaagccatacatatctgttttagctgacccttattttttgtcttgatttgcttttttccacttttgtacaggctttatgtttatggaggtcaagtatgcattctcaaccttcaaaacatgctatcattcattttagggcagatgctgagaataagtatttatttaatctattctattttacccttctgcccttgtacttttcccagatttgcagaactagacaggtttaaattccctaggaaatagcatcccatttttttttcttttttttttagcggggagggagaacgggtgatatttaaagcccaagtatgtcttttgaaatgccgttttcactcaaattgattcctagtttttgctgaaatctctgatcagggacttaggggtgtgacttcaaggtaactttgatttgtgatcatttaaacattttgagttgtaaaagaaacatattgggaaaggtaaattcagtaacaatacatgtgttagaataacacagctttgaagatcaagtgttctgttatctacattttcatctgtttaatgtatctagtcaattccattggtgattcacaacaggattataatgggaaaaagagctcttagataatttacagttttttagtgctatggtgccacctactgaaatattactaaatactcctttgactaaataatgaaaacacaagacatttaagttttaaaaaatgtagaaaatttcatccctagaagataaaagtcaaagtgtagaatgtagtaactgtaatatgtggaacactagatatattactgtgttttattttatatttatttgatgtgtttatagaatttgagagaaagctcaatgcagttcttactttgagaaatagtgatgccttctctttattgtcacacacctacacatgtgccctcttaatttccattgctatgtcacatattttgctttacctattttccacactttcccagtattgttcataaagaatgtttacatatattgtagtgtaatttgtattaaacaatctccaaatattaaatatttattgtgcactggttataaaatactttatgcaaaaattttgtttgcttttcccagatctatttgactccactaagaatatattgttgcttttaagtaatacaggaaatagggtagagtacaaggctgtctacatacataaaacaacttaggtaactacatcagttcatttgttttgcattggacaagcacagtaatatttaaccatatactccagtctaaatggataggtcatgaagtagttaaatatgttatacaaccaatcttttgttgttgttgttgttgttgttgtttttgagtcagggtctcaccctgtcacccaggctggagtacagtggcaccatcacatctcactacagcctcaacacacactcatgggcgtagcctcccaagtagctgggactataggtgtgcaccaccctacccggataatttttgtattttaagtagagacgaggttttgcatgtttcccagactggattgcttggttcaagcgatccagctgcctctccctcccaaagttctgggattacaggtgtgaaccattgcacctggccacaaccaatctcatcaggtcttttttttctatcagtgaagattcagcacagtggcttctatctatgattttggtaatgtttaataatgtttgcacatatgaagtgcaacagacaattgaagtcattgctcatgtaatttaggaagaattaaaatatgatagagaattaataaattattgcagatatttggttttatagttttctctaaatagttaagtaccttcacctactccctaccttgtttcatatataaaggcattctccaccaaagtatttgttagtgttctgctaacgttgatgtaaaaatcattagatgactgggggggcggggtgtggggaatgtccctttagatgttacgtaggtgttttaactaagctattttatataggtcacatttagcgtgttcctactttaagactggtaaaatgtttaacattaaaaagactgaaaaatagatttatgtaatctagtgcacatggcttattaaaattgatatgttgctttaagttgcatcactctagtgcataccttatttccttaggggcattggcttaaattttaaagtagtttttaatttaaaatttttattttaaatagattctatgtgtttttttcaggcacgaaaacatttttatgtcatttatcatgttgactaaaagtgttaccaaaactaaaaatctgtttatagggattttatgaccatgagaacaagcaagttgagtcttacactaagtctaaacagtgatgctgaagtcttggaattttcttttaaaaagataaaatggtgtgtggggtgtgtgtgtgtgtgtgtgtctgtgtgtgtgtgcacgcacatatttgaaatagtatataaaaatgaaataaaacatagattacaatgttttagtgtcacctaaaaatcactcagtggaggaatttagaatcatatccagtgataaatcagtgtacaagcaaacacatattcaattcaagaggcctttatgggaagtaagcatgaacatagaagaaaggaaaatgttggctctttagatattatactgttttccaggatattaaattttgctgcattaaagatgaaaagattcgaggaaattttgaatatggagcgatgatgagatcagaaaaaaatgtatatgtatgcccattattctgtcctctagctccagaaacctcttaacatctaaacaaaaggtctgtaaattttaataattgtgcttgatattagtgtagtttggttgactttcctgtcaaaatagtattctgtaataaattaacttgacacacctctaaattttctctaatatttgtttgtaccattatagagcattcactcagcacattgtgatttaatctgcatatctatttttagggtcaaggttattttagcatttgtagcactactagtaatttacttgcagccaaattatgattaagatgcatttttacttagctcatgagtttttaataaacaccttctgtaaaagaattctcatgcttaaaatttcatatgaagaggaaaggctgtaaggacaagttgatgggaaaaggggacgcctgatgaatgagagcatggcctgtaaagtcagacaggctcaggttcaagtctggctcacatatactagactggccttgtgaacttggccaagacacttgacttttctaagcttcttagggtttttgtggtgcttaagaaagaaaacataagcaaaagacttagtatagtgcctggcacccagtaaacactcaataaatattaacaattaataacaataaaatattatttctaaattattctttaaaaaagtaaatcattagaaacagtcttctccgttttggtaatttacctcttgtccttcttttcagaagttagattaaaataatatacatcatgtatttcttttaaaaaacgtattgcctttggaccacttggaagtttattaatctctctgagacatggaacatatacgtagtctgatgaatagtgtactggttggaaacagttctagtatatttactcaggcattcacagttcttttgttaaaaaacaaatagcttcacatagtgtcccagcatttttcttctcatttctgtggtaaacagatgatgaattataattttcttttatgaaactctatctatagttggtgctacacattttggtgacaacaaagtagtaaatcagaacaacagaatataggggtctgtggaattagtggtgcaggtaacattaagatttctcttttctctgtcatcaaatttgctttctgatttctcctctgtattaactgatccaatggcttccgtcattctgaggaaaaagttcaagctccttttcaaggcctacagtgcttgctccttggctcttctcctaaagctgttatcatcagatctgtttgatttctcctttgcacttactcatgcttaaaagaatccagcaattacttatcaatcacttcttatacacaagactctttgctacagctatttctctttcttctcctcctcttcctcatcttattatgtgattcatgctgatgttgatgcgagaaattttgattattagtcttaatcaggtgtatccatgactaaaatgtcattgcagatgactagatatatgtgttttatgggttataagcttatccagggcaagggtcatgcttttatcatgtttgaacctagtctccaacagcataccagcaaaacaatgtatgtttcttgaacctaagtgaactaaattaacttgtttcaagttccaaggaatgaggtgcttgcatgagaaggggcatatcaacctaattttagatatgtaagagctcatgtatttctcagataaagaagagatatgtgttgtataaagtatgttcacacactcaaaaacaatttgaatattttaaatttggtgatatgttttgttcttcacaaacaatgaaggacacttttcctttcacttcaaacatgagagctattagttattgctatactaatatttttttcttattacctcttttgcaaatcaacacaattctaagactgtaatttacaaggaaataagaacaaataaggagagcggaatgctgttaatgggaacataaacataacaatagtttacatgaaacagaaagataaaagctaactagataagaaaagggacaaaagtacaaacaatatcaattaaaaacaatatttaagtatgaattattaagaaaaagagaaatgtaatgagaaaacaagaaagtcattatgttaataattatgtatcacccatcaatgatataaaaatatatatatcaaaaatgcattttacttcaaggaataagccagggaatgtcattgaagaatacggggtgatgctccttggatggcaactctgaaggaagaaaatgttttcacatcagtttgttctcagaagataaaatataaaggcagaaagtcaccttaagtaccagctaattcactttcccatctgatctctgattctctttaacaacctgagtttacagtcatttggaaaagaactttacaatcttttaaataggcatttactaagatgagggatgaaaacattgcacttcactgtagactgaatctagttcccatcatgccaagaaagctgctcttttcaacatttccacaaacccagatgataaatccagttgacccatgttaatgcaccatgtttatcctgcatgtgaatccccatattatttgacttcaaccatttccttctcgaaacaccctctactctttattcttgtttgctacagttttcctcttacttggaaaatttgattacctatgctggctctctccttaatattcactgaacttcaggattctatcctggacacttctcttttatgtagttcggtgatctccttcacctctgtagctgcaaaatgtatctatatgctgatctatagcatcagcccagatgtatgtcatgagctacaaacctctatattcaaatgctattatacattttcacatgaaatctcaagcaaattctgattcacctctctactcactgtttattactctcaagttcagtgaaactataactcactagcatgttaaactatcaatctagatattttccttattactctttctcctttattctcacttgaaaggatttacaaagtcttggtgattcttgagtgtttcataggtccttttcccccaacctttcttttggggtatactcttcctacgtaggacatcatctctgtctgttttgctttggttttggtctcctgattttcctgcccccacctttgctctttaataatccattttccatttcctgaaaggttgatctaaaattcaaatgtttctcctttaggcctccctttaaagacatccctttaatggatatctaaagcctgtaagataaatcccagcttcttattcttctgggaccaagctagctatatgcaatcctttaggttgtagcttaaatacatccaagaaaccctctgtatcaactcctttaccagccaaccaccaactctggaaatataaataagatgatcctgttatgttctcctttagcacattctgtatcacctgtcatcacactgtattgattgattgtttttgtttatatctcacactaaattgagctcattgagggcagggaatttttatatgttggtcatattatatccctagcatgtggcataatgtctagcacaaaataggtgctcaattaatcatcattatctaaataaataatgcatttgggaaaaaaaagtttcaaaagtttttcaaaagtcttttgcaggcttgaaattaatcccaatagtgatcctttagtctgttatgtttctgatttagcctggggattcaaaaaataaataacataattttgatatatttgggctttgtaaacatggtactaagagaggaaatatagtttcattagggtaaaagctactgaaaattgccacttggtgaatgttctatcatagacttgaggtacatataaaaatctaatatatgtttacattaatatgaatgaaatttgaaattttctaagagatttttgtttcttctttgcagggcaaagcccaacaccttcccccactggtaagaattaatatttatatttttactaattttattttcttgttgcaaagtttatatatttaactacaattttctattattaacactgaaattatttttaaggataaattttataatcatgagtgattcttgacattcacttgttcttaaactttctgcttatacgttatagagtttaataactacctaaacatgttattaaatttgtatatatattttgtgtataaatagtaacttttcccaaacttgacagtaaatcacacaacaggtttctactctcttttaatattttaagactataaaaaaatgcatttaaattagataacaaaattttatagtctgaaagcaggttaacagctgtctatgtatgttatagatatgtagataacagatttgcatatgtctatatttctttaagagtatgttgcttttttcaatggtatgcaaaacctttgagactattgagatatttttaaataataattttcaaattctactgaacacttcaatagtccttataaatgtcttaatcatgagataaatttaaaacacagagatgctgcaaataaattcatacatagtacatacaaaataagagaaaaaattaaattgcagatggttaaatatcacatcacttaactgatgttactgaaaatgtattttcctgcataatcatatggttgacagtatgcattaagaaggtaagtaaaacaatgaagacaattttgatttaatatggtaatgcacaattccaactaacgtacattcaacagatcatgaaattgggttattaaaatgaatatttttgtcattaaataaaaattccgtccaaatgaagaaaacaaataaccatgaaaatagtaacaaaaacacttctgaatctgcataagaactatatttccttatttttaaagaaggtctaacacaattttacagcgtttagcatggcagtgatgttttataaataaataaaagtcattcttgcatagtagattgtgattggtttatgccagctactcaaatgcaacttagtatctccaacttttacagaagatagattcatctcaaccataccagatggttatttttgcaggaaagggataggtataaggtagaatggggagtgattctttaaaatgacacatgactcatcaccttattgagggagtttctgttatctctgaattgactctattatgacaagcctccaagtgatgaaaccaggtaagttaaaactgttaaccaaaatgcaaaggaaaatggtctctcccaaatattggccacaacaatgtcatcaatggaaaccaggagaatttgcaaagtggaggttcaagaacaatgtggaattggcaattgagtcaggttttctaattttaaattcttatttgtgaaagggaatgtgaactgaacttaagatgtgtgcaaagatatgaaggagagtagttctctgaaaacctttctccctacccctgggactgaatttgcttggctagaagtaatctttaggaatgctactcatcaaaatagcgtggtactatgtattagtctgggttctctagagggacagaactaataggttagatgtgtatatgaggggtagtttatgtgattgacacacaatcacgaggtgaattcccacaataggccatctgcaagctgaggagcaaggaagccaatccaagtcaccaaacctcaaaagtagggaagctgacagttcagccttcagttggtggccaaaggcccgagagcccctcacaaaccactggagtaagtccaagagtccaaaagctgaggaacttggagtctgatgttcaagagcaggaagcagccagcacgagagaaagatgaagaccagaagactcagcaagctcacttctcctaccttcttgtgcctgctttttctagccgtgctggcagttgcttggatgatgcccactcatattgggtgggggtgggggggttggggagggtctgcctcccccagtccactgactcaaatgttaatctcccttggcaatacgctcacaggcacacccaggaacaatactttgcatccttcaatccaatcaagttgacactcaatattaaccatcaaatactattataaggagaatgttgcatgattttccttctagtctgtttgtaattcacatctaatgaaagagtgagagtggacgataaagggaacttgttgaaacatttctctcaaagcaaaagggatcattggaagcaggcagacaccagaattggtttaacctaaaaataacaaattaataattatcaagtctataatgatgacagtgacttaatgtgaatagaaagaattctaaactctctccttccttcctccctcccttctttcctactttctttccactccctttctcccacccccttttcttttcctttcttttctcccaccctctctccctccctttcttttattcaatgcatagtagttgaaaaaatctaaagttagacctgattttacactgaagactagaggtagttactatcctattactgtacttagttggctatgctggcatgtcattatgggtaaaagtttgatggatttatttgtgagttatttggttatgaaaatctagagattgaagtttttcattagaaaataacacacataacaagtctatgatcattttgcatttctgtaatcacagaatagttctgcaatatttcatgtatattggaattgaagttcaattgaattttatctgtatttagtaaaaattaactttagctttgatactaatgaataaagctgggttttttatttatcatactatttccattttcttctctagtaatattgcaattttcattcttaactctttcctgtcctatcatttctactccttttctagtttctctcattctctccctttttccatatttgtgccattgtcttttgcccaatcttgttgaactgatttaattattttttgttgtgtgatatagttcagtttttacctaattaaatatttaaatttttttttttgcttttcaaaaagtaaatatatgttaagcaaaaaaaaaaaaaaaattaaatacatctttataattccaacctccagagatcacatgagcttttttttttttaacacatttggtatatttttctattcttttattaagaaaatcacttttttcagtaaaagagcattaaaaaaactttaaaggactttaatcaacagtgctgatttgccctgcagaattttttttaccattgtacactcatgtcaactgtgcataaacttatttcactactactttgtcacatattttcctcttcttaaagtaaacttgagctgtggatattatttcagtattttaaattgtatctctttgttatcatgacgtcaaagacatttttgtagactttggttgtttgtaaacctagttgtgagttttgtttttcagtcctttacacacattttcattgctttgtttgcttttaatttattttttaaaaaatccatgaataggccaggcgtggtggctcacgcctgtaatcccagcactttgggaggccgaggcgggtggatcacgaggtcaggagatcgagaccatcctggccaacatggtgaaaccccatctctactaaaagtacaaaaattagctggatgtggtggtgtatgcctgtaatcccagctacttgggtggctgaggcaagagaatcgcttgaaccagggagtcggaggttgcagtgagccaagatcgtgccactgcactccagcctggtgacagagtgagactctgtctcaaaaagaaaatatatatatatatatatagatagatattttttcatggatatatatatatccatgagtaaatggaagttttgtcttttttttcccctggaaccctagccctgctaaaaaccttctaactttacctttctctatccttttctttatctacaactttttaatttttttaatcatctttaccattatgcttcatccttctgaactcaattgctttggataggcgagaagctgctttcaatttcatttccccatttttatctttagctaatgttctgtagcttgttttagatctgtgtctacatattatatgtatctctgtatgcatcaatatttgtatatatgcatgcatatatgtgtatgtatatttatgaatacatatacacaccatatacatacacttatgtatggtgtgtgcatatgtatgtgtagatatatgtacatacacactatagtggactggggagttagtatactgggaggagcatacatttagggtatgattcacatatttattttgtccttctcccattttccattaattaacaggattgactacagcaaagatgcccagtgttccactttcaagtgaccccttacctactcacaccactgcattctcacccgcaagcacctttgaaagagaaaatgacttctcagagaccacaacttctcttagtccagacaatacttccacccaagtatccccggactctttggataatgctagtgcttttaataccacaggttggcacacaaaagttgttaacttaaatatcagggaatgtcatttagaaaattctacagttatcagtacaacttgtctttaaattatttgcacagtttctaagtatgtgattttattcaagtgcagaaattgcaggaaattagtatctgtgaaatatagatcgactgaagtaattaatgcatgttgttagggagtggagagagaaaagaagggaagcaagatctccaaggacaatcaggaggggaaatttgttctagtatcctctgatctatacacactcgccatgattctcccgcttggcttcccgccacctggacagatgagaatttccctagttcagagattatcagttctactctccttggaaggtgtcttaaatgggagtcttcccatttctttgtttcactctagattctctttatccaaaaattgttgaagatagagaatgtattatttttaaatccactctgagaatcgacaacccaattttgttatttgagtttcttttaagagcatttgcatcattgaaaacatttttaattaaggttgtgagttctactggtaaattaaaggcaatgtagccatgttcccgggaaaaatcagattgatgcaagagatatttttgccaaggaggggcactatgctccttagaatactgatatatgtatatgctcatttaatgtttagcaataggtctgccagtgtattcagactcagatttaccatcagtagagtgttcatgcttttctgaaataatgtgttatgttgacttttttgtgggcaaacaggtttatagacatactctgataaaagatactaagctatttgaactgtttaacaatgccatttatcttcgtttgaaaaacaagcatatataataccatcacagaaattttgtttagggtacatcaaagtattttgagtaccttactgatgaagtttattggatatagtaagcagttaaataaatggtcagtgccttcctacagcaagtacaagactgtgtatttaatcttccatttgtttccctgtcaccatagcagagtagtaactaggacctgtctaaacactgtaaaaatttgaacacattgcccaaaatttttacaaaaggaatgcaaggatgaaggtgctgatgactaggtggaacatctcatgctattttattattttgtttattgcctgagtagtgtcacattgagttttccttttgaaggttctgtatttcacgtcacatgcacaaataaaaacatgcaacattcttttcattcccacatttttaaaacctaaaaccacttaagccataaatttacaggtagagcaaagtatgagaaaggtttaaagttgaatagattgaaaataaggatgaataattttaaaatactgatttgttctagcaaaataatactgatgttgaaattaccttgaaaagttcatgctttcaaataaaaacacactttcttttctagaaaataatcttttcatcaggtgatacttcaattatctattggaataaagtctatatgagttatttaatttatgattatgattgatttatactgctgaatgcagtcaatttttttcatttactgatataattgggggaaaatcctttaatctgcatttctaagaatattattacacactattcaaaattgttcatttttgaaaatggctacaatgaccatccatgtgcataacattaaatttaattatgtaattttattttataaagatagtttatgactatttcaaagcattttcaatatagatgggtatgtgtgtatatatatatttgtatatactgttaagtatatataaagtatatgtatgtgttgtgtgtatatattttaatcctatgtatacatacatatacatatatacatataggattaaagtatataaaatgtatactttatatgtacttaaaagacacacaatgaaaataccctttaaattctgttccttaaagatacctttttaaccattgttgtatatcctccaggctctcaacatatgattttgtgagtatgcaagagaccgtgtatgtaagcatggacatgtgagattgtttccacatgttttcaaacactagatattatcaaccttttaaaactctgccagtatgctagttagaaatatttcatgttgatttacatttaaaaaattgttcttaacactgaacactttttcatataccttttggcccttctgtatattaggtagatgtctgtcacatctcttgtccatttttaaatttcttcttttctttgtaatttgtaagagatactagtacattggaagattcctttcttattctccctacaaagaaatgtcccatctgtcagtttgtagagttgatggagaattcagaaagctcatagtgatgtgaaagtcaataaagccacctggaaacacgaattctctatggctgcatccagctcaggaaacctcccaaggctatgtaaatagaggactcaggtgcctgtcactttccagccaagcaaatttaaatactgacagacacattttaacagattcagttacttcacagtttggtaaactataatcgcaatttgctccttataacctcttagtaaattattcatctccagtgggggaagactgatgtaatgatctcactttcctaccttaggtgtttcatcagtacagacgcctcaccttcccacgcacgcagactcgcagacgccctctgctggaactgacacgcagacattcagcggctccgccgccaatgcaaaactcaaccctaccccaggcagcaatgctatctcaggtttgcgggtcctttagacttgtgcaaatatgaaaagtacatgacgactacctgtatttaagaatggtgtgaggaaatctaaccacttattcaatgtgcagctattgctagttgatgaatttggaatttcagtcactcttaggaatatgaaaccacagaacaaatgtccttttaacagagatgaaataatagtgagaattgtgagactacagcaaaaatctgctcaggaggaaagagttattcagaatagtctattttttatatatttcaggcaattaccattctacagggaaaactttttgttagaagtaagaaataatatgcataaatctttacttaaagactttgtaccaacaaacaaaagggtgaagagtgattcctattatcagtgaagggcagtgagaaattgtaaccacaatgaaactgttatttaaagaatgagaaaaaaagaaaggaatgggtttatttcccattcaaacattaagaatctttcaggatggcatctctgtgtttataacaacaatgcagaatatttcctcccttttcttttcaaaattagtgtccaaatcacttcttggtgtccttttatatgcaagaaaaacaagtatgtcttttgtcagatcacaaatccacacagtctcgtatataatttcagtgatctgagtgcttgaaagttaaagatataaatggtagacctatgtagctggtaggaacatggtcttgctttaggtaggaatcaaacacatcaaatagaataattattattttgcagtattaaaactgtgcccttggcataaaaatcattccaggcaatccacactctttaaacaagtgggagaagagccgccctcaccttcctcattccatctagtccagctgccatgggaaccacaataaaaatatttggagcttttagcaaacccacagatccagaaatagtggaggggcagaaactgtaaaacaacaaaaggggactgacccctggggctggttgtcacacagactagtctgctctgtcctgatcaaggaattcttcttctcaaagaagtggctaattccactgatgaaaaatctattaggattaatcaacctaattaaaattgtaaatgccgtccataaccaccactgagagtacctacataacaagggaaacgaagttttcaagtgaggaggagggaaggtaggaagtttcgggaggttgagagtggaagcctcaaaacagcttgggagcagggtctgctagagaggggagaacagatcaagtgagtgagaggagtgtggaaaagaaggtggaaaaaagctgatttcaaaactctgcagagggccagttctatgtctgaatgagttttttaaaggatgaataaatgagctttcctcactcttctacatattctgctggagccctcctctggggatccagagtggaaaacctcatgtttatgttgtttattctattctatggtttagttaaatttcgtggtttagtggcttttgaagactgagctgagaacccatgctcaattatttggaagatgcattttcaattctaatggaatgtatgtgtgaaattatagactgtactgcatttgtaattggtagacacctgcaagctcaaatcaaagccatgttcagaacgtgcatgcatgtatcactgcagaaatacagactctgcctgcaaatgtgagactaatctcacatcattgaactgatgaccccagggatcttgacagaaaataacccaacaagctcttgaatagagggcagctcatatttcttttgctttttccatggcaactagcatagtgctagtcatctagtaggaaccaaatgaatatacattgattgcctgtgctgtaattctggatgtgatgttgggcaaaggtgtaaaatacattaggtaatttgaagcctgaaaatggaaagttctaacctagtacaatgtgcagtttctttggctacaacactagattctataccaattagcaactatgtgattgaaaaataagagaatgatgccactgtaatgtggagtttgttggatttcaagccaatttgatttttcctggccagggaagcctgaattgtgaaagtagaattgtaaccttcagctggaaaggaagaaaaagaaaacctttgagctcatgctgtggcccaggcaggatcccattcagctctattttaagaaaattaaaactgagcacctgcacccagggatccctccccagagaggtgtgtgcctgcaaggctctcagcatgtatcaagttgcacttcctcctgtgccaaccttttacactcagagctctacctccatctacatggtctcagcaccactaagacagcaccagtctctactgctttgatgcattttttatattgcctaaggcagcctgcagcccagagtcttaggcttcttgggctgtccaaactatatatttttttaagttgtgctctgattatgaagctgcataggtttccagttgtctgcccctaaatgcatctttcccataagccctggtatttttggtacagttctgtagaatgcatgtgtcgtggtatagcagaagtgcttgaagatttgtttctctgccttatctttagtaattgtgtttatgttggctatctggctattgcccttgcgtgacagacacaagtgacagtgctgatggcccttctgattgcagatgtcccaggagagaggagtacagccagcacctttcctacagacccagtttccccattgacaaccaccctcagccttgcacaccacagctctgctgccttacctgcacgcacctccaacaccaccatcacagcgaacacctcaggtctgactatgctgctctagtagtgtcttcagttatagataatgaaatggaaactcaaaactttaatgtagctcttttattttgtgccagatattatttgtaggtttcccattttacaaatgttcacgtatcaacaccaaattatgcaaaagaaacttgccagtaagctttttctgggcatattttattttactattaatattataaaagtccatggcaaagaagaatcaataataggccttaatgtcatatagctctgggatcaaatccaatttcttcaacttcgtagctgattacagggcaaattactaatactttctgcatatcagatttgctttctgtaaaaatggacataataacactccttttttaattatgtcaaaataattaacgtgatgtctgaatatgtaaaaatctggtatgtaataaatattttaaaagagtaattgtgacgcttattagaatccaagtatggaaagccgtgaatgaaagggaaatgaatagtctgaggaagattgcatatcatcaactaagaattatatcaaggaatgaatagttttccctcaatttatacaatgtttagtttaaataacttgaaataaatctttgattcactttattattttaaaaacaagcgaatgtcaaatcaaacgaggactcctagagcaaagatgccaataggaaattatctttgctaaagagtttttctttcaccttttaatataacgaattaattagcttttattcttctattcattttcttgcagatgcctaccttaatgcctctgaaacaaccactctgagcccttctggaagcgctgtcatttcaaccacaacaataggtgatattaccctcagtcaggcagccacaccatccccatgtgcctggtgatgtgctctcacaagggccttccacccactctacctcgggctcctttctttaagttgcattaagtgtttgaatcctgagggtgatggaacagcaggaagatatttctctgcttagcagtgcaacagctgatgagatcaggatgtaattgttactgtcataattcatcagaaagcatgtgtgagaaacaaccacatctactagaactttttctcacaggggtttaggtcttagtaaggaaaagaacaagcccatcaaaggggctgtccattgcaagtggtgagcatcagacggctgatggcagagttcccgttaagcagtgagagggcgtggagataaaggaaagagaaactgaggaatggctgcagcaatggtggtatctgtgaatcagcaagtaagctgatcagagcttgcaagcccacaattctcctcaaattcttccaacccaaaatcaagatgagcagagatctcttagcttacacaaagcacatgttctcccaattattcaacttaaatgcctacactcacacaagatactgctaaatttgttgacagagcaatttgttaccctggatctagtagatgtgcaaagagcttacaaaagttaatctagagaatgaagcagtctttgcattttctctgacttttttttatgtaaatgaaaagtataaacttcgtactatgggggttataattatataaattaacattgagattaatcaaaatatgaagacctttaaaatatttttggctgtgtgaatcttcagccatgttgccataccgccaattagatgcgtacctaaaagtcttaatattgttaattgtatttattgggtatatttatgaaaaattttatagaattagctcattcctttataatgctttaagttttgaaatgaaaacctgtactaggcaaatccttcatattctgttaaatctaactagatagactttatgaagtagaagtattgtaaatcagctttcccaaaaatgacatggcagatattctaaagcaaaattttaataatttacattttttttctccattacagctactactccatctaagccaacatgtggtaagtttatttacttagaatcagcatacctcactttggaatagcactttaattacatctttctttattccaagctttcaggacccactagtaagctaaactcactggctctaatttctcaccgatgactagtctcaaattagtaaaaaattactagctacacatggacatagagttgggaatgatagacactgggaaatacaagagcgatgatggagggaggaagacaagggttgggaaactacctatattgggaactgtgcctacttgctgggcgtcgaattcaattttactgcaaacctcagcatcctgcaatatacctttgtaacaaacttgcacatataaccctggaatccaaaataaaagttgaaaactaagttttccagttagacaactttggtaaagccacttaatttaatttaggtatttgaaaaaaaaatggaataacagcaagtttgttggtgagggggagggggacaaggattcagtgtgatgataaatataaaatgtggataataccttcaaagcttatcaagaagaaaaatctctctttttctctctctttctgtcttgcttgttaggggctggctcaaagcagatacttgaaaacagtttgtctctctttttttttttctcattttcttccttgattctcagttgaagcaaagcggttcttcatggtcagggcttattcctccattcatttctaagtctaaccactggagtcactgccttcagtagctttccatacatttagtgtaaagagtggccttcatatgtctgtttaattaatatgatcttttgtaatccggttgtcattcatctctcctcccgcctcttgaatcattgcctccttatgttcttcacttaagtaatatggaaccactttcagttttcttttctttctttctttcattcgttagttctttctttcttttttttttttttttctcactctgttgcccgggctggagtgcagtggtacaatctcagcttactgcaacctctgcctcctgggttcaagtgattctcctgcctcagcctcccaagtagctgggactataggcacatgccaccgagcccagctgatttttgtatttttagtagagattgggattcaccatgttgcccacgctggtcttgaactcctgacctcaggtgatcaacctgactcggccttccaaaatgctaggattacaggcatgatccaccacgcctggcccacttacagatttgtaaacacatactgttccttcctgcctctgtggccactcctgctcttcctctacaattggaattctgctccaacctcatcccccaaaccccatgtctatttttctatttcctgctcatattttaaaacacaaactaagtcactttctctggaaatcctgtcctatacctccaaatggaacagatctctctctttctagtgccacattatttcctgcataatcttattttagaggtttgtatgtctcctgcaattcatgcttgtgtctgcctccacactggattatacatttctaaaagctgattatatctaacttgcctttgaattcctagtattggtgaccatgtcttacatatgacaagggcttaataatttttgttgaataaaaacaaatgaataaatttatatttgttgtaaagatatttttatcagtcagcagaaattgttgacactaaacaaaggtgctttggaggtatattatcaatcataattttacccaagttaaggaaagaatgagggcttctgatccctgagtaattaatgccccacatatatcaagaaacaggtggttaataactacgttttagaaaacaagaaaattataaagcaagaataaatttctcaaatgcatcatttatttgtgcatcaagtcaacaagtaactagtgagttcccattaatgatacatattatgcatactcctgaatttacagtgataataaaaatagcctagactttgctctcatggaagttccaagtccagctaggaagacagacacttatctggtaatcatccaaatataaatttacaagctgaggtccttgttagggcagtaaagcacagataattacgaaaaaaatgatatggaggcacctaatgtgttttttctttttcatgttttttggggatatttggttagttgatttgatattttggcatttgcattaatgtagttttatttattctggaaaaataacactcaatgttctattttcttttagatgaaaaatatgcaaacatcactgtggattacttatataacaaggaaactaaattatttacagcaaagctaaatgttaatgagaatgtggaatgtggaaacaatacttgcacaaacaatgaggtgcataaccttacagaatgtaaaaatgcgtctgtttccatatctcataattcatgtactgctcctgataagacattaatattagatgtgccaccaggtaaatatcaatttatttcttttaataaatttataaaaacagtacacttttgtgtgtggtgttctccagtggtcacaggagctagtctggtgagagaacagggctgagggaaaggaaattccttggaaacaagtgggtgaactttctgctgtcttaaccaagtaaaaatgatagagtcaaataagccttctgtttacatccattaatcaccacttctacttatttaacagggagatgtttatgtgcactaaatatagtttatcctgctaagtgattgtctgcaagctttctttattctcctctacttaaatgaagtattaattatatatgtacatatatttattcttttaagtacaaatttatctgaaatatattagggagaaacataaaggatttgatgtgtatgggaagaaccaaaatacattcataaaaaggaaggttatggtcatgttagtgagatcaagttggttttgtcagctaagctactgcttggaaagaggagggggtgacaggcgtcgggcagactctggggaagcatctcttagccaaatgcattctggaaaagggattccagagccgtgtaatttttttaaaaagtcatatcatttaataattcaagactattaataaatttgttaacatttaaatatgttaacatcaaatgtattttgaaaataaaatccatttaatttattcattttccctaaatattactgagataaattaccaattaaacacagaagatgacaatacttaaaaatgcatttcccaatagggaaactcccaatacactttataataatcattcaattaaaagtaagtaaagagtaaacaaaaaatttaagataaaaacaaaaatacaaaatggaatgagtgttttttaaaatgtgcgaaagctacaattttatcaatatgtttgcttgcatttcattttttaacgtggtataacttataaatgaaacactaccaaaatatatggtgctaaaaataataaagtaaataataaaagaaacaaatccctagagttattagacttttcccatagcaatctcaatccttgccaaattctatgtcattagcataatttcagtggctttaactgacatgttaggaatgaatgagggcttaggatacacattatgaaatactaatcaagtttatttctgtatcttcttgtcaggggttgaaaagtttcagttacatgattgtacacaagttgaaaaagcagatactactatttgtttaaaatggaaaaatattgaaacctttacttgtgatacacagaatattacctacagatttcagtgtggtaagaatataacattgaccagagaatttttttttgtggcacaatgttgttctagatattatttaatcttactctctgccctttctctcttcctccctgcctctcttgttctccctctgtttgtcttttttctttcttgtctttttcttggtctgtggtatatttagagtcaaataattaaattacctatacaattcaaacaaattcacaaaataaatgaatacttttcatgaaaaataaatatctaaaaattgaaagtcaattaatttacaataattttcttggcaattgttatacacaggcattgttgaagagatcatgaaagaagggtgttataaggaaatgataatacacaaactctgttatgaagtaaggaaaaaaaatacaggattgtatggttcaagagtttactttttccatcctgcatcaacaaaattcatacacaagttcaagaacacttaaataagaagaaagcagaaaaagaacagcaagtgcatctagggatatgtttggatttgaattgaggcaactaataattgagatagtatttttaaagtgtatttgaatttaatgaggtgaactctcccaccctttgacttaaagccatctgccaggccatagctggcatgacagacagatgtgctcaggtgtgcatgcgcatgcacgcatatccacagctacacacatagaggatggagcattgcgctgggtgtaatcatcacctaatcaccatagtatagattcatggccatcaggcaagcagacaaggaaaggaagagcaatcatgacagaccaatgataaaatgttctctctagacaatctattagatgaagactaggtgaggtgcaatttcaactttaagttgtatttgctatatacagattgggcatccctaatctgaaaatccagaatccaaaatgttctcagaatccagtactttttgagtgccaacatgatgcggctcaaacaagtgaaaaattttacacgtgacctaaagtgactggtcatagtcaaaatgcagaaacataacacagaatttagtcagcatccccagagaaaaataaatgacctcaagctatgtatatgaggtatatatgaaacataaatgaattttgcatttgaacttgtgtcctcttcccaatatattgtatcatctaaatgcaaatattccaaaatctgaaaaaaaaaactaaatccaaaacacttctggtgccaggaattttgaataagggaaactcagcctgtattttcataaaagttgaatgtaaaaattatttttagggttttttattattttggtaatttccacagatgtttcaatctgataaatattaaatagagaattataaatgtgaaattagaaaataaatgtgtgcgtgaaatattgcatcgatatattcattcgaaatatttctttatttcaggtaatatgatatttgataataaagaaattaaattagaaaaccttgaacccgaacatgagtataagtgtgactcagaaatactctataataaccacaagtttactaacgcaagtaaaattattaaaacagattttgggagtgagtatgttacttgcatttatatgtaaaattgcttctctcttcatgttcttataattatttgagaatcataggaaatgaattgtctttttgctgtttttgatactttttaagcatatgctttttatttcaatgaagcgcaatttatctatttttacttcttttgcttatgtttttggtgtcgtatatgaaagtccattgccaagtcatgcagatttatccatatgttttgttctaaaaattttatagcattggctcttaaatttagctctgttacccactttgagttaatatttgtatatggtgtgaggtaacagtctaatttcattttgttgcatatggccatctaatttttccagcgccatttgctgaaaatactatttattcccccactgaatagtcttgccattcttatcaaaaattagttgaccataatgatgggtttatttctgaactttcagttttattttattgatttatatgtcatacttacactgtcgattactgctgctttgtagtaaattttgaaactggaaactgtaagttcccccaaattgttacttttcctcaagattgtttagaatatctaagggaacttggaattctgtatgaattttaggatcaacttttcaatttttataaagaagccatctgggattctttcagggattgcattgaatctgtggataaatttgggaaatattgccatcttaaccatgttagtcttccagttcatgaacacaagatatctttccattaatttatgtcttctttaatttattttcaaaatgttttgtagttttcagtgcattagtgttataattcttctgttaaatttatttctagtttaagtttattcctggttataatgctgttgttttcttaatcacattttcaggtttgttactaatgtacaaaagtacaattgatttttctgtattgatcttgcagtctgtcacattactgaatttgtttattaatgataatattgagaaatttttgacaaaacttataaatgtaattctaaattttgttttgttttgattttgagacggagtctcgctctgttgcccaggctggagtgcagtggcgtgatctcggctcactgcaacctctgactcctgggttcaagcaattctcctgcctcggcctcccaagtagctgggactacaggtgcgtgccaccacgccctgctaattttctgtatttttagtagagatcaatctcctgacctcatgatccgcccaccttggcctcccaaagtgctggaattacaggcatgagccaccatgcccggcccgtgattctaagttttatgtaaaaaggatagttgaaggctaaagaggctgcctaaatccttgtctcctcatacttctccaaaataatatatagctacaagaacagcaaataaaactatgtaaaaactatatcctcagcataactagaaaattttaatgtatttttattagtaccacaattattacattctttataatcaatgcaacaaaatagaaatcccagaaaactatgttttatatttgaaaacagcacaaaatgttttcagtgggggaaaaatagtcttttcaactaatgatcctggtatctctgtagaaaaaaaatgaacatcagctctcacctctcaacaaacacaaaaattaattcaaaatggattccagacctaaatactaaagctataatttaaaaaattctaatcaaagacataggagaaaatgtgtagctttagcaaagatttcctagggcacaaaagcaagaaacataaaacttttttgatgaattggagtgcataaaaattgaatattcctgctctttggatgaggccactaaggaaataaaaaagcaataaatagtttgtaaaaaatcaaaattaattttttcaacaacagaagtttttccagaatatacagagagctctttcagctgcaaaataaggactaaaacagctcaattgaaaatggacaaacatttttaatatatacttcacaaaagaggatacacaggtggttaataagcacattaaatgatgctcagcatcattagttaactgagaaatacaaattaaaacaacactgagatgataatactatacatccattaaaatggctaaacttaagaatacggatactactaactattggtcaggatgtgcagccatgacccaggaatttcactccaggtatttaccaaagaggaaacatgacaaagcagatgcattcatagtagccaaaacctggaaacagcccaaatgtgtattcactgttgaatcctaggtaaaatgtggtgtatctttacaataactactgataattttttaaaattctaactatgacacatgcaactaagtgaatgaatcttcagaacattacattgagtgcaatatgttaggagtgaaaaagtacttactgtttgtttcattttatttacatgcaatgggtaaaaagacaaacttaatctgtagttaacagaaagttgatcagaaggtacgtgagtctggtcaaaggagctgagttgactgggaagtaccacagaaggacattttgggatcacagaaattttctttatcttgattgtggtgttggttatgtggatgtatacatttgttaaaaatgcattaaactgtatctcaaatgggtacattttaatgtaaattttacttcagacattttatttaaacatttatcagtttttctcagtttcaaatgactagttactggaagcaatgacaagtgctactcaatgactgctaaatttattggtgctatgaatgccagatttttagcacagcaaaatctacaaattccaggatttttaggtagtatctgggcaagaatatatatgaataatgtatatgaaaggaagagggggttcttagatatcttcaagtcagtggaatgcttaggtttcacagtgccaatctggtgtgacatttactttgttaaaggaatttactctaaaacaaattaaatgagcccagatgcatttctttaaattttattttgaattcatcatttgtcaaaatatggttatcaataatgcatgcttataatatgaagaatgctttatccatgtcttatttttcatattacataacattcttattcttttaacaggtccaggagagcctcagattattttttgtagaagtgaagctgcacatcaaggagtaattacctggaatccccctcaaagatcatttcataattttaccctctgttatataaaagagacaggtaatttgtgtagaatttaatttcatcagaaaagagaaatcaagaatttgaaagtactagaaatttttattgagccagtgagtcacaaagctctctgcttagagactgcataggcatagtatactccctgatcttagaattgcttccactcattcaaagctttccagccccagaaatgactaaaatccagaacattctaaatatttgcttgtccttcttggtcttagtttaaatctttgtgctccaaagcctagagacagaaaacctctggatgacaacactcatttctgtcttgcaagtattatgtaagtgatttgactcactttgaactcatcattcagcctcctaaacaaaccaacaaacaagcaaaccccttgtaaaacttgtttcagctaataatacagacaaaatgttgggtgaataaaaatgaacatgggcccatgtagccgctggggccagtttggtgtaatcttgggagcatagttctaagtttagaattagacttctgcagaagtaatgcaattaaaaaaaaaaagaagaagaaagaaatgtgctatgactagttcactcatgaaatgttcaaatgagatgctatttaagagaacaaatatcttctggacaatttaaagtatctaaattgtttgtagaaagtaacatcagtggagtatctcagagcagcctcaatgcctgggatagccctttctctattcttttatccataggttaaaataggaatgaagtgaacctcatagaattctgtcactctgtgctgtggggaaggaaccagacatacacttcaaaacttgaaaagtgaaaggctatttttcttcattatgttattttatattttaatggccttttcttgctagtgtctttaggtcttaataatcagactactaaagcaaagttaaatatgcatgtagttttcaaattaacattcaaaggccaaggaaaataaatatatactatatatttgaggttatgataaatttaaaagttaagtctatgtggaaggaaaaatggaaattccaggaagataaaacagcagaggtactgtctgcctcattggacacctcttttacaaacactttgtgtagcttctatgggaacacattgttcattttttttttctcttctctgaatcttctattcactatccctttctgcattcctcaatgtctacactctctctactagagagtattgtcgatgtcagagtatatggtagacattttatgcatttatggctcttttatatttttacagtttttttaaactgtatttccactgtatttgcataattagggtaaaaaggatgtaatgagttagtagcaactcattacagcaactagcatgggtccttcttattgggcaactaaatagtgttacccaaatttaacagctgtccacatagaacacttaaacgggattgaatggctgagaaggggaggctagctatcaggctgtgtgttttcttttctccaaagctgccgattggtgactgaatgcagctttggaccatgccctgacactgcataaagggctctttggagccagctctactctaaacagcgtgctccgcttttgttttctccttcatctcaaacatatacctgtctcctctcccatgttacctaaggcaaagagagttgataggattatagtatcgttaaggcaacttaacttttctcaccattttaaataaaattactattaaaaatccacaggaagaaagtctatgaaatttgcagtttactttttaatcagatattaaatttcacttcattacttcacaatttaattttttcagtgtctctaaaagagagggattaaaagaggagaaaaaatgcaattgacattaatttagttttattggtttagcaggtttttttaattatgtattatttaaagattttatcaactattttaataactcagtggagatgtgcatacatatcttcatagttcatatgatgaaactgaggttaacagaaaatgtgatagatgttcaagttcagtagcttgatctgtttcctttctgctcttggttttgtttgtttgtttgtttgagagggagtctccctctgtcgcccaggctggagtgcagtcatgcgatctcggctcactgcaagctccgcctcccaggttcacgccattctcccgcctcagcctccctagtagctgggactacaggcgcccgccaccacgcccggctaatttttttgtatttttagtagagacggggtttcactgtgttagccaggatagtctggatctcctgatctcgtgtgatccgatccgcccgcctcggcctcccaaagtgtgtttgtttatttttcctcacatttttagcttaagatattttggagaactgcagttttatctcgttaacttaatgatggcaagtgacagtgaagcttcttggtaattggggaattggggaagagatcttttgtgctttattggatttaaaggattatttttcaaaagttactgaaagcaataggcacctttcaagaccaccatgatgttgctggaaattattttgtgtaatgccttttatttttttaagaaaaaaaaaacagaacaaattgcttaatctctctgtggctcagttttgtcatctgtaaaatcagatgatagtgagtaccaactaatagttgcagtgatggttaaattaattatttcatgtataccccttgaaacagtgcttggcacatacagtgagttattatttttaaaaatcgttattgatattattattactgttgctgctatccagaaacatgttgccactctaatcatcctctttcctgatgtcacttggctactcaaaaatagcagcagctggtgatttttttacttaacaagtgctaagtcttctgcctgagtgtgaaaacacacttagacactgtcctacctctcatatgcctccccagccagagctgttgtcctgatcaggtttgtcactaaactcaaaaacattccttcttccgtttgtaatattttcttttctcccttacatgtattcagttccacttacctttcaatgaacagctgaattccacttccggcatgaaactccctcattctcacagctcccgttaattactgtagtgtccaaattactatgatagaatcaacccaatgactgatgatcaaatggattctgcatctaacattcaaaacagtagctaataccgatgttcaaagtttggaggttacatatcagaaaaggttttctaaaaaagaatcattctgaaacatgcaactcaagacttacagtatacactgggggctgtgttttctcagaaacaaaagagatcgtcttcacaaatgaatctgaacttattaaatattttatgtaccaaattaatgatataaaaccataatttttcaatatttaattttaccaatgataattgagtttgttcaatacactggctgataattgtaggtacttttgagtatcaaggatgtacttatttttcaatcactcaatagtttggagttcacttggaacaatgtgatgtagagaccaaattaattaggtacgtggtagtactgacttttaacgacttactaattttttttcacatttttcctcagaaaaagattgcctcaatctggataaaaacctgatcaaatatgatttgcaaaatttaaaaccttatacgaaatatgttttatcattacatgcctacatcattgcaaaagtgcaacgtaatggaagtgctgcaatgtgtcatttcacaactaaaagtgctcgtaagttatatgttttaatgcttctttccataaatggtaaaaagcaaggtatgaactttttagcctacaatatttctatctttattctagcaagcacatttacctggcacatttgttaacatctagggcttataaacacgtaaaatctaaaagtttaaaaaccgttatcctggattctctctcttcttcagatatagtcatagaattttaaggacaaagcataaaagcatcttaattggcatcagtttgtgcaatttcatgcagttaagtacttaaccaacttagattaaaacattcactgtttgctgttgtctttactatctggaaatattaattgtaatcagaaacctaacaatgtctcataaagcattagcctactaacctctgttcatctgataaaacatttcataaaatgtaatattttattagcattttcttctcttcgttaccctcaactacttactattctattttatgtcacattatccatttaaggtttcctttcaatggcatttggctcttgccactagtataatctctccatagtttccaggcccaaagttagatctgcttctggggcacatgttaacctccatcgaggacagggaagaagaaatgccgtgttttaaggcagcatctatagctccagagaccctaacgggcactagacttgtgaagaaatattgtgctatttggggctgaatataagacacttttaaggtcatttaggttttggtttgaaaagttctggtcctggagctctatgcttttgttgttttcctgagtttctgtatcacagaaaaagaagacaatttgtttctgttcctgaagaacccatctaggtgtttaccaggataacattagcactccgggaaagaagggtctagattgtgtaataggacttggaggtttcccaatcaacaacatttttcctctcctctccccaaacttccccctcttccccactcccttccctttttctctattctctaattctacacagtctccttcagggattgcaataactctcatggcttcatgtacaacctatatgctaatacttactgaataaatgagtgatttattcttcagggttttgatattgttttttaatttatgtactatcataacttccttatttataacccccaagctaacacttaaaatactttatactatatccaagtattgtcaagtaatttacatatgcatctattaaattattaataacaaatctttcttcattttgatagctccaagccaggtctggaacatgactgtctccatgacatcagataatagtatgcatgtcaagtgtaggcctcccagggaccgtaatggcccccatgaacgttaccatttggaagttgaagctggaaatactctggttagaaatgagtcgcataagaattgcgatttccgtgtaaaagatcttcaatattcaacagactacacttttaaggtaaaagtatgctctctacattactatagtaccaactacattataatgattgattcatagtacttaaataactttaagaccactgctcacatgagattgagaagctctgatgtgtaatggaatcacacttaaagagtctcaaatatttgactctaaaatttttattcctatagctcaagtcagtggtttaaagcaaatgtttcattggaatattttagaacttcaatatgacttaattatagctaaattattgcttctgtgttaagaagcacaacactttatgcacaacagattattactttaccaaatctaccttttctttactttggctttttatctttattaatgtggaatttttcaattgcaaaatttcacaggtaccttgaggttaggaaatatttgaaataaacactagacaatactagtgagcatacagaatttaaaacactcattatctcactgtctactgatcgtattttgtacatgtaacttcataatatacacatttatatgcacttaacacgtattatcaacattctgagtacacagttttcaaaatacagttttaaaactgtatttttaatatatcactatatcacacacacctttctatgttaaatatttaactactatgtagtttttaatgcctgtataatattctatgtatggctttatcacattctattaactataactatgttggtctctaatataaacaacattccgataacacacttattggtaaagcaaaatttttgaatgtctttaataatttatgtttcataaattcctaaaaatgcatttattgggtcaaaatgtattttgaggctttttggatatgtaactttttttttctataaaatttaccaaattgccctggtgtatcagtgtatgaaatgactgcttcttgagaggctcaccaacactgaatacgcctttctttttctttatttggtggttgaaatatggtattgatatctttcttttaatgaagtttctttacttattgttctttgtgttattctttgcctcttttatccagttttctccggagaaatgccttgaatattaatgatattaaactctttgtcacatgcgtaaaaatgttatcagtttataatttgccttttagttttcttcacagcactttgtcttacataattcccctttttatttttaaacaaatgtatctgtcacttttattcctgttaaatagaaatttccatagttaattttttaatatgatgttgacaaacggcctcatattctttttttgttttgttttgttttgttttgtttgtttgttttgttgttgttttttgttttgagagggagtcctgctctgtcacccaggctggagtgtggtggcgtgatctcggctcactgcaacctccgcctcccgggttcaaatgattctcctgcctcagcctcctgagtagctgggattacaggcacctgccaccacacctggcaaatttttgtattttcagtagagataggttttcaccatgttggccaggctggtctggaactcctgacctcaagtaatccgcctgcctcagcctcccaaattgttgggattacaggtgtgagccaccgtgcccggcccatattctttatcacttaaagaagtgttttcatatttataaactttttgattttgtttttgaactggaaatgtcggttggattttatcgatttttagggcattatgatagatgatgccatagttgtgatgccctggtgtgattagtttaaatgatgcaaaaccattgtcacattctaagagaaaaacccctgctctgtcattgtgtgttattctctcagagtattattgaaatcaacagcctattattgtctttattagtagatattcaaaaaggagatcattcagtgagtagagacggtgttggcataggcgttggatgacatcattcttattaaatttggtataaaggttacactgatctgataaaacacattgcttatatgttcctgtttttctgtatcatataactttttaaaaaaattttattattattttttgagaaagagtctcgctttgtcacccaggctggagtgaagtggcgtgatctcggctcctgcaacctccgcctcccaggttcaagcgattctcctgcctcagcctcccaagaagctgggattacaggcatgcaccaccatgcctggctaatttttgtatttttagtagagacgggggttcaccatgttggccaggctggcctagaactcctgatctcaagtgatctgcccaccttacctcccaaagtgctgggattacaggcgtgagctactgtgccaggcctatattatataactttaaatagtataggagtgatttgttcctgaaaaatttgtcttcattcctttcatgcagagaaattctttaagactcatttatatcttctttcaataggattagtcttttcagatattttactctttttgagtgagtgtgctatatatattttttcaaagaatagtcaacctaaaagaaatattttcttattgtcacatcattgtgtattatacttcattccccactgcttctccagtgcccattaagctccaggtgcactggtttctctataatttctcagaggcacctaggtgttactctttttagccacctccctccacgctcttcccacttcctagaatatgcctctcccactcttcaaatcgtataagttactatggaaaaatataggtgtacatcatattaaaatacaaccttaacgttcaaagtaggagataattattcagtttcgaattctcttcccccaatcttcaaaagatggtttttgttttctttattatacttgccataccttcttattatgcttatttctgtctccactatcatgttttgtgttcactccttcatgagagagcagtcatttcagctttttcaccattgtgatctctggttaataaattaatgaagttgatttattagtattacttttccatagatttattttgatgctcttcaggtggctttcggattaaaagtgttttcttccttgtaattttttttcatttttataaactaaagggaaaaaaaaggctatggattgtactttggtaaaattttgactgtaacccatgtctatatcgtttgtcactaatttctgaaggccttcacatgaaatgtaatcaatgattcttaaagtaaaacattttgattattgatgatttctaatgagtctgtagttataatttggaagagtttttaatatatccattatttaagagagtttttctacatttctggtgctttaatttcttattgctactaattattagctgataaaagttaattggcttttacaatttctgccttttaggatttgtagaataatttttacagctctatgtgtgatatttatgaatattctgtgaatattgggtaaattatatattctccataggataaaagcttagatatatatttgtcagatttattatatttattattattctcttttaatgatattattcaaatatattttacttaaatttttttggtcaaggattcttactgctcttttgctcttttcattttccctgtatatgtaaattgttttcacttcatttgtattacattttatgagacacaggtgtttatgcattatgcctatatagtaaattttactatatatccatttgcccttaaaaaaatgtatgtgcattttatgcataattctagtaaacagcttatggttgaatttccttttttaattaaatattagcctattaatagggaattttaactttatgaatattttgatgtattggattttatttcttcatccagtttcattattttaaataattatttaataattgtttaataactataaatatttttattgctaagtgagataagatatctttttgattgtcttttcaaatatatttgacaacatactgacataaccttgaagtttaaagcaaatcagcatacttttattgtatgcatggtatgaaagataatataaatgttttacattgtgatatataatatatatatatatataaattcacattagcaaactaattattttattttttgttactgaaattcaggcctattttcacaatggagactatcctggagaaccctttattttacatcattcaacatcttgtaagttatcactgggctatttattatatatattaagatatatattaatgcttataaagctatattattttacacttataatcacatttgattgttaaatgcttaaataatatctcttccgtaaatgtaatatttttaattgtcagtaaaaccatacatatatatgtaaatatatttaaatacaatatcttaaattcaagttaggagattcaattattaaaggtttgttgaattcataagaggatttatatacccaaactattaaattatgtttatgtttatgaaatatcgtcatgttagtaacatttttcgtgtactattttagattatctattttattctgtctcttcagcatatgtttagcagaagtgggccttagatacaagtctgtcttgatttacttaatggaagctaatataagcactccctaataacaatatacttatgtaaatatttatcactgatatttaaaatattttcatcaaagtaaaggtgtacatgaaaaattacttagaattaaatttcattataataatgaaaataacagctgcatgttacattccccacccacaattctgtttgccaggcaaccacttttaaccatttctatttttgggtctccttatagtttccttcatatatatatatatatatataaacaatattgtatactgctctttctagagttactaacattaccaattgatctgagcctatggaggaaggagacctagtactctactttgggctttctctactggttaacattgtaaatagaattatttaagcctgtatgtactttgttgtcagcaacttctaggtctttctatctttgccacttctagttcttcctctcttacatatgttacatatgcacatatgcatgtgcacaatcactggtatgaatgcaaagtcaaaagagaaaatataaaaacagcttattttccaaactgctttactaagccctctgcaaagttttagttctttctgctcagatttatgaaataaaaactccctgtgttaaatgtcaaaaaagtccagcaagatagctttgattttatttccacattacctttttcttttataatatctttataataaaaatgacttcattgactctttcctattaaattgtaaataatttatagcagtcatagactcagctgaacattcacactcacatcttaataggccagatctgaaacatttcacctggaaagacacagaacaaaaagcacagcatgctagcaagggagcctggcagtgggaatccttgcagcgggaatccttgcagcagtgcacacagcaatccagctacttttcttatgacactctcaaagacaactgagatatgagagaatgagaccacatgtgtaggtgtaggagctgcattccaaaaggaatcagtatctcttatactatttccatgggcatagcttccagacatgccaacaggggtgtgctcagttatgagcgggcactgcactcagggaaacccaaagctggtacttcccatgaggacaatagagttcacatatagcactccctgttcaggtgtagtttagcaatcaagggtcattttgccattagcaatgttgtctggtaaccagctaatattccacttttatcaggtttccaggtcaacggagccaaaaaattagccctcatctttttccacaaaggagacaacattgtattcactctctgctcacaatatcattatcctaagagataaataatatagtttcttttaaaatagtgatatctgttccaggaaaggacttgggctgtgaattgctagggtacagctactagggatgtgttgttgggtttccccggcataatattccaccacctgtactttgacatcattgtcaattgaactcctggggaccctttcttcttgctctgatctggactctcacatgccatcttgaaatattcccccatcagttttctggtttagatttgctgtatcacacatagttatttttttttctgtctgagttcactgatatatgttctctagtgtaagaaaaataattctaattctcccatacaaaaaaaatttttattctgctctggcacttgttcagtgtatcgacttggtataaaattctaagttaaaaattttagaatttaaaaattatttctgtcttattttcctgaatccaattttactttctaattccatcctgattctctctctctctctctctctctctctttttttggtctgttcccaagttttcctcccctggaaatgctaggtttctgtctttattcttggtcttacctgaattttttgtttgttttgttttgtttgtttttgtttttgtttttagagggagtttcgctcttgttgcccaggctggagtgcagtggcataatctcggctcactgcaacttctgcctcctgggttcaagtgattctcctgcttcagcttcctgagtagctgggattacaggcaggcaccaccacacctggctaatttttgtatttttagtagagaagggatttcaccatgttggttaggctagtcttgaactcttgatctcaaatgatccacctgccttggcctcccaaagtgctgggattacaggtgtgatccactgtgcctggccctgaatctttttcattcattttttctggatgctattgacctttgtaacctgaagatttatatatctgagaattctttgctccattttcttcccatagtctttggttgagtctattagtcataaaactcataagttgacttattattttggcattcccctttggtgttgatgttttccttaaaagcttggttcttattggtagtctagtcatagtcacagtgagacaacaggaaaggttgattagatgttctgtggtccttagaagatcttggtgactgaggagatttcctatgatattgctgatttatttttttctgatatcattcattatcaccaaaaactaattaatccccagaaattaatctccagaattaccctactccttgttgtgtggtaaagtgtgaaaaagtggttcttctcacagtaggacaggaagataggtgtccaactattgcatatgtggacaattacattgtcctcctaattttagtcctgtgcctcatcccttccctgtactgagcctgactttattctcagtctctcactgctttcatttaattttccttttgtcttctcctccctggtagtattttttcaagaagatattttttgttattgttgttgttgttgttattgtttttgtaaatagacatttgacttccatgttctgacccatgattcacatttactgcatatgtcactttcaaacctgagactcaggcattctgagtaaatggaatctattcctttgatttaggctgtggcctcctttcttttgttttctaccttctacaacttgttgaaattgctctacttctaatttcccttctctcattttcactgtcattataaatctatggcattttcagttttttaatattagcagggttcctggaaagaagggggaaacacatgtgtgcttagaatgcaagctttatctgaagacttggctattttattaagtttgttgagaaaagtctgatgctgcttaatatttttgtagaacttaatctaattattatggattggaatgctaacttacagtcatttgcagtttcttgcaaaatcttacttcagagtattctagaagttagatgttgcctctgatgaggtttttattcacaaatatctggaaacaatcatgctgattgatatatgtatactagtaatcactggtatggattgacaatttcagtgaaaggaatttcagatagagataagacaaggaacactttgggtcattttaggagcctattgcaataagaacttcttccctaaaaatgttcactgcaatccacctatatattcacattcatgtatcccatccatttttatatatgccggcagtataaatacccctttaaaggagataaaattatttctattttatatatgaggaaactcaagtttggataatttaatctatttgccctatgagtcaaagaaatgacagagcctgaattcaagctcaggtcttacagtctgtatctgaaattactttcaatattcctgtttgtatgagtttccagttacagaaattttgatcatgagatgaactgtttctggcagctgtttgcttgatagagtcatttccttctttccagttgtagaaaaactgtctcatgctcaaggcctccacttgccatacagaaaatacatcccctctacttccttatcaccctacttatttttttcagagtatatgaaaaaatgcataattatttcatttgttcacttacctttcttttttcttttcttttctttcctttttttttttttcttgacagagtcttgctctgtcgtccaggttggagtacagtggtgcaatcttggctcactgcaacctctgcctcctcggttcaagtgattctcatcccttagcctcccaagtagttggcattacagacacacaccatgcctggctaattttttgtatatttagtagagatgaggtttcaccatgttggccaggctgctctcaaactcctggcctcaagtgatccacacgcctcggcctcccaaagtgctggggttacaggggtaagccactgcgcctgtctgttcagttacctttctagtgtctgtttcccccaaagagaatgcaaatttcctgaaaactaatattatctctgccttatattctatagcatttccacggactgtcttcctttttatcttcacagcccttatatcttctcacctacatgaccatttacttatttcttctgttcattattaattatctatttttcttcactagagagtaagttccatgaggacaggacccttgtttttctttatgtagatatcctaagtacctagagctgagtttggcagatgaccaaaagccaaaaatattttttttgtgaatagtgaataattagtacttactacttcccagccaccgtgctacgtgtttactgtgaatcaacacctttagccacattttaggattttgggaaaggagggacaaagataataaggaatctggccaagttcccaactaagaagtggtagagctaggattggaagctaagcagtcgggctctggagctgaggctcttaagtcaccgcattattttgctgcattttcactacataagaaaaggtgaatatactggagatatttccaacacaccctctcttctatgccctttccctaggaaagggcaggatttcacattaaacttagtgaatatttaagtcagggtaagtcttatcctaactatagaatgaaaccatttttgtctcttagtgaatggattttacacctcagtgaacaggtaagagggtttatctttgtgaagtagaagtctttctcatccccttaagaggctacccacttctgcatataaagttaaactatatgagtttgtctccaaaatttataataactggattacctccttgatcccttcaaaatgaagtgtctgataaaaaaagagaattaaatttaaatgtgtcttatgaaagaacattatttaatcaaaagaaagataattattcttctattcttactctccttaaatataaaatgttttcattggttcagaacaatatagccaaaatcacagaattagaaatttattgtatttgaccttattctaaaatgtttattttttaaaacctcacaataaatttaaaaatattaaaatataaatactttggaggtgattattcaaccagtctagcaagttatttgacaatcgttctctgaatgtattatttttcatttctagataattctaaggcactgatagcatttctggcatttctgattattgtgacatcaatagccctgcttgttgttctctacaaaatctatgatctacataagaaaagatcctggtaagagttgattttaaatttttaaataataatggtattagtaatggtgcaaacgcatatccatatggcagtgatggaaccagttaaatgaaatatgtgaactagagagaagacagcatacagcccacttcatgacacaacttttaatcaaaaacttttagtatggttttattggtttgaattaaacattaatattattttctaaatttactaataatgttgtggacttgtttaataataaccagtgaaaagaatgtgtgtggtttttagtacaaagtgggtcagagggatctaggagtgtcaaaagaaaaagaaaggagggagatgtctggggaagttaatgtgtttctttggtcagaaacaaccacatcttatgaaaaacagaagatttaaaataaaatcatttagctacttatgtgagtttagcagacaattcttggttgttttctttcctcccacaccctcctctctcctctctgactctgctttctcccatccttctgtcctccctctgctcaaggctcttcctcccttccctcctttcctcttctcctctcctctcttccccttttcttatccctgacttccttcctttgttccttcaatatattcattaaatataagtaaaataccaattgaattttgtgcttcttgagaatatagaaacttatttttcctattttcacagcaatttagatgaacagcaggagcttgttgaaaggggtaagtatgtatatttttgctgatgactattccttcccctgcatttgaatccattcattttatttatttatttatttatatttattttaagacagagtctcattctgtctcccaggctgaagtgtggtggtgcaatctctgcttattgcagcctccgcctccctgttgaagcaattctcatgtgcctcagcttcccaagtatctgggattacagacacacatcaccaggcccagctaatttttgtatttttagtagagatgggatatcaccatgctgcccaagctggtcttgaactgctggtctcaagtaatccacccaccttggcctcccaaagtgctgggattataggcatgaaccattgcgcccgtccccattcattttaaataagaattgggcatttttagtttaacttggacttttgttgatacagtgataaaacttaaattcctttactcactcagcacctgtgaagttcccagtgtacgccaagcattgtgccaggtactgagagtactacagtgacaggcacagactctgcccttaaagggtttagaatctaatagaggaaagcagatatctcaacaaatatgacggtaatttgatacatgccctagtagttgaatgtgtatagttctatagatatatggaagatagaaaactgtgtgcaagggcagaaatctggtctgttaagattgtggggaaccaatggacaaatgagggagtggtggagggacgagtggatggaagtcacagagatggggagatgggatgtctcctcaagtccctgccagggtggaatggtggctgctcccactaaagacacatttatggattggacaaagaacagcaatttgacttgggagaagaaaacacatttgtttatcttttttttcaacatttatattctttaattttttaaaaatgtgatttctgatccagtaaaaggggacaaagtttcagaaattgaacctttgtttacaataaagaaatgtacttgctttctcatgcttaagacaggaataatttcagaactcctttgtctgtgttaatctgtgttggaagtgtttccctctggtaatagcaggtaccaggtctctatgcagaaactttagggctgaatctttggagctccttaaaaggctttatttttctttgcagaatgtaacactatctgatcccttattacatatttattcatttggtcattgactatcctctcctaactagaatgtaagctttgtgaaagcgtggaggcttttttcttattcactgctttatgcccagtaccaaagtgagtacctaggatttgataaatattagtgaataaataacactgacatagggtatcgtgaggattcattttgataggctgagggaggaatgaagagtacaatcagtaataaacacctgagcagaacaggaaaatccatctcaaggagttaaggtggacttggaaagtgtcaatgaaatattttatctcaaaattggtaccgattgcaccttggaacgcagtagaatttactcactcagaccccatgaaaccctgaatgtggccctcagttcagaatgaatgaataccaggcattcccaacaacctaaagaaacaattgcacatagccagtttgagagctgtgattgtatagaaagtttccatgggcaataagataaatgggtcaccctcatggataacttctttctttatctgataaactggtaaaattaatatgattactgaaagaaacactatcagtagtacatggaagagtaggagaaacataattttacatatgcgacagcttaaattctcttacctttctaaagctgttggttttcaagttccatatgcaattgtagctttttatggttagtatactttttaatcttcagtaagttatttcacaaacatggtatataatgtgtttcatatacttgaagcataacaaattaatacaacttgtttcaccatttagtgtaaacagatgatcaaattaagctgagtcatgggtataagggtattaatcatattgtcttatttcatttgcatgtttacagtatttcacaagttgaaaatgaaaatacaaagaaaaataatattgtattataaataaataattatagtaattgctataaaatgcatatagtcaaacgtgaatgtccttataatggtgatgtttggtctgggatcccttctcttaagcatagaaaatggggaagaacattctagtagagagaacaatataaagcccagaagagatctgaagtacaagattgaaaagtcattgatttataggtaaatgtttgtatgtgagtgagatttctcagatgaaatgtgtacgaggaggaaagaagctaaaggattgagtacacggtgtaaatttaatgaaatgtgtatgcccacctgaaagacacatgtaactagtattgaatctttaatatgtttccagatgatgaaaaacaactgatgaatgtggagccaatccatgcagatattttgttggaaacttataagaggaagattgctgatgaaggaagactttttctggctgaatttcaggtgtgtgttgcttttgttatatgatgataaattcgacatcaagacagttccactttaagtgtatttatattgccatttgcctttataatttatcccacttgatattgcaacataagcaaagtagatattattagcagatctctatgaaccagaagagagactcatagaggttgacgggattatagtgtagagctagtaaatattttaatgtagtgctttattgtattatgaagttgtgtcacaaaatgtatttggctgattttgtagttgtactctagatactcatccaagtatctgtttttaaatgaatttgatagtgacacaacaactaatcctaaatttgtccccactcaagagatttgttctgaaagttgtcaatcattaatttgtaagaaaaaagttttttttttaacataattcctgatcttaattttgattactctaagcaaatttttttatcaatatgaagaaaatattttacaggatatctcatttactcaaaacggtcattggtaagggggaaattatttttcctgaatctgctgtgatccaagaaatcgttgtttctttcagagcatcccgcgggtgttcagcaagtttcctataaaggaagctcgaaagccctttaaccagaataaaaaccgttatgttgacattcttccttgtgagtatttattgagtgctgaattcccatatattaggctacttgattattcactatttcacttgtttatttttcttttccttaaacagatgattataaccgtgttgaactctctgagataaacggagatgcagggtcaaactacataaatgccagctatattgatgtgagtaaaaatttgcatttttcttatacctacatatttcattcagctccttgtttgtcttggtaaaattttagaaatattattaaaaatattttgaagtgagcccatatgtcactgatataaacaaaaaattatcaatattagcaaggatagttatttattatgtgactattggtattaggtataacatagaattttcctctacaaacaaaattatattaagaattaatttaatatactctggtgtctattatgtgctagatattagactaaatattctatgcatatatttctcacaagaagtccacatttgcctcagccatgtgccgtataggtgaggactgggaggctcagtttagttaattaccttgttgttgttcacacaattggtaaatatttgagttgaaattcaaccagagtctgactgactccaaaatgttatgctttaatttcatcacactaaatttcagcagacattcctcatcaacatgatcatctatccattggatttatgcagaaatgtaaatgtccgtacgtggttaatttatttaaaatattttaaaatttaatttattatacaaatgttaattaatgtattacataggttaaataattttaaacagtataaaaatatatacagactgaaaaaattctttttgtctccccaaatctgccattttcccagtgtcctcacctaccagaaataactatattttctattcaaatatatatggtaattatggtatcaggttacttatgtttccccaatggaacttagagctccctgaaagcatgtgtcttctgcttttagataggtgattgacatattgtagctattcaataaatacttattaaataaatgaatgtatgcgcaataatgtgtcatgagatagaagtttcaggaagttacttaaattaatgttgaattcttgtgacccatgtttcaaatttaatccaatggcaaaggtcatccctttctgaagagctcctttagttactgaggtgaatttaggagtctgagataattctggaagaagccagtataatattttatctgcctctgtactcctttatcttggtaacaggagcagagaaagcagacatagtaggtaatgaaatgaaagttattatatctcttatctgaaatggcaaagaagtctagggaatcatattccagcagaagttaagaggtgaaaatgcgggtaaaatctaagaatgatttgtttaaagaaattgagtaaaaatcccaaaagtaactacatggctggtgagcttgtttaaatagtggtagatgatcctataagagttggcaggatataaaatgttgaaatgtctagagcactcttgtaaattaccacagcatcgcagatgnnnnnnnnnnnnnnnnnnnntagtattaaaattgtttgaagtttacagcaagctacatgaaagtcatgaatattctttgcaaatgctaacatgtttagcacaattaaatgcctgaccaccaattaataagattcccttaatactttgaaactgcccagtagtaaattcacaatcacaaaatgatggatctgaagcaattcctctaactcacaatttttcctgttaatgagtaattgaatgttcagcaaatgacatatctctgcatgtgttttcaatagggtttcaaagaacccaggaaatacattgctgcacaaggtaatttctttgataatccaatattctttttgaaaaatttttatagcacttttaagaaaatttttcttatcagcttttatttgtttacctcctaggtcccagggatgaaactgttgatgatttctggaggatgatttgggaacagaaagccacagttattgtcatggtcactcgatgtgaagaaggaaacagggtaagaaccaagaagattcatagtgtgggtcttggggttaggaaaacaaggtgttgaatggcattttgaaaagccacatgtatctgcctgatgactaaaacagagagttctctattttaatcagtgttaacatttaatttaaaattttcatacatgtagaaaactaaaacttttaacatacaaatatatgtctatatgcataaaatttcaatgcttctgattaattgctagactcttaacttgattcctgtttctttgcagtattgttataagttcagtatatttcactgttttaacttcacaagaccttaatactcgaaacaaaactgaccttgggcagataggtggtgagtcatgtaatgtgactttaggaataaaagcctctctgtccccctacctaaaattaaccacaagcaatcatatcctttttgctgacaactgattatgtcctctcttaacatgcatctaagcctggaaagatcatcctgctaaaaagtatgaaggaaattcttcaggacacattagtgggaaatagaatatatttcaagcatcacagcttaaggtttatatgtgcttaaactatacaactgttttgagaatttcaaatgagtataggttttgttttcactgtttaaagaaagtttgataaaaaattggcttaaattaaaaattaaaatacttaataattttttaaaatgtagaacaagtgtgcagaatactggccgtcaatggaagagggcactcgggcttttggagatgttgttgtaaagatcaaccagcacaaaagatgtccagattacatcattcagaaattgaacattgtaaatgtgagtttgctttttacataatttttgttttgatacttttttataaaaatataattatggaatattaaaagtgagaaaataaaatatatcaggaaaaattatttttgataacctttaggatgaaagctgtggttagaacaatgacaaaaatcaatagggtcaaatttaagtcactggtcaagacgtttttgtccaactcaaatcgaaagaattatactgtattaattaattatctgttttaattattaaaaaaagagggaaggtccattaaatgtgttgaaaatataatcaaattattaaaagaataagcaatttgtcttcattgtcagtgagttcctacttttatgaaaaaaaattatattatttccataagagaaatgacagcattagagaacactgtaagaagtataaagttctaactatgcagcagagatagaatgtttagttcagaaaataaggaggtcattgtggccttagataatagttaaaatagagatcgtcatgcatgttatataattccattatatgaaaaatccacaataggcaagtcaataaagacagaaagtagatcagtggttgcctggagctgaggaggtcaaacagaaatggggagtggctgcaaataagaacaggctttcattttgtgatggtgaaaatgttctataattagatattggtgatggttgtactatttagtgagtgtaatatgaataccaaattgtacattttaaactggtgaactttatggtatgtaaaatgtgtatctcttatttccaacaaatgaattttatttttaattttttggggtacatggtaggtgtgtatattcatggggtaaatgagatgttttgattgaggcatacaatgcataacaatcacatcagggtaaatggggcatccatcatcccaagcatttatcttttctttgtgttacaaacaacccagttatactcttttggttattttgaaatgtataataaattattgttgaatagtcaccctgttgtgctatcaaatacaaggtcttattcattttatctaattatatttttgtacacattaaccatcaccatttccacccctgccatacccttccaatcctttggtaaccatcattctactctgtatatccaagagttcagttattttaaattttggctcccacaaataagtaacaacatatgaagtttgtatttctgtgtctggcttatttcacttaacgtaagtcctccaggtccatccatgttgttgcaaatgactagatcttacccctttttatggctgaataatacttcattgtatatatgtactacattttgtttatccattcatcagtcaactgatgcttaggttgtttccaaaagttgactactatgaatagtgctccaataaacgtgggagtgcagattatctcttcaatctactgtttcctttctttgcggtatatacctagcagtgggattgctggatcatatggtagtgctatttttagtttttttgagaaacctccaaacagttctacatagttgttgtactaatttactttctcaccaacattgtctgagggttttctttccttcacatccttgcaagcattcattcttggctatcttttatatataagttgttataactggagcatagtgataacttaatgtagttttgatttgcatttctctgatagtaaataatgttgaccacctttttatttatctgtttaccatttgtatgtcttcttttgagaaatgtctattcagatcttttgcctatttaaaaatcagattattagatttttcattataaagttctgtaagcttcttatgtattctggatattaatgctttgtcagatggatagttggcaaatattttccctcattctgtggcttgtctcttcactttgttgattgttttctttgctatacagaagctttctaacttgatgtaattctacttgttcatttttgctatggttgcctgtgcttgtggggtattgttgaataaaactttgcacaaaccaatgccctggagagtttccccaacattttcttttagtagtttcatagattaaggtcttagatctaagtctaatccattttttttatttaatgtttgtatacagcaagagatagggctttagtttcattcttccacatatgaatatccagttttcacagtacaatctattgtggagactgtcctttccccaatgcatattctgggtacctgtatcaaaaatgagtccactgtagagttgtttcattgctctatgtatgtttttatgccagtaccatgctgttctggttactatagctctgaagtataatttcaaattaggtattgtgattcctctagttttgttcttttcactcaggatggctttggctattctgggtcttttgtggtttcatataaatattaggattattttttctatttgtaaagaacattattggtattttgatagatattgcattgaatctgtagatagttttgagtagtatggacattttaataatactgagtctttcaattcatgaacatggaatagctttccattttttatgtcctcttcaatttcttgcatcaatgtttcatagttttcattgtagagatctttcacttctttggttaagtttattcctaggtatttatgttgtttttatctattgcaaacgagattactttcttgatttctttttcagattgttcaatgttagcatataaaaacactgcttgttttaatgttgattttatatctcatgaccttactgaatttgttaatcagttctaatagttttttggtggagtatttaggtttttccaaatataagataatggaatgtgcaaacaagtataattggacttcttcctttccaatttggatgccttgtgtttctttctcttgtctgatggctctagctgggacttccagttgaacaacagtggtgaaagtgggcatccttgtctttatccagatcttagaagaaaggctttcagttttttctcatttaatatgatgctagctgtgggtgtgtcatatatgactttcattctgttgaggtatattccttcgttaccctgttttttgaggtttcttattatgaagagatgttgaattttatggcataatttttcagcatcaattgaaatgatcatgtcttttgtccttcattctgttgatataatgtatcacaataattgatttgtgtatgttgaaccatccttgcatcccttggataaatgccacttgatcaggatgaatgatctttttaaagtgttgttgaattcagtttgctagtattttgttgaggatttttgcatcagtattcatcagggatattgaccggtagttttcttttttttgatgtgtctttgtctggttttggtatcagagtaatactggccttgcagaatgagtttggaagaattcctttctcttccattttttggaatagttagagtagaattggtactagttcttctttaaatgtttggtaaaatgtggtagtgaagccattaggtcccgggcttttctttgctgggaaacttttcatgacaacctccgtttcattacttgttgtctgttcaggttttgggtaccaaaaataatggcaacaacaacttttcaagacatggagagcaaaataacacatgaattgaaacaagaaaatggcaaaatgtggaggaatgaagttaaaatatagcattttcattatattacactttgcttgttagtttgtttacacaatgtctgttgtcttcagtgtaaaataatgcattataagatatgataaccccaaatccaaaagcattcaacagatacataaaaataaaaagcaagaaattaaaacagaccaccagagaaaatcaccttcacttaaaggaagacaggaagaaaagaaagaaggaagaggaggccacaaaacaaccataaaagacataacaaaatggcaggagtaagtctttatttatcagtaataacattgaatatcagtagactaaactctctaaacaaaatacatagagtggctgaatagatattaataaaacaagacccaacaatctgttgcttacaagaaacattcttcacctgtaaagacacaaatagacttaaaataagagatggaaaattatattctttgtaaatggaaacctaaaaagagaaggagtacctatacttatataacacaggtatatttcaacacaaaaactaataaaagagacaccgattgtctctacataatgataaaggagtcaattcagcaagaggatataacaattgtaaatatatatgcaactaatactggagcacacagatatataaagcaaatattgttagagctaaagagagagatagactccaatacaataatagttggagacttcaacactctactttcagcattaggcagatcacccaggaagaaaatcaacaaagaaacattggtcttaatgtgcattgtagaccaaatgaacctaatagacatttatagaacacttcaaccaatggctgaagaatacacattcttctcctcagcccatggatcattctcagggacataccttatgttatgctacaaaacaagtcttacaaaattaaaaaaaaattatataaacttttctttgactacagtagaactagaaatcaataacaagaataagtttggaaactatacaaactcatggagagtgaacaatatattcctcaatgaccactgattcaatgaggaaatcactaaggaaattttaaaatttttcaaaacaaatgaaaatggaaacacaacaaaccaaatcctgtgtgatacagtgaaagcagtactaagagaaaagtttgtaagagtaagcacctacattaaaaaagaaaaatttcaaataaacaacataatgatacatttcaaagaactagaaaagcaagagcaaactgaactgtaaattagaagaaaaaataataaagatcaaagtagaaataaatgaaactgaaataaaaaaatacaaagcatcaatgaaataaaatgttgtttttaaaaagagaaaattgacaggccaggtgcagtggctcatgcctgtaatcccagtactttaagaggacaagtcgggtgtatcatttgaggtcaggagtttgagaccagcctggccaatatggtgaaaccccgtctctactaaaaatacaaaaaaatattagccaggtgtggtggcatgcacctgtaatcccagttacttgggagactgaggcagtagaatcacttgaacctgggaagccgaggttgcagtgagccaagattgcatcattacactcaagcctgggctttgcagtgagactttatctcaaaaaaaaagataaaattgacaaacctttagtcagactaaggaaaaaagagtggagactcaaatgcgtacagtcagagatgaaaaaagagacattgccactgatacttcagaaatttaaaagattatgagatgctactatgagcagttatatgctaatgaattggaaaacttagaagaaatggataaattcctagatacatgcaacctatcaagattgtaaaatgtctcttgatagagctgtttaaaaaactacaagtctttacatgggggttaagattttctcttaatttcatttattgtagggcttttagtaatctaaattttatttttgtatagtctagctatattttctacaggagaaacagacttagtctatatatctccgtaggtcttcttaggtttccatggtattactaattgttatgtctatagagtgctgtgaaacaatcctatcaatagtttctggccaaacacttgtttgactaagccacaaaggcacctgctccatagatatgaggatatatttctagattgatgcctatctggctacattctgtagtctgggtttactggtgttaattaactcagtttgtgtgtttcttttgttatctaaatgtagatggttctttatacctggccatagaattatgacttatgcatcttatggtggttaccttgaaattagaacaaacctgagctctaatctggggctgactttcctcagtcgtctctctacattctgtgttgacaatgctaccatgtgaaggcctaaggaatacaatgttcatcaaataattaatcagactttgctcacatatgaattagttctgtttgctggcctatcaagcagaagtattttaaacagttgtgagaatgacctttaccaaatcattttaaacacaaatccaaaaagcttccacccatgcaccccacttttatggtgtatgtttattttgggttttttttgcttgacagcatgcaagttcctagaaattttggttatacttttaaagaaagtattaccttacttaccttactgttaagttattgcttacagggtagtacatgcaagtcctgcacaatatcttaactactagttattgattagaaaggaaaacacaaccatggttgagaaaatatataagacacctgaggaaactatgaactcttttgagtagtttatgtttacacgaggagactttgtactggtactcccttccacttatttatgtttcatagtttgctttaaaaaaatcatctcaaagaaaatattatctcttgactagaaaaaagaaaaagcaactggaagagaggtgactcacattcagttcaccagctggccagaccacggggtgcctgaggatcctcacttgctcctcaaactgagaaggagagtgaatgccttcagcaatttcttcagtggtcccattgtggtgcactgcaggtaggaaaaacgaacaaaaaaaaaaaacaacaacaaaaaaactccaacagaatccacctgcctagggctgttagagacatctttccctttggcaattgctattttgggaaacaacctatgggagaagcttagattcttatattggcttcacacctgacagcttttccatgatcatgcctctgcttttttttgcttggtttgccagtgctggtgttgggcgcacaggaacctatatcggaattgatgccatgctagaaggcctggaagccgagaacaaagtggatgtttatggttatgttgtcaagctaaggcgacagagatgcctgatggttcaagtagaggtatgttctaacctttagtgattattctcactttggttttttggacttaaatcttttccaagtgataataatgatattttttaaaaatccaaattcttcacaacctcaaacagtagatgatttcctgaaaactaaaacgtggtaatcaccagaaatacttagaagcatttttcattagtgcctaaaagtactgtggaagaaagatgaccacaaaatatataatttttaaaataatgaactactgttaacatatatcagattggcaaaaaaagtaaaaatgctgaaaatagatttggcatcatctcataaaattaaactgaagagacagaatagtatagtaatcaacagctggttttagaaactacacttacaggtttcaaatcttgcttttaattattaatacgagggtgagtggtattgtttattaagtaattttagtctgactgcacctcagttaagtcatctgtaaaatggagacaatgataatacctcacagacttataaccacaaaagtaatacaaataaagcacttaaacaagtccctggcccatgctatgcatttggtgattgtaagtgatggtaattactgaaaatgtctgtatttgacccagcaaaatcacatatatgcatatacccaagagaagcatcaactagaaacatttgcaagaatgtgcattgcattcagcattgtcaaaatagcaaaaaaaaaaaaaaaaaaaaagtgaaatacatatcaatgaaagaatggaaacaccgtaaatatgtatcaataggggaataggaagacaaaatgtggacatgtgaactctctgtacaacaaatgctatgttgtggtagaaagcaatgatctaggtttgtgtctgtctgtttggagagatgctcagatgaaaacaatgagtgagtaaagctgccatacgaaacattcaagatataatttatgtgatttaaaaaaaacatgaaaatgtacaatgcttgtgattacagatacatagatagcagtgtagaaacataaaaacaaattgttaaccaggtaaaaagaaattatttacagtggaaaataaagtacagtggaaagacagtgccaaactcagggaactaaaggtggcggttaaagaggattatcagaagtataccatttccttgaaaatactggattcaaacaaaataagcagtaaagagtagttaaatctgggtttggcccattggattacaaaaaaataattttcttattaaaagaatacttttcttattttaagttctaaaaactataaaaaaaggttttctaaggaataacaacttgcttttttatctcttgaatatactgtgaaatttattatagttttacattcagtaatttggcttactgacccaataatcactaaaggaagtaacatacaatgttctttagtttttaggaataaaagttgtgcaatacagagtacatggataatctatttgcaaagtaattcttttctgaaaaaataatctgaaaatagaatttgctcatattccagaaaactctgagagtgaacttccagaatatttaaatattatagatatcaatttactttgccatgaattgttccaatatgagcaaatttatggggaatgtatattttatttaaatatgacttggaggactctagattatcagttaactatctgtatttgttcttgaaattgtaggcccagtacatcttgatccatcaggctttggtggaatacaatcagtttggagaaacagaagtgaatttgtctgaattacatccatatctacataacatgaagaaaagggatccacccagtgagccgtctccactagaggctgaattccaggtaatgatagtgacaacaataataataattacagataacttttattcagtgtcatctactttctaggtgtttgctatgcacttgacatagtgcttgcatttagtcttcaccagaaccaaaggagcacagatgagaaaactaggacacagtgagttaagagaaatgcctgaatctacacaactattacataggagatttctttagacccagaaatctgattctattgctaatacttttagccattcctcattaagctggtataaaatgaagtgtcaaaataatagtatatagccacaaaactggtctgccaaaggcaatacagcatatcacctttaaaaatcgtatctggttttggtttgtaaaggaaatcattagaagagtttatgactgcttaggaagttgaactggctggagctggtagacacacagtaaaggataagtacatgtgtcttaacctatttattaggcaattattctcacagctaacctagcatgtagttcactataatttcagagagtttgcatagctgtcctcaaattgctcagttgtcaaaaaaatgttttgtgttttttttgttccacctatgatttccaggttactgagtcattccataatctaccaaactggtaaattcagagtttctaaagaccaggagtgtgcttttaatcacatgcagaaccatttaatgtttaggatcaaagtggggttaaggtgggggtggaggtggagcatgcaataatgaccaagtgactcaatcccccagaagacctgtacttataatggaagaactagcagacacagggtagtctcaaacagagtagtgttttattgttgttttcttgcttttctagctgataaattaaccttattcaatatacctgccctactaatccacataaacacataagctgttagagacagttatacatttaagttaaacattcttatgaatgtttatttactatagaaaagacagacaatttttttcactaaataaatgtgcttgagtttctgctatgtgccaagtacaattctaggcacaagagtcaaaatgatctgcaagtggacatgggaagaaggatgagaggatgtgatccagatcacagatggaagctgtgaaattattccatttaagcagacagtaagacagaagatgagagtagaaatgcaagtcggttggtaaatttggtattgggaagttgaggcagctcttgcctgatgatctttcatttttcaagaaaatgtgaggctaggtcatcagttgagagttgagagatacaagggcgagtagggcaaagaagagctcaatgcttgaagggtataaactagttacctcaaagtataaaaacaatctccctaggcagaggcagtaagattgccagaagttatcatttgatcacctgaaatttatgattataagtttaaagaggaattagtcagttggttgtattgttttctatggcagcattgagctctttgggggtagaggctgtgtatgcagatagttgagttaaacctatctaggttttgaaaagtgactatttgaaaatagtgaggcaaacgagttgagggtgtttacaaatgaatgatgactgaggtggaaaataaaaagcaaattggccacatgagggaggtgagagaaagtagtaaggataataagttggagactttgatagaattacagattgctaggttgaacatatcagaataaatgactaggaataataggggtaattttcaatagcacagatagttgaacttatgattttagaggtgatgtaatatttggaatgaaacctacaaaggtggaatgatgaaagtggatgactgggaagtggagggaaagtcatgggaggtgaagaagctaagaaatgaagagactagagtcttggatagattattcttgtcaatgttgaattaaccaaaaatgatgacagaccttggaaagaagagaatatacttagccaagcctaaaactaaatgaggtggagtgattcagaaatcaatacctgacacttcccagtgaagccggtggatagaagctagtatagtatgatggcaggaatatcaaagtgcttggttgatttgaaagcaaatgagtagaaatggtttgcaagtagaatcagggatcaaggagaacacgtatcttttcttgaagctgtgaggtaaatggggtgtgaggaggaaagtcaactttttcttaaaagggctgctgagttattggtggtgtccttagctgacatccaggttttaattggtggaaagaaaaaaaaaagggtgaagtgactgttgggagaagatgattaagataaatgggagttcacagatgacagacgatgggcatcagagggcagggaggaaggcactgatgggttagatgtaagagactgggttgtatctgaggatacaaataaccattcaggaataaaaatctggggaatgtggatgcactgggaagcttagacttgtgatggcaagtgaaacaggtagagatttaagagtgacagatcctttgtgtcttagatgaaggtgagccattaattccacctataatcctgagtattgctacagggcataggctgcctcggtgactacactcacaagagcacaaggtgttgtaacagtttccaaaacatctggtccttcatgcagctcatggtggtgttcaagtggcctaaaattcagtgatgatattttctttcactcaattacgtagcaaagaatgaggtttgaaacagggtgccataattagtttgaatgagggtactatgctgaaaaaatatatgtctatatacacacacgtatctacatgcgtgtgtgtgtatataaaatcttaccgaattgtacatgaggagccttctcagtttcagttatttgtaacattatctattatcattaaatattattcacttgacaaatacttatttaaggactagtggaaagactgtaggcaggggtgtcttccagaagaaattggtatttaaactgatacctagagggtaagaaaagttattagagcaaccaaaaggggaaagggtagttcaagcaagaaaaaaaaaaaaagtgtttatgtgccaagagttgaagaacagcttggcccttccaagaattgaggaagctggtttggtagaagtattgagggacccagtaaggtgtaaggctggagaaacagtcaggggcgtatcaataaagactttttatgctattttgaggaggtttgttgtcctcttatagtgatggaaagctgttcatcttcagaagagcatcttctgttttgtgttttagaaggattagagcaggcgagattgaagacaaagaggccagttaggaaattgttgatgttttacaagcgagaaatgaaggcagactggattaagtaggaagaaagaaaactaaaaggatttgtgtatagaaatgatggatcttttctgactaattaggaactgtgggtgagaggaaagcaatctggaaggtgtaaacaaattaagaatgaactttcaaaacatgtgccaagtctcctaagaatgtgttgtctccaaagtttatttctgatcatttaaaataacttaccattgcttttgcaatatagatcaacatcggtctagtggtttcaatttatataagaacaaactatattatttttctatcaagcagctctgaagaaggagacatagtctgttacatatatatctttagtgcatactagccctgtcaaaaggactaaatgcctgagcaatttaaagaaaaaaaatcagaggcaaaccgaaaaattatggcctatagggagcatatgcaaatttcacaaaaattaatgaaatgcttttccttagggagcatcttatgatgcaataagccaatatttacattttaaaggagtttttctgtttttttttttttttttcagagacttccttcatataggagctggaggacacagcacattggaaatcaagaagaaaataaaagtaaaaacaggaattctaatgtcatcccatgtatgtagtttatttttttattttttgtatcagataaagttaagctcttttggatttgtttaatgtgggacacacagtcatataaattatcttgaagcaagttttcaacatttggttgttaatagggaagaagttactaggtattaaaatactagttattgcaagaacttataatcctgaacatttacaatgggctttggagggtagactgtattcagtgttttctttttaccaattatttcagaaatgggttgtcataaaagagaaatatataaagctgggagaaaaaagagcaagtctcttttacccattttctttcatttttagtttatttcagttatttactccagggtaattgacaaatagtaaaaattacatccatttgttctctatatgtttcctttttatcccttataactgggaggttgaaagtaaggggaaaatactctataaattctaaatcttcaaatttaacagatcaaaatatgcacagtttcaatacttgaattctactatttaagcatattaaaatgatcacatatggtaattttattcagctgcataaactaaaattagcatggataaaatataacacaagttgataaattagatgaccaaataaatcagatcagtgcatggttgacctagttaattttcataggagtccttatgaatgtagtttaaaatatggaattgatggtgatatggttaatcaaatcatttgaccaagttattataaattatagaaattaagaaacagtgagaaattataggtcaaataattttctgggctaaataattaatcaaagctacccatataagattgttaatttaatattactggagtataattgagggaaaaaatctacgctatgtattttgtaaacttatatcaagcagaattataatagtccatgggaaattaaagtatatgtatcaaagattaaataatcatatataatgatatgatatctctttgttgtttgacatggaattatgttccatgttttttcctggaatcctttttcttagacttttgttgtataatttgtttatcgacaagtactgaattttatataggatcttatttcatgtagatcagtaagttttcataatacaatctgtccctttttaaatactttcaaatttccacatgacaatgaagaagaaatttaattttttcaaggaagacttactactgatttatttcacatagatgactataacagagtgccacttaaacatgagctggaaatgagtaaagagagtgagcatgattcagatgaatcctctgatgatgacagtgattcagaggaaccaagcaaatacatcaatgcatcttttataatggtaggtacttaaattgccaaaacccaagatccaaacattttaaaataatatctatgttattagggccattcattaagcgattttataaaagaataatgagcttggtcataactacatatagattgacatgagagtttcaatttcaatgctacaatttaacttaatgaaagatttaaaaatactataacctaataacctgagacaaaataagataatgctattggttatattttatgacaaatatagctataatcacatcaattttaaaaatagtaaaatttgagcaaatacaagtatttgaaaatgtttatacatactcagatacccaaattgtaggcaatgacaaatttgtatatttgtatggttagaaacttttcattcagataaactgaattattaggtgagtctgtgtcatatccccccacttttttaattaactgagaattcaaacaatgaaactttagtcatttattaaatatttattatttatacactgttggatttacttattttccaaagtttcctaaagcacacattcatagaatattagtttaattaggaaatataataagaatgtaaagacactaattaaaattagtatagacacgatgaaggtaatttgaaatgcttaagtaattcctttttacaatcacattaacctttatagagaaacaaaaatgtgtgtcttttgtggaaaggaaaatttgtttcgcaagatatgttgtaatcttgatttcacattattagctaagaattactattatctgtataattattttacatatagctattacattgtttcttgtaagaaacataagaatattactatttgtatgtaacagcattgatatcaaactgactatatttccaaatggttactttaagaatctactgagctctcttctgtagtaacgaagtcccaccctttttttgtctaaaaagagctactggaaacctgaagtgatgattgctgctcagggaccactgaaggagaccattggtgacttttggcagatgatcttccaaagaaaagtcaaagttattgttatgctgacagaactgaaacatggagaccaggtttgtacttttgaggattttcttttaagcctttctgtcataaaacgtcattctctagtcttggattgcttgcttcatcgccatacccacgtctttttttatccctccatcacataattctgtctgctcagtcttacccctttcaccctggtgttggcctccatcagctgtgtctggattctgacagtctctcctgtttgtcccctccagtcttgcatgctgctcacagattagccaggatgcagcaatgtcagcgtcacagcaaataacagctacattttcacgctgttttcctcattttctcaagataaaagccaagatctttttgtgatatccagcaccctggacaatcaccccctcatgtgtctttcatcttcctcccatttttatgttttccatcctctccactctggacaagcaggtttcatgcccaagcctaaacacgccatttgcattgtcatcactgagtctaaacttattgatattccatgtaactaaatgtgtgctgtcttccagttttgaccctattcttttaacaagaccaaactcctgaaaaatgtatctatatcatcctttctttattcccatataatatttattgccataaaagtctatagttgaaggtgaatctaagctataatttgatttttttacttaatgcttgtgacagatattttatccttttcttaatgtcttcagttattattaaaatttccctggtggtagatctcactcagctttagcaccaaccacattatctgacatatgttcaagcctattcagtgaataaccttataagtatgcaaaagatttatgcttttttatgcccctctctctcccctaaatctcactctttctcaccctcacctggtccccttcccctgtacatggaaagttgctttttatgttttttgttttaaaggaatataagtccagatttctagcatggaattcccacaatcctttccttcatataaattgtgaaagctgggaaacaggatggaagtaccggcaggactccctgtctttgtcagaaattgtggggttgtagttggtagacaacagtttgtagtaagaagaaacacttttgtggttcatctactcttcaatctggccctttccttagctatgtagacaaaatatataaagctgcttatggtgttggtcaacaagatgacagagacaaagctccaaaagatgcagcctccttcctcaagaaccactgaagggacagtgggacctgagttattgaaagggtcatgaataacattgactcatgccagccataaatattgaagaggtcatgataagcatgtggaaaagaggagcaaacctcaaagacctacactaaggaaaacagctgttccgggggtgtcccagtcacctcgattgtgctcagcttcccttttcttacacaaggaaacaccacatatttattaaatgggtcgccagcacttaaatagattctggatttttataagtaggtttcaattttagaacacaataattttcatttaatagaaaagaggcacagacagagaaagaaagggagaaagagggagactgatcctttgcatatttcaaataggaaacaaattgttgaattgtcttcttttatctaggaaatctgtgctcagtactggggagaaggaaagcaaacatatggagatattgaagttgacctgaaagacacagacaaatcttcaacttatacccttcgtgtctttgaactgagacattccaaggtatggaaacaatttggggagtatatttctttgatataatggatctggtagcaaaatgaatataaattactctatgcaggcaaggccatcatataaataatgtttcagaataacattttaaaattatttaaatagaagtaactgtgaagaaaatatgactatcaaattagaaaataagctgaacttcactccagttaatgctctcttcaattctgattttagaggaaagactctcgaactgtgtaccagtaccaatatacaaactggagtgtggagcagcttcctgcagaacccaaggaattaatctctatgattcaggtcgtcaaacaaaaacttccccagaagaattcctctgaagggaacaagcatcacaagagtacacctctactcattcactgcaggtgcgtgggatttggtagaatgtgctctcaaaatcataatgcttgacttctcggttcacatgttgtcttatctagttatcctcatatatgaaacacataaccacagtaaaaacttcttatggagtcggtcactctcttggttgtttccacaacacaactattgtagaaatataatagaagtgattatattatagtgcaataattttaagttgtgttttttaatacttggtgtcatgtcatctttgattccttggtagctaacattgagccaggaatgtcatttgtgtgaatgaattaatgaatggaagggtgtgtgaacagataggtagatgggtatcaccttacacatatacccatatacattgatctactctattaggtgtcacaaagacacctaatatgtttaatgaacacaaagtttattaaacatattttaagttaaatattaactgaaatcacaaagcttagcaattttgatttgaaactcattatttaattttctaaactgaaccaaaggcaaagattgtggtaatatcaataatactactagattttattagtttcttcatctgtgataggtgcttacatattcaccttaaataagcaatataattgaaagaaagatatataatataaaagtttacatgaaaaagaatattgaagtaaatgagaaacgaaaaatagtaaagtaaaatgagaaatgtttatctagtgaaaaacttttggaatttttgaaaaagtctaattgttattattggaattgcatatactagaatcaagccttaagaaatatatgaattttcagcatttatgtggaaagaaagctgaggaagggaagtttacactgtaaaactatatatgtttcttagaatatgatttatgtacaataactaaagtgtcctgctgataacatattgtttaaattgaatctttatgataatgctttatacttctcattgtttggtaaactatttgattgccctctttttagtgaataattctactaggtattacttttctactgatgcagaagtgaaaacatttgtgaaacgtggtagagaggcagaagagtgaagaagagcatgtgttctagtaatttacaaaatattaggtctaatatttctgattacatcagctttctcttctccaaatcttggtttccttatctatcatactggcattctgatattggtttcaacaacttcagatgtaaataaaaatgcattaaaatccataaaatactaaataaaagaaaatatatttgtaaagtcgaagacaaataagttttcaattccaggattatcacactcttaaattgaaaaatttgcctaaaaatgcatttagcgtaaataatttggttcttgaaagaggttggaataagataattatgataaacatgaagcaaaaaatatattctctctcttcctgtttttattctaatatcaccctttttggtgagaagtaggattattttctatcttttctttcttttatagggatggatctcagcaaacgggaatattttgtgctttgttaaatctcttagaaagtgcggaaacagaagaggtagtggatatttttcaagtggtaaaagctctacgcaaagctaggccaggcatggtttccacattcgtaagtatccttcaccattgcttttaacatgctcggaattttttttttctttttgacggtttccttttttcttttctcctctcctttcctctcgtttgttcttttttcccctttccttttctcttctctattttctttcctattcttttagcttttctacttttacatgataattcacattaaattattataagtctaaataagagcctaaagtttactagcactttgttgtgacagttcatgaagagcctttccctaaatgctcatgaatttcttaattttctttccttcactcctgtatcgatttgtgttgtgtaacaaaccacccccaaatttgggagcctaaacaaataacatttattatggttcagtagtctaatgatatgctggaatgttctgctggtgccctcaggctcaggcaatagagaccaggctgactcatgtgtctgccttcagctgatgtgtgccctacagtttggctggtctaaagtgacctacactgccagtaggctggcatgtggctgccatttagctatggcaacaacagtgagtgggccacatgtccctcctcatccagaagactagcccaggcctattcacattaaagcagcaagttccacaagggaaagaagacttgtgtgagaccacttgaggcccaggcttaaaagtgacacacatgtcttcttctgtatgttattagccaaataaataagtcataaagcctgcccagattcaaggggtagggaaatagactccacttcttgagagggcctgcaaattcacattgcaaagaaatgtggatacaggaaggaaaataagttttatattcttgtaatcgatctatcgtgtataccctctatgtggtagtaactgtagatggtcatctgggaattaatccttattcacagtgtaaacttaattactcactaaaatatataaagcttttaatcatgtatgatattgagatttcatatcttggtacttaaaaatgtatcaaatgcttgctatgtgctcttgctataaagagctaattggtatgagggaaagccaggtatttactaatcaatgtagtgagtaaaatgacagaaaaattataagaagaacatgaatgagggcatttaatttaaactttaggaatcaagaaacgcttctcgaagcagtgattcctgccctgattcttaaataatgtgtaggcattagacaggaggataagtacaaaacgtggcatcatgagcaaaggcatggaaatggcccatgagcggagtgaacactggtttggggttgctccaaggtaaagttcaaaaagtatcctgcagtcaaccctttagcaccataaagaaactaaattatttagatgtttttatgagaacatatcaaaaagtacttttctgtcatccaatacttccacaaataaatcattagttcttgctaatcttcatctggcataaaaataatgacatcaactttcttcatgtaatttcccacttaattcctttactaggagcaatatcaattcctatatgacgtcattgccagcacctaccctgctcagaatggacaagtaaagaaaaacaaccatcaagaagataaaattgaatttgataatgaagtggacaaagtaaagcaggatgctaattgtgttaatccacttggtgccccagaaaagctccctgaagcaaaggaacaggctgaaggttctgaacccacgagtggcactgaggggccagaacattctgtcaatggtcctgcaagtccagctttaaatcaaggttcataggaaaagacataaatgaggaaactccaaacctcctgttagctgttatttctatttttgtagaagtaggaagtgaaaataggtatacagtggattaattaaatgcagcgaaccaatatttgtagaagggttatattttactactgtggaaaaatatttaagatagttttgccagaacagtttgtacagacgtatgcttattttaaaattttatctcttattcagtaaaaaacaacttctttgtaatcgttatgtgtgtatatgtatgtgtgtatgggtgtgtgtttgtgtgagagacagagaaagagagagaattctttcaagtgaatctaaaagcttttgcttttcctttgtttttatgaagaaaaaatacattttatattagaagtgttaacttagcttgaaggatctgtttttaaaaatcataaactgtgtgcagactcaataaaatcatgtacatttctgaaatgacctcaagatgtcctccttgttctactcatatatatctatcttatatagtttactattttacttctagagatagtacataaaggtggtatgtgtgtgtatgctactacaaaaaagttgttaactaaattaacattgggaaatcttatattccatatattagcatttagtccaatgtctttttaagcttatttaattaaaaaatttccagtgagcttatcatgctgtctttacatggggttttcaattttgcatgctcgattattccctgtacaatatttaaaatttattgcttgatacttttgacaacaaattaggttttgtacaattgaacttaaataaatgtcattaaaataaataaatgcaatatgtattaatattcattgtataaaaatagaagaatacaaacatatttgttaaatatttacatatgaaatttaatatagctatttttatggaatttttcattgatatgaaaaatatgatattgcatatgcatagttcccatgttaaatcccattcataactttcattaaagcatttactttgaatttctccaatgcttagaatgtttttaccaggaatggatgtcgctaatcataataaaattcaaccattatttttttcttgtttataatacattgtgttatatgttcaaatatgaaatgtgtatgcacctattgaaatatgtttaatgcatttattaacatttgcaggacacttttacaggccccaattatccaatagtctaataattgtttaagatctagaaaaaaaaaatcaagaatagtggtatttttcatgaagtaataaaaactcgttttggtgaattctgtaatagcttatcatgaaggtcaaacacaacctttagattggtttggttttctatatctttactcttttgtctgattttatatgtcttaactatacagcaccgattattgtccattcaactcacatttattttgtgtccctacttctaattatttcactattgtaacatataaaattaacaattaacccttatagtagtatatagatccttgtgcttatttaacagatgaaaagaagtaaattttacaatgaagccacagtttctaatttatattaaggttacttattacatctttacttattaatgagaaaaggggattagaatcaccaattatgggcacaaaaaataaagtttgctttcacttacctcttcagtcactcaaactattatgcattcttttcttttattgaaacttgatcagttgccattttctagataatgtagttaaaatttgcagttctcatgttcaatagaacattatgatgtatgcctactttatctgttaattgcttcaaaatacaaatagcagaaagtctaaataatctacaagcaaagtttttcttcagaagtttcaattgcaagtaacatcttccaaatgtagttgtgtgttttaaatgtgttttccacctgacactatcttttgaaagattaaaaactacttagaaaatagagcaataataatttctattagtttaagaatcaagcttgagactttttttctacatatgggaatttgttgtaaagaaagagatgaaatagtggctcagaaagcccactactttgtgagaacatatactaaaccgaaggtgagacccatggcactagaacatggaattatatgtctatgatttttacctgtagaaagaaataatatgtgaattataggtctatgtctatggccatgggttgcattaatggggatctgttacaaggtataaaagatttatttgctaaagtttggcactgccattattaattctaggatccagtcagaaatattaagcaaaaagttttgacttacaaaagcctggtacactgtagggataatgttatgaatccagaacattacatttattgggcaaaaagaaacttctaggtttcttttaaagttgtttgctttattcctggtattagaattcaatgggaataaaagatacatttagtaagcctaaacttcaggtcccaagctattaattgtgtacataagtgacaaataaatattttcatttaagagatatatatattttaatattttcttgcaagaggaaaactgtgtaaagtgattagctgaacatctgtctttgcaaagataattttaaatgcgttaagcttcccctcagaattcttatatttgtacagagaaattttcctgtttttttccctctaaaatattaaacataaaatttatttttacaactaactaggactgatcttaattttagatttataccagatattggttataagatgatttcataacaccatattagatctgaataagtgaatgctatttgctcctagctaattgcagcatgtttcttgatatgaagaccttaaaatatatcacttcaaaggaaatgaatatctgttaaaatgagtagaaaaggctatgctttcaatctcctacacaaattttacatctggaatgatctgaaggttcttcaaagacattcaaaattaggcttttttatgtcctgttttaagtgaaaatatttattcttctaagggtccattttatttgtattcattcttttgtaaacctctttacatttctctttacattttattctttgcccaaatcaaaagtgattcctaaattttaattatatttgtaggacaattaaaagcttttgataacttacaacaaatgaattcttgttttttgctaagatcccgtaaagaaaactcttcttctttattcaaactatccatgattactttcttcaaaatgacatgaaatttgattgtcagataaaatacaaggcattgggttacattcgaattttaaatgaaacaagaatagttttttagtgcaagtatgtctcatgcagtatttgggacatatttgcaccaaaaattgtttcttgtttattagaaatttaaatttaacttggcatcctattttttttaatctcgcagctttaacatgaaagaatcaactatatctacttcacttaaaagaacatttgtagttctccttgcagagagagacttcacctctctagttagctgtattcctaagcattttattatttttgtggcaattgtgaatgggagtttgcctctcagcttggctattgttggttatagcaatgctagtgatttttgcacattgattttgtatcctgagactttgctaaagttattcattatcctgagaagcttttgggctgagactataggattttctagatacaggatcatgacggctacaagcaggaatagtttgacttcctctcttcctatttgcatgcccttgctttctttctcttgcctgattgccctggccagaacttccaatactatgttggacagtagtggcgagagagggcatccttgtcttgtggcggttttcaatgggaatacttccagcttttactcatttagtatgatggtagctgtgggtttatcatatgtggcgctcattattttgaggtatgtttcttcaatacctagattatcaagagatttcaacatgaatggatgttgaatttgatcaaaaatcttttctgcagctattgagataatcatgtagtttttgtctttagttctgtttctgtgatgaatcacatttattgatttgtgtttgttgaaccaaccttgcatcccagggataaagtctacttgatcatggtggataagctttttgatgtactgctggatttggtttgctagtattttgttgagaatttttgcatcaacatttgtcaaggatattggcctgatgttttctttttttgttgtatctccgtcaggttttggtatcaagatgatgctggcctcactgaatgagttaaaaaggagttccaccttttcagtttttttttggaatagtttcaataggaatggtaccagctattctttgtacatatggtagaattcagctgtgaatccactgggtcctgggctttttttattgttggtggtggtggtaggcttttattactgcctcaatttcagaatttattattgttttgttcagggattcattttcttcctgcttcagtcttgggagggtgtatgtgtccaggaatttatcgatttcttttaaattttctagttaatgtgcataggggtgtttataatattctgtaatagttatttgtatttctgtggggtcaatggtaatatcccccttatcgtttctgaccgtgtttatttgaatcttctctcttttcttctttattagtctagctagtagcctattttattaatttttttttcaaaaatccagctcctgaattcattgatcttttgaattttttcatgtgtttcaatatccttcagttcagctctgattttggttatttcttgtcttctgctagctttgggatttgtttgctcttggttctctagttgttttagtacaaatcactgctcaaagaaatcagagatgacataaataaatggaaaaacagtccatgctcttggacaggaagaagcaatattgttaaaatggccatactgcccaaagcaatttatagattcagtgctattccttattaaactaccattgatattcttcacataactaaaaaacaaacaaacaaacaaacaaacaaaaaagccattctaaaattcacagaaaaccaaaaaaaaaaaaaagcctgaatagccaaggcaatcctaagcaaaaagaacacacttgtaggcatcatgctacaccacttcgaactatgccacagggccacagtaaccaaaacagcatggtacagatacaaaaacagacacatagaccaattgaacggaatagagaacccataagtaagattgcacagctacaactgtctgatcttcaacaaatctgacaaaaaacaacaatgggaaaaaggttcccttttcaataaatggtgctgggataactggctagccatatgcagaagattaaaactggactctttccttataccatatacaaaaattgacttgagatggattaaagacttaaatgtaaaactcaaaactataaaaactctggaaagcaacctaggtaatacctaccattcaggacataggaactggcaaaggttttatgatgaagatgccaaaagcaatagcaacaaaagtacaaattgacaaatggtatctaattaaactaaggagcttctgcacagcaaaagaaactatcaacagagcaaacaggcagcttacagaatgggagaaaatgtttgcaaactatgaatctgacaaatgtctaatatccagaatctatatggaacttaaatttacaagaaaaaaaaaacccttaaacagtgtacaaaggacatgaaaagatatttttcaaaagaagacatacatgtggccaataatcatgtgacaaaaagctcagcatcactgatcattagagaagtgcaaatcaaaaccacaatgagataatatctcatgccaatcagaaaggctgttactaaaaagtcaaaaaacaacagacgctggcaaggttgtggcaaaaaaggagcacttatacactgttggtgggagtgtaaattagttcaactattgtggaagacagtgtagagattcctcaaagacctaaagatggaattaccattcgacccagcaatcctactagtgggtatacacccaaagggatataaatcattctattataaagatacatggacacatgcagcactattcacaatagcaaagacatggaatcaacttaaatgcccatcagttatagactgggcaaagaaaatgtggtatatatacaccatgatatactatgcagccataaaaagaatgagatcatatcttctgcagggacacgggtggagctggaggccattatccttagcaaactaatgcaggaacagaaaatcaaatatcacatgttctcacttataagtgggagataaatgatgagaacacgtggacacatagaggggaacaacacactggggcctactggagggagagagaacagagaggatccggaaaaataactaatggatactaggctcaatgcctgaatgatgaaataatctgtacaaaaaacccgcacaacaaaagttttcctatgtaacaaacctgcacatgtacccctgaacttaaaagttaaagatatttagaagaacatttgagagttcagctttgtaagatcctgagatgaaaagattaaatgaaactatttacattagtgtgcaaataggaactttaaaaatactgactcaatcaagaatatgtatctcatatcattacttataaataaaaaataattattataattaacatttattgagataaacacatgccaggtatttatcccttgttttatacctgcattggtttcataagacaaatcctatgccacatatattcttttttccattttatatggggtagagggttagaaaagttcagtatctggtctgttacagcaagtgacagagccaggacttgaaccagctcttacaaacactgtaggctgtgctcctaatccaccttgcaaatatcagtgtcatgtgctttgaaaaactggtgaagaaaacaacctgaaattgttttctgtctcttctttatttcatgattaaaacaaaaacaaaaccgtgtgtaatatatgctctcaacaacactgcacaacatagtgagcttagatgaactcacagcattgaagttattatataaaaataaacacactcttaaacacccatgggaaaggattgttctcataatttgtatgagcaaagatcacctcattgctgaagtgagtgccaggaaataaaacactacaataaataacaaatgtcattgttccattgtcccacaatttggtaatcagaacaagttctcactgtttggatcacatttctgtgtgtttgtcagacgacccatcaatcagtatttaaaacaagttaacagggcaccataaaatgcaaaccacatttatggggagtgtgactcattaactctatctggggtggcacactgagtccaagggagctctcttctgatctagttgtccccaatttagtatgccagggaactgaaaatggactttctatgtaaaataacacgtttttccctctagagaaacattgctttgttgatgtgtattcaccctttccagagtaaaaatggaaactctggtgcatttttatttcattttccagaaaagggaagtttgctggattcagtggtatctttcatagatagcagggaaatcacagctatagaagctggcgtcccatcaaagaataaaaatattttattgaatttttatggattgtgtaatctttagttttttatgcacactttttgaagtgggaagaagatgtggcaccaggaaaggaaataatctgtccatggtatgaaagctgggaagagaacctggtcatccacagaacctgcccccactggttaacacaggcttaatgtaggggtctcctgatggtgtattaggtcactgcctgctaagaatttgtatgggtaatcaataattctgacttgtcattaatacagattagtacatcatgaattacatttctgtgcttttgttgtatgctatataagacaggtgtgaaagggattattatagtttaaaaacatggcatgtagtaaatgcctttattaaagagctttcatttatatgtatttgttttcattgcactgacaacttaggctaaaggcaggaatggaaacaaagaatatgcaaaagatctaaagctaaaagtttgaatgtttttgtcataattaccagatattaaaaaaactaaactttctcaagggccatctagcatctgctttgaattactctgaattgatttggcaaataaatttcccatcatttctcttatattgtggtggatccttgcagacaatagcaaagaactcttaggtatttaaggttacactctgtagaaggttttagcactgattcttcggacatcatgtttttttttcaatgcatttttttaccttacactattttttctcacctggatgtatactgattaggttaccaactcttcaatcatctactagatctttgtcctagatgctgaatcttgactttgatcccatactatcttagagcatctggtaatcctaaatgataattttgcatccatattgaaggaacacaagtaaaacataaagaatcacactttaacaaacaagaagcaattgttcaatagctagagtcaagtgaattatctgagaaaatgcatataaaggatataaatgtagtacaccttaatctggtttttccagtgtgtgtgcaagtatatgggtttcccctaagacagtcgaatgtttctcatctgagctcacagtcagtttcagttttataaaatgcattcttaaatgaaccaagttatttttataaataaaatgtgctttggcggctttctctttgtttaaactagcattaaatcatggaagtcaagtttctctttgatgggagtcagtgggaaataaactctacttgttctttcaagagatagcaaaatatttgtttccaatttaaatgcaggaagttaaaaaaggtcaaaactagtcgaatcaatgacaactttagtcaaattactaaaatcttataagtttctctctacagatttgtacagtatgttttaattcaatgccctatagtcatttagggaacatctgaatttcagaaataaagtcaactatatatttatataatgttaaaggaagagattaattttagttagcatcgcaagatgacatcctttgtaggctatttattatttaatataattctatggagatttacatataagacatctgtccaggaatattagctgagacttgtattttgtgattttatgtagcaactgaaattattacaagtgcaagacatgttatgatactaacttttgcaaaaaaaaaaaaaaagaggaagaattggatattgtctggggtttctaactactccattgaaaactctagtacttcttcttattccaattatttaattttttccatgccctcacttcaattccttgtgcaacagcatcattagctccttctcctacagtggcctatcacctccattgctctgttgacaactaagcttgtatcagtcagatttctctcctccttgcctctattcccactctagctgctgctttacttgaaactattactattttaaaaaacataacttacctactggcactatgagatatgaatgattccaacatcgattcaggaccacaatgtaatgaatagatctttttcttgttttcaattgatctcttttactattccccttggtattctcccaaatgtgaacatctccatggctactactttcatcaagtgccattgattcttttactttagaaaaaaatagcagacattcacctgaatttgttcctgtgcatttaaaaatatattctaactttatcatattcacttttcctttcctatctcagaagaagtttccctatcttttactgggccaaactctttacctgtggtctttgcactttttggaataaacattattttgttaaatgatacatccttattgtaaaaaagcaagtgacacagaaaagcaccaataaaaatgttaacaaactatcccaaatccaactggaaagcggttaaaggagaaaagagagttcacagaacaagaattccaaaaggccctaaacatatgctcaacttcactcagataagaaaaatgctaattaaaacttcattgagataacaattttcaatagtaaatatatcctgttgtcagggttgtggggaaataagaactttcattattttaccagtacaaaataaacaaccttaaaaaggacaatgtggcaatagctatcaaatttataggtgtttctacatttacctagaaactctacatctggggagttaccctcgaggaatatctatttagttacaaaatatgtgtacagattatttattacatcttcctttgaagtgggaaattattggaaacaactaaagtgcccatctatagctattcagttaaataaactaaggtattctattcattacctatagggaatggcaggagatggtgacatgggaaggagcttggacatgttagcatacagttttgagttttaaactgtgcatctattccctatttgaaaaatcattaaagaaaattccctaacacacttacagatataaacattatatttttgtgaatattattctagttatttctctatacacatagaaggaagaaaagaggaaaggaagggagaaagaaataaatgaaggaagaagggagaaaagaaaggatggaaggaggaagaaggaaggctaaataagaacatttttccatttttttttttcctttttttcttttttttttagatggagtcttgctctgtcgccaggctggaatgcagtggcacgatctcggctcactacaatctccacctcctaagttcacgccattctcctgcctcagcctcccaagtagctggaattacaggggcgtgccaccacacccagctaatttttgcatttttagtagagacaggtttccaccatgttggccaggatggtcttgaactcctgacctcacgtgatccacccacctcagcctcccaaagtgctgggattacaggcccggcctgtttttagattttaaaagatgtataaaaatctagtaataacaaaaatttgaaaacataaaatatagattttccttatattaaaaatgattacttttaattcacataaacataagaaaaaagaattgtaacaagttaaaaaagaattttttaacctatagttaaatttctttttttacaacatatattttatgacttt

SEQ ID NO: 118 - DNA, 4775 bp, Homo sapiens
aaggacgcatgctgtttcttagggacacggctgacttccagatatgaccatgtatttgtggcttaaactcttggcatttggctttgcctttctggacacagaagtatttgtgacagggcaaagcccaacaccttcccccactgatgcctaccttaatgcctctgaaacaaccactctgagcccttctggaagcgctgtcatttcaaccacaacaatagctactactccatctaagccaacatgtgatgaaaaatatgcaaacatcactgtggattacttatataacaaggaaactaaattatttacagcaaagctaaatgttaatgagaatgtggaatgtggaaacaatacttgcacaaacaatgaggtgcataaccttacagaatgtaaaaatgcgtctgtttccatatctcataattcatgtactgctcctgataagacattaatattagatgtgccaccaggggttgaaaagtttcagttacatgattgtacacaagttgaaaaagcagatactactatttgtttaaaatggaaaaatattgaaacctttacttgtgatacacagaatattacctacagatttcagtgtggtaatatgatatttgataataaagaaattaaattagaaaaccttgaacccgaacatgagtataagtgtgactcagaaatactctataataaccacaagtttactaacgcaagtaaaattattaaaacagattttgggagtccaggagagcctcagattattttttgtagaagtgaagctgcacatcaaggagtaattacctggaatccccctcaaagatcatttcataattttaccctctgttatataaaagagacagaaaaagattgcctcaatctggataaaaacctgatcaaatatgatttgcaaaatttaaaaccttatacgaaatatgttttatcattacatgcctacatcattgcaaaagtgcaacgtaatggaagtgctgcaatgtgtcatttcacaactaaaagtgctcctccaagccaggtctggaacatgactgtctccatgacatcagataatagtatgcatgtcaagtgtaggcctcccagggaccgtaatggcccccatgaacgttaccatttggaagttgaagctggaaatactctggttagaaatgagtcgcataagaattgcgatttccgtgtaaaagatcttcaatattcaacagactacacttttaaggcctattttcacaatggagactatcctggagaaccctttattttacatcattcaacatcttaattctaaggcactgatagcatttctggcatttctgattattgtgacatcaatagccctgcttgttgttctctacaaaatctatgatctacataagaaaagatcctgcaatttagatgaacagcaggagcttgttgaaagggatgatgaaaaacaactgatgaatgtggagccaatccatgcagatattttgttggaaacttataagaggaagattgctgatgaaggaagactttttctggctgaatttcagagcatcccgcgggtgttcagcaagtttcctataaaggaagctcgaaagccctttaaccagaataaaaaccgttatgttgacattcttccttatgattataaccgtgttgaactctctgagataaacggagatgcagggtcaaactacataaatgccagctatattgatggtttcaaagaacccaggaaatacattgctgcacaaggtcccagggatgaaactgttgatgatttctggaggatgatttgggaacagaaagccacagttattgtcatggtcactcgatgtgaagaaggaaacaggaacaagtgtgcagaatactggccgtcaatggaagagggcactcgggcttttggagatgttgttgtaaagatcaaccagcacaaaagatgtccagattacatcattcagaaattgaacattgtaaataaaaaagaaaaagcaactggaagagaggtgactcacattcagttcaccagctggccagaccacggggtgcctgaggatcctcacttgctcctcaaactgagaaggagagtgaatgccttcagcaatttcttcagtggtcccattgtggtgcactgcagtgctggtgttgggcgcacaggaacctatatcggaattgatgccatgctagaaggcctggaagccgagaacaaagtggatgtttatggttatgttgtcaagctaaggcgacagagatgcctgatggttcaagtagaggcccagtacatcttgatccatcaggctttggtggaatacaatcagtttggagaaacagaagtgaatttgtctgaattacatccatatctacataacatgaagaaaagggatccacccagtgagccgtctccactagaggctgaattccagagacttccttcatataggagctggaggacacagcacattggaaatcaagaagaaaataaaagtaaaaacaggaattctaatgtcatcccatatgactataacagagtgccacttaaacatgagctggaaatgagtaaagagagtgagcatgattcagatgaatcctctgatgatgacagtgattcagaggaaccaagcaaatacatcaatgcatcttttataatgagctactggaaacctgaagtgatgattgctgctcagggaccactgaaggagaccattggtgacttttggcagatgatcttccaaagaaaagtcaaagttattgttatgctgacagaactgaaacatggagaccaggaaatctgtgctcagtactggggagaaggaaagcaaacatatggagatattgaagttgacctgaaagacacagacaaatcttcaacttatacccttcgtgtctttgaactgagacattccaagaggaaagactctcgaactgtgtaccagtaccaatatacaaactggagtgtggagcagcttcctgcagaacccaaggaattaatctctatgattcaggtcgtcaaacaaaaacttccccagaagaattcctctgaagggaacaagcatcacaagagtacacctctactcattcactgcagggatggatctcagcaaacgggaatattttgtgctttgttaaatctcttagaaagtgcggaaacagaagaggtagtggatatttttcaagtggtaaaagctctacgcaaagctaggccaggcatggtttccacattcgagcaatatcaattcctatatgacgtcattgccagcacctaccctgctcagaatggacaagtaaagaaaaacaaccatcaagaagataaaattgaatttgataatgaagtggacaaagtaaagcaggatgctaattgtgttaatccacttggtgccccagaaaagctccctgaagcaaaggaacaggctgaaggttctgaacccacgagtggcactgaggggccagaacattctgtcaatggtcctgcaagtccagctttaaatcaaggttcataggaaaagacataaatgaggaaactccaaacctcctgttagctgttatttctatttttgtagaagtaggaagtgaaaataggtatacagtggattaattaaatgcagcgaaccaatatttgtagaagggttatattttactactgtggaaaaatatttaagatagttttgccagaacagtttgtacagacgtatgcttattttaaaattttatctcttattcagtaaaaaacaacttctttgtaatcgttatgtgtgtatatgtatgtgtgtatgggtgtgtgtttgtgtgagagacagagaaagagagagaattctttcaagtgaatctaaaagcttttgcttttcctttgtttttatgaagaaaaaatacattttatattagaagtgttaacttagcttgaaggatctgtttttaaaaatcataaactgtgtgcagactcaataaaatcatgtacatttctgaaatgacctcaagatgtcctccttgttctactcatatatatctatcttatatagtttactattttacttctagagatagtacataaaggtggtatgtgtgtgtatgctactacaaaaaagttgttaactaaattaacattgggaaatcttatattccatatattagcatttagtccaatgtctttttaagcttatttaattaaaaaatttccagtgagcttatcatgctgtctttacatggggttttcaattttgcatgctcgattattccctgtacaatatttaaaatttattgcttgatacttttgacaacaaattaggttttgtacaattgaacttaaataaatgtcattaaaataaataaatgcaatatgtattaatattcattgtataaaaatagaagaatacaaacatatttgttaaatatttacatatgaaatttaatatagctatttttatggaatttttcattgatatgaaaaatatgatattgcatatgcatagttcccatgttaaatcccattcataactttcattaaagcatttactttgaatttctccaatgcttagaatgtttttaccaggaatggatgtcgctaatcataataaaattcaaccattatttttttcttgtttataatacattgtgttatatgttcaaatatgaaatgtgtatgcacctattgaaatatgtttaatgcatttattaacatttgcaggacacttttacaggccccaattatccaatagtctaataattgtttaagatctagaaaaaaaaaatcaagaatagtggtatttttcatgaagtaataaaaactcgttttggtgaat

SEQ ID NO: 119 - protein, 758 aa, Homo sapiens
KIFNIQQTTLLRPIFTMINPLFYIIQHLNSKALIAFLAFLIIVTSIALLVVLYKIYDLHKKRSCNLDEQQELVERDDEKQLMNVEPIHADILLETYKRKIADEGRLFLAEFQSIPRVFSKFPIKEARKPFNQNKNRYVDILPYDYNRVELSEINGDAGSNYINASYIDGFKEPRKYIAAQGPRDETVDDFWRMIWEQKATVIVMVTRCEEGNRNKCAEYWPSMEEGTRAFGDVVVKINQHKRCPDYIIQKLNIVNKKEKATGREVTHIQFTSWPDHGVPEDPHLLLKLRRRVNAFSNFFSGPIVVHCSAGVGRTGTYIGIDAMLEGLEAENKVDVYGYVVKLRRQRCLMVQVEAQYILIHQALVEYNQFGETEVNLSELHPYLHNMKKRDPPSEPSPLEAEFQRLPSYRSWRTQHIGNQEENKSKNRNSNVIPYDYNRVPLKHELEMSKESEHDSDESSDDDSDSEEPSKYINASFIMSYWKPEVMIAAQGPLKETIGDFWQMIFQRKVKVIVMLTELKHGDQEICAQYWGEGKQTYGDIEVDLKDTDKSSTYTLRVFELRHSKRKDSRTVYQYQYTNWSVEQLPAEPKELISMIQVVKQKLPQKNSSEGNKHHKSTPLLIHCRDGSQQTGIFCALLNLLESAETEEVVDIFQVVKALRKARPGMVSTFEQYQFLYDVIASTYPAQNGQVKKNNHQEDKIEFDNEVDKVKQDANCVNPLGAPEKLPEAKEQAEGSEPTSGTEGPEHSVNGPDALNQGS

SEQ ID NO: 120 - DNA, 5292 bp, Homo sapiens
ggaaattgttcctcgtctgataagacaacagtggagaaaggacgcatgctgtttcttagggacacggctgacttccagatatgaccatgtatttgtggcttaaactcttggcatttggctttgcctttctggacacagaagtatttgtgacagggcaaagcccaacaccttcccccactggattgactacagcaaagatgcccagtgttccactttcaagtgaccccttacctactcacaccactgcattctcacccgcaagcacctttgaaagagaaaatgacttctcagagaccacaacttctcttagtccagacaatacttccacccaagtatccccggactctttggataatgctagtgcttttaataccacaggtgtttcatcagtacagacgcctcaccttcccacgcacgcagactcgcagacgccctctgctggaactgacacgcagacattcagcggctccgccgccaatgcaaaactcaaccctaccccaggcagcaatgctatctcagatgtcccaggagagaggagtacagccagcacctttcctacagacccagtttccccattgacaaccaccctcagccttgcacaccacagctctgctgccttacctgcacgcacctccaacaccaccatcacagcgaacacctcagatgcctaccttaatgcctctgaaacaaccactctgagcccttctggaagcgctgtcatttcaaccacaacaatagctactactccatctaagccaacatgtgatgaaaaatatgcaaacatcactgtggattacttatataacaaggaaactaaattatttacagcaaagctaaatgttaatgagaatgtggaatgtggaaacaatacttgcacaaacaatgaggtgcataaccttacagaatgtaaaaatgcgtctgtttccatatctcataattcatgtactgctcctgataagacattaatattagatgtgccaccaggggttgaaaagtttcagttacatgattgtacacaagttgaaaaagcagatactactatttgtttaaaatggaaaaatattgaaacctttacttgtgatacacagaatattacctacagatttcagtgtggtaatatgatatttgataataaagaaattaaattagaaaaccttgaacccgaacatgagtataagtgtgactcagaaatactctataataaccacaagtttactaacgcaagtaaaattattaaaacagattttgggagtccaggagagcctcagattattttttgtagaagtgaagctgcacatcaaggagtaattacctggaatccccctcaaagatcatttcataattttaccctctgttatataaaagagacagaaaaagattgcctcaatctggataaaaacctgatcaaatatgatttgcaaaatttaaaaccttatacgaaatatgttttatcattacatgcctacatcattgcaaaagtgcaacgtaatggaagtgctgcaatgtgtcatttcacaactaaaagtgctcctccaagccaggtctggaacatgactgtctccatgacatcagataatagtatgcatgtcaagtgtaggcctcccagggaccgtaatggcccccatgaacgttaccatttggaagttgaagctggaaatactctggttagaaatgagtcgcataagaattgcgatttccgtgtaaaagatcttcaatattcaacagactacacttttaaggcctattttcacaatggagactatcctggagaaccctttattttacatcattcaacatcttataattctaaggcactgatagcatttctggcatttctgattattgtgacatcaatagccctgcttgttgttctctacaaaatctatgatctacataagaaaagatcctgcaatttagatgaacagcaggagcttgttgaaagggatgatgaaaaacaactgatgaatgtggagccaatccatgcagatattttgttggaaacttataagaggaagattgctgatgaaggaagactttttctggctgaatttcagagcatcccgcgggtgttcagcaagtttcctataaaggaagctcgaaagccctttaaccagaataaaaaccgttatgttgacattcttccttatgattataaccgtgttgaactctctgagataaacggagatgcagggtcaaactacataaatgccagctatattgatggtttcaaagaacccaggaaatacattgctgcacaaggtcccagggatgaaactgttgatgatttctggaggatgatttgggaacagaaagccacagttattgtcatggtcactcgatgtgaagaaggaaacaggaacaagtgtgcagaatactggccgtcaatggaagagggcactcgggcttttggagatgttgttgtaaagatcaaccagcacaaaagatgtccagattacatcattcagaaattgaacattgtaaataaaaaagaaaaagcaactggaagagaggtgactcacattcagttcaccagctggccagaccacggggtgcctgaggatcctcacttgctcctcaaactgagaaggagagtgaatgccttcagcaatttcttcagtggtcccattgtggtgcactgcagtgctggtgttgggcgcacaggaacctatatcggaattgatgccatgctagaaggcctggaagccgagaacaaagtggatgtttatggttatgttgtcaagctaaggcgacagagatgcctgatggttcaagtagaggcccagtacatcttgatccatcaggctttggtggaatacaatcagtttggagaaacagaagtgaatttgtctgaattacatccatatctacataacatgaagaaaagggatccacccagtgagccgtctccactagaggctgaattccagagacttccttcatataggagctggaggacacagcacattggaaatcaagaagaaaataaaagtaaaaacaggaattctaatgtcatcccatatgactataacagagtgccacttaaacatgagctggaaatgagtaaagagagtgagcatgattcagatgaatcctctgatgatgacagtgattcagaggaaccaagcaaatacatcaatgcatcttttataatgagctactggaaacctgaagtgatgattgctgctcagggaccactgaaggagaccattggtgacttttggcagatgatcttccaaagaaaagtcaaagttattgttatgctgacagaactgaaacatggagaccaggaaatctgtgctcagtactggggagaaggaaagcaaacatatggagatattgaagttgacctgaaagacacagacaaatcttcaacttatacccttcgtgtctttgaactgagacattccaagaggaaagactctcgaactgtgtaccagtaccaatatacaaactggagtgtggagcagcttcctgcagaacccaaggaattaatctctatgattcaggtcgtcaaacaaaaacttccccagaagaattcctctgaagggaacaagcatcacaagagtacacctctactcattcactgcagggatggatctcagcaaacgggaatattttgtgctttgttaaatctcttagaaagtgcggaaacagaagaggtagtggatatttttcaagtggtaaaagctctacgcaaagctaggccaggcatggtttccacattcgagcaatatcaattcctatatgacgtcattgccagcacctaccctgctcagaatggacaagtaaagaaaaacaaccatcaagaagataaaattgaatttgataatgaagtggacaaagtaaagcaggatgctaattgtgttaatccacttggtgccccagaaaagctccctgaagcaaaggaacaggctgaaggttctgaacccacgagtggcactgaggggccagaacattctgtcaatggtcctgcaagtccagctttaaatcaaggttcataggaaaagacataaatgaggaaactccaaacctcctgttagctgttatttctatttttgtagaagtaggaagtgaaaataggtatacagtggattaattaaatgcagcgaaccaatatttgtagaagggttatattttactactgtggaaaaatatttaagatagttttgccagaacagtttgtacagacgtatgcttattttaaaattttatctcttattcagtaaaaaacaacttctttgtaatcgttatgtgtgtatatgtatgtgtgtatgggtgtgtgtttgtgtgagagacagagaaagagagagaattctttcaagtgaatctaaaagcttttgcttttcctttgtttttatgaagaaaaaatacattttatattagaagtgttaacttagcttgaaggatctgtttttaaaaatcataaactgtgtgcagactcaataaaatcatgtacatttctgaaatgacctcaagatgtcctccttgttctactcatatatatctatcttatatagtttactattttacttctagagatagtacataaaggtggtatgtgtgtgtatgctactacaaaaaagttgttaactaaattaacattgggaaatcttatattccatatattagcatttagtccaatgtctttttaagcttatttaattaaaaaatttccagtgagcttatcatgctgtctttacatggggttttcaattttgcatgctcgattattccctgtacaatatttaaaatttattgcttgatacttttgacaacaaattaggttttgtacaattgaacttaaataaatgtcattaaaataaataaatgcaatatgtattaatattcattgtataaaaatagaagaatacaaacatatttgttaaatatttacatatgaaatttaatatagctatttttatggaatttttcattgatatgaaaaatatgatattgcatatgcatagttcccatgttaaatcccattcataactttcattaaagcatttactttgaatttctccaatgcttagaatgtttttaccaggaatggatgtcgctaatcataataaaattcaaccattatttttttcttgtttataatacattgtgttatatgttcaaatatgaaatgtgtatgcacctattgaaatatgtttaatgcatttattaacatttgcaggacacttttacaggccccaattatccaatagtctaataattgtttaagatctagaaaaaaaaaatcaagaatagtggtatttttcatgaagtaataaaaactcgttttgg

SEQ ID NO: 121 - protein, 1298 aa, Homo sapiens
MYLWLKLLAFGFAFLDTEVFVTGQSPTPSPTGLTTAKMPSVPLSSDPLPTHTTAFSPASTFERENDFSETTTSLSPDNTSTQVSPDSLDNASAFNTTGVSSVQTPHLPTHADSQTPSAGTDTQTFSGSAANAKLNPTPGSNAISDVPGERSTASTFPTDPVSPLTTTLSLAHHSSAALPARTSNTTITANTSDAYLNASETTTLSPSGSAVISTTTIATTPSKPTCDEKYANITVDYLYNKETKLFTAKLNVNENVECGNNTCTNNEVHNLTECKNASVSISHNSCTAPDKTLILDVPPGVEKFQLHDCTQVEKADTTICLKWKNIETFTCDTQNIYFQCGNMIFDNKEIKLENLEPEHEYKCDSEILYNNHKFTNASKIIKTDFGSPGEPQIIFCRSEAAHQGVITWNPPQRSFHNFTLCYIKETEKDCLNLDKNLIKYDLQNLKPYTKYVLSLHAYIIAKVQRNGSAAMCHFTTKSAPPSQVWNMTVSMTSDNSMHVKCRPPRDRNGFRYHLEVEAGNTLVRNESHKNCDFRVKDLQYSTDYTFKAYFHNGDYPGEPFILHHSTSYNSKALIAFLAFLIIVTSIALLVVLYKIYDLHKKRSCNLDEQQELVERDDEKQLMNVEPIHADILLETYKRKIADEGRLFLAEFQSIPRVFSKFPIKEARKPFNQNKNRYVDILPYDYNRVELSEINGDAGSNYINASYIDGFKEPRKYIAAQGPRDETVDDFWRMIWEQKATVIVMVTRCEEGNRNKCAEYWPSMEEGTRAFGDVVVKINQHKRCPDYIIQKLNIVNKKEKATGREVTHIQFTSWPDHGVPEDPHLLLKLRRRVNAFSNFFSGPIVVHCSAGVGRTGTYIGIDAMLEGLEAENKVDVYGYVVKLRRQRCLMVQVEAQYILIHQALVEYNQFGETEVNLSELHPYLHNMKKRDPPSEPSPLEAEFQRLPSYRSWRTQHIGNQEENKSKNRNSNVIPYDYNRVPLKHELEMSKESEHDSDESSDDDSDSEEPSKYINASFIMSYWKPEVMIAAQGPLKETIGDFWQMIFQRKVKVIVMLTELKHGDQEICAQYWGEGKQTYGDIEVDLKDTDKSSTYTLRVFELRHSKRKDSRTVYQYQYTNWSVEQLPAEPKELISMIQVVKQKLPQKNSSEGNKHHKSTPLLIHCRDGSQQTGIFCALLNLLESAETEEVVDIFQVVKALRKARPGMVSTFEQYQFLYDVIASTYPAQNGQVKKNNHQEDKIEFDNEVDKVKQDANCVNPLGAPEKLPEAKEQAEGSEPTSGTEGPEHSVNGPDALNQGS

SEQ ID NO: 122 - DNA, 421609 bp, Mus musculus
  misc_feature (1)...(421609): n = A,T,C or G
aaatcgatggtcctccttcacctgtgagtgtggctgcttgttggactgacccgtgggtggtatgagtctgaagcgtgcttgctcaaagaaccggatgtgaacatcacacatgggtgcactccagcttcttccttgaagcacacactttttggctgtgcaaactccaaagcctttctctccccattagctttcactagcccacagggagcttctgggtggtaggtcagggttcaaaccctgaatggagccgtggagccatggagagcagttcagagtctcgcccccccccccccccccattaccaccttggagatggagccctgctttgcataacctcccttactaggtattttagaaccttaactggtcaggcagcattctttgtgggcaccaaagagggttaaataggcatcaccaccctgagatgcaagcactacagtgcagttcctctgcgtgcttgcgtgcgtgcgtgcgcgtgcgttatctgctccttctgagaaagataaaaagtcctggcttatggaaatcagtgtcctcacgcaacagctggtggttctgcctccacaagctggaaattcggccactttcttctgttttggtgttggtacagctcgcctttgttatgtctgccatttgcctgttcaaaaaaaaaaaaaaagatctcttttgcatatagtaaaagagttcagatgtccctgaaagaaccaaatgtcaacacttcccaagtgcttaaaagtgttcacagaggggtctgacatacacgtggaggagctggttacaaggtacctggagcaggctctggctggggctcaggcaccggtgacattttactctggttgtgggttttctgtgatgttcaatgttgcttgtctcatgatcataatacctagtctttgtgccaggctctgccatgctaaggccattaaacattctttctaatctagaccatgtggataggtgctgttattgtgcccactgtacagataaggaaaacaaggtcccagattcagtatttgcacaaatatcggcaaagagttagtttgtgaactggtgttcccttcattaatttttttttaaccttcttattgactcttcgtgaatttcccatcatgcaccccagtccttttcttctcgctatcccttcacatctgccctctgcccttgcaactgcctctccaaaagaaaacaaaaaaataaaaactaaaagcagcaaacaaacagaaccaaacaagcaaaaccaaagccacacaagcattttacatgtaagctgcactgtgtcacagtgagttgcacagtatgcccttttgtccaaacatctttattcacaagtgttcattgcaatgagttctggtttgaggcctctggcttctgccaattctggatcctcattggattgtcaaggtgtttgaactctgtatcatggagaccctgcagctttggttctgcaggaccagccctttcatgatctccagcagttcatacatagggtatataactctaagccctggatctgggtctgggtgctaggtgagtttgttagctagtcctatttcctgtacccataccatcaaggtcagctctccctctttgctcagatgagaggcggggccagctctgcatggcccccaggcagctcacaccagggacttcagtgataacattgcctttagtgatagcatgggccacagacaacaacacaggcactctgctacaaggctacagacccagacatggccctaggcggcagcatgggtcaggatatcaccatagcctcaggtggcagagcaggctgctcacaacagtttgttcctcacgaccctggagtctccagttctccctctcctcatagagaacaaaccatcctgcttttctttttctcccacttccctaacaaatacttgctcattgtagtggagcctgactatcaagccacatggtagggtccagcctctgggtgtcttctgtccctcctgaaacctgtgcagaaggctggggcctccccttctttattattttggtgaatctcaattctaattgattctcctcctcctcctcttctcttgtgctgtagataaaaaacaaacaaacaaacaaacaaacaaacaccaaacaaacaactacaaaccaaggcctactgcatgctaaaccaatgtcctaatattgagctctatggaccccaagccctgatcatgatgatttaaaatgtgataacttgtgtggctccttaatgcagagcctatgtttgcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatactcacacacaccacacacacacacacacacacacacacacacacacacacacacacacacagacatacacacacagacatacacacacagtcgtatatatgcatatatatatacatatatatatatatatatatatacatacatacatacatacacacatatgtatacttttcactctcttctgggggatggattagtggttaagaacacttatgtacagttttgaggaccagagtttgtgacctagcacttacataataggacaggtttcctgcaatcccagcttcagggatgaaggatggagacaggaagatggctggagcttgctgcattctagtctagctgagaacatgagagccccaggctcaaggagagaccctgcctaaaaggatcaagtagagggtggtcaaggaggaaaccggtcacactattctgtcctttgcatcatgagtaggcgtagacacctgcatatacacggacatatacacaatcaataagttgttaaatctaggtcatgcatgtagagaaaacacgtagcatttgtccgagtttggtttatttcccttatcatggtgctctcatccattcccctggatccatcttctttaaaattggatataattaggagctgaaggggccgaagaacagcaatatcaaccaaccagacccccccagagctcctaggggctaaccaaccaaagagtacacatggctccagctgcatatgtagcagaggacggccttatctggcatcagtgggaggagaggctcgatactccagcatagggaaatgctagggcactgagatgggagtgggtgggaggatgggagagcaccctcatagaagcagggggaggggggtggaataaggggcttgtggaagggaaactgggaagggggacaacattttaaaatgtaaataaataaaataaccaatgaaaaattggatagaattctattgtgtatatgtgtcacgctttatctattcatccactcgttggtggacaggtaggcaggctccacttcatggcttttgtgggtagtgtgttagtggccagatatgcaaccagctctgtggtatgttgactttcagttctttggtgaatacctaattgtataactgggtcatatgatagctctgttgtaataaaatttaattatttaattattcttattagtgtggggtggatcacttggtgcacatgtggaagtcagaagaccagctttggggacgtggtttccttcttccacagtggttacaggcatcagtcaggcccgcaagcgtgtgtgtgtgtgtgtgtgtgttttgtgtgtgtgtgtgtgtgtgtgtgtttgtgtatgtgtgtgtgtgtgtgtgtgtgtgtgtgtgtgtgtgtatgtagcaagtggccctctgagctgtctcactagtccctgttttcaggttcctgaggaaactccaaactgattttcatagtggctacttcattttacactcccaccagcagtgggccttagcttccctttctccacatcctctctagcatggccattctgactggtgtgggatggaatctcaaagcagtactactccacatttcctggatggctaaggatactgaacacctttaaaaatacccatggctccatccgcgtatgtggcagaagatggccttgttgggaatcagtgagaggagcagcccttgtgcctgaaggggttcaacaccccagtgtaggggaatgccagagcgggaagatgggagtgggtgggtgggtgggggagcacccctcatagaggcagggggaggaaggatgggatagggggttctgaaggggagacctggaaaggggaaaccatttgaaatgtaaatgaagaaaatatccaacaaataagctaacatccacaaataaaaaaaatgcattatttaaaaaaatatatatttgtatttcttccgttgagcactgcctgttctgcttgttagtcacttactgattggatgacttggttctccacgttttctctccgcggttatttacatattctagacagataaatatctgttgtgtagttggcaaagataaaagaagttttaatagtgaggtcatgtatcctagagataacagctggacctaggttctttatccagtcatctagcctgcgtcttcagagtgtgctgaggccagctgcccttaaagttaaccctgacgggtgtttagcgattcctgtagtgctggttgttagcgattcctgtagtgctggttgtttgctggttgtttgctggttgtgtttgctggttgtttgctggttgtttgctggttgtttgctggttgtttgctggttgttgtctgtggtttattatttgctgtttctctgttgccattgggacttcgctgggtgctgtgttggacacagtggactcctaagctctccgtcatgagctattcccttcattttcatagaatgttggatggggagttacgctggaggcagctatgtgcagcacataactacatgctgtgtttattcttcagattccttggttttgagataggttttcacactgtagcccatgtgaccttgaactcttgtcattctcctgctgggtttacaggacaccctgccaggtaatctttgaaggatgtattcaaacatcaagaatgtatgtccaaggggctgggcagatggctctgtggttaagcacactggatgctcttccagtgagggcttgagttcaattcccagcacctacatagtgactcacaatcatctgtaactccagtcccaggggatccaatgccctcctctggtctctgtgggcaccaagtgtgcatgtagtgtccagacatacatacagtcagaacattcatacatataaaataaaacatttttttagaaaagtgtatgatgttttaaattctttcatgtgggtggagcatgaggatctggtgatatgaatgagctgcaactgtgtggagtcagccctggtagaccccattcctggtgcagaagagagagatgcacattgctgcacttgtgtgtgtgtgagcctgcactcgtgactgtatatgtgtgtgcatgtgtatgtaagcatgtgtatatgtgtgtgcatgcacgtgtgtatatgcttgtatgtgtatatatgtgtatgtacatgtatatgtgcacatgtgtatttgtatgtgtatgtatgtacattcatgtgtatatatgtgtatgcacatgtgtgtgcacatgtatatgcatgtatgtataagcatatgtgcatgtgtgcatatatgtatgtgtacatgtatgattatgtgtgtatgtatgtgtatatgtggtatatgtatatgtgtgtatgtatgtacatgcatgtgtgtatgtgcatttatgtgtgtgtgttaggtgttcaactttcactctgctttcattctgagtcttatgtaaagtcctacagatgcaccactggaaaagtctagtatcaggtactcctagtcagaaaaacagattgatgccaaatgtgggcttaaaggtcaggaaatagtttagacagcatttttgacagaaaaatcagaatttctgctgccttgtgattggcccttatttctggaattttccccaggtaaatagattgcttgttataggccacattacatgagttctagctttggatcatgtaccaaaaaatgaacaagggtaatattattcggatgacagatggttgtgtttccctgaggttagtgtgttctggggtgcacaggccatctattgtgtagcattctgactggaaaattttaacctgatccaactgggaaaatatcaggtaaacaacagtgagggatagactaagaaataagttagctgtatttttcaagtataaaaatgttacaaaagatatcatatagccgaagattgaggattgtcacaattaaaagaacttaggaacatgtgaatgaactatatgaccctggacaggaatctgtcctgggatggacaactggccacactggaataaagacagcttagataaaagtttataccagtatcaaatttcctagacacttgaattttgttccttaatactgcatgagagactcgcagtaatgacaggtaaatcgtcatgatatttgctatctacatcaaaagatcctgaagatgtgtgtgtgtgtgaatatgtgtatgagtgtgtgcatgtatgtgtagtgtgtgtatgtatgtatgtgtgagtgtgtgtgtttgtgtgtgagtgtatgtgagcgtgtgtatgtgtgtgagtttgtatatgtttgagtgtgtagtgtgtgtgaagacagccataaaacttgtgataaattataaatattgatgaatgcactgtattattttgaaaaagtctttcacgaatttgagattattaaaacaacaacaaagaacaggtaattcctcagtgaggcctttgcctttgtcaaggtttgcttgaaccccgtgtcctgggccctgcccttatctacccatgtggtgggtgaatcttcattatcaacttgactacatttggagttgcctaggaggcacacccctgggcatgtgtgggtgttttcagagatgattaactgtggagggaagacccattctaaatgtgactctattctatgggacggggtctcaggctgaataaagggggggggtgaacaggacagatacctgagctcatttgtctgtttccttacagtagatgcaacagctgccctgggttcctgccgccatgccttccttcaaaccccaagggaaagcaaaccttccctctttaagttgcttttcccaggtgtttcatcactgcaacgagaaaacttactaatgcactgtcctcttccagagtgatgacaaccctcagctcagacctgttggggttggttctaatgctacttgtaattaatacaaatttaatacacaggaaccggtatgtatacctgtaagagactgaaggttcctgcccccagttggctttgattggtgaaagaaagagctgccagcggccaacagctgggcagggagacagaggcgggacttttagatttcctgggcaaaggagaatgggaagaagaaggagcagcgtcaccatgatggagaagcagagagatcagattaagagctgcaggagaaaaagcatccaggcatgtaagagtcagagaagcagccccaggcaagggaaggtattgagaggtacctcaggatgatggcgtcttaccctaggtaactggactcctgtcctgggactcttggttttagggggccctactctgggttgaggctggtctcacaagaagccagaacttgggaacccagcttggcacgttatctgtttgtcaggagaaacagtcacacacccattttgttcctgttggcctgactttgtgtaagaaaaccttccaggtttaggccagcaattgttgagcgtccattggaccatctcagaacacaacttccaatgctctggatagcagatgcctccatcccaaacccatctttgtttcacctagagattttataactcagagcccatcccttgtttcccaacactaatatgaacgtagacaggacaactcctaatgggcacctctcacctactaagtcaccagatctgtgggctggtgatgtggctcagttggtgggagggagaggaaaaggaagagaggcgttggaaatgagaatacactgcttctacacaaggtggggcttgtcccacaccaagacttgagactggcatttcctttctgttccttgctgtctaaaacctttccaatcaaggcatctttgaattggaaggcaaaactcccctaaactctgattttggtcagctgtgatttgatcacggcattcgcctcttcagtatcttccacagggtaggaccaaacatttctaaaacagtactctagaggtggactgacacacaacagagaggttgctcccactcatgtcctgcctccagttttatttattataaccttgtgtgtgtgggggttacaaaggctgtcaacggttcctggagatggaatccagttaccctcacttgtgagccctcactgccatcgctgacccacctactgacggtcaccaggtcaccatagcagctgcagctgctggatccttttatccagtcatgaacttaagaaaaacaggatccaagaacagctccacaggagtgtttcctcctttcctcttctcttcatttgtgtcttcttcaatcctttcctccctctcaattaacttttccactcaaacatacatccactcagactccagcttttacggtcaggattctccaggcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttctccaggcctctgcgtggtggtgcgaacaccacagcgtttcacccaccctactcccaccccctcccacccccatcgcctgcgggctcctactctcagctggactgtcacgggcgctacaagttccaagcagcgtggttgctctgcgccctcttccagtcggcgtccctcaaggccggttccatccgagccctcgtgtcggcaattttcctccaaacccctctaagtcccttgccttttgcaaatagggattgtccctgcgcgctccgggtcgtcctgtctacgctggctgcactgcaccccttcccagcccgcatctgaaaagtcctgggtctctcctgggtccttggggtcgtcttccctcccctccctgagtcactccagactgtcgctgctggtcccggggctgcccctccaagatcaccctgagccagaaccaatgcccccagctgagtccccgctatccccgcagcgccgcccagcgtggctcccacgcctctgtcctggccgcttcggggtggcccgtcccccgagaactggccccgccccggccccgctccgcccctggccgcccaggcttgattggccgcgcgcccccctccccggggcttctccccgccctctcggtccgtgggcaccgccacctggtctaaagagtcccccaaggggacctagaggctccgctcaggccgggagcgaactgtggggacgcagagggctcgcgggccagggaggaggagcgaaggtgtaggacagaacttcgccaggaacaggaaacctacttctgggcaggggcggcgacggcggcgcggggccatcgcagtgtccccagcggtggcctcgctgccgctccccgagcagagctgcttggacccctctgacccagcgggcctgagctcacccttgcgtgcagcggagacagcagggacagccacaggagcgtgaagcagcatgtctgacaaaatgtccagcttcctctacattggggacatcgtgtctctgtacgcggagggctcggtcaatggcttcatcagcaccctggggtaagcaggacgtgctttgagcagcgccagccaactcgggtccctgtccctctggcgcgcggcttgtctggggtctgcgcctgggacagccccgggtcccctaggtctcagcgcgcaggaagccgcgagcgcttctcagcaacttcataatctccaacccgagacacatccgagaagaggaagtggttcgcacgccccagacaggccctgcgagcctgccttccctgccttgttttgattaaaatgtgtgttttctcctcatcttccctatggcccgttctcagcgcgcggctggaaagaagggtgggttgaagtcccaggctttggccatgaaagtaggcgatgtgcactgcgcaaatgtggctttgtcctgctggaggagattaccagcccctcttcgctgaagtaatttccttttggccttgccaaaggaggactcactcctcaggctttgccaaaactggcctcctgggcagccagggttctagaactcagctattctctctccctgtccatccccttcgcccagtgaaaggagttcagcctactgcaaggcccttgtgattcgagtttgtatatgaactggggaaatactgatgtatatcatacagaaaagcagcatgttagttaggttaggaccatttctggtttctagaaaattccttcatggtgttcgcgctggtgaacagttaattgcactctatgatatattttagtgcacaggtagtttttggttacttcacaggccctgcctcagactgtcttatctgaggagattgaggctggtgactgctctcagctgttaggtattggagtcctgtcccccggggttgtgagggagagagcctttctgtgactgtgttgcgtgcccagtgccttctctggaggacaccagtggctccacagttcctgttctttgttcatttcccaacagattgtgggaaggaaggtttaattgaatatcttttctatgttatttgctcctgagattgaagtgtgaaagaagtacttagtccaagtgtttctacttgatccagttgtttctgaaagaattcacagtccgagtctagtctgggtccaggatagtgcttcattgatgaatcctgtcaaacttggtaggcatgaaaggtgtcaccatttagcagctaaaaggaggggctctagaaacagaaggtttgtgctgggatccccaccctttggtttgcaaaccttatgaccctgggcaggttatgaaatctatctgggctacatctcctgagtttaaaaatggaactcacagtggtttctgcataggggtgtggggaggaaagaggtaagagaggcaaagtgcttaccacggcaaagccgtaatgactacgttcataagttaattagctgatgcagtaattatcaccacccagaccaggcaagagttcaagggtcacttgcaaggttgaatgtggatagcgtacaaagcaaacgctggaagggctgaggaggtcagctccacagtaggcatcgttgggaccaggagatggggaccaagagaagtgaccgactcaaggaacagagggtatttgtgtccaaagcctcagacgccccgccaagtgtgtcctgttctgctttcaataataactgtagacacagaaaaccagcatgaatggctgttgctgtggtgtgctcggtggcaatcaaaagtgcttattttagtctgtgtttctcggtggtgatttgatagtggagtttccttaggatgtgtttgcagactgtgtcattccctgttcgtgaagtaataatgttaagatgaccgcaaggcagagttcaagttgtagagtcttgaacatgctaccctgggtggagcttggcactttgattggatatttgttttctgaaatagacttttcaggggttccaatagctcatagaacttcagaggtcatgcgtgtgattgccctcacgcccaaatcaacaggttttccaaggctggttacagtcgttgctgacccccctgatacattttcttgcccttggtgaatgttgttcaaagggcctttcacggcagcctagagacatggacttcagtgggttctatacaagtttaaatcttacaaagtacaatagactagaaagcttccgaggcacctcgcttgacaaatactaacatccttgtatctgtgactgtttagaaaagcaaataggaagaaatactttcatatttgggaaatatccagtaatgtccaacatgaaattattaattttcttatcaatgagcatttccaaacaatgttactaggggttctgtcttataaagtaatttttcaaagttcaactacttaagaaataattacattgaattttgtaatagcttaatcaaggtcaatttcccattattataacaaaatacctgagattatcagcttgcaaggaggaaagctttttgtttttcttccctgtagttttggaagcttcattctgcagtcttcagttctgttgctttggaatgacagtggcttagtatagacggcaggtgcctgtgagcacggggcagggccagggcatgctcttaaattctactgtgtgtgtgtgtgtgtgtgtgtgtgtgtgtgtgtatgagagagagagagagagagagagagagagagagagagagagagagagagagagaaagagagagagagaggtgggatggtatgtctctgggtgtgagtgagtgtgcatatgtgtgtgtgcacatatgtgtaaatgtatctatgtgtgtctgtgactgtgtatggtgtgtgtgtctctctgtgtgtgactgtgtatgtgtatctgtgagtgtctgtgtgtgccagtgtgtgtgtgtgtgagtatatgtgcatgtttatgtgtatctatgaatgtctatgtctgtgtgtctctgtataggtgagtgtttctgtgtgtgactgtgtgtctgtgcgagtgcatgtgtgtttgtgtctgtgtgtatgagtgtatgtgtctatgtgtgctgtatctgtgtgagtatgtatgtgtgtttatgtctgtgtgtgtgtgtgtctgtgcatgtgtgtctttgtgtatgtgtccatgcctgtgtgtgtgtctgtgtgtgcatgtatgtgtgtgctgtgcatgtggaggtcagaggctatgctggatagtttttgtcaacgaggcaactagagtcatccagcaagaggcagtctccattgaggaattgccctccatcagactggtctgtggatgcatctatgggggcatttttgtgaataatgattcatatggaaagcccagcatactgaccttggtgttggagttgggttggaggttccaaatccaggcaggtgatcctaggcaggtggtcccaggaaggtggtcccaggcaggtggtcccaggcaggtggtcccaggcaggtggtcccaggcaggtggtcccaggcaggtggtcccaggaaggtggtcctaggttctataagaacacaggctgagaagcccatggagagcaagtcagacagcaactcttctttactctgcttcagttcctgcctctaggcttctgcccagagcgcttgacctgatgatgtcttgagttcatccatgactctgtagcctataaggctaaataaacccaagtagctttttgattagtgttttatcacagtatcagaaaagcaagctaagatagaggctttccacctaggcccttcctcttatgacttctttagttctctatccactatcgactggaggtaaggaccacacctgtaacatacaggcctttgggagagacttaaaattaaaaatttaagacctttattctaagtcactgggacgattattattttgtaggttccttttattgctttgtttatggctattcttggttaaaggtttttttttttcgtttttctttctttctctctttttctagcttatacagaattaggagtcatcatggtattttccaaacattctttgttttgcttccccaattcttccccattctttcccctttccctcccaccctccattgtaccttcccatccccttttatgctacactcatgtgatcttttcatgcatggtttcaaagtataggacattatttagcttgagaaaccagaaaggtctttgcccaagccaaataaaatattttttaaagtattttattttattattttatgtgtttgggtgttttgcctgcatgtatgtctgtgcatcacatgtatgcagtgcctttggaggtcagaagaggctgttggatcccctgaactggagtttccgatggctgtgagctgccaataggtgctggaactcaagagcaggtgtttgacatctctggagactcacaaagtagtatcttccccagggcctgttggggtgtgccctccctgttacagtgtaattgtcagagtctacagagccagccaggctgaggctccctctacattgttgccatgtgctcacgggtcttatgtatcaattgctgggtagacacttgtcagtaatttccctgttcttctgctcctgtcttggacttgctgttaactggcacatggccttgttcatatcttgtatctcttcctcagctttcttgtcttggagactaaggatagtggatcctgtcctccctcatctaggataaaattgataaacttgagcataagagagaaatgaaaatttggtaaaatgaaaatgtatagggaaaaggctatatttccatatatacaattacaacatttcttccaaggccaatgagctgctggagtgaactagaccagagaactggtttaatgactgtgatgttgcacctgtttagtcaaactcatttgttccactgtaacattacaaattccagggagtagctaagaattagacaggaaactctctggtttctgttttaactcttcatcactctgacacgttcagaagcaggatggtactgctattgaaatcaggtgggcggttgatgagagctgactttacacagcacagaggtttatttgtaaataaatgttgcctacttgaaatattttctggtgtaaatgagttttaaagactgtgttgtggggagtgcttgctgtggcgtttgcagtaagggtttcactcttaaggagtttagcaggctccttttggcggcacctgacaagatgaggctcgttagcttttccctgtgactacatttttaattctctctctctctctctctctctctctttctctctctctctctctctgtgctggcatgagtgtcacagcacatgtgtaggggtcagacagccacattggggatcacttttgggtccccagtgcagtgagtgcttttatgtactaaactatctcaggcccttcagcgtggcttttaagtcccttgaacattgtggttgcaaattctgcgtttctttcagttttcctttgagtggtatttatactttggagacagggttttctctgtgtagccttggctgttctggaactttctctgtagaccaagctggcctcagagtcagagatctacttgtctctgcttcccaagcgctgggattaaaggcctgtaccagaaggcccagctgatggtgtttaaatctaaagatctgtataggatacccttgtactgccttaatagaaaaactgccttatgacctagatggtgtatatactttgaatgaactgatttttttttctgatgatgtattttagagttatagttttctctttgtttcttttcttctctttttgtcttttctcttccttcctttgttttttctttcttctttcgttagggaaggagggatttcagatacactgtgtagtttccaatgcaggctaatgggtcctttggtctttccattcttttctgtcatcatagacagatatagaggaagtaaccatgagtttgtatgacattgtcccaggtcaatcacaacacagttcacttaactactaatcaaaacatctttgagatgtctgtatcatttttaaaggattcttagtttcttatttagtcttaatgaacagtacttattttgaaaagtataaataaagtatttttccagtcactgtcagtagagaaaaaatgggggaacacagccatggttattattcaaacttggatcctagttgctattaatgttttaaagtgtagcatggaaaacgcttgtctggccagcaatgctgagcagctatgaggtctggcctatttgttaaagcaaatgtgtattctgcctcatttttaaagcgtgttcaagcaggtatgacctatacacctgggaatggctccctggctgtgttagcaatctccaccctaagcacgaggcttctgttgtcagactcactgtctatggtctcagtttgtgggactgtttcgttggtatgtgattgaaataaaccaagagtgttttagtcgactgtttttgaaatggaggagtgagttctttccaaattataaccaataattggttaaaaatagctgttacagtgctggagagatggctcagtggttaagagcactgactgctcttctagaggtccttgagttcagttcccagccaccacatggtggctcacaaccatctgtcataggatccagtgccctcttctgttgtgtctgaagacagtgaactcatatacacaaaataaataaataaatcttaaaaaagaataactgttacatagttagagcattacctattcacagatcttaaattgaggataagttaaaatggcaggctgttcagaataaaaatatttttttgatattgaaattgaaaatgtgcggtcaagaactgagttcatgggactgttctgacaaagtccttaatgctggcacgtgctgtgctttgattgacttcattcattcacccattccttcactttatgccactgaccctttatgatgggcgagacttatacccaagagatgctgtaaatccttatctggaaagctggccttcttttgagagcttgtggtttgatgtttggtgaagtctgtgggggacacaaacacatccaatacctttgctctcaagtctagaaaccaacaggtacttttgtgtcttttgaatccttttgtgcccgacacgagacagttcctgaggtagagctggaactctatggagcctacaaggtgtttaatgagtagctgtaaaacagatttaggattagcatcagagacaggatgaacacgagcagagtcaggcagttcctttgccacgccatgggaaggtcagacactatgtcacagagagttggaagagccatttcttcccctcttgctggtctgacctggttgagacaggcttcaaggagaggaagagcatgggctcaactcaataggatggacagacatctgcatcctaatacacccacagtcagtggcacattcttgatattgtcttctttcattttcaacaaccagtaaaattttactactcattttaatagctctaaaactcccaaagcaaatagtttgatgttgttgggctaagcagagatagaaggatgatctgaaaacgcttcatgcttcacctaagagagagctttgagcttgggtcagactgtctgtgactaccacaacagcttccagacactgacgtatgtgatgggtttaaagagactgtggcgatgaccaagggaactggagcctggtcaggaaggaacttgcagtgactggggacttttagacagtaccagccctgtggatttcaggcttctattgaattcttcagttatccatctccaaggttgtatatttgttgttttccctatgggctgtgtccagcttctctggattttttccccctgaggtagagtctcactcacattgcagccccggctgccctggaactcaatatgtaatgcagggtggtctcaaacttgtactgatcctcctgagtgctggcattgcaggtgcgcactgccacacctgatttaaagtcatttctaattatttttaactcaagttccacagcccctctccttctgacttggcttcactgtcctaaagagtgacaaagttcagggattcgcatgaatgcaggggagggcaagggaagttgacacacatctaagctcatatctaaattcttagaattcagacagactttcctgaggtcctatctgaagtaagatgtttgttactgttaaaatataactggaaaaatatctctgtgctgaagatcaaacataggacttgttacagttgttattaagagatgcaatggaggtcctgagaagtctatctctgaggcagtgtggctgcttccaaatccatcatcaggagctttccctgcacagcaattccttccgaaaagagaactggactttgcattcagaatacatatggatccttaaggctcaacatggagaccaaaggaccaaacaaatataaatctaacaaaagactgcaaccttacacaagtctgtaacttttccactaaattgtcaaattgacacctcttgtcctcaaggtttcagatagtgaggtgccctccaatcctgttcaattcactttttttttctttttcttttttctttttggttttttgagacagtttttctgtacagccctggctgtcctggaactcactctgtagaccaggctggccttgaactcagaaatctacttgcctctgcctcccaagtgctgggattaaagtcaattcatttctaattaagtcatgtaacattttaattaagttacaagttatcaggtcgaactgtcttgataccctgtaaacagttcacagggatcccttgcataatggtttgcactgtctgatcttaaaagacctgaaggagcctgcctgtcatactgcttagctgcttgcttggataaagctggagcgcagaatgactggcttgtgttagtaaggctctatgttggtaataaacaaaaaccacccctggccagctcaagagcaggaaatgctttcaaggccatttgagaaactcaaagcaactgaaaggaggactcactgtgggctttagataggcagggaaacttggccttggggctcccaacagaggaccttcttgctggacagcatcctgaacgtggacatcacccagcagttcccgtgttctctgtctctcttgttaatttgttagataatacacctggtagaagtcattcctgcttggattaggagtcattacttgtgatggctaatcttggttgtcacctagacatgcccaagaggaccaattaaagacttgcctccattagactggcatatgggcatgacaatgggggctttttcttgggttgataatggatgtaagaatgactagcccactgtgggcactgccatctctaggcagatgggcctgacctttatacaaatgaaactgaaccaggagcctggtgtttgcttcaagtgcctgctttgagctcctgctcagatttctcttgatgatggagttgtaacttgtaaatgcaagcaaacactttcctcttgagttgtttatcacaacagaaaaaaacaaactaaaacattattcatgcccaggaagtcaggtttcaaggcctagatctggccagcagggaaattgctgagctaagatagactttctgctactttgggggctgtgtggtgtgggccacagtggaactttgcctgagtgaaatgctccaatttgtaggcaaggaaagccatagtagaagtgtagtgccccttgaagcaaattgtgatagggtatgcatgctacaccattcactatcttggctgccttaagtgtgtaatcggctcaggggcagcaaggatatggcagtgtgggcaatcaggacttcttcatatcagaaacaaggtaccattctgacacaagtctacatcgtctttgaggttcttccatttctatgaatttggctgttccaggtacctcatggagttgaatcatgcaacagtcctttgtcacaatgtcacttgctgaacaaatgtgcattacattgggatctgtgtactttaagatagcgaagtgactagcaacagcggcttcttcttgggggaaacagcagtgtaattgttcttatgaaatctttgagagccacagataattgtaaaagtagggagctctcacagaagccagtgatattccatcttgtcgttagaggttctttaaaaaaccaacacatgacaaaacttacatcagaaacagtaatgcgtgtgacctttctccagtgtttgcattctgaagccacagtaaacgaaagctgatgttttgcaagcccagttttgatggttacaagctcaaagaattcgtaagcaccttcaaaactatataacagagagtaggccttttatggacaacacataattctcccagggacagattttgtgcctgagtttgaacagagagaacttcctgaaatcaaacccagagaatacctgaagtattaacatgtaatttactttagaaaaacatagtaggatgtgtttcccgttgtaactttcatttttaagatttaagagtaaatggtgaccaagagacatttcaatattgtgtaaagagaacaaagaggtatttttttcatcttatattaattttgattatacccactgatatgtttgggcattgtctaagaatttgaaatcccttaacattgcactgactcgtgttctagaagccttttgggttcaatacacagatgagttattacatacatgtagaagagaatgaaaagaaggaaatgtggatatgtacaaactacaaagcaatttggaaactaaagcaatgtgatttaatgttcaagttccagctcactatcatcctctatgatagacattttaaaatgtcttaatattagaaatgtgagcttgactcgcctggcatggtgccgcatgcctttaatcccagcacgtgggaggcagaaagagaaggatctctgcgagttcaaggccagcctggtctatatagtgagttccagaacagccagagctatgtagaaaggccctgtctcaaacaaataaaaacaaaaatgtgagtttgagatgaaaggcactaatattatgggagttctgttacatttctgtgatgttcaaatgtggtttaatgacatcgtaccttgtaaacacagcaattaaaacaaaaatcagctgccagatccccaagtgcagagcagtgatccaaagtaagttaatgatttagagactggtctcttgagtttggagagcattcaaggtcaatgctaatatcagagacatgaccacttaaacatttacactgcaggctttggctttggccatgttttctaagagggtaacttccggtctgactctgggcagcacttggagaaggtagtggagagattttgtcattcttaggatgctacccagtgacttggggtgacagacataagagacattcattgtgagtctaaccaagaatcaaagaaagcacgttatgagaatgtctggaagtatgttcagggctaatgagaaagggcttttatgtgcttgtcttttgttttcttgcaaactgggacacaggcagcctcatccccatttcccaggtaaatctttgttaccggggaagggggaaagcaaaaagcttgctttcaggtctcagccactggagatcctttcagatctttaagcatcgctgtgttggaagcatagagagtattctgtgtgttgttggaggcttagaatcaggaggggtttaagtcaaatgtcatggaggaattctggcaggtggtaactctttggcaacagataccgtgaggttagtgcataaacactttctgaagaatggaccatgccctgggctggatcctcagtactggggaaaagaaaaagacaaaaaggagaacagcttcacatctctcaggtgcatcttcttcaaaacaggagctgtaacctgtgcctttaatgttagttatttaaaatatttgtgtgtgttcacccgcacacgcgtgttggtatgaaagccggaggtcaacctcaagtgtgctgttgaccttgtctctggcatctagggcttgctttgaactcaggtcctggctcttgtctaacaagaaccttgccactgagttatgcctccagccctagtctacgagattctaacaaagtatcaacagcatcatagaatttgaaacatatgtaacaaaatgtgtattaatgttaggccattaatctggcctatctggctatcgctacagattctttttttcttctttgttactagcagatgacttggatttgggtgttcaggacaaagtccacgttttcccctccctctgcactggacattctcccccaggtcactgtggccactcactacacttgggatgatgaggaagaccattaaggagggctcagtgccccgctctgaacaggtgcttggaacaatagcgtgggaagaacgcatcttgggccacgtagatgaggccactgtactagaaatgttaacaaggtatcaggaagtgaaactgttctgcagacgacctcaagcccagttctttgttatattcacctaagaaatgggtagccaaggaccagagtgggttttctatatcaactatgggtgatttttaagcaaaagaatgaaacagtttgctttagaaaggccaggttttgcctcagaagggccgtgctttggcctagtggcagagaagaaggcagggatggcagcacaggaaactggggatctaacatggcagaagctgtgctggggacagaagccacttgtcacagaggcactgaagggacactgctctgcttcagtttagatctatgaaaagcttaggaattggaacagccaccactgtttctaaggctctatgactctgacgactaagtatacagattttaataaaatgtttgcttgctcacatctagttaaaatatcatctgttctcagtttgactctgggttctctgcgttccatgctttgtagtgtgcggtcctctggcagaacacctgcttttctttgtagctgcaagatatccagggcttcacaggatgttaccccacggcctgctcagtttcctttcttacctgcaggcctgccttcaatttcccacgcagatgccagctgtaacttgtttctgatctccggactgtgtgaggaccctttatgagctacagaattgcatggcagtctctaagtgtactgcagctacagctttaattttgattcttttctttttttgtggtacagtgtatggtgtatacgttcatgtgtgtgtgtgtgtgggggggagagtgcacgtgtgtttgtgtcaacgccaagtgtgtttcctcagtggttctctagcttagtttttgagatggaatctctccttacccctggagcttgatgattggccaggtcagcttcccagtgaattccaggcatcctcctgtctctacctccccagtgctgggattacaggcacttgctgctctgcctggctgtgtgtgtgtgtttctaggatccaagctcaggtcctcatgcttgcaatgaaagcactttaccatcttctcaatgcttgactctctgtctgtgagtgttgggttgtccttatttctccttttagacttaaacaaaagggcagaggttaagtgtggtttgttcacagttatgttgccaaggtcttacatggcacccatcagatagaacatatccaagaaatatgttgaatcaatgcccgaggctgtagcatatggttgagacttttgctttagacaaatctggtttcaaattgtgtctccacttactctcacagtgagatccccagaagttatttaaccctgatgcctagacttccttaactgcaaaatgggaggccaggggatcttgtctagtcattggtcatcaacgcacataaaacaggttgtatggaacaggcctagagcaccaggctcctgatcatgaagtaagagcaagctattcattggtatttgtaggaccaccatgaaggaggcatcatgaatccctttgtagcagctgagctgagctcaccctacaggggtgctagacatactgccataccatgagctgctgtttgcttagcaggctgttcaaagtcatgctgccttatcagttatttgtttggttttgatctttccttttcttccttgtgccactggtgtacatttctaaatcaccagtgcttgcgtttatctttcagttctggttcgatgcctgctgtgccctgatgtactgcaaacactggatgcatgagtatgaataataacttcgatagctgtgtgcacactgcaccacaaatgctcacacccccatcctgtatttcctatgactagagttttcaagttttcttatgttttaaagccaatgtcttttacttgctaatatttccccctactaggatgtagtaacaaaataaaacatttaaaatttatcattctctcattttatttgtaattatttccctctctctctctctctctctctctctctctctctctctctctgtgtgtgtgtgtgtgtgtgtgagagagagagagagatggtgcatgtgtagaacaaccctgtggagtcatttttctccttctactttcttgtgggatttgagcttgacctctggatacaaggctttcacgacaagtgtcttactcactgagcctcctggctggccctgttttgttttatttactgagaaaaaacaatgcactagcttgcagcctttaggataaaagtgtgcagacctctccgtcactccccccacaccctccaccccatcccagtgtctctgacttttcagattggccaagaatcaggagttctgaccagattgattgttagggatgagcaaaacaacttatgtaagataattagacagtttacaaacaaatctatttgtttaggaaaaggtgtcaagttttagctactaactgatcaaattataatccttgtcttggagacactagtgaattttagacaaaatcatgcggatttgagatggctacagggtggatcttattcctgtctcttagcagcagctacccaaacagcaaacaccactgggccttcagctttcttttagaaatgcctcaggataatttctctcttttctggaaaagtgacatatacacatggactcagtgtggaagaactgttaaaaaaaatcattgaaaatgctttaaaggggctgaggatgcagctagtctgtgtggagcacttgctgagcacgtataaaggcctggatgtgtgtctgctgtcccactcaaatggcacaggcaggaggaccagaagtttagggtcatgccttcactgggtctctaatagcccaggctatgtcaggaggttgaggccagcctgggctacttgtttgaaagcttctctttgagcggcttcttctcttagctcatgtcaatagagctctgaagtgagaggggctactcgtaggtgattaattggtgatagacttgggcttgaaacctaccacactctcaggcatgataaagaaggaaaatatctggacactaattttattagtcagatacggtttgggggacacaggaatgagaaaaatccaaatcaaatctctaacctaaaggattttgtgatgagagtaacagagtctgcacgtccagactctcggagcccaaggctctgtaccacgtgggttgtctcaagcctggtcggtgctctgtctgtgatgccaggggctgctggaagtgttcttcttcctcctcttcttcctcccagaactaagagtgctcaaagccctcggaacagtatgtgatctccactgcagcggattagacaggcgctgaggcaggggaagagctgctggggctaacagatggggtgccatctcttagagtgggaggagagcctttctcccttcttcagtcagggttcctggtgggaaggagggacttgggtactgaaagcaagcagtgataagacccaacacatcgcagccagcggaatagatcccagccctcagaaagctgcatcctaggaccttagggaacgtgtgtagcctgtagttatccactctttgagcgttctccttcagggagctagggctctgccacatcctgatgggagggggaatggtctgagacctgactcctcagccggtgggaagtctcagctttgtcttcagctggtgaagacacggtttttcagggactcagctggtgagggaacccagtggtttgctgtaggtcagtgatgtcgcctcacatttgaaatggaaagacttcgtgaaacagtttttctagaagagcccattgttgagtaaacgtttatttccttctgtgtgtgtcccctttccctctccatttccacctcccacccccaccccgtgtgcgtgtgcgtgcgcgcactatgaagtagggaccttgcctatgtcttccctttctctttagcttagcacagtacccaaaggacacccgtttctctcttagacaccatccagaagctcttcccggcctgtcttaaaatctaaattcctagagtgtggcaatggggctgctctgtggctagctgctcagcagaagccccagggctgacagaaatcttgctaagtagcatttgttttctctaacagacttggaactttaaaaaatatatctaaattaccaatggtttttgtttttgttttgagaatttcatatctaagtgctaaatttacataattccaaccctcccttctctcctgtccctcccgaattcatgacctcttctttttaattagtcttggaactttgagagagtgtctggaagcttccacaggaaatgccccatgtcagtttactcacggttgggttctctgggtttctggctatctagatttagacacgtagccacagtgtgattttctttttagtcttcactgactcctgggctttgaagatacagctgtgctggtttctgttttggtttagtatttatttattttattttatttttaacaagcagtgaagctcgaggctgcacttcacttcctttctccatttcttgctttaaaagaggacatgaaggagacttgaatgaggctcaggtgccatggctgcagtgtggtttgggaatagttacctaaaccaagctatttaattttgttgctagagggaggctgaagggataaatagaggctaagagctcaggctgctcttgcagaggacctgggtttccagcacccacatgtcagctcataaccagatgtaattcctgttccattgccttcttctggcatcctggcacatgcatgctatagaaacatgtatgcaggcaagccttcatatacttaaaataaaaataagtaaaattgtaatttgtagatagccaattatttctgctttctaaatatgttcctgcatcagtaaacacaacgtcaaatcaaggacttaagggctggagagacggccctacagggtccttaagagtgtttgctactcttgcagaggacctgggtttggtttctgctcaagtcaggcagctcacaactgcttttagctccacttctagaggatctgatgctccctctggcctccacagagctgcaggcttatggtacacatacaaagcagacacagatatctgcatgaaaacctattaaaattgaaaagagaaaacaccgagtggctgggaatggtggctcatacttgaagcaggtgaccgaggatgtgccgtgtcgttaacttactctgagggacagacactaggagcgaagacaggccctctcatggctgctacactgggctgatctggacggaaactaataatgaacaaggacttctgttggtgatgctgcctgagtccagagtaaactttggggcaacgttcctctctcacagaccttcctcagataagagcagctttcttatttttctactagtccttgtgccttctgcaagagatgccaccagcttctgcggttgtggcctttcactgtgcaagttacaggtagatacacagttagaggcctggctgtctcctattgtgtgtgtactttctcatctaatttatagttatggatggcattaatatttgtacttaacttggactttatgcccaaagctagaacaacttaaatgaggaagaggctgcgagtctgaactggtttagatgagagattgattatatatgaaatctacattgtccctgccgagtaccaggaaggtgagatgactgtgcggggctgccccttttatgattagaattttggtgggaaaacttcacaatgggccttaaaaacagttgctcaaataagttagctttaaaaacaattactgtgtaatttagttcaaaacacaccgaactctaggcaaacggtgactaaggagacagagtcagcctttccttagcactgagctccgtagtcagttgtctagtacagaaaggtcaacccagaaaccatgcatacaataaaatcagtatcagctggttgtatttctatatctgtgtacagatacacatatatacataggtaatcataataattggagaagaggaggctgtcaatctgagagtgggagcaggttggagggggaaccagagagggcctgggaggaggaaagggaagaaagagctgtgattgtgtttcaattaaaattaaaaattcacagaaagtgtgagggttggggagttggctctgtggtaaagggcctactgtgcaagcctgaggactcctgtgaaagctggattgggcaggggtagcactggatagggcaggttcagcactggtctgagtgggtgtatcagatggagacaggaggatcctggggcctgagggccagcttgtctaagctaatcaatgaatttcaggttcagtgagagaccctgcctcaaatacacaatggagagacattggaggaagagaattgactggcttccatatttgtaggtacaggtcagagtgatacacatatgtgtgtatgaccctcacctcattccccaggaaatgtgaaatataatgataagcacatttacacgatttagtcacagagcacaaatgatctccaggttggtgcttttctgctcatttctacagagggtagaagattatactatcttagagggaattaggaaaatcttactgtgctgtctagttttatatcaacatagctatggtcattggacaggagtaaacctcaattgagaaaacacctccataagatggggctgtaggtgatcctgtagggcgttttcttaatcagttgattgatatgggagggaccagcccatgtgggtggtgtcacccctgagctggtcattctgagttctgtaagaaagcaggctgagcaagtcatggggaccaagccagtaagggacgcccctccctggcctctgtatcagctcctgcctccaggttcctgtcctgcgtgagttcctgtcctgacttccttcagtgatgaacaatgatatggaagtgtaggcagacaaaccctttcctccccagatttggtcggggtatttcatcacagcaataataaccctgactaagatatgataccccaatcaaaaaacagactccttaaaaagaagagtgatagcctggtgcttgtatgtatttgcattaactgagaagattggagatagttatatatcccttagattcctggatcttcagtttcaggcagttggttgcagtattagttggcactgaaagtggatttgcctttagcagtttagaagcaggaagagcagcaggaagaggcaggaatctgtgctcctcggaagctgcccccaggctatacagcagccggttccaagtcttggtaaaggctgtagccagaggaatctgcttggtatcagctcagaagaaaagcacaagtgtggagtggagacagcctctccctagggaggaaggggttaaagcagggacaggagggtcaccatggctcagatccaagggatgccagtacatcccctcaccttgtccccctaaagctgcctttctcagatgtgaagttttaaaaacaaggtatacaacttcaaagaagcctttaacacagtcgcgtgccctgcaatccccagggttgctagctctttcacagggcagtggctctttggctgtattagattataacatggagttgggcttggcactgcatgcctgcaatttcagtccttgggattggaggcaggaagatcagaagttcaatgccaatctaacctgatctacatgagacctggctcaactcccctccttgcataaataaaaattaagaaatacttatgtccatatatattgtgtagggtttggagactctcaaatgaagagaaaagatacataaaactatatacagatggtagcaatgacccttcagaccacataatcttcttttaggaagatagtggtgtagctcttctattccttcacttcctagaaattgtctgtctatctgtctgtctgtctgtctctctctcacacacatacccatgtgtggtctcgagagttcttgctttatcctctccataccccttactataggtctaatatttgagaccctcttacccttacaaagggttaaggcagcccgcttcaagctattagctttactttcagaggaaaactgaagaaaaggagccagcaccatcgtatactgtgacagtggtgtttctgagctgtgcctgttgagtagaggaatcctctctttactcttcactgagatcaaaagattaaatttgtgctaagaaataaaagacctcaagagaaaacaatcgaagacctcttgacctcaaggtttgcttttgcacataactgtggcctcagaccctgggacagtgctgggctcataagcaacacttgagagaaatctgggctagcacagaaatggcttagtttaaaaattttaattttagggatttttgtttgctttggagacagtgtctaatgtaagcatgtaagttgagattgtttggggctcatcatgttatccttggattcttgatcttcctgcctccacctcctacggggattataggtctaacctactgagcttgtttttaggaatggtttaattcatgtcttttgatttctgccatgccaattggagatgtgtctttggaatgacaacttttccttttctgtcatacgcgtttacatttagttgctggaaaatgttggaagctccgtgtctgcaggacgggaagcgtgcttctcagcacatccctttcttagaagcaccctggcatgcatgggctgcctcagtcgcctgctttagctttaaccaggtagcttctaccctgtgcaactgtgtggaaacatagcttctcgggcagtaatgactgtgggaatggctgcgcagctgccagaggcttttctggctagggaacttctcttgccaactatttcctctaagaatatctcccttttatgtctgctcagccaggaagtgatagctgcatctcatgttctttgctcttttgaagaaggcagcatggttgaggaagcgggaggggtgcttagctccggacctagtcatgccccgcagtgctctgaggagttcataagatggaaagcttctgggtatttaacactctgccttgttctatcctggtgctgtcactggctagatgactttggagagctccctttgtcatctgtgcctagactataatatcaaatatatggttttctcgagggagtccgtgtgaatttctgtgtccctcgtttcttcctttatttctgtgatacttgtctgtggcatcattaagcccaattttattttctggatcttgttttctttgcttttatgatccactgaactatcatttactaaactcagactgccagttcctaggcacttcctgttgactggaggcatgcagctagcagtgcaacaaagtaacagcttgaagtgtgctgcagctggacagctgtgtcaggatcatgggtgtgctgcagctggacagcaggctgtcagctgtgtcagaatcagggaaccctaggcctgaggatcctgactttctttttagttaaacatacgttcaatgtaagccaagagaattaaagacacaaaaacaagacaaaacagaaaaaccttaaacgtgaagatttacacgtaagccatggagtcaggatgtgcaaatcctatagtcctctgtattgaggtttttttttttttcagtttgttcaaatggaaaatattttatcatctgttacgttttatatacttaaagagtctcataaattgctatgttttataagcagtcattcaaattcatgttacatatatatgaattggcattcatctgcttaataaaatgcataaaataatttcagtaaacagtattacatgcttagtctgacaacagtgcggtttccagcccccacacacttcatttaaattaagttttctggttaccatatgtgctggctagttttatgtcaaccaatgacacaaactagtgtcattggaaaggaggtagcctcaaatgagaaaatgcctctatctgatcagactgtagacaagcctgtagggcattatgctagtgagtaatatagaagggcccagccaatggtgtgtggtgctatccctgggccggtggtcctgggttctattggaaaacaggctgagcaagacagagacagtagcaccccctcatggcctctgcatcagctcctgcctctaggtttctgccctgtttgatttccagccttgacttctttcaatgatggattgtgatgtgaaagtgtaagccaaataaaccctttcttcctcaagttgcttttggctacagtgtttcatcacagcaatagtaaccttgctaggatacaaagtatctgatcccaggcggctccatatgtttgctagtcatcattctctcccctacggctctcccttccctccttcctctctccagctcactttctctagttcctcctcaatctgcctagttacactcagtccacagtcctttctattcctcactttgctagggtgaatacatgcacaggaatagatgtgagagcagcagggtgcacacatgatcaactttaattttttgaaaaaagttttatttagttactttgtttgcatgcatatatgtctgtgtgccatatatatgcctgttgtgcttggaagccaaaagagggcattggttcccctggagtgggagttacagatggttatgagctgccatgtgagtgctaggaaccaaaccctagttctctgttaaaagccagtgctcttaatcatggagtcatctctccagccccagcctattgggtttttagtgtcagtggtcttatatgtcctataacatatgtcttataacataggtagatggacacttctgcttccttccattcctcctcctcttttttccaaactcatttccatttctttaagtctttagggtgaaatgactagtgtccccagaagttgtatcaggagcagggcagctccttgggttactctgactttcactaggctctgggtagagaagacaaccgtgtttgcagaagtttgctgtgatctgattgtcttccttccccctttctctctaagactgcaaagcactgagactagggggtggagcttagaatggaattcacacagatggggtgagtgtcccttgtataatttttatgtaccctaagtagggctgaatttttctttttaattcattgtgctttgaattcttaatatgtcttggctccttagaaaatctggcctttcttccacgatgttttgtctaagtctgatgttgtgatacactcagggctgcttgaagcttttctagctcagtgtcaggaactcaagttggattggggggctggcattaggctttgctctctggatacaattcaacttcctgtttctaagaaaacactatctaaagacctgtaaaagagatttctgcctgcctggcagcttgtgtcaaccacacttagtaactagcatgaataacatgcatagatatgcgcatataatcaacgttacagggattatatctctacatgtgtatgatactgcttgatcatccctcccccatggaaatctgatctcatagaaaaaaaaatcccaatctgatggtttaagaagtagatccttaactgggcggtggtggtgcatggtttaatctcagcacttgggaggcagaggcaggtggatctctgagtttaaggccagcctggtctacagagcaagtcccagaaaagcatgggctacacatagaaaccctgtctcaaaaaaactaaccaaccaaccaaccaacaaataaataataagtggatcctgttggtaactaaataaaccaggaaccaacatttcatattggttgggattttatccataatgagtggaatccacccgtttcgcagattctagttaattccatactgaaaaaggaagagaaggagagctgccactcggacacctccctctgggaggatcactgatatgcttgtggcttatacatcctcacagcactgaggcagcctttcctgtcaggccaactgctctgcccctgagaggtcaagcttgagtctcatcagaaccccactgtggcttgctgggctgccttggagattaccattgtcccttattcacttataatgaacaaagggctgggatgtttggtttcagaccctagaacaagggtcaggcgcatattttacttatcaaagcagacctggcctccaggttttcccagcatccatcagtccctaactggcatttcctgcccccaaccttgaactttccagtccaggggctgggctgccctttccccactagaggctcttccctatataatccaaacattttggtctctcctcccctctcctctcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctccccacccacccgtgatgagttccctggcctcctttcttggggcaagtgaactcacccgcccaagagcagcttcccaataaacatgcctttaatataatctaatttggcttgaattggctcattttaccagggtagaaataacctatcaacatctaacaacagaagtgagaaaattgtaaatgctgaggctaatctgaccactcttttttttttcttttcttttctttttcctttctgcttccttccttccttccttccttccttttttttctttccttctctcctcttcttcctcctcctctttcttgagagacaagagtcttttttaaaaaatgcctatgcagccctgtctgtcttggaactctccaagtagacttgaccattctcaaaccctgagatccacctgcctctgcctctcaagttcatacaccactataccaggctcctcattactgttaatattttgctgtgttccattaaaaattattcattttatgcatttgtgtgtatgtggagtgtatgtgcagcatgtgtatgaaggagctggagaatgtaggtaggaccccataaccagagctggattcacaaatagttgtgagctactatgtaggtgttggcaatcaaatccaggtcttctacaagagcagtaagctatttaagccactgggctatatctccagcctctatgtttttatatgtacatatgtagaggtatgtgtatatatacatgttcttttaaattattacttattctttggtggtttcatacatgaatgcaaagtatttagattgtatttaatcttagctccccccctcacactcctgtctctgtttcttctgcccaatgccattccttctccttgccctcctgttacccagtaagtcaattagggttgccctctacttgtgcaagagtgtatggctctctatttcaggatgggcaacttgctagggctgcacctccaaagaaaaataactgtttctcctcagctatcacctgctaaatgcttttcagttaacagtggggccttgtgagcccctcccctctccatatttggaggcatattggctggcttgacccaaggcatgttattttaaacatgtatatgcattgctgattggtcagtgcttgttctcccaacaccctagaggtcagggcatttccctcaacagggttttagatagctcagctctgcttggtagttgtcaaggtcatggccaatctaacaagtttcctaccacttaatgcttcctattctttccagaacctaatctttttatgaatctcggactctcaagaagtttctgagtattcagactgtaaatatttacctgatgtccttgtgcggtgtgtggcttatgagtgtggtgatgttaacagtataaacattctttccctccaggttggtggatgaccgttgtgtggtgcacccagaggcgggagaccttgccaacccacccaagaagttcagaggtaaggaacttccagtttccccataggttttgctgttaaatttggagggatctatgatgaatcatctgatttttgttttgcatcgtggcatctatagactgccaaggaatcctggtaattacctatgaaagatgaacttttcaagccagtagatataactacatactatttatttatagatttctgtggcagttatattatacatgtcatagtgttttactgttagcttgttaattctctttatgaaagtcccatgttgtgtgaatgtggcgtttagagccctacacagatggcatgtggtaactaactggttgtcttagagcttcatggtctccttggctgagaaaccagttgtagtagcaggttgattataactcagcttctgcagaaggattaatgggacctggagaacatcctagaagacaaaaagtagtaattacaacatcatacagacattaaaagctaggatctgcatatgaaagagagcaagtgattttgatctttctgagctgtcacctcacttaataccagtcttggggttctgttgctatgttgaacaccaggaccaaagcaacttggggatgaaacaatttacttcatcttacagcgttcaggctacaatgtatcatcacataaggaagtcagggatggaacgtgcaggcagaaactgatacaagcaatgggcaaatgctctgtattgcctttctctcatgcttgcttgctttattttattttattttatttttatttttttatttttaaaaattttaaaggttttttattagttattttatttatatttcaaatgttttcccctttttaggtctccccttcagaaatcccctaacccatttcccctcccctacctccatgagggtgctcccccacccacttctgtctttccactctggcattccctttgctttttaatacaatgcaggcccaactgcccataatgggctgggccctcccacatcagccattaatcaagataatgccccagagacttaaaggccagtctgatgggggaattttctcaattgtggttctgtctccccagatgtcaagttgacagaaaacaaacaaaacaaaaccccataaaatcaaaaccccaaaacaaaacaaaccaacaacaaaagaacaacaacaacaaaacaacaacaacaaaaacacaaccaggaccatataataatatctaaatccatctgtttccctgcaagttttacactttcattatgtttataactgagtaaaattccatcgcgtgtatatatcacatcttgttatccctttaaccattattggagacctgagctggttaaggattcctctttctttacattttctcttttataacgcttattttattgtgtgtatgcatgtacatgtatgctcctgagcatatgaatatgtgccacatgcatgttgtgcccatggagaccaaaagaagtgggaggtgatggtgtcctttctttgcaagaacaacaaaagttcttgctatgtcaccatctctctctagctggtcatttgacttttgttctttgtttgatcaaacccattctgattcagatgagatagatcctttaagtagttttaatttgcatgtccctgactggctaaggatgttgaacataaaaatgtatattgatggtttgtgtttcttcttgggggaactatttatttcatcagcctatttattgattgacagttttgtttcattcattgattgttgaagcttgtcttagtcaaggttactattgctgtgatgaaacactgtgatcaaaagcaagtttggagaggaaagggcttattcagcttacacttccacatcactgttcatcactgaaggaagtcagagcagggcctggagatgggctgatgcagaggccgtggaggggtgttgctcactggcttactccccatggctcattcagtctgctttcttatagaactcaggaccactagccaagggttggccccacccacaatgtgctgggccctcctccatcctaattaagataatgctctccgggcttgccctcagtgagtttttatggaggcatttgctcatttgagattccctcttctccaacgaccctgtcttgtgtcaagtttacatgaaactagccagtacacagttctttatatatattctttatttttagttttgtcaagttaaggtttctctgtacagccttggctgtcctggaacttgttctgttgaccaggctggccttgaactcacagaaatccccctgcctttgcttctgctgggattaaatgcatgtgctaccacagcctggcgtatattctaagttttaacttccttgtgtaaggtctgtctggcaaaggttctcctccactctgttcattctgctgatggttttcttcactgtgtgaaaacttttaactttttgtagtcctagttcttcatttttatacgatctcctgtgctgctggagtccagtttagaaagttcaaaagagaattagtctcaaaaccaaactgggacagcacagtatttatgttggggaaaagcatgcatttcaagaccttactgtattgtctgggggctttgtcatctaaagtgggtcacctgtcaggggcctccaagggcctctgtaactgtctcatgagagctgagctggatagcaagaacaatgtccactgatgagcatttgtaagccttgcagtgttctcagggaaagctttgcagacacacttttcgtctttatgcaaaggcagttacattataatgaaagggtacaacgtgactctgttaagcgtgtttggctctgaccttactccaccttcttctggagcagaaatctctttccttttctttctatttctcagtcattgaattttacccatagaaggcgactcctcctctggacagccatcggatactgtggtttgagatatccaagctctctctgggatcatgtgatcaaacttgattcacagggtatcccaggtctgtgctgtgagttgcagcagcctgattccttggttcgcagtgggatttgctctttccaaaagcaggttgtgtgaaagggcagattattctggagagcaggaaggctttggagggtaacagacctgtgctagaactaacaaccctgtgcccagaggcagatggacccagatgcctgtttccttgttatccagtgggcaggggttcaaggtgtgaatcattgtcagagctggagcctggttttcctgtaatctgattcttagctcacatccctgctagttggctctcagttcctacttccactttaaaactaagcctctgtctctccactatcgccagagaagggtgtcctttccagttggagacccaaactccccttgtctgaaagtccaactcttctctggcagagcccagcacggaagtttctgagattgactggcttctgtcctggttttcccaacagccaggagcaaactctcccaaaagcttcagccacgggcatcttgttgcagctctgttggcacttctgtactctgcctgtgtctgtttctcctgcccgcctctgcagctgtaaaaaccatcgcacgccctagagagctgacggtgggaatcacccgcctagcatgtccagactcctctgccaagtttccagaaccggattgtttcttccttagatgttgtgaaggaacaataggccaccatcatcatagctccttgagctgggcacatgctcttctcaagtgaatttgaatgtttttcattgtccagcagtgaaatgtgatcctagctcaagtcctccgatttcttgagcaattacattttttttttttagaaccaaagttctagattggttgaagtaatgaagtaatgatttctccaaccatgcacaatctagaagtttcccatgaacgtgtcatgagaaatttttcctttgggtgtgtgtctaggcaatgtcatccccttccttctaaagttccaagggcaaacccttgctctccctgggaaccaatgggtttatcagacttatgcgcagagcatgggtaaggtttactgtaggagtgtgggtgacctcgaagcagctacttaggaggtctgcatggaccatgaatgatgtctcctctgtgcctggcagatgaggtcccctgcctttaggcttcttcagcttgtatcctcaatcccttccttgagtccctgaggccatgtgcagttgtgaaatggacactactgtctggctgctcaggcaagggttcagtggccctcacacccattctttgtctcaaggagcgtcggtagtccgtcagccctgctgtgatggtcttctgaaaacagggacagccaattgatgaggaaagtaacagcttggccaggaggacgaggtcatctcggctgttttatcagcagagaaaaccacactgtaactaacaagctcccagagttcctcaaagcctagtgtccagttctttctgtagaaaccacacacggaggacgatgagaagggagacagactggctctgtcttgagtgagttaaagttctttaccagtcagatttgttgtttcatttattctacttacttgacttttaatttattgttttgagctggggtgacctctaatttgctacatagctgaggagagcctggaacttccatattcctgtctctgtcctcacctctcaagtgctgggattacaggtgtgtgacactatgcttggtttcctctgtttttgtttttctattaattaattaatttattcactttatatcccagccactgccacccccacctctgtcccagctcctgcctcacacagtccctttccctatccttcttctctgagagggtggagccccccaccttgggtatcctcccaatcctggcatatcaagtctctgcaggactaggctcatcctttcctactgaggccagacaaggtagcccagttagggaaaaaaggtccacagacaggcaacagctttagggatagcccccacttcagttcttgagggacccacatgaagactgagttgcatatctgctacatatgtgtgaggggcctaggtccaacctgtgtatgttctttggttggttgagtctctgagagtcttctagggtccagactagttgattctgttggtcttcctgtggagttcctatcccctttggggtccttggtcttttccccaagtcatccacaagactccatgagttccatctaatgtttgacttgggtctctgcatctgtttcagtcagctgctgggtggagcttctcaaagcacagttatgctaggttcctgtatgcaagcataacaaaatatcattagtagtgtcagggattgattcttgcccatgggatgggtctcaagttgggcaggtcattggttggccattcccttaagtctctgctccatctttgtacctgcatttcttgtagacaggacaagttttgggttgaaatttttgtgggtgagttcatgtccgtattcctccactggggaccctacctggctacaggggatgctatttgaggttctatatcctcattgttatgcttctcagctaaggacaccctcatagactcctgggagctttccccataccaggtctctggcacattgtagagatgccctcacccccaccccactcccacaccgactttctttgtttttaaaatcttgagactctgtgataaaggtgtctatacaggagaattgtaaagctggctcagggaactctaccctgttccatgaacttaaatccttgtgtagctgctacatttcttgtcattgtaacacccccccccccaagaagagatgaaccaagggaggaagggctcactctggctcatggttagaggcttcagcctgttgactcaggaaagacctgatggcaaggacagcctgggacagtgatgtaggctatgaaggtgcccactcacatctgggcagatcagtgagcaaaggaaagggcattgtgggaactccattgactggcaccttttctcatgatattattctggggtgagccccttccaggctggcctccccgctcagtcagcctgtctgaaagcatcctgcagacatgcccagatgtgagaatcaggtgcttccaaaggcagggaggctgactgtgactgtgaagcaggttagtttgtgcctcacaggccatttgtccacagtaagagtttgcgctgtgtgtgctgctcagtactaaatttcagactcatctgaccatgagggttttccactcttccattttcccccagatatcctcatctcttggtttttttttttttttttttttttttttgaaggttacaatgcttcttcagtctttattgcttttgtcctggagtctttggaagaggacagccagagatttttattgactttcttatggattggctcattttagtgtttttggtacaatttacttaagcgggggttaaggtctagagacacacaccacagaggttatgttcgcatctccacgtctcacaggtcacaatgtcaacatgatttactggtagtcttgtttcccgatggataatttcacattccctgtcttcaatgaagagagttgctttcatctattttatattggtttcagtgtactggcttatttcctacttccctttatatttctccctttttctggaaaattgtcctgtaagaatggaattgtacaaacatctgtgtttgtacacagccgggaggagaagctgacttatatgaaagcaagagtttttttttttttttattttttgtccttctgtgaccctaggggtgaggaaacacaggcatgaaggtgcaaccaaggagcttgtccccaggaggaaagagatggcctcgggcccaaggtcaggctttttggaccaggagaatgtttcaatgcttgagatcctgaagttgttgactcttgcctatttcataacccaccaagtctatcacagggctactcctgccaagcaatggatgtttggaggtcataagtcacaatgttgcaggaattggaatttaaaggaagagtttctggtctgtgcaatgtgaaaagcagatggtgaaaaatcaggggcttaggtgtaacctgtgaggaaatgtaacctgagcctttttctggtgaccacagatggcattttgaaggtagagccttacttgtgcctccagccatggaggttgcacatctaagcacacttgttagtgtgtgcatgtgcgtgtgcgtgtgcgtgcgtgtgtgtgtgtataggccagaagttaatattaggtgtgtccctgtatctctctcttccatattttttgaggcaggatctcttgctgaacctggagactctcatttcagttagtgcagttaatctgtccccaaggccaactgtccccagttacagatgcacactgcctccccagctttttacatgggagctgaaggttcaaactctgcttcttgtgcttgggtggtagggactttactcatagatccacctcctcaggccccggtggttgaacacactagtctctgtctcagccctggtggttgaacacactagtctccatctcaggccccggtggttgaacacactagtctctgtctcagccctggtggttgaacacactagtctctgtctcaggccccggtggttgaacacactagtctccgtctcaggccccggtggttgaacacactagtctctgtctcaggccctggtggttgaacacactagtctccgtctcaggccccggtggttgaacacactagtctccgtctcaggccctggtggttgaacacactagtctctgtctcagccctggtggttgaacacactagtctctgtctcaggccctggtggttgaacacactagtctctgtctcaggccccggtggttgaacacactagtctctgtctcaggccccggtggttgaacacactagtctctgtcttaggccccggtggttgaacacactagtctctgtctcaggccccggtggctgaacacactagtctctgtctcaggccccggtggctgaacacactagtctctgtaaaactcgtgtgttacacttgctgcctccaccagcccaacacttgctctgtggaacttcttcagatttgggtttatatactcctttatttttattctgagacaggacctcaggtttcccaggctgccctcagatttgccatgtagcagagactgagcttaaatccttctacctccatgccccgagtgagggattttcagtgcccaccatgcttagcattagtgtagtggttttttttttttttttctttctttcgtacacagtgacaaactatttcaagtttgaaaccaagcagcgtgacttattgggcgttggatacttttatgccgcatcatgcttcaggctccctagcctttcttactttgtcaccagagattgttgctgttcagaattggagttcagaaatctgagggcaatgaggtcatgcagccgtcacaggtcactgaccttttggggcagagctgagaccggggcttaaggaccctccctatcttggaattttgcttgcctggaaattctacctcatggctttcacagctgtgggagaacctgagccttccctcaccttaagtatttgtttcagtcgctattcctcagctcctttcttctgcgttcttggtatgttttaactcttttatattgccgctaactacagattcctcaggcgtcctctagccgatgccgtgaggcctggtttgttttctgccaaggtccttgtgggtgagtttgacacttgatattcaccaagggctgaacacactacagttgagtttattctggagagaggtcatcttggtcttggagaccatatttacagctcaggggaatttcttccttcaagttttcagtgaaccccaactccgatgtagtaatttgttgctcagagaactttggaaatttgcaatggattccaagccaacagctttataaatctgaattaggacctttaaacacgcttcactgggaagttacttggactgcaggtagcagtgtttgtgaaggtcatcgtgacaacctttgtctgtagcttatccactacaactaaactcctaattgatggctgaaatgagctaatacgagtttactttcttcagtgagactttagagaaggggtggtggtggtggattccaatgcctgtttcattcccctgtggagtacataggatttcagaaatctgtgcattttaaagtgccggagagatggtgtaggcttagaattttcaaagccaactttaataagcgttcttaaacactactacctcccttctagcccaccgatcgaagttaggggagaaagatggttaataggacaaaagggatgtggacctgtttagaagttgttctttggggcgattctgatctttgttgtcaggataccagcagtccagtctaaaacatcaaacacagaagcagcactccagtccaatcggcaaacacgaatcagtagcagcggctcgatctagaagaaaccatgaggcttggccgagccagcaggcatccaaggaagtggcaagaagtagctggaatagcacaagaagaagttcttttctctctatgaagtgacaacaagcaaagaccagggaagaccagcaaagtgttgtaagatgaaccaatgcaagagggtcatttactgtctattgggttatatttatactctttctaagcatcacacatcctctcatgcatctgcctcaagcaaagcattctctcacaagacagagtccagaaaaacatcacatgacacaaccgagtctcacttcaagatggctcagtgcttaagggtacgggatgctcccagggcctacatggttcctcacaaccatctgtaactccagttctaggggagccagtgtcctcttctgacgtcacaggcaccaggcacataggtggtgcacaaacacacaagcaggcaaatcatccatacacattaataaaataaaacaaataaatctaaagcacctagtcttcattagaaggagactcttgtggtttctgagtgataaggaaagaaaggacagattgaattgtgacatttagttaccccctttatgagtaagaagtgagaggctaacaagattgctctgtgagtaaaaaatcctggaggctcaaaggacagttagctaggagcacactgttgcagagacaagaaaaaccctgctccagctgaaggcaagaatgaatatctgaaggttgtcttctgacctccacatgtatgctatggcaggcacatcatcacccatagacacagttcatgcacaggtctgcacacacacacacacacacacacacacaccaataaataaattgtggtgtaagttcatatgccacaatttctcctgtcaaactgtgtgtgaggttattggtctaaactcttactaggtaccaaataaatatcattatctgagcattttaatagctaacactacaagttagaaacagtagagagttttgggagctggttcagcagttacgcacccttgtggaagacctgagttaggttcccagcactcaaatgggtggctcacaatcacttgtaactccagctccagagaatctgatacactctctggcctccctggcctatacaatatctgaataactaaaaatacatctttttttttctgtttttaaattttattttgtgtatgggagtgttgtactgcatgtatgtttctgtgtactatgtgtgtgcggtacctgcagaggccagaagagggcgatgctttcttggtgctgaagttactggtcgttgtgagccgctcagggtgggtgctggaacagattctgggtcctctgctagaggagccagtgctctgagatggtgctgagccatctctccaactccaaagcaagctttttttattttttaaaaaatgtgttaaatatggaaattctcaatgtcaagtgcttagaatagtttccatgtaagtaaggtggtggggctgaggatcttccatgctggagtgtcttgaagagagtcagcagagatctggaatgtgtagtctcatagtgtatcatgtgatagcattgctacactctagacaagttggatataaacgtaaatctcgaggagtttgtaatctaatgagggagataagagctgtattcaaatacttatacctcaaggtaggaagagataagggctaaataaaaagctatggcgaggtactgtgggtggatggaaatttaacttccggctttaagggcagccagcgcttcttagttaggttgtctaggaaggattgggtctgagttggaggggcgcctgggtttcaggcctatgattagcctttctatgaaggtaatttaggaacgatcattcctacctcgctcagaggacagctttccggagtatgtgcttctctcactactgttcctaagtggcaatgattggtgcacacagcaacatcctgatgccaccctgaaccgccgtgggttcagtgagcctctcttgagtgcaccagagatgaaagcaccaagctctgtcattgccatatatctggtctggagcaggtgattgtaagtgaaccaacaaatgattatgataaaagatctatccacaactaatatttacctactccttactgtatgccagttgattttctaactgctttatatcattaaattattaatattatctaacctaatgagtcatattttaataaaattttattagcctttgtaacggaaatccaaaaaccacaccttcaaaacaaacccaaaactggtccaattgttgtgtgacagacttttcctggggagacactgtatatatgtctactcaccccagagatgaaactcacaacagaccgaagtaacatatgcactaatgccctattcgaggaatcaatgcatttttattggggttactaacaggagtgtttccttagggttttactgctgtgaatagacaccatgaccaacgcaaatcatataaggacaacattcaattgaggctggcttacaagttcagagattcagtccattatcatcaaggcaggaatatggcagcatccaggcaggcatagtgcaggaggagcggagagttctacatcttcatctgaaggctactagcagaatactgacttccaggcagttaggatgatgatcttaaagcacatgcccacagtgacacacctactccaacaaggccacacctactccaacaaggccacacctactccaacaaggccacaccctctaatagtgcctctccttgggcccagcatattcaaaccatcaaaggagtatgggtgaaagattacttacaaggagtaggtataactcgaaagcaactacatctccagaaagctaaccccagtgggtgagctttgacagcatccttctctctggggtctggctgctcagagcctctttcctcagcaactattcaattccttttctaatgcagggagggccctaaagcctcgtccaggttcttagtctcttgggtacctgcagtttagtttatctactgtttttaccggaggctccgggagccaatgtttcaatttggagataatgttgcaattcagaggaataggccatatctcatcaatgacttatataggccaaaggtttatttatcttcctcttaatagctgctaggtgacaaagctgggacaagtttagttaaacactctccagagcccctctggacttaccatactagaggcatgtataacaagattcgttttggagctggagaaacagctcagtggttaaagatgctggctgcttttccagagaacctggattaggttcacagtaccctcaggtggcttgcaaccacctgtaactccagttctggcaaggtcaaaagaagatgctggagcctctggagctggagccacaggtggctgtgagctaatcaggcgctgggactgagcctggattttatgcaataacagcaagtgctgagctatatcctccagccccacagtaggcatattatgaaacgccgtgttggcccagttcttacattctttatagcatacataacagtatgtgcagtgggaggaagaatgccacatacctatttattattattttaaattttaattagtgtagtggctattcctggttgtcaacttgactatatttggaatgaactacaatccagaattggaaggctcaccagtgacccttatctggaggcttggagatagaagtttctgatctggatcttggtatggagatcttgaggcatagtggctatggattccagaagactaaatctccgagttcaaggtcatctgggattaaagggtgtggtggaacacacctttaatctgggctacactttctgctggagacaatataaggacattggaagaaggaagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaggaatagaaaccctgactaagacaattagtttctgagcatttcatacattgttcatactgtgtttacactgttttaaccctctctcttcctgcttcaacttcgtttgtgtccccactcacaaacctatgatctccttttccttaatcttgctgttcccctcccccatatgtttacctactgaacatcacttggggttgtagaaactattgggaacttgtcctggagaaaattactctctctgtctctgtctctgtctgtctgtctgtctctctctagccattatttgcttgtagttctttttctaggagtggggcctcgtgatagttccttcatccatttgacaggttagctggagttgttattatgctggtcttgttcagcttactacactgcggagtgttctggggtaccacttccctgctgtgtctacaagacactatggggcagcaggtgtcctggccctctggtttttgtaatctttctgctctcttgctgctgttttctccagtctcgaatgcattagttgcatcatggacatgttgttcgtattgtggatgtatcagttagttggcattaggtttttcaatgatttgttatggtttgaacacacgtgcgtctctgtgatggtctctgcctgttgcggaaagaagcttccttggtgaaggatgagagcaaaacttaactgtgagcgtaaggataagaattcagaatacagcgagaaattgccttaagaaaatgccagcagtaggttttctctagggtccgtggactctccagccattggcaattggctaggtttagagtaccagacatgagttccctcttattgaatgggactgaagtcaagctagacagttgttggttacccctagataaaagtgcaactgttaagtccttggggtgatgaccccagggtggtcattggctcgctttgtaggctcgtcatctaggtaggattattgatcatttttcttccctggtggcttgcacagcaccttctgataccgtgagagcttttcctcaaggaggaggaggcttccagatctgttcttgattctcccaagttctgtgtcataagtgtatggtctcttcagtagtagggtcttgtcttcaaattctgagaagcaatccaggacaatggcagtggcctgtgttgtttatcgagtctcttggattctttcaccccctacaaagtacgattttaagtggatataccgggctaggctggagctcctatatcttaaggtagtccttaaccttgggactccccaccctgagtcttaaaaagattcaaagtatggccttgtgtgtgaaggtcccatgcacctctttgaagctgcataatccttaacgattttccagttagtaagataaattttatgtgaaagattgatttacaaattgtgtattctagtgtattctagaagtcaactgccttcctccccaggtgttgatgcagtgacccagtggtttcaaggtctcctctgatcaggcgcttttgtttatagtctgtggttttcatggtaaatacagcaatttcagaagaaagcaaacagggctggcgaggcggtgatgtttgttttacaaatgcttggaattggttcggaagctgttctccagagaataaggtgcacaggaacgtctaaagctgccctcagccactgagatccagtctgagctggctgtggggtgtgggaaggtggttaaacttctctttgcagaggcccaacaacagtggaacactggaagaagataagacctggagaatgtcctgatcaggaatcacagatgggctgaaaatggcttcttaggggcagtgttttgtctgggaaggaggcgttgtttagtggcaaggctgtgggaagctgtccctggttgttgtaggtgcccttcataaagtgtgggcagctttctgctctcaggaagcctcctggataagcaacttgaactctgattgtatctgcataattaaatgctcagatgtgggaaatttgtggaagagcagtaaagagaattggttgtatggttgggttctgaaatgtgtctatagtcagagccaatgcagtccttcaaaaatcacattaaataacaaactaaacctgcctcatgactgtctgcggtagaaaaagcaaggtaaaacagcaataaactagagttgatgtttttcacgtaaaacagtaacaagaaggcctttaatgtctattgtgggttttatcttcatgtatgtgattatgcactctgtgtgtgtgtgtgtgtgtatgtgtgtcttccttagtatgtttgtgtgtgtgcagctgtctgggtgtctcccggccttatagttaaaataattcaaatttaatttttcttactatttctttgtgtatatgtgtgtgcacatgcatgtggacacatggtggcatgcgcgtggaggtcagaggacagccttgcggcattgtttctctccttcatctctgtggattcccgggatctaactcaggtgatcaggtttgggtcttagggtgtcaaacacctttacctggacttggagcttgattttcagctggactgagctggccagtgagtcccaggaatcctcctgtctcttgtttcctagccctgcgattagaagtgtgtgctgacgtgcctggctttctatttttttttttttttttttttttttaatgtgggtgctgagaatctgagctcaggctcttaggcttgcaagagttttactagctgaaccatcaccaaacccccacctcctaattcttggtctgtttttgtctctatgtatttgtccagcattatagacattaagcgcaaacctctactcacctactggcttgtgggtcctgagccagtgagctaggtggcttcctgctttgccctaatgtggaagatgggctgcagggctgcagggcttttcctaatatcctatgtgtctcttctttgcccttctcagaaagtctatcaaacagcccgggatccaagtagcttagaaatgctggctctactgatcaagctgttggtacttggaaagtagtcacatttgtcgagaaagcattagcaatcgagagagtttcctgcatatgccctgtatttgggacttgccggctcagtgaacagcagccaaatagcaggccatgcctaggtgacaggagtcataggcccagaacctggtctgggcacctctgtggcttctctgggtcttttgagaggagagtaagaaagatccacttctatttgtaataattctaaggcattattggctctcttggatcttattttcttgttcatacagtgtcttcagaagctacatgacacctctttgcctggtggttgtaactttaatactctcttcatagaggagaggaaggggggatgtgggcacttttgggggagcagaaacgattctcagaggaaatgatcaaggctgaagaccacacaacgttcctctggactgtggtatagggtttagttttcgttctcctgctcactgataaaagtttagtttgcagtttgagtaatgaagtttcagtcagagaactgaaggcagttacaatcccctagtgggtaccctcttcagttacctaagggcacacaccattgaagtctctttctctcctctctctctctctctctctctctctctctctctctctctctctctctctgtgcttaggaaaagaaggagtcaaagagggttgaggaatcaaggcaagaggaaggctggagtccatagttccaatatggcccaccaacttagcacagcacagcaccaatgagccctgactgagcctgaaatgttagattctcttgctctctctgctgtttgcttccctggctgggacttactgatggtggttcgcaatggaggttccacaccatgccctgcccatagccaccatctgcacatcttccacaattcctctgtcacccctcgttgctcttcagtctttgaaggaatgctgctacctgtttgtaagcttgagggcgacagtccacgtttcatttgtctagatttgcctgttgtttgtgaaacctgtttcaactttcttaggtaagatacaattttacaatagaatcctgccacagaatttaaatagcagctgccaagggagggcaacagttacaaatggctctttgccttcctttgaaagggagcctttctgtgaggaaatgccccgccttgccaccctgtctaatttacatggaaaaagagaagctcaggactcgtttgaatttggattccagtgcataaattagatccttgtcagacaaatgtgaagggacgactttggcatttctcagatgggacattttgccacgttagttatgtaatggatatggcccagttacctccacctggccacaagtggattcctccccccagcctccagcattcattgaacactttacttgtgatcacttcaatagacactgggttagctggagatgcagggagaatccacacttgtcttcgggacctcagtcctggaggagacccctgccagtttgtacccttcacagaggcaacataaactgctgcttgagagactatttaagttttgctgaatttctcttggcagcgaatagaagtgagaacaaatgcattattctatgaaactgaggtctgcttcttcctttcttctgggacatctcttctacacagccccctcttctggatttgttcctttcccaccaggatcatatccgtgtttcccgggtttttttgattctgagctctgtaggcttgggggcacatctcgggagccttgaccagtcaacccctaagtcctcatcccctagtcatctacctaagcagtactctatgcactcttctggggccgccctcccactgttgggcgtgaggacattgactgcaccttcacatagcacatgcagcttccttacagaagcgtctttcagacatggtggatggttctgtgtttacctctggcggcctgggcagtctcacagcattcttttttttttggggggggggttcttttttattgcatattttcttcatttacatttcaaatgctatcccaaaaagtccccttattacccccccccacacacacccccacccacccactcaactcccacttcttggccctggctttcccctgtactggggcatataaagtttgctagaccaagggtcctctcttcccaatgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngattttccatgtggttctgataattttatgtctgggttttggatgtttgaaacttcaggtatgaggtgatgttttaggcatttcaagcttggttgacctgagttgatggaagtttgttgtgaaaacacagagaagggatggaagctagaagccagtttggtcacactacctgggccttgtttgaggagtttggggctggtcctctggataccacagcaactattaaactcatccctgaagacatggttatctgctactttgaacttggggtacagtccttttttgactttttttaattgatgttctatcacaaaaaagtgagtgttatcttttcatgggtggggggacacgaacaaatacctatccaccccagagtgggcatcaaagagacagtcccacccaagcccaccatggtcaaccaatgagttcagtaggtttacttataggagcttgggtgaggagtgtgggtaaccaccccccccccaaaaaaagtgctgcaccactgcagagttcttattcatggctgcatctgcatagactcactgctctgaggtgaaccatctacccacagatacagtgtttcttaatctgtgggtcacgaccccttgggggatgaatgacccctttacatgaattgcctaaggttaatatctacgtatccaatatttacattatgattcacaacaatagcaaaattacacttacaaaatagcaaccaaaacagttttatggtttgggggagttaccacaacatgaagaacttcattaaaggggttgaagcattaggaaggttgagagccactgctctagcacctcccaacatcacgatacagtcgggagtggctgttacctcgggtgaggccctggggaaccttctgatcccatccgtgaggaaacatcaacaatcaacaggccggtcttgtaggtcatcgcagtgctgtgatggcaaaggcagtaattctcagataatggcacaccacagccaggagcatagtaggcacacagttatgctctgcacatgtgcccatagtgctgaactgtattcatttacaacatacacaaaagaattaacaatagaaacgtaaatgtagcataaattttctttctagaactttctttcacactctcctagaatgcacacactgcacacacttttttcagagccttatgtcatggtgtgtgctgtcattgtgactcagctgtttttgccgtttgggtgatgttagcaggctgtatggtcgtggacagataacctcatttagctcacttctaaagtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtggcccctgtgaagggtagttcagccctcagaggttgtggcccacaggttgaggaactgccgatttatggtgtctaccttctgttctgctgcaggattttgcttgctgccctggttctgtcggctttctttagaactctcaagtgtagacagagcatctatttatgcttgttggttgtgacagtaggttccattttctctggagtaatcctgacttttacctatggtcacaatgtagttgtggttcttgtgtcttggttgttcttcaagaccatcaggtagcatgggcccatgtggaaaggtgggctctgtgtgtgatgattccctcgttggtattgcatgcccaagagctggcttcctccttggtattgcatgctaaccctctacagatgatgtttcaatcagacatattgactataagaaaatgatgggcaggtagggctggtgagcaaggatcagagagatgtccagtttaagaggcagccatcttttagatgaggccagggcagtaggcttgtatagccaggttgtctgtctatccagagcgtaagagtgaaagtcaagaatgtattgaaattgaatttggtgatctaagcctctgtcgtgaagctcaacctcatgatgaatttttttcctgtgttgagaaaatcttctcttgttttgggtggtgctgctgtgtgcaaggttaaaccattgtttgtagcaatagttagaaataggtcttgttctatacgaggctatagagcagtggttctcaaccttcctcatgctgaaaccctttaaaacaattcctcatgttgaggtgaccccagactaaaccataaaatcatttccattgcttcctcataactgtaattttgctactgttatgaatcataatggaaatatttttggaaatagagatttgccaaaggtatcatgacccacaggttgagaaacactgctctagagagaggggaatcatttcttagtctcttgatgacttacttaagactcttgtgccttgtctggtgagctccctcaagttgtctccacttttttcatcctattgaacaaaagtcaatattgaacagtagaagtgaagattcttgagacaatgctgatatgtgaatcatgacatcatcctggggcagataattttaaattactcttctctttatgcagtcataggaaacacaggctgtaattaagaatagagcattaatgcttttgatatcttcattaaaatattaatttattgttcatgcaacgtgtgtgggggggcacgtgcatgctactgtgtgcatatgtgagatgttctctcgtctcaccatgtgggttctggggatcaaactcaagccaccaggctcatgctgcaaacacctttacccactgtgccacctcactggcccatgctttgttttcttttccttttaaattaattttaattagcacacaacatgataagtttcattatgacaatcccagatgaatagtgtactttgctcatattcagtcactctaatatttattttcttctttaatctggtcttactgtggcaggctgacctcaaactgcatttctcctgcatcagcctcttgagtgctaggataatatacatgagtcctannnnnnnnnnnnnnnnnnnnaaaatgttatcacaacaccaggtgcttctgatgagttttatcagataggcagggagagagcaacagttgggttaagttcctggatccaaagacttacatgaagctaggagaactggctaagcgttatcaaaccaagaggactcagctgagaggacagaggggctcaagctctgtgagggctttattaaccaagaggcctgataaaattataatgagttttcaatctttacttattttttgagacagggcctcttatgttattttggctgacttggagcttactacgtaaatcaagccatacttgaacacacagaggtctgtctgcttctgccttcccaatgatgggattaaagtgtgtgccaccacacttagcctgtgagatttgagatgcctactatgaaattttaaaaggctaaaaaagttttagattatatttattcattttgtgcatgtgtacacatacgccatggcatacatgggggtgggggcggggacaggggacaattgaagagagttggctttcttcttccaccatgtgggacttgaactcagggcctcacatttggcagcacccactgaaccatctccacagctcttgactgttaaggaagtctggggtaatccactggggactccttcatactgcagtgagctgttattttattccttagtaaaaccttgcttgccttccccacaaaaggacccatttacccatgagcatgaattattactactacctatgctagacaaacagctctgtaattgtgagggattttccatgtggttctgataattttatgtctgggttttggatgtttgaaacttcaggtatgaggtgatgttttaggcatttcaagcttggttgacctgagttgatggaagtttgttgtgaaaacacagagaagggatggaagctagaagccagtttggtcacactacctgggccttgtttgaggagtttggggctggtcctctgggataccacagcaactattaaactcatccctgaagacatggttatctgctactttgaacttggggtacagtccttttttgactttttttaattgatgttnnnnnnnnnnnnnnnnnnnncgtgcatgctactgtgtgcatatgtgagatgttctctcgtctcaccatgtgggttctggggatcaaactcaagccaccaggctcatgctgcaaacacctttacccactgtgccacctcactggcccatgctttgttttcttttccttttaaattaattttaattagcacacaacatgataagtttcattatgacaatcccagatgaatagtgtactttgctcatattcagtcactctaatatttattttcttctttaatctggtcttactgtggcaggctgacctcaaactgcatttctcctgcatcagcctcttgagtgctaggataatatacatgagtcctatacctgaaaggcttttggttttaatctatcattcataacattagccagaattgttaatattgaaaaaaataaccacaaactagcagatgttaatcccagcatttcttttttttgagatagcaagacttttattcctaaagtgaatgcagtatttgattgtgctgccctacagaagtgatctaacccagcgcaggccagagacggttccctcttgagattcaggagcagagccaagccagtgcttgagctcagtggtaaagcatttgcccaacatgcacggggccctgggttcagatcccagcccggtttgacgggcggtttgacggcactgccggacatcttacatcacgttacgagcagcagctttccgtagagctttataggggataatcctgagtgactgtggttttggattacggtcattttaagctttctcacttgaacatgttaaagccaatgctaacaaatcacaagctcactgaacttagcgtgcgtttggactgcatctccacattgcagggcaaagagtaacccatagaataccccacagtaactcaagagaggctggggagcaggctcagggctgaagtgcttgctaggtgagtaaggactggaattcaatcccttgtaacttgtaactctgttgctagggaggtggagaaaggctattcctggagctcggtggtcagcttgtctagcagaatctgcaaaccctaggccagtgtctcaaaaatcaaagtgtattgtgatcaaagagtgacagctgaggttgacctccacacgcctgtacacacatgtgcatctgcacacatgtaaacttaagcagtcagcctgtatactgctggatagaggcttcatcagtcatacatatatacatgtatacatacgtacatatatacatacatacacatatacacaatacatgtatacacatacacacatacacacatatacattacatatacatacattatatgcatatacattatatacacatacataatatacatatacatacatgtacacatgtgtgtgtttgtcttacagccagactctagtaatgaatttaatttcttttagttcttcacatacatgccaaaggtgtgtattagatcctcctccttcatactctgtatttctgtatttgagtttcatctgtttctgtggtttcagcagtctcttggctggtggaggctgagggtcaccttgtacctgttttatctgctttgtcatgagtctcatgatcctggtcatgtgtgtcatgatcctagtcatgtgtgtcatggtccccaggaactcagaagccagatgagcttctcagtctcccccgcagtatgtcactcatgggtttctgaatccattagcggttttaacaacttataaaacccaactcattcagataccaagaatggccagggtggttgtaagtgcggaaggaaggtctgcctcccgtgggaaacggaacatcctgtggacagggttctgcagacaggagaggagtcattatttgaaagcgtttgggaaaagctggtgtagaggcatcctcctgaagtttaggtgggaatgattgttaacaaggagagagagagaattcctttgttatagttttagaagattaaagtttagtagtgagtgtttgtgaaaggaacagttcctctagttttgaagatggaaggacctatgttggtagaaggatggtaagacagttcttatgatggagtgacctgctaaagacccattgaaaggaatgagtcatgggtttgaacagagagtcttttgaaaaaaggggtaatgaaggaatatcatgaaggcgatgacgggacatggacactcagcaaaggggtgtgacttagaattgcattcaataggaaatatcaaatcagtgttggaagagactgacccagcagtctcagagccagaaggtataagggatggggctgagctaagtagagaccttgtcccataagccatcagtgtccaacagcaggtaggagatgagaaatggagcctaacttctcatagaacttggctagagtttacagcattggcgtgcacagtgtaaagaagaaaagatacaaagatggttagggttaactatatcaagttactaaaatttctaaagtctacagatgcagtagttgatgtgttttttttttttttgttttttgttttttttgacattgagacctggtgggaatggattaactacttctgaaaatagttaatttcaccagtgagaaaccaacaacaccggaggtcatggttacagcagatcacaccttgcttttttttttttttttatccttctgcacacgtttattgggagagcttgattgtagaggcgaaagacttcgagcccagaactagtgctgcttttataggcctaggaggggcgtgtctcacacccggattggttatgcactaagcctcatttgcatgttcctcatctgattggttatactctcagtacctgacagaacctcattatcatacctcatttgcatgtctcacatctgattggttatactctcagtaccttacagaacctcattatcatgcctgggtcaggcagtgtctttgcaaaaaactttactgcatatgtacacattggttgtttgtccaatcttatgtgtggtggccagcagtagtcagtgccactcagcaacggcacatgtggcttcccacatctccccctgtttgttttaataaaatgaggctggactaggcctgtgcaattatgcccatccgccgtggctcctgttttagttcgttcctctaatgtcacagccttacccgtcatagggtaaccctatcgccaccgggccccatgtcttaggttggactgtgcacgaggaaagttgcccgtctctggatacctcaagtgctgtgtgacaataactgctaaatgacctagggcgaactctgcaaaagaggccagccaaaaaatgaattagtggggaatcatgatcatcctattgatgagcaagggctgatcaatgatcgttgagtctctctcatcccatctcatgctgactaattcttgagcatagataaccaaatttcaggggaggagccgttttcaatagctaaaagtgcctgagttataatcaccttgtcacgtttttgttgggttctgaatttgcataccaaccagagcatgaacaccagtccacagcatatggcagcaccaaacaaaatcactcccacccattctttaaagtaagaaaaagcagaggtaagccaagaggtaaagtctccaagggtcactggttccactctggtcccattaaggttcaggatctgcatctgcagcctcgtctgcaacctttccagctcctgcgaccaattccccttcaggtaattcgataggtctgtacttttaataaaagaattattaatatacctattgggagtaatgcatacatgcgatgtggatgccacacaactcatttgtatgacatccatcatctgttccatgtcatgttgtaaaatatccactctcgattcactaacattaaccctgaggtgatatgagaatccaccctttgcagggtaagcaatgcttcagacgttttttctgctatctgacttatagtgtcagcagtattaatttgatctgcccaattagagataatctttttcttaaaaatatacagggtgtaaaaggtttatccacattatgcacaaagcataatgtataatttaaatgaaaactagtactcttatacacccgtggctcttgaggagtttgttgtgcataaggcacatccaaaaaacattcctttgcaaaaaacaaaggctaggtagaagaattggaatgtaccggtaaaggtactggccatgatcttactatggcccataaaggtatacttatcctggtttcaatcatcaggagcaggagaatcatcttggggttcatcttgctctttcagggtccttgtcagtcgtgtcgggacccaaagtggattttcttcaccctgtggaaaaacacaaatagctccccgggatctgattaagataggatccgggccataccatttattatcaaggacatttttccatttgaccatttcattgggcgattgaggccattgtccatgcctttcagctggtgatcttccagcatcatctaattttagaaaattaagagtaaatattgcaagggatagaaccatctttggcgtcatagcctctatttcccctttctgtttttgcaaatattgtttcagagtgcggtgggctctctcaatgatgccttggccctgtggattatagggcaatccagtaatatgttttacttgcatttgtttgcaaaattggcttaatttagaagaagtatatgcaggaccattatctnnnnnnnnnnnnnnnnnnnnnnnnnnnttatctgtctttaacactaggggcttgccccatgcagcccaagcctctaagcagtgaggatatgacatgaactgctttttcccctgtcaagggagaggcatgtaggacaccagaactggtatcgatggatacatgtacatattataatttcccaaaagatgggatatgcgtgacgtccatttgccaaacatctaggggtcgcaatccgcgaggattaacacccacggaaggtgcattaataaattctacacatttaccacactgtaggacaatatctcctaataatttttgaaaatcatttagtgtctttagatgatcttttcttatactaatcttttgtggggtgacacaccgtaaagtaatagtggctcctagaaaatgactaacattagactgctgtaccttttctggtgcaataatcaagccattattttttaaagtttcattaagcaagccataagcttgctgtatactttcttcttctggtccacctgataacactgtgtctcctttctttttcctttttctttttaagcccttctcctctcccgacatactttctcgttgctctgtaaggattttctgacctgtcttgactgcctctacacacagtttcaaacagtaacagagtccatatatcagaacaaacaagaccaaaactatcagacctacccacacagggtcaatgggagaaaaaagcataactcatgaaccttaacttgtcccaaagccgggaaccttatcgtctcaatcctttctttccttctcttctctctttcccttttctctttccttttttccctttcctttcccttttcctttcctttactatttccttttctttatcactgattccttttatttttcttcccttttctttttcttaaaaaacatatcctcctttaacctggggatcaatttgggagacttaccggtatcaccgttcctcagctgaagagctctgaatccacgccggatccttctcagcagtctgttttgcaggaacacttcattatcaccgttccccagctgaagagttctgaatccactccggatccttctcagcagtctgttttatgggaacctttattaactgctccttccccatgatgcagttctgaatcctccctgtagcaagggggcttcgctcgtgcctgaagatgtttcttgtcccgggttttcggcaccacttcttgcgcgcgctcgactggccaggaagaacgacgctgcaacaggatccttctgcacacgtttattgggagagcttgattgtagaggcgaaagaccagatcacaccttgcgatggagaacataaagccttatgtggctatgatatatgcagagagatataccatctggcctggtagcagagcaaatgatgctattgaaagtaagaggaagagaaggaggaggaggaagaaggagggatggaaagggtaggggagaaaaagagagatacaagacctatgaggaagcaagaaggaaaattttaatcaattacttttcttttgtaattttaatgcctgcttttgtgtataactgagcctcagatacaataacaagtcctcgtgtggtgcttacctgatttgaagactgaccgttcctcagatagtttggccctaattgccaattgctgctttgatttacctggatatttgataaggtatatttctgtgtttcttcagaagagggtcttgaggcatcttttgcttactgtgataattgtttttatgtaaccactcagagaattagagccaaattaataaggaagctaaacaaaataacactctttaacacacacacacacacacacacacacacacacacacacacacatgccctttctcccccacctccccagccttgagctctctggagagaaggcagatttatgcagcaaggcataattttgcaacatctagtttggtgtcatcacaggacaccccctttctctcattcatgtgcgtttgattggacagcataacttagttgtgaatgacccccctccatgtgctttgtagcaaatgtgggggtctgccaagtcaagtctgtgtgctcttggcaagctaggggcaacaccactggctaagtgacacatcccacagacaaggatcctaaggagtcatcggtactgtttccacagaggcacccacgatgccaggatccacagcaatgcaagaagcagtttccagctttcaggagtcggtttgtcagggtggtcccctctcatcttctgcgcacggacacagggtcttcctgagctctgcagagaacacagcttctctctgaaagtgggactcaggcagagagtgagctcattctgcagactgcccatttgcatgcacagtgcagcagtcttcagagaagcagctcttggagccatggcagagcgctcctgtgtgggggtgcacagtgtgcatctgtgtgtgtgtgtgtgtgtgtgtgtgtgtgtgtgtgcatactcatgcatacatgcaagagcacgagtgcataatgtgtgcatatgtgtgtacaatgtgattgtgtgtgcacagtgaatattcacagcgtgcttgcatgtgtgtgttcatagagggtgtgcagtgtatatgcatgtagtgtggtatgtgtgtgtgtgttgtaagaatattgcattttgagctttttacccacttgggatgaatggggtgaactttttacccacttggggttacctgattaggtttatgaatttgagatgcacgtgatctagttggagagttaagaatcaacgtagaaaataaggaccaacagaacagtttatgtctatagataactagtatatacagcagggaagaagggaattcctgtgtggtcatgtagtcaggaaacctcttcaaagagtagaaaatggcagttatttaacatctgcactctttgtaactggattgaaatttgggttatgagtgaggtgccctgtagagctgcggatgctttctgttaattgtttctggggggaaaaggtcttctgccccacccttccctttctttctccttctaaaatgacatatttctgtgttgtcatcatctgtctccttctttctgtctctctttctctcttggtctctctctgtctctctttctgtctctgtcactctgtctctgtcaatctctctctccttccctccctcttcctgtctgtctcctttcctcgccctctcctttgccctctccctcattctcaccctcaccctctcccaacttttttgagacagcatctcattctatctcagactcattttgaactcactatgtagtgcagactggactcaaactcatgacaatccttggccttgatttgccttaatcacaggtgtgtcaccaggtgggcatggggtctggatgcaggtgctgtaatcataggtgtgtcaccaggtgtacctggggtctggatgcaggtgctgtagtcacaggtgtggtcacaggtgtgtcaccaggtgggcatggggtctggatgcaggtcttcacactgctggcccctgagaccctccctaagctagccggcctcccagccatgatcaggccagctactagcttcccctggccacgccaggtggcttctgttaagggcgctcatctggaagactccctttaggggccttcatggtctgctcatctcagagaagtaactctgcctcctcccttgggcttctgttcaaatattcccatccctcttcaacctctctcctggccaggaccctggtcacctggcactatcttcctgtgcaccacccaccatactatctgacaaatgtccagcacctattaggtgctcagtgaatgttttgagtattttctgttttatggcacagtagctttcactgtcccagaacacactctgtagaccaggctggcctcaaactcagagatcctgcctcggttggaattaaaggcatgtaccaccatttccagcttgactgtccatgaataaccgaattaaagatccagagttactcatccatgaatatggagtgtaattgtaacagtctttggttcaatttaaagactttagcataaataaggattatattttattataaatgggaagtaaagaatatactcatagtatttggtgctgccaatggagtctattcacaatttgcctaaaataaacaaaaaacaataaaagataatgctgtgaatgcaggtttggtttggaggtgcacacttacaatcccagtgtagaggaggtagagacaagacagcaagttctatggtaacagtttctagagagtgaggctttttcacacacacacacacacacgcgcgcgcacacacacacacacacacacacacacacacgacaataatgctataaatcaaaaaattccttttcttctgaaaattcaatgaaggccagggagatgactcagtggataaatagcaagaggctcaaagacctgagttcagatccccagaacctaggtaaaaagtcaggcaggtgtggcagctgcctgtcgttccatcactggggaggtagagcaggaaattccctgggaagctggctagctgaaccagctggaaccagccaactcgagttcagctgagacttgcttcaacagataatgtagcgagcaaccaggaaagacactgatgtcaacttcaggcctctacatgaacatgcacatacatgcacatttagccacactcacacgtgtgcccactgataggcaagcatgtacatgcatgatgaatcacagccaacaaacctcatatatcttacttttaaacttacgagtatgacactgagacattgctgtgtggagtgtatttgtgtatgttaacagtgcctctctcctgtgggagaggatgtatccagcctgctgccgggttcctcggcctcctgtgtttgtggactgctgttagagacacttgggaccatacacatagcctttgtgacagaaatcttccacttcagtgcagttcccaaggctcactcacactatcgtctgacccagtaccttatccttttacaacagaacgtggcttggtgtgtacacagagctcgttgattcacctcggctctgcagccaatgtgagagctaggctaccggagacattcacgtgcaggtagcagcttctcttggctcaggtgtgagcgtaggagtgaaagtgtgtctcactcaggctgttgcttatagcagtagctcacttttaaaaatcactttttggggaggagtacagattgaacacatgccaggcaaccagaccacagtcattcgccaaccactccatcgtcatgcagtaactaccccgctgtcacgtggcaaccaccccactgtcacgtggcaatcagcctgccgtcatgaggcaaccagcatgcacttcctcagtccgttttgtgtttattttcttattttcatttttaatttcgaggctgctatgctgactgctcaggttggccttgaacttgctctgtattaaggtttcgaaacagggtctccctttgcagtccagcttagccttgaactcttgaaagtcctggctcagcttctgaggtgctgtggtaacagtataccctgacaccccaagcacttacacttttattaaatgaatattgcatgacactcaactgcagagttcctgggaaagggacatgcgtataatagaccacctagaaaattaaacaaagccttcctaaatgtggtgtgtacatttttacaggtgcatggtcactgtctatagtgttgattcacaataattcctttcggttcccttctgttccttgactgtactcacctgtaattccttcccctccccctcccactaacccctcaccttcctcctcccctccctctccccctcccactgggctctttccttatccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcccctcccccacccactgacccctctccttccccctccactcccctctcccccttcctctggcccctcttcttccccctcctttctgctttcatatcatgtctccatacttcattttatgtttctatgtaaaatccaggacccacaagtaagagaaaatacatgatatttgtctttctgggcttggctaatcttttttaataatttgatgctgggaagatggctccatgggtaaaggtgcttgctgagaaagccggctgacctgagctcagtcctggaaccatgtagacctgggaggagagaactgactctacatgtgtgccacaacacttgtgcccttgcccaaacaataataaagaagtgatttattaattaacaatttatcattattattaaaattaaaatttaattttgaattgacagttttaaccatcagttcaagatagcctatagtcactggaaaggaatctcaattttgaagggttgttcagatcagcttggcctgtgggcatatctgtagggggttgtcctgattgttaatagatgtaagaggacctagtccacagtgggtggcaccattccctgggcagatggtcctgggctgtgtaaggaagccagctaagcatcattccttcatggtttctgttttaggaccctgcttgaattccttctgtgacatctctaatgatgggccgtaacctgtgagcgaaaataaaccctttccttccctaagttgcttttggtcatggtgtttatcagttacagagaggaactaagaacacaacgtgttccaggctgtgttccaggctgttcatctatccaaataaagctacatggtgaccccagcttctaatttacttcatgctgtgtttaggaaaagttatctcaggaggcttagccagatttacctgctacaccccagggagtgtcttatcagccaatcatcgaatactttggaaagctacccaggacagggaagtctctagatcctgtgaggcatcacctggcaaccataaacaaaacagcgagaggagagcctatagcctcaaagcatgtctactattcagtcattttaagtgttgatagctagacagtggagcagtgatcaaggcagtcactctcttgccgtgaggaccgtgaggaaagctcctccgtacctttcgtggtccgtccttgtgcccatcccagttccagctaatcactgtctttctgagggtgtcatattgttcatgtgtctggcatctttcactgagcataacatctttggaggccacttcaggttcttgtatatgttatgattttctcatattctggctgagtactattccagtgtttggaaacactagtatatctggtattttaaatttgggccatttcttttgctttctcttcttccggctattataactaagctgactaacatctgagtacagagctccgtaggatgtgcttcttttgggtcgacactttgaatgggataactgtatcatggaagcagacgttaacctttaaagagactaccaagatggtttccaaggagcccatgtcaccagtgcaccggatccaaccgttcacatctttaccagcacattgctttggcatttgcgttcattttggctattgtggtttcagtaacattctctaatgaccagggccactggatattatcccccctctcgtgtgtgtgtgtgtgtgtgtgtgtgtgtgtgtgttgaaaggtatatgtcacagcatgtgtgtataggtcagaagagaatttgtgggagttgttttccctttctactaagtggctcaggatttaacccaggtcatcaggctgcaaggtaaaggccactttgccagtcctgagcttgtgtgtcttgatattggtttttgttatttttttaattatttgtaggtgtgcatgtgtgcatgagggaatgtgcatgtgtgtgcaggcacccttggaggccagagtgtggggtgctgaggagcctgagttacaggtggttgactgcaacctgttgcaggtgctggggactgaacgtgggtcctctggaaaagcagcagatgctctgagctactgtgccacctctccacatcttctcagtgtcttttaaaatgctttttggctttctatatcttgtgtgtgtgaagaatggatgtccaaatctcagtagattttgtcttttattgaattagaatagtactgtgtatattattcataggtgcagaacacctatgaaatatgtgctttattattttttttgctaagttttgtcaagaaaatattcaagttctttatagttttaaatttaaaatatgaagaacatattcttgtccaaataaaatggtacatgcttcagggacagtttacaatcatggaagggtgagaagagacataaagagaaaattcagagattaaaaaaagagaaattcaggggacagagtgatctaatattgcagaaggaggaatctgactaggaaagatggaaaccaagaggtatggacagaacaggagcctgagaaacagagcaggaggaaaaggacaaaagttaaagctggggctgggaaacatgaagttcccccacggtcccttgctctccttacactgttcactgcatgtgcagctcgcctcagctgctctcctcccctcagctgctctccttctctcagctgctctcctcctctgagctgtcctcacctcccctcagctgtcctctccttccctcagctgctctcctcctctcagctgctctcctctcctcagctgctctccttctctcagctgctctcctcctctcagctgtcctctccttcctcagctgctctcctcctctaggctgctctcctccccttagctgctgttctcctccaagttgctctcctcctctcagctgctctcctctcctcagctgtcctctcctcccctcaactgtcctctcctctcttcacctgctctcttatcttcagctgttctctccttacctgctcactcctcagcttccctttctcctcagctgctctttcttcagcttcccactccttaggactagcctgctttgcagaagtccctccttcccacccacatgccattactgttccccaccaacatacaaaacagccggttgcatttgttctgtctttagcacacaaagacacagctggtgatgttactggtgtgggtttgaatcttagctgtaccactatccacttagctgtggcagggcagactttgatctttaaaatgacagcagctatgacatcttctaaaacatctccatagattaaagaattgatgccgagatttttattggtattagcacacagtgcttagtcatgagctgtcacagaagctgttgggtgttgggggagggcggttttgactatgccttccatctttggctctctgctcatctagtctggaagctcatcaccctgccttagagacccatgacacaaacacaactgtatttgctcatctgcaaggcaaagttgggactaataataatgagtactggcattacctgagctgtgagcattttaacctcgtgccgaaacatactgcgtggcagaaaaagcttcctggttccggaacgctgacaactcaaagcaattgggtttagtaaatacgatggaggtgggtgagctgtgcccttctcccctcaacccctcagaactctggctgacacaggaccccttctgcccggcccttgtctttccttgcctcagcacgacgagtgaaagtttacgtgtctgtgtgattcacagcttttgctttttccagttgttggcaaggttccctcacactgaactaagttttgctttgatcctggatcaatatggggagataaattctctctctctctctgctttaaacctgtagctgctcatttctgtgaaacgtgtttatgaacctctctccatctcctctctataatgcaacgttttctggtttttcctgcatttctccagatacccattgtccttgtgtcctgacatctgcagccccagtgcaagcccctttcttgggaagccacttaaaacgtggctcccagaacggtatccctttcccttctgtgaggtcccattcattccagctctcaatggtggtcttggcttttcagcaactacagtactgtgtctgtgaattatacttgggacgatcatatacatgccattcacactcggccactggggaaggagaaggggcaaggtttaccaccaggcgtgggcagcggagcaaagcagtgacatcttaggcttacgctggtgacatcttggatatacagggaagtatgatcaatcactatattagttgtctattgttgagatacaataccccagactccaaacttataaagaaaagaggcttagttagcttccactctctggggtgtaagagtgtggtaccaatacacgtttggttggttgaggactccttttgctatgtcacgtcacagtgatgacagaatacagagaggaaggaagtcagaggctaggaggaacatcctgctcttctgtaacaatcacggcctgagaatcaagcaagcttccaccagaattgccttatttcccctctgagcgagcatgaaggtgacctaattgtctcccactgaactccaccttttgaaggtctcaccaaccgtgagcccaggcaagccatatccaaccacagagtcactctatgtatgctagctttgcattttaaaaactggtcacttgtattcaccccctcctgcactctgtgttgtgtttgggaggttggggttttttttctgatggtggttgagcttcagtctcaacacacttcaccttctgtgagacaggctttagaggtaaaatgggaacagatcctcaactacttcctactgttgggctctagaatgtctcagaagagcaaggacaggcatctgaggatgccttctcaggaagcggcatggcattcattccctttgcagaaaacgtctgagcatctttacattgcagacagtaggtgctaagtgcaggctcgcatgcagaggcgcaggttaacaaaggcaacggctgacaggcactgctgtaggaaaggtcaggctgaaaacgggaggagtcatcgttttaaagctttattgatctttatcttttcccatcttctattactatcgatgaagaaattgcctacaagggcccctccccaaaaaccacacaagaaaatgcttaccaaatgtctgtaagccaagtccgagggaagtgagtgtgtagcctgcgatctctgctcagggaggatgggttttaggaaaatgattcaagaactgatatacataaatcaacatggtaataatagcctctggtctaaatctttaattaaaaaaacccatcgcggaatatttcttgccaagtagcatctgtgtgacagagatatggagcttgcagagctgcacggtgtttatccccctggagctcagttcactgctcccctcccaggggagcccttcctcaaaacccgctgctgcctcccctgaacccgtgtgctacgctggtgccctcagggagcaaaaccctgtgcataagaaagagatgatcctggatcccacccatggccaccactgcagattcttggctctcctctggttaacaccatcacagagcagctgctcgaaggccaggaccatggacaaccaccgcacagcagcctaggcaaaggagtgactggactcctttggatgggatagaaaaggcctgactgaatgggatgggagcaggaagaggaaagaggagagggaggtagcagttactgttttgagaaatgcattcacgcacgccgacctgtacacacgttgcaatggagcgtctagggaagctagaagatgggaaaagttagatcatcttttgcattttaacttaagtcactatacaaagatctaaattttatgtttttttttcaggactaaatacaatgattctctataaaattataaaaatggctttggaaagagacggccatgggttaaacactaaaactaattttgagactttaagattaatcggtaaaatgttctgagttcctgtttccacacttataaagctagcgcatcctggggctatcagctcgactgtcaggcatttatttgctgggcaggtgcaaggctatggtttaatcttcatacagccagaaagcaataataaacctgtgagggaagctagcattcatgaataatacatacataataccatgtgcgcatcccctgatgtatgtgggttggtatagaaataaatgtttcttttctttccttcctttcttccttcctttctttctttctttctttctttctttctttctttctttctttctttctctctctctctttctctctctctctccccttccctccnnnnnnnnnnnnnnnnnnnntccctccctccctccctccctctctctctctctctctctctctctctttctttttttctttctttctttctttctttctttctttctttctttctttctttctttctttctctctttcttccgagacagggtttctctgtgtagccctggctgtcctggaactcactctgtagaccaggctggcctcaaactcagaaatccgcctgcctctgcttcccgagtgctgggattaaaggtgtgcaccaccatgcctggctgaaataagtatttctgtttgatttttgtcatagaaaatttatatatatgtgtgtgtgtgtgtgtgtgtacacataagaacatcatattgtaagtatatttttatatgtatctagtttatatgtatgcatataaattcagttccctttcttctcactcggctcttatgtttaatgaaatttagaaatgtatatttgattcctgaaatgaattcatccattacaatttaatcgtcagtgtgaacaggacacatccagataaactaattgaaaaaaaaatacttcctttttttttggatagcgaatgccgcttacccactgaagtgatctgttgagtgctggaccccaaacataaaccagactgtaaatgatccataatgtgcttaaatttgtttctcttccagatacaaatggagctttgttcctgagtatttacttgttaacatttaaatcaggaaactaatctcaaggagaataagactttgtaacattctcattgatgtgtttgcacttattttattaaatatacattaataaaattttcctgaaatactattcatccatttcttttgatgtaacataagtactgtgtgtgcgtgcatgcacttgtgtgtgtgtgtacatatctgtcaatatatcacatagttatttatctgaaagttgtttgtgttgcatggcttcagtaggatggatgagaagccatttcttgttgtctggccagtatttttccactgtctgtgcttgctggccacattcaggccttgctgtttaattgaacaatcacctctattgtggtgacaatagacctgggtcttgctgtgatgatgaggtacaagctgaagtgcagaactcagaaggattcagggcttgtggtagaagctagttccaactggttctgagtgaccttgggatgcacaggtagaattaagaacaatactcaccgtcaacatgaataacatatggttgctttgatccatcagctatctatgaaattggatttggagactcttggttcaaattccagaccaatttcttagccacactttgtgtgtataagaacactgttttcatcttcgtaaccctgactatctctcaaggctggagggtgaagaggaaatggcttttgttgccagtaatactcttcactacagtgtttgctaatacccagcaaatcgaagggacgaagagtaatgtctttaccatcaaggtctatgctatagtttggatctttaatggcccccaagacctgtgtggaaggctttatccccaggctgtggctctattgtggactagagagtccaacagtggggcctagtagaagttaggtacctggtctaccatggaggggcagttggtgctccatctccttcttgcccttctctttgcttgctgtctatgatgaggttagtggttccgcccttcacacagtcccactgtggtttcctgtggcaccacagatccaagtgcagcagaacttgcagttgttaactgacttgactacctcaggcattgtgtcacagtgatggaaagacacctagcataccctgtcatttgcccagggactcacaaatcctatgtgtggttgaacttgtgtcacgtgttctaatctagagtcttatcagcaaagatcttgacagctcacaccctgagttttagctcctttatctcagagaacataaggttggattttatctgagtcttcttggaggtttaacactgcagtgttgcacagcctagagctatgaaagacagcttttcttcccttcagtgatgagtatatggctgtccacagggaggagattgctgtgttcatggatggtggtccacactgtactttgatgaactttaatgtttgttaacataggccagacatttctgatggcctttgtaacctctctaggcaaggccaaggtcgaagtttggtttgacattccatgctggagcattctctctctctctctctctctctctctctctctctctctctctctctctcaacttctcaacattaagagtttgatgtagacagtacatttccaaatgagtttcttagtctgaaacataggcagagctacacctgttgcatactgtccccacagtcaagcctgagattaattgctgtcgtgtaccggcccttgttttcctgtctcctacctgaaggagtcttctaacagctttgtctgtcagtcactgggaaagaccactggtctccactgcatcctcttgtaaagaggagaagaactttcccagagcctcacccttgagtctgtccacatgcagggagtgaaagtctcgggcagcaactctctctaagtcagcatgagctcattttacaagtcagcatggaagggcattaggtggatatccaccttgccgaatggcagcttgcaggtggtttaatacgttctgcctcacttgcatcttaatctttaagcaggaggagacatgagaaaacatgacttctctttactcttggccaagacagtgagatttagacactggccttgaccagagtgctgaaggtggtttctgggaggcagagacagcctcagaggcaaatattttagggatacaaagagcaacacttcaaacttgagcaggtggctaccagacgtggaggtataggctattgtacggctaggtttgcagggcctcacccagtgtggagtttctgctacacactattgagaggtttcaagggtcttccctccacaagtgtttgaaatgagtttgaagtgagtgcctctggttgcttcatttccttccagggtaattagaaaagaggtcctgatgttgtgtttcctctgacactgcatggtgaaccccccagtcttgctggatgactaatgtgtccagagatgccttgttcctacagagcgttggcctctgaggtgaaggttaaacttgtcaaggaattaaactcaaatcacttccttttgtttgtgcttcccatgactgtttcatgaagcaaacttttccttttcctttgttttaaaacttttttttgttgttgagccttagcatgatgaagaggccattgtctagttacaaagtggctctgagggagtttctgactggagagtccctttcaagttgagagaatgagcagatgtagaaagctaacttcagttttgttttgggttttgagacagggtcgcatgctgtagcctaggctaggctcaaagccatggcaggtcttctgcctcagactctcaagtacttggattacaggtgtgagtcaccaccagctttttagcaagctaactgtaacagcagggttggaaaggtctgggtgagtctgaactagctgagttctgcaagcagggaaaagtgggcctgttggaggtgccactcacactggtattgtgacagagcctgagtcatactgtacttacaatacaatggaaagtgtctcccctgttcaatgctgttctgttacagagacttcacgaattttatacaaaaacacactggaacgtctcccaccgaaaggtcgaacgtgttgttcattgcacactcttggggtgttgttcagtttgaacctatgatcgctttttgctgcttgctgagggcttagtcagctctgagagaaggaggcaacattaatcatactgcctcacatttatgacaggctttcaagttcacagagagattttatcttcttgtccatctcagcagccccgtgaagtaggtgtggccggcattattaacactttcattaggcagtaaacttagaactggacaaaacatccgactagcccacgattagtatgtatattctaacattccccctgaagaagacaaagcgagaaaactaaccacacataagctccactccccagctttttccacagttgtttgacggatggtccgtcgatccaaactgtcttgcagtcctaattctcatgctttatttactaacttataaaatgaaatgttacctgtaggagattcccaggagcagttgactaaagccctgctgtgaaagggattttgcaataggaggctttgcctgtcaggcaggatgggtggaagcttgttcatctggcccacttcacccctcccttcccctgtttgcagccccgaagccacaaggctactgggcattggtcccgttcattctagtgtagagccttaccaagtctgaccgcagtggttcaaggcatttgtgctcatctttccatctcctgctctcttcaccttttgagttctgtcaaagcttgaagctcattgaaagctctgcattttccatgggttgtggtggtacacctgagcccatggcctctccctgcaggtctggacctcagccaaacacttggtttgcacatcccagccaaggtcctaggcttcgtgcactggagcgtcttgcacagctgctggctctgctgcagtgaccttgcatcccccttctgtgtttgtttcctccctgggaagccttttctgacatctgccgcatgcgtctgctgcatgtgtctgctgcatgcgactttattcaacatctccagaccccaccatggaaaactttacagagggtttcctaagggtgggacctcagttgtagcgctctggctggactcctgtggggaatacagtaagcaaggttggatgtttggtgtttcctaaccacttgagccacatacttggtcctcactgctgtctgcatagacatttttctggcttcccaaagaagccatttcaaaggagtggcattggagtgttctggtatttacaaaaaagtatttttggggtcagaagtccccttcctgatgtactactataggaatctgtagcaaatgagagacctgttgctcctcttttagcaaatgattgagtcgaggagggcgggccgtggatcacagggctctgctctgggagagcatcgatttgcgatttgcggttttgttgtaccgagacggtgaagtttggtcactgcctcatatttgttgaaagagtctacagcattaactcacagatgttctttcagagttgtgctttataactctgtataaccctctttgtagtcactagtgtgtaggaaataatttctgagccatgtagggatacactgccaacgataacatgtctcaactgtagcctttggtcttccccagcaagtgccaggtacttttgagtcacattgaagctgcgatggtcttccagcctgcgttagcagtttgatgatgtctgttttctgctccgtataaactatcaattttgggctggggttatatgttagtggagctatagcttagtgcctggctagcattcaatcctgagccctgccagatcaaataaacaaacatttgttgttattagtatattttttaaaaacttactgattttttgtgaatttcacatcatgcacccccttccccctccccttgtatctgccccctgcccttgcaacctcccctcaaaagaaaacacacacacacacacacacacacacacacactaataaaaataagacagagcatagaaaacatctcctgtggaagctgtagtgtgtcacagtgtgtccagcagtgtgtccctctgtccacacatcttcaattgtgaatgttcattgcaatgagtcttgggtctggttcaaggtctctggcttctgtgaccccaccaacattatcagatcctcactgggactcctttgggttattctgttcttgtccagtgtcatggagacccttcagttttggatcagcaggactggcattttcacctgtcccaacagttcacagataacacagattttgccgtgggccaactaagagccctggatctaggcctgggtgttggttgagccggtcagcccactggttctcccttatccgtaccaccagggggagctctacagcacagctctaactaggccacccaatgtcaccatcatcaggaggcagggtcagcttttctgctgccctcaaggccagctcacctgaacccatgcctccaaagtcagcttcactaggctgcccaatcaaggcatggagcccactctcccaagtgctgcagtctgtgaggggctgggccagttctgcacagatcctggaagtacacatggtcctggttggccgcccaacccagggacttccccatggtctctagtgttaatatgtgcgtccaaaccccggctgccacatagccactgacccagacaaggccttcagagcagcagcacaggccaggacgtcaccagggcctcaggcgggattgggggcgtggcttgtgtctccagttctatcccctttacagtgctgaaactgctgtcctctctctctctctctctctctctctctctctctctctctctctctctctctctctctctctctccaccacatgcttgtatattgtagtggcacccgctgcagactgggtgacctactctgtgttgcctggcctcaagagggtcttaggtttcgacagcctgcccaggaggcatggcggtaggtgggactatggagagctcttctcccccagggagtcctgtggaggcaggcaagtctctgggactctctccctgcctacaccccatggcttggcagtgggagggtctctggacatctttctcctcccgtgctactgttgtgtggtggcaggcagggctctgtgtgtctacaggccttcctgtagtgcagtagagggcatctttctctgcatgatggtcagcaggtctctgaatgtctcctgattttacttttagcctccactgccatcagcacagccttgggatactgtgatgatctccttgtcactgaccctagcacagcagccagaggtctcagcccgacgcactctgtgtgtgtgtgtgtgtgtgtgtgagagagagagatagagatagagagagatagagagagacagacagacagacagacagagacagagacagagacggagacagagagaagaagtgcgcagttagtgagcagtacctgtggaagccaggaggaggcatcagatcttctagaactggagttacatataggctgtgagtcataggtccagtgggagtgctgagagccaaacgctggtcctctggaagagcaggaagtgcacttaaccaccaagccacctaaattacgaattaatttttgtatatgaaaatagggcaattgatagaatttgtggggtaaaggtgctctctgcgaggcctgatgacatgagtcagatttctggaacttacaaggtggaaggagagacccaacccccacaagttgtcctctggccttcacagcatccccaccaataaataaataatagatagataaaaataaatagattctttgtgtatatattaagattattatatttcctggttttctattttttttaattttaaaaaaatttttaattatgccaggcagtggtggcacacgactttaatcccagtactttggaggcagaggcaaacagattttcgagtttgaggtcagcctggtctgcagagtgagttccaggacagccaaggctacacagagaaaccctgtttcgaaaaacaaacaaacaaacaaacaaacaatttttagtcatactcgttgtctttgtcagtgttccattgctgcacaactacagtaattcttataaaagaaagcttttaactggggctagcttacagtttcagaggcttagtccaggatccttgtggtaagggctgtatcttatatgtgcatgcctggtgggtgaccaagaagctcggaagagggtgctggttcctcaaagttggggttacagttaatcattccccaccatgtacttgaacctgggtcctctgcaagagcaacaagtactcttaaccactgagccatttttccagctacgttttaaagtactgagtatgtgtgagtatgagtatgtatgtgtgtgtgtgtgtgtgtgtgtgtgtatgtgtgtgagtgatgtgtgagactgtatgtgtgtgctgagtatgtgagagtgtatgtgtgtgtgaatgtatatgtgtgtgagtgtatatgtgagagtatatatgtgtatatgagtttgtgtgagtgtattgtgagagtgtgtgtgtatgtatgcctgtgtgagatatgtctgtgtgtatgagtgtgtgagagtgtatgtatgtgagcgtgtgtgagtgtgtgtatatgtggagtgtatatatgagagtatatgtgtgagtgtatagtgttatgagtgtgtgtatgagagtgtatgtgtatatgtgagtgtgtgtgagtatatgtgtgtgtgtgtatgtgtgtgtaagaaatatggagacaatgttgggtctggtttcacttattgctctcttatctgtgatgtcaggattaactagaatgtcattgtcgcctggctgggatcctggtcagtgtgagtggaggaagggctgagcagccatcctgtggctgaaagagctctgccattgcagcaggaagggcacctatggccctgcagaccatgggcgctgacctctattttttgttgaagtcacctcataattctgtgacaccagctgtgtctggagagctgcgagccggctcttcccgctaggaggagtcactgctgagctcttctgcttttgaggggtctccgccgtgctcacctgtggtcatgagttccagcctgcgtgtttatttggtctttggaatcagaactacagtctcggcttctgttttgttcggtgttgttccttcctattacaccgactttcaggtttccaccctgcgttcagcccaggtatctggagcctggagggaaccctgtggctgtcatggttgtgtggttgttatttcttgcaacaactaccctgagcatggagaagggttagggttaaggagtcacagtataggcgcagacaaggcatcgttttcatctggccttgaactcactattccactgcctcggcctcctgagtataggatggtcacatttggcttcactgttcacgttccaagatcaagtacctcctgtcagttgagaaacacctcactggtgaggggtggtggctgtgcccaaaatcctagcactgacaaggaaaaggcaggaggatcaggaaatcaaggtcacccttgtctacatagtaagagggaggctagcctgggctatgtgaggacactgtctcaaaagcccgaagccaactaagaattgccttctatcacactgcactgctttcctcgtgagttcactagccagagtgttccacagaaccctgatgagggaaggtctgctttaatgagatgtaaataggtatgtgaagaggatgttgtggagtgagttgctcagagaatgactgacacgacctctgcatggcctcccagatgctgagataccaacactccaaaccagccttgcaaagggtctagagagcgctgggagccctagttatcactctgtctgttgtttccccagactgcctgttcaaggtgtgccctatgaatcgatactctgcccagaagcaatactggaaagccaagcaggcgaaacaggggaaccatacagaggctgccctgctgaagaagctccaggtaagcgcaccatcttcctcctgcggcaggcaggagagccagcagagtcgtcagagagttcagatagaccgaggtgaggtgcacaggcaggtcctttcagttgtgactttttaaggtgtgccagactaattgtaagcttctcaccaaactgaaaacgaattactccgactagtaaatcgaatcatattttattccaccaagtacttatttttttttcctaatggactatggagaatataaaggatttttctttttcttttttggtttggctgagtatgaacttgccctatatcacttaaaagccaggcactctcagaattggaagctgtgctttgaggttttaattcacccagtttttaaatagtttcatgttacacagtaaaaaattcctagttccacagagccttctacttaaatgaaactcacagtatagaaacaaatggcccaagacaggtctggctgaattcagcatagtgtggtatatggggcagcggcatctgggtgctcttagtaacagaaaacttccttgctgggtgtggtggttggtgcctgtctctaatcccagcatttgggaggcagaggcaggtggatctctgagttcaagactagcctggtctacagagtaagttccaggacagcttgggttacatagagaaactctgttttgaactctcctctccctgcaaagtgtgtgaagttgccaccttgtattataatcatttaacccttgcctctccccggctctgctcctcagggatgcagtcagtctgacttactcttgttattgagaatgctttgtaagccatccttgctgcttgctgtgtttccaccctgaacactcggttgctctcttgtagcatgcagcagagctggaacaaaaacagaatgagtcggagaacaggaaacttttgggagaaatcgtgaaatacagcaacgttatccaagtaagtctccattttgtcatcaagaggaaagtagtttgcaggtgacttgtgaaatcacccacgtggcagtgtgccagtatctgaggtgccatgcttgttctttggtggggatggtaattagtatgacattttcagtaaacatccattgcaccatgtatgtattgaatatgtcttgcaccaggcccccaagcccagaacatagggaatccattcagtgacaagacaagactgtgccaaaaggatttctaaggcccgtgagaagcagctctttagagggttgggctgcagctagatattggcgatgtctctttccctaggtggatgagaaggttttcaagttgtacacgtaacaggaagtcttcaattgactttcagtgttcactgtcagttcatgcacaaaccttgatttatctttgctgcattccgttctcctgtttcatttggatctttctggctttttttttttttttttttttttaatttgctagtaagtgccacaccttattccaaaaagaatgtgagaccttttccaagaaacacagcaccctgggagatgaaggcccagtcattgaagaggccctgggtagctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaacctgtttggaaagtttggtaaacccccagcccagagcatttcagctgctgcttggccaccaggaatgacccccaccactgccccggtgtgtgtgtgtgtgggttctgcagcatagctcccatttagagtctagaaacacagccattcccagaagtgagaccaggaaagtgtttctcttgtgtgcttataaagacgatgctgtttaaaatggtaaacaacggcctcacaggttccttacagtaatcgccacaatgaggtactttataagtctgctttaaagaacaatgtctcctgatgttttgtcctggaccaatggcaatgtgccagagggcagggctaaagctgttcccccacagggcaggatgggcctcggactcttgaatgtgagacctcatttagtgatagagagtgaaagcttggcagggctacatacgcccgagtagtcttccagagagtgtctcttcatagagttttggtgacttacttgagcttcttctcaagtacttcaagtacaaatgtctgtcttctcagcccagggccatataggttcatactcaggcttgagtgtgtgtgtgtgtgtgtgagtgtgtgtgtgtgtgtgtgtgtgtgtgtgtgtgtgagtgtccatgagtgagtgcatgagttgtgtttgtgtgagtgtgcatgtgtgagtatgcatgtgtgagtgtgcatgtgtgagtgtgaatgtgagtgcacgtgagtgtgcatgagtgtgatcgtacatgagtgtgtgcttgtgtatgtgagtatgcatgtgcatgagtttagtgtgtgaatgtgcatgtttgtgtgagtatgtgtgcatgagtgtgtgtatatacgaatgtgtgagtgtattgtgagtatgcatgtacatgagtgtgagggtgcgtgtgtgcatgagtgtgagggtgtgtttgtgtggatgtgtgtgagtatgcacaagtatggagtgtgtgagtgtgtgagagtgtgcgcgtgagcgtgcatgagtgtctgtgtgtgtaagcctggggtcagccttgtctcagttgttccttaggagctgtcccaccttgttttggggacaggatctctcataggcctggaactagttgattcagctaggctgactgccaggagcccacggatctgcctcccctgtgctgggataacaagtgtgtgtcacctcgtcctcatttctattttgactttttaacttgaggggactgaactaatgcttgtaaaggcaacacttgatcagctgagctatttcccagactcatgggtctttgtgcctttattgggacaaaaagaaccaagggtagtgtgttgaattttgcaaaaagatgatttttttttcaattaaagatttcccttttactctgaaattactccagcctcatcttgtgggtactaaaatgacctctctcttttgaaagattaaagtagatggggagtttattttatcttcatgtttctgttcagtaaggttatatgtagggaaaactctgtccatagcacctgtggagatgagagaggcgagagctgtttgttctgtatgcatctgacaactgggaggtcagtggctccctgctgactctgttgatgccacagagcaggagttaatgctgtctgtgtgcagaagtgcttagacacacaggtagacgcacattctctcaggttttctttagtggattctgcttttgtggttgtacaagtgttggtaatgagtgggatctgggggaccctccaggtcattttgggaagcccggttttagtttgttatgtcttagtagaagaagatgccttcagcatcccctggtgtatctgcctcacaccagtcagcatcacccttagagcagaactcagggtagaggcgagaagcagctcggaaagtgggtgcttgttgagccttgggaataggtcgcctgtttagttttcaccgtaagccgtggtgtgcagatttagggctataactactgaggagaccgtggatacaatcactaatatacatccctcctcccgcagctgctgcacataaaaagcaacaagtacctgacggtgaacaagaggttacctgccttgctggagaagaatgccatgcgagtgtcactggatgctgcagggaacgaaggctcctggttctacatccatccgttctggaagctgagaagcgagggtgataatgtacgtgtgtgcaaagccaagagggaaacaaacatcgtgtgatgttcttagagaacatatcaggaagtacacacagagatgggaaatgcagtcttcagccagttaattcttaacgaattaaggcagcatacgaagtaatgggttacattgcattttttgcacacattttgcgttagcatttttaaaactaggctaaatgcattggtttacagtttacaccatgctcagaaatcacaggccagatatcagctcaagttagaggcatctccaggcagagtgtgtgaagtcttttcaaagaggcaggttattcttttgcttagtcaagattgagcttgcttgcaaggaagaggaccgcggtgcctcctggccttcggaatgaacaggggaacaacgagagtcatgacaaagctccgttcagtgtcttcacagccaactccttacagtgttgtcatggtgtgcagcatctgagggagggactgtggcatgctctcgttgttgttgatgcctgcagagtgggttgtgcagagtggtgtcatgactgcttacatcagcagttctcagccttcccagcgctgagaccctcgcatacagtgtctcttgttgtggtgaccccaaccataaaattatttttgttgttacttcatcactataattttgtgactttatgaatagtgatgcaaacatctgtgttttccaatggttccaaaggagtcatgatccacaggttgagaaccatgggcttaggtcttctctgctattttgtagagggggtggggggagtgaaataattccataggaacaatagtttcatcttatttttttttttgagacagatctcactgtattcctgtccgacctagcatttggtatgtggtttaggctgacatctaacttgcattgatcctcctgcctcagtactagtttacgggctgctggaattacaggtgtgcaccaccacatctggctaaaagttcgatatttttgtgatagtccttagcacttggaagatactcaaaaaaggctggttcataaaataaaattccttacaaaggccacatgagcaatattgccatgtgagatagttaaagtgactggcatgaaaataaaattctctgtcagagttttcacagtcaaccctttggttacatctttagtgtgctttgaggtattttgtgtgtttgaaatgtcttctttttctagagaattttaaagtgtgaattcaattccacaggacatgggcgccgtgatttaattgggttaataagttttctggtgatgtcttccttaggtaaggcttgctatgcatggcatgcaggaatgtgtcagattccttggaaagtcagtgctcccctcccccatatagttgatctgtgcagagtgcatgctacatctttactctgagtgtgtatggttagttacaatcaactctcaattaaaatgcagtttgtgaactgcagccatagaggatacctttccttctagtgctgtatccaaccctgcaaccccctcgttaccatctatgaaaactaaagagcaaaccaaaggaattgtaagctcaaaccactaaagaataagatggcatgctggaatgggcctctcagctttttagttagctgtggtctcctttctcttcctctcccagcttggaagcctcttgatggtatcggtagagagttgaatgtaaccaactgctaagacaattagtttcagtagaaacaaagtctttcacggaagcctgtttttttgtggccacccacaatgcgttaagttgctcttatctggattcgctccacgtagcccagctgtaggtcttccatcatgctgcttgctgaaatagtcactgcgtctgttcacctccatgtagctttgtgtgtgatgaaggttgtggaagaaggctggcatgcccacagccccatatcagctgcacatggacttgtatcacaactctcactctctctttgctagaataggcagcattttgaaacatcaacctactgtagtttgctgaaggcagttgcaaatactatctctttgaatggtttgatcacgactgagtttctgcagaggtatattaaataaagagggaatctctatgtttagagggattttttaaattgcagtctactatttagcaacgcgtgaggtagcgatttaggtcatgcacattcaacaagcagacctctgagctcaagcggagggtgatgcagataccagcctgagtccaggctgttggttgtactaagtgcacgaggctgcactccataggaacgcacagtttggggaaaacacttacaggctccctcacactccaccatacacaaagtccttggctgctgctaagttaccagaaaaagcatgagggacacccatgaatggaaacagcaatgtttcattcccacttatcctcttcacgtttgagtagttactttttcattttcaatcttgacctaagcagacaagggtcctttaagccgatggtagactgcaaggtgtgaagaggtgggattgctttttaagtcagtagaaaagcctagagcttagggagagattctatctagcaagcggactttgctgttttacacagcgatgcgcccgacatcttttgcagaggtggaacaagggtgctggcattctgactcccattttgaggttcttcttattgtcccaggtaccacttcaaagcagggacagccggctacaggtggcaccacagcttgaatgtggcatagccgttacgtcgcccaacagatgcttcagggatttcagtttctttgctaagatatgctagagtgccaaggtggctgactgtaagatgtaaaataaaatgccctcatcctccagttatgtgccaaatagacagcttcttagacagcaccctgatccttcagtacttcaggtctggagcctcactcccctgagaataattccagtgtatctcgtaatgtgggctgagactgtgggctgtttcttagacacatttgtgttcttcctagcccctcttaactaaagatctctaaaacaaagatttccttatctttattttctgtacacgagtgtctgcctgcattcatgtttggaaggtcggacaaggaccagagaccagccccacaagcagcaggttcttgtcccacaaacccaagggcagtctttctgtgtctgattagtgaacctgaggcttctctgacatactcagatctccagatagttcggggcaacacaactcctcaacattatctactcagggtcacatgacactggaagtgtgaacgagtgttttggtctaaggaacatggagatgccctggcttccagtggttttcttagttacagatcaaactaatctataactgttctaatatgcaactggtgtgaaatacgcaaagggaagggttttgattttgcttcagagtggggaagccccacgtgtggtagcagagatggcataagaaccatcctctaaagaaatctagcagtgcacgtctctctagtcactagatcacaccactactgccactaagaaaagggaactttaattgcctcaaactgagttagatgcaagtaagtagacattgtcatgattgcacagacaaatgtaaacatagaattggtatttaacgctttcccctggaaccctgacaattaagaaccacaggctcctacagttcttgttttggacatatcaaattagagggacccaaaggctccaggccagacgcagaataaatattttataaagtcttgccttgctttatatttcctgaatacagaagaggacatgatgcttcataattctgagattaggggatgatcggttaaccagacttgccttttagcggggaggagacactgatcttgttctctgctgccccgttgaaattctaaagagcgtcttggcagccgcctttaatatgtctgctgcaaggttttgtgggaggaaactaacccaattatggcttctgaggaatccggctgacatggggaccaatgaggaatgggactggaccaccttcactggacaggttttggcagggcaccagaggatgcgactgtatgcatcagtgtgtgtttgaacatgcttctcagggagaagagtcaagctgtagaagatgacagccggggaggcaggttgctggtgaggcttgctgggaagtttttagccccacagagcatcagagtgtgtttctgattcctagatcgtcgtaggagataaagtcgttctgatgcctgtaaatgctgggcagcccctgcatgccagcaacgtggagctcttggacaacccaggctgcaaagaggtgaatccaattgggaaaggaaggaggggcagttatggagcttctctagagggagggagggaggaagagaggggaaagagggaaagacagaaaggagaaggagggaaggaagagcacacagagggggagggatagaagaagaggaaaagggagagggatagaaggagggagggagatggtgatctttctagattctctcgagtaccaccttagtggccttagaatccctatggcatctgtaggtactagctgttattcgaacaatcctttgaagatgcttttatggaggccgacactttgttgtctacagttgcttcttttcctgtttgaaatggtgatttctggtacagaatatagagtctactgtcttacgtctttaacactcttttttccatccctaggtgaatgctgttaattgtaacactagctggaaaatcactttattcatgaaattcagttcctatcgagaggatgtattaaagggggtaagtacctctccacacagatctccatgctcgcatttcactgagtaccagtccctggtattctgaaatgtgcacacagtcattccaggaaagtcgctgacctggagtgccagaaagggactgcagcacctctggtccccgtggctgttggaaggacagcgtttctttgcctgtctctctagggtgatgttgtgagactctttcatgcggaacaagagaaatttctgacctgtgatgactatgagaaaaaacagcacattttccttcggacgaccttgcgtcaatcagcaacttcggccactagttctaaagcactctgggaaatagaggtgtgtacttttttgaaggggtggtggtggtagtggtggcacttttactaaatatttagataaaaagataaagatacactaggcggtttgtttttgctgttatgggcaacactgatggcacgtccctgacatggaatggcttttgtgaattaacatttatttcttaatggcggtgaccaacttgagaggaatttgccacaatggaacccttcataaagcagaataaataaatcaaggggttgaaaagggaaaaaagttccattgtgaattcgccattgttgatcagactggaagccgtgtgcttctgtagtactgtctgagccacggcagaaactcacctcatcactacagagaacagtgcatactttttctttgaatgctattgaaatcaagagactcctagttaagaatgttattcaccagattgagacaagaggacagccacaagtttgaaaccagccaggtctccaaagcaagtttcaggctagccagagatgcgtgccaagactcagtgacagagaaagagaatgtttgatttctgaaagatttcactaattaaacatggcagtatggataagatgtggctttttgtttaaggaactattccaaacaatggaggaaataagacatacatagtccctgtgaacaagccagttctgagatctaannnnnnnnnnnnnnnnnnnnnnnnnnnnnnnnnnnnnnnnnnnngccattcttctctccctgtctctttcatacagctgccactctgtatcttacactggcctcaaatttggagtgatcctccagcttcagcctcatgcagaaataaatcacagctggctttcactccttgagttgaagccatatgttttgcaatggtttcggtagtgacctaacataaaattgacaggtttttggggttaaaaccagaatgaaatacttgcactgtagcagaagaactaaaataaatgtcatcacatttcacatttaatgactaatgtttctatctgtcctactccactttctgttgctgtgataaaatgaaaagcaacttgggaaggaagagaacgttggtttggctctcagttccaggtcacattctatcccctagggaaggcagggaggaagggaactctaatgggaacttgaggcagaagccatggaggcatgctgcttgctggctcactggggcctatgctcagcctgctcttatataaagtccagtgttcctgcagaggggatggtgctgcctatggtgggctgtgccttcttatgtcaatgagcaatccaggagatccccacaacgtgtctgttggccaatctgatgtaggcagttcctgaattgagggccctcttcccaggtgaatctaggttgtgtcaagttgacagtaaaagctaggtagcatagcattcatttttagcattttttttagcaaacttgtttgcaccctgtctcagagaggactagcacaaggtggtcagagggtgtgctgctcaagtacaggcaaaagagagtgccaaggtaggcatgagacctgcaaggtcgggagtaagggagccagtaacagagcaagctaagttgctcttgacaaaagtataagaaaataattgtcattaaagtagagagtaataggaaaatcagacacggaacaggcaaggaagtaaggtccacatacaactcccagaaagggtttcatgcagcctgtgcgcgcctggctttgatgctggtgttttgctcagacttttccaattctgtggcctagtgatggtatgcattaggcagagtctcattttgtagcccaggctggcctgggactcactgtgcagcacaaggtgaccttgaacatttgggccgtcctgtctctcatcatcccaagcactgggatttcacttgtgagccactatcccctgacagaacattgtattaagacagcatttacaggtgtgaggcatgggcacccacaagtgaggtgtggtatgtttcttgctctctgatggaaagtttatgtttcttctacattgttatatatgatggcttcggccacacagcagggtactctggatgttgactcttgctgactgacatgtagataccatttggtcactagactctccttctctttaggtggttcaccacgatccatgccgcggaggtgcgggacagtggaacagcctgttcaggtttaagcatcttgcaactgggaactacttagctgcagaggtgaggcctggacactgtgctgttagtctctctctttctctctttctgaaataatgaataaggaaacccctttctgcaaaagtcattgtcgtgtcagggccagtttatataactcagtttttgcctatgataattctgggttggtagttttgttatttttcttgttgttttgataatatacccagaaagaagcagatcaagtgggaaaagaattctttcagctcatggctgtaaggtatagcgcatcatgacgaagtctgggcagcaggaacttgaagcagccagtctatggtagggggcagagacttaaatgctggtcctcagcctgctttctccttcttaatgcaggctaaggtcccagcctaggggatgatgctgcctacagtggccaagtctttctacctcagccttctcgggctgaccccctacctgtgtgctcagagacccttctctcagctgatgctagagctcaccaagttgcccactgcaacccaccgtcactgttagatcacgaattactatggttttgtttgtatatgcaatgtgtgtttttatgtgttcatatatgtatgtggaggatggatatgcatgtgggtgtttgtgtatggagtctatcggtcagcctcatgtatctctgctcaggagtccatccaccttggattttgagacaggatctctcactgtgctagctgatgaggtcaggctggtcagctagggaccatgcctttacctttctagacctggggctataagcatgtgcaaccacccagccttttctcccctgtgtgggctctgaggatcagactcaggcccttatctttgcaaaggtgggggggagcacgttattggcagagctctttctccagctctgacacgggagttatttttaagatgaaaacattagtcaaagacttgaaaatccaaacaactaccacaggggctggggatatagctcagtggcagagaacctgctaacatgcgcagcaagccctggctccaaccccagcatggcggcagaagctggcaaaggaggcccatggaacggaacaggcagctggtttgcttatgtatgtggcttggtttagaatgttctgtgtggtttcacttttcccacatctgtgtgttatagacatggttgtttccttctggtgctgtgtagctcaggtggtgtcaggctcacattctttatccatcccatcatgagcagcagctggcgtttatggctcgcactaaggagagggaagggactcctcctcatgtgaattcagcttgctttcaaacaaggaagtgtgtggggtccaatggctgatccgttgcatggatatgtttgtgtttggaaggttattctggaagattgaaggggagttgacaggagcagaaatgtagctcagggcttgtctgtgaactggaagagggtgggcagttatctttgaagctaaggaatgttgttgaatttgcatttaaagaagagtatttggaactgatctgtccggtgtggtagctttgagctatctgttaactaccaaagtgaatgtggtatagtgtttgcacattaagcatcccacatggggtgtcccagatggggacacttctgtcacctaaagcaagtgccagtgggcaggggtgactgcatctgttgtggagtccctggaagagatggagccattggcaggagacagggaagacaccactgagcaatcctgaggaccaaggggggcatcctggtgatggcaggtagacagagcttgaagatgtctgcaggtggcagaaaccaacaggagcccattcatagcacaggcaaaaggatttcagctttgcaggattgtcgaggacagtggcccacctggagaaactgatagaagtgccacattgatcaataaagtaattcagttaattattaactaattagcttaggtgttcttcaaaagaggcacggtcccttgattgccacaccagcgctccccttagtttattatgtttaatttgggtaattagaacatatccaggtatcagagttgatggccccaggcttctcagcatttaggagtttggggatcgagcatggctgatagagaagattttgatctcatcggcacaaatgatctcagcagaagtgcgagagggtgacgagggtgacgtgtttagacacgaacctcccaggagcctgggagccattaccaggagtcagggcagaatttcacaaggtttggaggggggatggggagcatggggttggggtgggggagggggcactggtgcacaggtcagggtgtagccaagtggcttcatgcagagttcttatggggatcccagcagtagggggagcaggctgagttctcacagcctgcccttcccagggagaagcaaaactcataaaagggaacccaaaggcccgggtgatgctttgtataacatttgttcaaaaatcaggctggggattgtccttttattgcaggaagggaagcacccagcaggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatgatctctttctttctcttttttatgaatgtgttttagacattcctgatcaaaacagatgacctaatccttagctgcttttgagtttatggttatttacagtggcagagagagcctagagttgtacaaagaaaagactatgccccccccacccccacccccgctttgaccatggcctcctggccaccaaacgctatgtatttaacctctcttggaatctgagtttccttgtgtgtggtcaaggcgatcatatatgtcatatggggttgtgctaggagtaaagaagacaggagtgtgcagcacagctcttgtgtgcacaagagtctaggaaactcgtactttccctcttggagataggaaggagagggtggagaacagcaccctgttcccactagcatcagggagcttgtagccagctattggctctgtcacagtgtttatgtgtttgtccctctgtctgtgcattgtatgtatgtctgtcagtgattgtcttgttcttcataatgtaccctacccagctctcccctggggggtggggaggaatgtctcacactgtaaccaatatttggtgtttcgttgttaagtatcagtgtgtatgtgtgtgtgtgtgtttctctgtgtgtgtgtgtgttattgaggcttgaagccagagccctggctgtgtgaggcgggcactctgctaatgaactatacctccatgtctagtttccgctaaatgacagactggctttgactcactaggtagcccaggctaggcttgaactcgtgaccatcctatctccaccttgcaggtagctgggattgtaggtatgcgccagcagggtctgcttgttcttgggatatccaggagggagaaagtggaacagggcagcttagttagtacacctgcctctttgggaaggaaaatctgcaaggctttgacataggaagtgctgtctccaggagacaccaaacatgtcagatcctgtgcacagccacacatggacacaggccgatagcactctgtggtttgagccaactgctatacagggaataccctgagccagctcggtaaagtggtgagcccaggtctaggagaagctgggaggctgacactgtcagccttgcctctatcacagtgtgcagttgcttatgtgtctgtccctctgtctgtgcgttgtgtgtacgtctgtcagtgactgtcttgttcttcataagggagggcccctacccagctccacagtgtggagagtgtctcactgaatctgtgtttactagatgcggtggctgagtggagaggagctacggcagctgcaaacccaggagtttctgttcacagaaaaggggatctagtgtcagagagtctgtgttttccttaaagttaaaataaacaacccttaaacaaaacccaattataacaaccagagctggccttgaactgctgtactgatgcagtctgccagaggttctgacagtatctgcagatgtttgattgacacagttgtgagagggactggacatcaagaatggctagcacagagggctaccttctcctccctgacagaattatctagtccaaaacacagaggccaagaagccttgatcctcactaatctgaaatttcgaggtcacttactgaatgcctactatgtggaagcgctgacctggtttggtgctgggggcacaggtgttaaggtgtggttactgtcctcaggttcctgcggtccccatgggaaccatgtaacacaccactgagctgcgggctcttaccgtttgatggcttccatcatgcatcagtgcacatgctaaaaccagtaaatttaaagaaggcaactttaaactaagaacagaaaagagaaagaaaccctacagtgttatgatcacagttcccagacacaacccgttaaaccagcattcagctatgaagttaagtcattcagaagaacacgatgagcttatgattgttgtagaaacagagtccaaggcaagcagagcacttcctgtggggcttcagcaggcgattgtgcaccgagcatgcgcagtggggcttctgcaagcgcttgtacaccgagcatgcgcagtggggcttcagcaagcgattgtacaccgagcatgcacagttgtaagccactgaagaccaggctctacattatggtgaatgtagaaagcatcaacgcttaggacagcactggaggatacacgtgggttttattctgcaaaaccatgagtagccgaggttaaaagatgcccttcctcagcatgaggagactcgccacacagtgttagaagatgcagattaactttccagaaacatagagggccagaaaaccagggttgaaatgtagaaataagcatttaattacagaacgggtaattcagacatttggactttatgtgatttcagacttgtcacctgtctctctgtaatgtcacttccttgggacacatgagttaggcagtcaaggtgaaggtggcagatgcggactgtacaactgtgcagacgctgtgacttagagaccttaagttcaggaccgtgcctgtgggagagaaaacaacgtcatctgaggaacggctaacacagccttggaaccaatcctgccccgtgggaagggcaacactcgggcatctctgctccccattcactgcttcagacatttccacactgtggagctcagtcactaaagcaacaacttggtatttctttccaaagcaagacaaagcaaagaatgtaaaataattttgttaaagatttcacatggcctttggcttggcaagccagggtctcattttgtttggactcgaacttgctatttttcagagactggctttgaactcctgatactcctgcctcaccttccaagtgcgtgccgccacacctggctgtcatatttccttctagagtagcttacttgggagttggggagagctcagtgaataagctgcttgccttgaaagcacggggtccttgccattcgggacttacctgagaagggccaggcttgggggcctgtgcttgtaatcctaccattgggtaaatggagacaggctctgtggccagccagcctagcccatcaggagggctctaagccagtgaaatacagtgtcaattaaaaaaagaagtgagtgatgtacaccacacacacacacacacacacacacacacacacaccccagtgaagaaaatgggctcgcttatttgtttgtaactaggtcaagcatccgctagatggcactaaacccctacttcctaactccaatactcctaggaacagttaataaaaaaaaccactaaagtgctggaagaggacagtcttggcgtcccatgctctgagagtgaggaggcaggaggccaggattgtctgcagcagcagcagctgtaaagttgagtctgaggcccacatagaagacactttctagaaaaaaaataaataaaaataaaagaaacaaacaccaactaaaacaaaaccccaaaagcaaaacaacagcagctagctagggaaatggctcagctgggagattgcttaagcagatgacggctatccctgggacctgcagtgtggttggcgctcctcgctcaggttgccaaagggtctggtgccctcttctggtctctacaagtactgcacctgcattcaggaacccacttgtgcccccaccttcacccccacccccaaaggactagaaagcaagactatgagcgtgaatcatgggcttctgtgatttcagtctgtttccttctgttgtgtgagtgtaagactgctggcatcctgcatctgactcggtacagttagcgagactcttgtggcgacctgactttctcttctgcacactgcactttaattgtgtgttttgatgaaggctacctgtcgatattgccagtaaccactacattctctcatccactctctccaccttgtggaccctgaatttgatcttggctatctcacggtcttataaatgcatgaaatattcttagaactcgggtcatttccccacagtgacacctctcctccccggttataggcatcacaacttgggaatcaagataagcatatctttccatggcagtttctacacttagatgctgatgactgtaaacatataagactgatgtaaacatcattcatttaacagcctctttcgtgcggcatgatcttccctttagcttaaaagcctctgaggtcccgggaaatctttccttcagcataagagcctatctgtggagtcgttctgttttggctcacacctttctgtttgctggaggcaggagaggagatgttgcagtctcttggggtgtggcttgcattcctcagacctgtcacacatggctctgtgtgacattcccgtcagtagcccacatctcatctgtgaagaattaaggattaagaacatttctcagaaggggaattgtgaagttaaatgaatgaactctcaaaagcatttttaaagaaacatcacacaagaggttctgcaaactcaaattagtcctacttctcttacttgtggtgatctctctcccttatctcctgattaaaattcaacctgccctttaatggtttccttgaacaccaggaataattattttttttaattttatgcatatgagtatactgtactgtatgtatgtcactgttttcagacacaccagaagaggtcatcagatcccattacagatggtttgagcccccatgtggttgctgggaactgaactcaggacctctggaagagcagtcaatgttcttaaccactaagccatctctccagccttcaggaataattcttatataaattagctcatcacagatcactccatccctcctgtgacctatgttatttacaaattattcatttctttctcctagctctggtcaaattctgctttgtagtatagctgaccttatttatgtcttattttccttctgaggtcacagggttggtggccagggataggagtcttgcctaaaatagcacaggccacaaagttttctccttaaagatgctctgttagtgtttattacaaaagttctctctctctctccaccatgcctgacttacaattcagtttttttctttttttttcttttttttcttgtattttcttcaattacatttccaatgctatcccaaaagccccccccccccccactcctctacccacccattcccattttttggccctggcattcccctgtactggggcatataacgtttgcctgaccaatgggcctctctttccagtgatggccgactaggtcatcttttgatacatatgcagctagagtcaagagctccggggtactggttagttcataatgttgttcctccgatagggttgcagatctctttagctccttggatactttctctagctcctccattgggggccctgacaattcagttttttagcatcatgaaatattttcctttaaagtcctaaaatatccaggaactgccttagcacaactttttcttccttctttagcaacattcttctttatgcatcattcactaattactttgataactacggctgttactatatttggggaagagacaaagtagtagactttgaggtgtgcataatttattgtttacagctaatgtctgtgaatgcatgtggctgtaagtttatttgggtgtttttctttctctctagtagtaacttttctcacagccatgacacaatactatcaacagcaacagaagaagaaatggcttattttgctacagttgcaggctatgggccatcttggtggggacgacaaggtggcagggctctgaggcagtcaccccgaggagcagagccagatggatgctggtgccgatctcagtttgtctttttattcagcctggagctcttcagtctgtgagatgttgttgctccattcaggactgtcttccctcctcagtaaacctctctgattgtaaacccagtcaggcccacagtgaaggcccatgtcatcttttttcctccctccctttttaacattattagtttgtgctttgctgactgatggagatgactggcaagcagacaaagacagggatgtgtgacttttacccacacagacctgtggacatcatgggtctccataggcttgtggctcagtctcacatgtccacagatctggggctcagtcagacttcaaagacttgggactcagttatgcatttccatagttttgggctcagccataggcttcacagactgggggctccatcatagagtttccccctcattttgtagacaaggactcccagttctctgggactggatgacttttcccaaggcccgaagctttaaaataaaaggcctgggtgctcttgatagggtttagagtgtggcatggtctgtggtagaacatgggcagcaccgccaagggcagaagctgttttgtgttgggcttggttgggtggattctcgtttctgtttacatcctgcttatgtgtgagccatggctctgagcttggatttactattacctggaactaagtattctaattcatcaaatgtaaccctttgatacagctttagatacagtctggctaactttgcattggttacatttctgttactagataagatactccaacacaggcagcttaaggaaagaaggtttattctggtttacctgtttctggctacattccatcatggcaaggatgtcacagtggcaggagctcactatggctggccacatccacagttcaaaacagcttgcttcttagttttaggtggtccaggatcaagacccagcaatgttgtctcttactttagtggactcttctccgccacactggcgaggtcagaggctaaactaacctgggtaatccctcacaggtgtgcccaaaggcttgcgagtccggattctgccaagttgtggatcactactgacccacagattatatacatatatatatatatatatataatataaatgtaatatatttatataatatatgttaatagataaataaatgtaaaataaaaatatatatctgtgatgggatttatgtatagtacataatggctatacataattataatataaggaatataagaaacaaacaagagtacaaagccaaagcccacgtgaccatgtgtcacagcgcagatgacaccacagacgacagctcctctctccctcagcccagctctcttccaccattttcagataaatgagctctgagtgaagccacatggtgggtggattatggttttgttttgtatttttatttctctagtacaatacttcagttgtcgttctaagtcctcagtggcagggcagctggctgtttgtcatgaagctctgttgactcttcttcatagcagagtgctgtccctatgttctcatgaagtgtggttccagtgggcatgccacctgtggcttcttctcctctccccatgtctcgtagtggttcctagaaaaccccctgcctccatctgcccctctgccttgtgccctgttacattctgagcgttgcatcatctctgatcatgaatctattggtctatcaaacctgcttggccaaccacactttggtaaattctttgggtctgggttccaggtcagtagtgggatcactggaggaatcttctttgtgtgtgtggtatttaagcatgttcacagtgtatgtgtgtgtgtgtgtgtgtgtgtatgggggggggggaagagggagagacaaggtgcatgctgggattgatctcagatcatccagctttcagtgatgctttatccattgggacatcttatgggcccaggttcagcacattcttactggcacttttaatttaaaacaaattttgctttgtttttcagcttaatcctgactatcgagatgctcaaaatgaaggaaaaaatgtggtgagtagactttcctgtcagtttgtcccaaatgttccacatcttattttatacgaataaatcaaaagacattttactaacaagcttgaagactaggaccccattcttaattgaaggaatggtcagagaagcatgtgggctcagatgctatccccatccctgccagcagggggcgctaagggaattcctgcctcttgaaggctggttattgcaagacgccgaggcttctgggaaataggctatggtaggtctatgttcagtttccagaagtacatggaagtactatctaaaaggggggcgggcagtgaaatggttcttgggtgtttccggagggtctgaactctgttccccaaacccatatggtagaaggagaaaaccaactcacaagagttggactttacatgtctgttgtggcatctgtcccccacatccatgcacatccatgcacatacatacatgaaaactaaatgtaataggaagttataaagagggctggaggggtagctcatgatacagggtttacatgtgaggctgtaggttcagtcctcagtactgggggacaagttgcttctaggaaggcacccatcaaaccttcccactgtgtggcttaattacagctctgctctgcttcctgcatggacggtggccatgcagctggctgtgtgggttgagcagagtgggtggacacagaaaatgcagcttcacggagcggttaggaagcaggattctgtgctaagcagtagactcagggtgacatcccttctcactaatcaagccttgtttggctgcgctgctctcctcctaattcctcaactccactaaagctgagaagaacatgcctgtgtttgagagcttgtccccagattcactgcaatcacacacagggcaggtggtctgcattctggactgtgccagtctcctgtgagagaccgccagcagcagaggtttggtttaatgagcctgtctccagagcctcaagtttgactgtaaagaaaactgagcccgtgaaggtgtagtgcgcacagtgtggcttcttgttccataatctgtttgtcacattgcagtaattacacttctgtctgaagaggaaaggagaggggttgttagagtcgatctgcagcctgtgacagagaagatcaatttcccaaaacagagcgccggcctctcacgcagagttccagtaacagtgatggcgatgatgctgattttccccttaattttccccgcgttggtgacttaatgacctgctaatattttttcctgtaattcagaaacctttatcaaaacgtcaccttccattttggaagtctcagaggttaatgtagggtgttgcagaaatgaggctgtgtgtgtcggggctcccattaaggctgaattgctgtgttcactttacaaaggggtccattatttccaatcttacaaatgcacagcttccctgtgcacccggtagacattggcaccgtgtcaagcccagctgggaacctgatggtcattatttcttctcgaaggtccacattttttcagatggctctgcagaggggatgtttttttaaaaaattctctgcaatgccattcgtattaccaaacatatttatgtggcaagggatctgattattttgaaggcagttctgttggggtctcacagcctctgcattattggcacagtggaccaaataattctttgtggtggtggcaagatgagctctgtatgagtagtggggtgtcctctgcctaagtcgtagcgggtgttccctcaatggtagaggggcaccccctggaaggcaggctgatggcagcatgctgatctcatcttactgggtgttagcagcttcaccccaccccagctctcagctgtgacaagcaaaaatgtgtccagaaatttttagatgtcctctaagcatcaaaatcctcctatgtggccaggaacagacctgcgtgtgtttatacacatggaaatgttctagaaaaaggagactgttgaagaagcactttcaaattctgatctgtagaatttggagatgggggtttaggttctgtcagatcttcacattgccatgggtttcactccaggctcactggcagtaagatgggcagacttagaaagcagaaaggatccctcaggaagctctgggaatgaggcttacagagacagaaactcccggcagcttccggaagcagcctgggatgtgcggcttccccaagcagagctggaggttgggctgaggagggaggggagagccatgacagaaatgtggcagccttctgcagcctgtacgtcagctccaaaagtcagacagggcttctcccagcatgtcttaggctccaacagcacagaaatgtgatgttcaatctaaagtcagtgactcaccatgactcaacacaaaggtgtcctggggtgccctgaagtacacctttccaggagagggggctggagcaggagcacagccatcagcttctttgtggctttgaatcagggcaggtgcctccctgtgcagctctccctgtgcagtgcctccctgtgcagccctcccaaagtgtgcagtgcctccctgtgcagtgccttcccgtgcaacgccttcctgtgtggtgcctccctgtgcagccctccctgtgcagctctccctgtgcagtgcctccctgtgcagccttccctgttcagtgcctccctgtgcggtgcctccctgttcagtgcctctctgtgcagttctccctgtgcagccctccatgtgcagccttccttgtacagtgcctccctctgcagccctccctgtgcagcccaccctgtgcagtgcctccctgtgcagcccaccctgtgcagtgcctccctgtgcagccctccctgtacagctctccctgtgcagcctaccctgtgcagtgccttcctgtgcagccctccctgtgcagccctccctgtgcagtgcctccctgtgcagccctccctgtgcagctctccctgtgcagtgcctccctgtgtagcccaccctgtgcagtgccttcttgtgcagcccaccctgtgcagtgcctccctatgcagccctccctgtgcagcccaccctgtgcagcccaccctgtgcagtgccttcctgtgcagccctccctgtgcagccctccctgtgcagccctccctgtgcagtccaccctgtgcagtgcctccctgtgcagctctccctgtgcagcccaccctgtgcagtgccccctgtgcaaccctcactgtgcagtgcctccctgtgcagccctccttgggcagtgtgcagccttccctatgcagtccctccctgtgcagccctctttgtgcagttctccctgtgcagtgactccctgtggagcctaccctgtgcagtgctttcttgttgcagtccaccctgtgcagtgcctccctgtgcagccctccctgtgcagcacaccctgtgcagtgcctccctgtgcagcccaccctgtccagtgccttcttgtgcagtccaccctgtgcagtgcctccctgtgcagccctccctgtgcagtgcctccctgttcagtgcctccctgtgcagcccaccctgtgcagtgcctccctgtgcagcccaccctgtgcagtgcctccctgtgcagctctccctgtgcagtgcctccctgtgcagcccaccctgtgcagtgccttcctgtgcagtccaccctgtgcagtgcctccctgtgcagcccaccctgtgcagtgcctccctgtgcagcccaccctgtgcagtgccttcctgtgcagtccaccctgtgcagtgcctccctttgcagcccagcctgtgcagcccagcctgtgcagtgcctccctgtgtagccctccctgtgcagtgcctccctgagcagtgcctccctgtgcagcccaccctgtgcagtacctccctgtgtagtgcctccctgtgcaacccttcctgtgcagccttccctgtgcagtgcctccttgtgcagtcttccctgtgcagccttccctgtgcagccctccctatgcagccctggagatcggtgctttttctttctagtttaaaaagaatgccatctggggttgaaagacaacttagtcagtcaagtgcttgctttgcaagcatgaggaccagagttcaacctcagcaccacttaaaaatagctggctatggtggtgcctgcctgtcactgcagcattgtggggagacaggcaggtccttggggattgctggccagccagtctagcctacttgtcaagatctaacttctagtgactttgtctcaaaaaaaaaaatgaggttcaagattgacctctggtacacacacacacacttacatatacacactctctctctcacatacatacacataccctgcacctacatgtgagaaaatgcatacacactcatacttacacacattcacatacccacacactcatacacacatacacacttacctatatccatacacatacattcacatatacacatacacatattcatagacacacactcatacacacatactcacactcacacacactcacatacagactcatatacaaatacatacatatactcacagacactcacatacatatacacaccctgcacctacatatgagaacatgcatacacactgatactcacacacactcacatatccacacactcatacacacatatacacacttgcagtcacctataaccatacacatatactcacacaatacacacattcataaacactcatacacacacacactcatatacatatactcacactcatacacactcacacactcatatacacactcacacactcacatacacacactcctgcacccacacatgggaacatgcacacacactcccatgtacacccacacatacacaaacttatgaaacatgcctgtttggtaagcaactagcatgtgctaataagcaaccaggtggcaatctgagacccgggctcctgagctgggtgtgtgtcagagagagcttcctggcggtgaactggcacctgtttaagctcccttggttacttttccatttttatgatggcaggcaaactgtgacacttccacaattctctgcagggagctacagttcctgtgtccccttttttgtccccttaaatatcgagggttttataagcagaatccacaaagcttatgagtttagacagaattttctttatgctgtaaagaggcagggttgcctttctattatcaaagctacactcattagtatgtgtataactaaagctttctggtgactctggcagccttgacaggctgggcttgacatcctgacacaagaattagagagaagactgagagggaaagcagagggaggggacgtttcagtgtggctacagtgggaggaagagcaggtgaaagaggccagtgagctcacctgtcttcaaggtcctgacaggagccttggctctaaacagaggacgacctagatgtaaccatgcagccctggtcagggctcagtctggtcaccacttctcagaccaggttccacaggaggtatgaagaagttactgttgagtgcaccactccgttcccacaaaatgatcgcttctgttgagagtgtagctgaatgccctcattggtactcgcctcactgggggactgtgtgtcctttgtgggtttctctcgggatccaaggtggctgcaggctcaggacaatgatgtctctgtgcctttagtctctgagggtaccgagataggtaagggatacagacgttctttgagtgtgtagtgcctacgtgcagggtctgagtggaaatgaagaagacagaaatgcaaggtgtttggagaggccaggcttccatcctgtcttaagccagccggtgactcaagggtggagtctccttagaaaaacagcttccaggtgcctgctatgctcataatgcattatacatatttaattgcttaaaaattctaaggggcagtcttgatgcttacttccaaactgtttatgaaatggagtttgttaaataaactagccagagcgtgggagagtcgaagcaggaagcttccaacaaggctcttgtaaaagtcatgtaggcatgtcggatgctcttccacatacacagttgtgaaattatttatgaacagacattttctatgcattagaactatttttgcaaaggccaatgggaaggatggagaaggagaacacactccatgtgttctatgtagttacaataaagccacaagtctccaatactattaacaatttgcagtggtttgttttaattaaccctaattagcacattttaaaaatacatattttgaaaagaatcattgcagtgcaagtgtcaaaatacagagagggtcctggctactctggttgggtccccgagagagacattaccaagaagagcagtagagtaatctagacctgacatcttgtcattctagaaaatcctctggttagcatttcaaaagtggggtgaagagaggattgaaccccagtatgaacttacagaggactgaagtacaggctacactgtcaaatagccctaaatagctgcatccgtttagcacattttcccccaaagagtatgggcatcaaaagctgggttatactaagtggaggagagctcagtcagcaaactgtgacacaatgcattccttttagtgatacagtactttttcaagaacactgcaacttcttttgtcctctacaccagactgttgcaatctggctctccttttgtgtaactcagaaaagctggtctccctgagctcagtagtattttgattatagcgtctcctgtctacataagccccttatggcctactgtcctttgaatgtcctgcctgtgttggaaacttgatcgtcaatgtcacagtggggtggggctctctgggagaagtaggcatgaggagtcagtgatggagagacctcactcccggattcctgggctagtgtgttagcgtggcttgttgcagaaccaggctggggcttggtggttctggctcatggggtggtagtctccatgtcacaatgtagcaccaaggccctcagagctgacacctccatgtgcttagccccctgcttccagaatcgagacctaagaaattaccaggtctgtggggctcggttgcaacagcagcaagtggactgagctattgctggatctcactgcctagtgtccaggaagatcgtttaggagctggcttttcagctctgtgctcttacattcttggtcacctcctctaaaggaacagtgctcgacgtatctgtgattctcttggtgtcaatagacttgtagaatccacaagctctgctaacagcttgttgccccagcttgagtatgctcgattctctgaaagtttttatgtccctaaggatgtaactgaaaacaaacttcctatccctgccccacactcctttcccttgagacagggtttctctgtaaaactcttctgttctggaattcattttggaggagaggctaccaggttggcctagaactcacagagatccccctgcttctgcgtctcaagtattgggaccccccccccccactctgacttagtctccttctgccaccttcttcaccataatcagtgctgtctttaacatcagagcttatggcagcctctgtctttgagagggaactccagttgggagcggctgctcatggtcttaactccagatttggcaggctgaagcaggaaggctgctgtgagtctgaggccagcctgggctgcttagggagaccctgtctaaaaagaaggaaggaaggagaaagggagggaagtgttttatgttgcacaagttcttcctttggttctttacaagagggtcacgtgcccctccatcccctgcccccccccccaaccttcctgcctctgttactggcagtcagtgctgtggtttcacagtctggagcctccagagaaagctgctgctctgccattcacagttgactgaaactgcacgttctttttgtgggccaatgaatctacatcctttaactcactttcttcctcccttcctcctttccttccttcctattgtctgtagtttgtccatccgtccgtctgtctgtctgcctttggcttttccatgaatggctttttgactagtcttcagccagcctggggtgcaggtctctttgtgaggtggggattgcatttgtgcacttgaacgtgaccctgcatctttctcacatcatcatgcccacaggaagaatccccaggccatgtgttttcacaatactttacatcccacccacaggatacaagggttcccttgctctgacctttggccatttatctctggacttaggtcatcatgtccctagcctgggaggctgtctgctttgctgtggttttgatttacctccccccccccacacacacataactgagcatgttttcctatagtcactggtcatttgtatgtcttcttgagtccgtggcatttagagagttctggtgacttaaatgtggaggatcaaatccttatgttgtaaattggtatacagccaccagagaaggagccataactgctgtgcccaagggcatgctcagattagactacccctcccgggaacataggctgtacaactgcccataatcattacaaaggctgtgagccctggtcttctgaagggtgattcaggatagacactcctgtaacccagtgaaggaacggtgagcaagctcacaccttatgtccctattagctggagcagttaacactaaatgtgaataaccttggacctcttccacagaaagacggggagattccaacaccaaagaaaaaacgccaggcaggggagaagatcatgtacaccctggtttcagtcccacacggaaatgacatcgcgtccctttttgaacttgatgccacaactctgcagagagccgactgcctggttccgaggtaaaaagaaatacaaaataaaaaaataaataaacaaatgagtaaaaagttaggctgagcagatgtttctttgaatagtttccccaacaagtaaggaatgaaaagtgtaatattgatacaagtttcacagtagaagagaccatgagtgaaggaaatgctcgaaaaatgttctgagtctaaggtgaacatgctaacgtagcttattttattcatataaataattaaaatgaaaggagttctgaaaaatttattagaatcatttattcacttgaaccgcctttggtcacagtaatgaaaggtaatctaatagcatttaaaaatctaaattttgtttccttcggtgtcagattcccacttggctcatttccttgttcatcttgttagtggcccagctaggaagtttctgttggctgtcagtttcaaggcaggcctggccctgggcatcgaaaggagaaacagagtcatgggaccaataaacctgtgagctgaagttggtttcgattgtgggtcacaaccagtgccctaagccaggtctggtctcatgtgctcagtaagccaattaaaagagccaaatcagaagtgaaaagcagaaatggagatttagttagtacactgggaagcagagaggcaagcgtctcttcagagttccatctccatgaggcctataaaaagataatgaagtgcttcaaagaaaaacctctgggggtgaggttaggccagagggtgcagaaatggcctctctgaggaaagactgcatgggctgagcggttcccttcggagaggaacattctaggcagcagaagtaggagggggaatcagcttgaaaaattctaggaggccagtgtagagcgacctaagcaagaggaaggggcatgggatgagccagccagtgttcgtgtagagaggttattgggttctttagcacgagtgtgaatatttttgttaaacttttttttccctagacacagtgtatcttgtccatgttgttacacatgtgggatggttctaatttggctgtgatgacacagcgttgaagttgggcctgccaaatggccgtggttagctggagggaccacacaaaaatgcagacacatatctttagtatcacagaggttccatgattaccttgtttgtgaggggaactgctgactggtgacctggtgtgagcccatctctcctacacacttgcttagcagtgtagcctgtgaagacacgccctctgctgctttggccaagtgtctgccttcttgtatggggatcttaatcattactctgacttaagtcattctagatccaagtcagcaaaaatgggatctatcttgaattcagcgcaggagaatttgtttaaggaagtggcaagcacccatggtcaggtgcatagacccaccacaaggttatgaagtcttgctgtgcccgtgtgttagctactgctgttcagagtgcttgaagtccttttctgtgttgagaagaatttgtgttaacatggattcagctgtcattcactgagctatagctaacaaaaactcttaacactaaccactcttacatcctcatctgaaatcctctgatattttctttgtgcccgccaagcctcatgtcaagttcttcatatctgttacctggcttcatcgtgggtaatgctcataggtcataggtcataggtcataggtcatagggcagaagctgagttagagcaggccttctcagactgactgagaaagatctgaggagtgggtctgggtcattctgagagtaggaaagtcagtcttggggtgagatgtggatatggcatcttttaaaaagcattacccagtggattccagtatgaaatgcagactttctcaaacttcgagctcttatggtacaatctttttttctagaaggatttgaacaaatgtctccaaacccaggggacctacaaaagaccaaaggcccaaacccagggcatctacagagaccaaaggaagggttttactcaaatccagtgagggaatcactgggtttgcttacaggagcatgatgagggatttcttacaggaatgtaggttacaatcgtgtcactgaaaaatctggcaccagcatgggtgataacctccccgtagctgtacagatgccactcccatcagctaactgcttaccatgtgtattctagaacttcccgagactgtatgtagttgggaaatgcaggaacaagtagcaggagtctgaggtgagcatgtaattaacctccccaccacatgagggagcaccagcaggtccaatcctagcggtcaatgaagcctgtctgatgaagactgtaatggcccttaagctcagaggacagagttccacagcaacactatagccagctgggtgaaatgttaatccaggttgtaccaccgaatcagccatggatttctgacacagatagtttgtaattccttggtctgcagtggggcttagagggtccttttctagcaagccccaaactagacattttgcatcaaaggcttagagcagagctcccagtctttcctgtgcaatgggacatgacaatctgtggccagtgctgacatccacctctctctagacactggtttaactggcatatgttgcaaccgggtctttgggattatatgcagcggagtttgggagacagtgactcagaaggacaagtgcatgaggtggggtttgatcctggaacacagaccgtgaaatcttccctgaaccgtcattccacagcagtgcccttaaactgtagacagccagactgtgtcacagcctgactgcaggcacttctccgtgacatagttcctaagtccttgcagaccacgctatcactctgggttatcatctcttcagcttgcaacccagtagtgttggctgactcaaggggcgcatccaggcagaaagcccccctgatctgaaaatctaagctgacatgactggagaagtgacagctcttaggaaccagtattgataccacagtggaaaccctacacgtgactgtgtgatggactgcagttaaaatacatgtgcattaaaaatattatataaaatcaccattggcaagatggctaaggcacatgaatgtcatgtctagacttgggtctcatttctagatagctcattatacacctactctgaaatgtttaaaaaaaatatctcaatctcaactactctggatgccagctgttttgttgctttttctattgtagtgaagggacaccatgatcaaggcaacttgtaacagaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagagggaggaatatgccaactgtaatggggcacaatttttgggacctcaaaagccaatctccaatgacatatctcctccaacaaggccacagctcataatctctcccaaacagttctaccaactggggactaaacattcaaaacataggagcccatggaagccatgcataatttaaacattccacacagtttctgaataaaggaaactcacctgtgttgaaaagttctaaggacgaaatagagggactggctactatgtagtgtgtggtgcatgtatggtggcctcactttccagacctcaggacccaggagacaagacagccacagtaggcggcatcatcccctacttagagaattctgggtgctaaagcagaggcatttctggttatttgggcaagggttagttgcttgccatggtaggcatttgtaactcagtgtgtgttttatctgcttttatgaactagcaagaacatgataatgattgagtttccccatagcatttgatgtcaagtcctctgtttggtcctaaaatgtgttagctttacgttgaacaatatgcaataggccttttctcttaataggcactgtgcactcttgttggagaaataattggaatgaggtagagggcaccgtgaaatgaggtgacgttctcttcaggtgcccctgctgctgtggtgcccacatagataatttttacacttgactcaggaaatagtcaaatacagaaacattgctcatgtagagtgtgagtcctctctgagcccctggttggaatgtgcctgcagtcagcacacatgcttgtgcatgtgtttggtaaagacaccttatgtggtacacattgtcgattcttcacactgaattagtggtaaacagactaaactcacaacccaagaagcttatctaccacagtgttttctttaaaacaatttttttttgaggccagagagtcattagctaagactgtgtaagactaacctctcagttataggagttgagttcagtttccagcacccacacggggtggctcacaaccacctgataacttcagccccaaaggatctgctgccctcttctggcttccacaggcactgcactcatggatattcacagatttaaatgaaacttggcatacacagggatgtattcttgatggtgtcttcctattcacactggcaggctttgttcttcgctgtaaccctgacaatcattttcttctctagtcatgttgttatcttacttaggagccagggtcagagtttttacactaaacaccaagattagcaataaaaccagagaaatcagggaagtgccactaactggacacagagggatgcagtttatggcatgaggtctgggctagagggccatgcagctcactgctcaccttcgtcttgggtatgtgcctgtcgagccactcagaatggtttatttatttggctgccttgcattatgccttcaatggccacagcagctccgtgatttggggctataaacgtgttttggttagtagctgtctggggacagaataaactagtctttgctgaccactctccacagtgtctgaatgtagaccagtgaggtcttaggatttgcatttttgaaaaaagtttctggctatgccaatggcttaggaagtgaagctgtgtgctccaaagcagcctgaatcgagggattatttcttattccagatggatccctagacagttgctagtctaagacacttagtgtccatatcacagatggatctgttgaatatgtcaatatgcaaatggttttaattgacagtgtgtgtgtgtgtgtgtgtgtgtgtgtgtttgtgtgtgtgtgtgtttgtgtgtgtgtgtgtgtgtgtttgtgtgtgtgtgtgtgtgtgtgtgtttgtgtgtgtttgtgtgtgtgtgtgtgtgtgtgtgtgtgtgtgcaggtcagagcacagctttgtggagttggtctttgccttccatcttcatgtgcatcctggagattggactcaggtccccatcactgggtggcaagcacctctgccctctgacccatctcgccagagctacatgtttttatatcacttgctttcaggaactcctacgtgcggttaaggcacttgtgcaccaacacctgggtaacaagcaccaccatccccatagacacagaggaagagaggcctgtcatgttgaaagtaagtgtggctgggggttcagagaactcagggaggctgaaagttcatccggtctctgactcgaggggctgcagcagggctgtggttcaggagggagaggtacagatatcaggaaaggtacaagaggattccaggcacgtcttctctacttggaagtatttgaggcagagggagggcatgtgaaagagacactcttccggtgcaggaaatgggcgtggtgagccatctcgtccctgatgcctttccttgaggatgctgtgttcaggagttagcatttctctgcttatccatccccacccaatgcgtcttggtactgaggagctcggtctccagaccttgcagtttaatggaaacacacgttgcagattgggacctgccagaccaaggaagacaaagaagcctttgccattgtgtgcgtcccgctgtctgaggtccgtgacttggactttgccaacgatgccaacaaagtgctggccaccacggtgaagaagctggagaatggcagcatcacacagaacgagaggaggtgagaggctttcaaatgtgactccgagtcattaggtgtcaactgttgacctgagtttgggaataaaagcctgtggtctcagcagggaggtagaagctggagggccaggagttcgaggttatctttggctacatagcaagttcaaggccagcctgggctacacgagaccttgtccttcaaaactaatgaaaaaaaatcacctaaagccccatataaacaaacaaacaccaccaccaccaccgctgccacccccctcccccaacatgggcaattagttcttacagtaaaccagatgactctaacagaacatttagaatattctccatagtagcagccttacatttgatgatgctcagtagtgaagaattcttgccagcagagacacctgatggctcacaacaacctgtaattctaggtctgtgggacctggcgccctcctctggccgtcacatgcacatacatacacatatacagaaacacacacataaataaaaattaaaaacaaaacaaaacaaaaactggaacctaaaactgtctgatggtatacttactttttccattttatcttggcttgaaaataaacggtttaaatttctctctgttcttattttgaaagcttttagggatcacatgacatacttgaatatgtttggattttgagttttgtgttgtcatttttacatattacatattttcatatgctctctgcctgagccactcacccagagaaactgggttcttgattcctaacttacttatttttaaaggtgtgagaaaaagaataatggctgctagaaatctgaaaaccaaacccaagccttcatgtagtgaagcttcaatagcgattcccattttggccaaatgaaatggagattaaactctatctgggtaaaatcacataaatagtgagtggggggtccagtcacatgattgacagttggagtttcccatggcctcacggtatagactcctccctcttcttctctttgtgatatgctgcagactttgaatctgaacagttaaggaggtatttgctgagtctctggcatgcacaccagagctcccacctacagccactgagatgattggctccttgctaaacagcccagccagggatggtaaagtcagagaaacagatgcttggctcactggttcacccctcagttggacattcttgaacatttgtccaaaataagcccagaacacaagggcaaaaatgtccagccttgttctaaacaaacccaaactgaaggctatccatgtttatcatagttgaagaataaaacagtactatgctcatagagtggagtaccacacagccagaaacacgaatgaactatatgtatgtgtgatggcatgggtgaacctaacaagcactgggttgggtggggaggaaacaggatggatgagtgccataacactgagtgttctgttactaaatgcatacattctagatacattgtatcatataccctagacacataccatacaattcacctcttacttaaacattgttgctatgctggcaagcagtcaaatgggactcagcttcctgtctgttcttaccatccttgtggaaccttcatttgacacctgtctttatgcccaccctgtggtggccagtaaagcaaggcctgaagcagaaactggccactcttatagctacagaagactgaagggcagagccagcttagagcagacatggatctcactgtgcagatgggaatgtctcgatgaattgtttctgcctgtctcccacgttcacaggaagtttccatgcttctctgagacttttggtaaagtgaggtatctaccgagtgaagagtcccattcatggttttcagcccttccgggtacctcctccaacaggccatttttctccagttcctgtcagggggaacccagctcctccagatcggcctcaggactgaggaccagagtgtccccggatcacacctttttactccccccaacccctgcctgtccttctgctgcttcagtgagaaacgacagctaagcctttgcacctgagaaaggggaggttgcattttctgatgatgtcactcctcatccagatgcagtccatgcttgccagtcagagcagtgaaccggctcttagtccctcaactttagaattcaatagaaaattcattctgcgaataactgacaactctgacttttccccctacggagactgcagttattattagctattctttttatttgaaaaacactgcaggcctgcctccaggagtccgtgtggttggatctctctcttccctttagtcaccccaggaagtgactccatgggtgcagctcctgtgtcaggcttcatcttcctcagccttatatattttcatttgaatttcctagttgtatcatgcgtgactgtgccaagaaaacagagttttaggagggcatcacggggagggagggaacatggggtgtcaactgctgtgtgagcctgagaaggcacacacgtcttgcagtctctgagggacctgctttgtccatggagggtcctctgttacagctcctcagagatgcagctaattcagtgagacctagtgcttactcaatatgtgccaggcactggccatgcagtgtgtgctctggggcgctgcataggtaaaagctgttgtgcctacctcttcatgcagctaggcctacttccttatgcagctagggacctggaacatggctaagtcacagagtgtttatccagtcagccagagaccatgctagacttgcttccaaatccagtaccttaagaagagcaccatgtctttatgcaatgaacagagctgagtggtggttcttataaacacaccatgtaaactatgatgtgtccctccctcctcccctccctccctctgttcctcttccctccttgggcgcccatccttccctccctcctttctccctctccctccctctttccctcttcccttttggtcccccctctcctcctctcttttttcttcctcctcttccctcccatagtgccagggagtccttgaattctgtgtactcaatagtgaccttggcctctttaatttcctcttctctttataatctgctttttaaaatctaggtacgctgttatctgtgtccctttggtattgccttataattgcatgtgggtaattttctgtatacttttattgctcagatttctgctggttcttggcctcacccatccacccttcattcacatctgccattttaaattatgttctcttgcggtaattgctttatctgctgaggactgacaacacactcatttaaatgtcacttagaatggctttgttacttgggttttactagcaatgaatcaaccttctgagttttagcttgatggctgtcttttctaatgtcagttttctctgtgttttgtgatttaattatgcatgcttcctttaggtggaacaatattgccttttctttcagagctcattcatttttctatctgctgtggcacagccaacgcctgccccctctctctaccaggccacaccgaggtgtgatgttgcctctcctctggtaaggggaggcatgtgagtcatgtgatcacaggcagggaggctccctctgtgtgcttcctgtcccttcagtgcctgcctagctgcagctcacgcagggctctgaatttctgaggtcctgcaagggggcctctgtttgtgtcctcacagttttcgagagacaggctttctctgtgtagcctgggtgtccaggaactctctcttgctctgtagaccaggctggcctagaactcagagctccccctgcctctgcccctgcctctgcctcctgagtgctggattaaaggcgttcgccatttgctgctccgggcttttactttgttcttgacccatgtggtcttttttattttcaggcgtgcgtcttttaaaatacataatatatattttatctaactttgctaaatctgacaggaagtctgttgaatggcttttctcaggagtatgtgaacagacagctactcatctctgatagggaaccgatatcagacctaaataacgattccagccaggtctcacttatcataaatatacacatataagtatatttttatatattatgtatatataaaacacatacatatattctatatacaatatatacacatatatgtataaaatatataatatagaaaacattaataatgtaatatttataaataagattttatagaataatatataaaataatgctcttccaattgtcccattaactattacctattttagaaataatcaagagtcatgacaaagttgagcctttcatgtctaaacaccagttccagttctgtccagcaagagccaagatttatgttcaagctgaatgtacactgagcagagagacacttggctccaggctctctccaacctgctatgtcgtgtgtgtcagagggtgacatcgcctggtgtctgtcagagggttgttttaagaacagtgtttggaagacattaactcacaattatattctctccccagcccactggtccttaagactcacaggattttatttaataactgtttaaaaataattgatagagtttgaattggagtagagggtggtgggaaatactgtgaaagttcaggcaagtagcaattgcattcgacattatattttattgattaaatatgttttaaaagggtttagttttcttagtctttttgttcttagacttaatctttaatggtctaaaattatcacaatctttttgtgtgtgtgtgtgtgtgataggtttgtgactaagttgttggaagacctcattttctttgtggctgatgtgaccaacaatgggcaggacgttctggatgtggtcatcaccaagccaaaccgggaacggcagaaactaatgagggaacagaatatactggcacaggtgagttgcttaaggagccaaacttgcatatgttatgttttgagttgcagcatcggtgaactctttgtatcagtcatgccttgctgcataacaaacgacacatatacacttatttcagctcctgtgagttttaagtgtgagagttgcttctgtggggtggtgcttgctccgaggcattctcagagggactgtcaaggtgctaagtgggtgactgtcatctcaagggtggactgggaggagatctacttcccagattgctcatagagtttagtacaactttgtctccagacaaggcactgcctgcctccctgtgaacgttagtgttagctgtggcttgacagatgctggggagatggattgctgaacctgcctataggttaattgatgttggaagactcatttttaactctaggctgttgccttccctcagctcccacccctgggtggagatctgggactgtaaagtggagaaagagctaagcacagcattgctgttctgatcttggctgtgcacacagtgaaagctgcctcaagctcctgctgtgccttcctcactgtgatgagctttggtctccaaaggaaggtgattccccttaagggcgagggatccagagagtggggagagacccaggctcagctagggagtctttaagacattatagcagacaccatcacatccatcagttctgtgcgattggctgaaagcaattttataatcactgtcagagagaattctgggagttagggaccattaaggggccagccttgaggcatccaccacatatccccaaatgctagtgtggtcagagtatctgtagaatctgccttggaaaaacttttgactggaatttcaggtgactttggaaccattccacctgcttttgtctgcagtaggtaggcatgtgagtctggtccagaactctcaagtgcacaatgtaccagtaaattaattagcttcctactaacctgtacatgggcattcttgcagttacatgtcttattgttttgttaatatatcaaattatatttttatataaatataataaataacgattaaaataattagcttttgtatcaactacatatggcctcaaggaaaagccttaaagacatacctatcatagcactaattaattaacagtaattggcattccatgctgagttgggaaaggaaacctgaagacatagtgtggctgagatccacagaatgtctgaaaacagtgttttcatgaaataaggtaaaggtctcaggtctcagggacaaagtctttctgacagcagtaaattgtttccagaaagcatttgatttcagggacttttaggaccttgagtgagttatgagcacattaactgctgtgcccaactttttatttcataatataaatacagaataatccaaggtctagggaacataaaattcttcttttcaaaaataatattattttttgagaacttcatacataaatactgactgcatttatcttacatatgcctcaccctctccccttccaagttctctctcctccaaattcatgatttcccctatcattattataggtatatatatatatgtatatatatatgtatgtatatatatatatgtatgtatgtgtatatatatatatatatatatatatatatatatatatatatatatgtatacacacacacacacacacacacacacacacacacacacaacctactgagttcacttagtgttcctcatttgtgtccggtgttgaccacttggtattggacaacctgtgtgggacctggtccctggagcaggcaccatatcacctctagctcttctcttgagggtggggtcatgtggaatttcccttattcaagtttgcatgtcaactggacctgtccttacactgatcttgctcaggcaactgtgttgtttagagttcataggtcacacatgaaaggcacagtctcacagcagactctcaagagtcttctggccttacaatctttccacctcctcttctgtgactttctgtgtcttaggtataggggatgtgtgtagttgtattaatcagacatgggcaccccagggccaagcagtcactgtattttgaccagttgtggatccctgaaataatctacacctattgcaaaaagaaatttgagaacataaaagtctcctggaaacatacggtcatatttcatgaactccaagggacagttcctttccacgttgaattcttgtctcgaggctcatggccttgatcacatgatccttctcagagaacgctctcagcctgctggcttctctccgcagtcagggctacctcctcatacttctttcccatgctccctgacctagcaagaatttggctccctgtgagagatggggtgtgtgggtgtggggacatctccagaatctctcttgtggcttcttgttaatgcattcattcctgtggccatttatctgcatactgtgagggggtgaaggggctcagagagaatttcatgtatttagaatcacggttgcatatgtatttggagttatttccttttgcctataacaaggcgagagtgacatttggaaaccattacctgatgtaaatttcaggttaaaaaaattgtacatgtcctttatattgttttaatttggggaagttaccaaaaaaaaataacagaatactaaaaacatatagaaaacatattttaattgatctgaatatttctgtgtaggttcatacaaatacctaagtatttaccatcttaataaaatacaatttctaaataaaatccattatgatattgatgtagtggatttgtccttgactttgcaagcagcggggtttggtttgtttgtgttcatcacccaggacgagcaaccactaatgtcctcccccactaagcaggaagcgggcagcctttgcattagttccagtcacacatttctacggtgttttaaagtctgtgttatctgtaaaaaaatgcaaatatggtgcaaagcatgcgcgtgtgtccatcaaaacaggaggatttttttttttattcctctaggtgtttgggatccttaaagcacctttcaaggagaaggctggagaaggttcgatgctgaggctggaggacctgggcgaccagcgctacgccccgtacaagtatgtgctgcgtctctgctaccgtgtgctgcggcattcgcagcaggactacaggaagaaccaggtgggtctggagcctcagcattggctttggtggctgttaaagtgcacactggaggaggaagaaactggactttgcaaggatgggttgtatgtggcagctcatagaaccacctataagaactgtggagttaaacaggtgttctttcttaggacttagactcgatggtgggatgtgcatatctatcttctgggtatggcatggtgttgcgttcatgaacacatagcagatgtggctacccgcataaggcttgcacacacaaaaagataggactaactggggggaagaagtgggatctttcaggagtgagagtcataaagagagggtaatggagggcagatatggccacagtatactgtatatgtgtgtggatatgaccatagtatactgtatatgtgtgtggagcagtcagggcatggtgccacacacctttaatctcagtacttgggaggcagaggcaggcagatttctgagttcgaggccagcatggtctacaaagtgagttcctggacagccaggactacacagagaaaccctgtctcaaaaacaaaacaaaacaaaacaaaacaaaaacaaagacaaaaaaaccaagactgcttcacattcagcaagaagcagcgtgaagacggtcttctctctcagcttgaactgggtggaatcacggaggagactcatctcccagcaggtctgccggggtgtttctaggtcttacctgaagatggaagaccctgagtgtgggcagctctgccccatgtggtgggcccagaactaaatgaaaagagaagtccagctgagcattggcccccatttctaccttgcctactgttgtgagtggtaatgttaatatgtgtgttttctgatgaacttaggcaatgcctgtgaaagagtcactagacccccaaacggcccgtgacccacaggtcgagaagagatggtccagggtaactactctaagcagctttctgatggtttatagaacaagggtttaaaatgtaggcagaaagctttgtattttatcttttttccctttatattctaataaagagttcgtgtgtgatttagtgctaacccaggcctttaatgttgtgtctgggtttattattatttagagaactcaagagtacctctaatttcatttaattatttatcaacatcttggaagtgtgactctggtggtaaaagtatgtaaatcaatatgtagctttaaagccatacactgcagaagagttttactttagttaattggctgcccaactctgaaaggccacaaaaggctgcctagattataattagatttctgtaaccaagatcacgttcagggaatagatatgttccggtatattttgcccaaggcaaaaaactactttctaatcagcaaattatctcatcatggaaacagagttgcatttccaaggagaaacccccagaaatggagagcctttgtcactaaggagggtatactccttgctctaaggttatatggatgtgtggctggcacacaggagtgacgacaagtgatcgtggtttgggacttagtggagtgagtatgagggacaaggagcagggctggagagatggctcaatggttagggcactggctgcttcaggtcctagcacccacatgagggtttacaaccacctctaactccaattccaggacatctgacaccctcttctggcatctgtgggtactgcatgcgtgtggtacagagatatacatgcagatacacacacacacacacacacacacacacacacacacacacaccattagaaaaagaataaggagcaaatgtaaacaatgcattactgaaactctcagtgacattctctctctcacactgctaaaataacattttggcccacaactcacaaggtctctctgtctctctctctctgcctctctctgtctttctctgtctctgtgagtgtgtgtgtgtctctctctcctttttttaaatgagaaattatcatcaaaccaagctgactctctcttctatacaattaaaaatatatttattttatgtatattggtgttttgcctgtctctatgcaagtatgtgtaccctgtgtgggcctggtgcccacggagtttctgcttccctgggccgtttgcaggtgatgctcgcatctctcccagtgctcccatggttgctggtctcacatcctttctgtccttgcccccaggtcagtttttttagcctctctgatctgcagttggctcttgtctctaacctcggtcccacttcactcgtccacgtgtaagagggtgcttgtttgctcttctctgtcccttatcctgtgtgatctccagaaaggatctctctctctctctctctctctctctctctctctctctctcacacacacacacacgtacagcaacatccatagcctcccacacagagcccagaacttatgaagccacaatgagatagttattgtgtggctggctataattaataacctgagctattatagcaccctatttgattgccctttacgggtatgtgtgctaagtttttgataatatttatcagggaagaccttgttattctagtactagtcaaagtactagactagtctagtactagtcaaaaacaatgacaactcagatcaatgtaggacctccaaatggcggcacagatctcacgccctatgagtgaagagtcagacaatcatgtgcttttaaacaattattattattttacccaaagttgatagttatgacttctggtgagaatcagagggccttgtgcaggctggggaaagtctacattaccatggtataaaaaactccatttggatttgttctgtcggtggcaagagtgtcagtacccattttaaaaacaatgattgacgacacagcttttaattatttaattatttatctagttatttgtggtaatgaagagggaaccttgtgcctagtacaccccaccacactccaacctcagtcttccgtaacagtttaaattttgtgactgcagctaacttttcctttgtcaagaaattctctgtattgaaaattatttactttttttttctgacaaatttcactgggtttttcttgtggctcagctgatctgagctgctgacgcttacagaggctgccacttgcaggcagtctgctgcatgtcctgctctctctctctctctctctctctcaacaggagtacattgctaagaacttctgcgttatgcagtcccagatcggctatgatatcttggcagaagatacgattacagccttgttacacaacaaccgcaaactactggagaaacacatcacagccaaagaaattgagactttcgtcagcctgctcaggaggaaccgggagccgaggtctgctctggtggggatggtggggccacaccaagctctactctagtgggtcccaggggttgcacattgtcctttgggtctatgctgcctcagatgggaggagagagcatagagcagccaaagacacacagtgcttgttccctaagtcctgtaacagcatagtgtagataggtggacagatgcttcctgaagtgtgcaccctagccctgctatacactcacctcctgaagtgtgtgccctaaccctgttacactcacctcctgaagtgtgtgccctaaccctgttacacactcacctcctgaagtgtgtgccctaaccctgttacacactcacctcctgaagtgtgtgccctaaccctgctatacactcacctcctgaagtgtgtgccctaaccctgttacacactcacctcctgaagtgtgcgccctaaccctgctatacactcacctcctgaagtgtgtgccctaaccctgctatacactcacctcctgaagtgtgtgccctaaccctgttacacactcacctcctgaagtgtgtgccctaaccctgttatatgctcactttgccttgttttttgttgatatatgggtttggagacactcacttgatggaagacaaatgattttctgaacaagagtcattgtcctaatggatgaaaatcatctaatgaatagaggcaaacaaccattctaatcaaggcttatatgtaatgagaattacttaatctgctcttaatgatgtagtagatgaacaacatgaggagaaataacacattgaagcaatatcaaaaccatatcaaaataagcttttcttattaaactccaaattatacttttgttgtgggattgaaatgctctgtcttgggctggtgagatagtgcaggtggtaagaacatttgccagtgaagtctgacggcccgagttcgattccccattctggcagaagagctctgtgcagtggctcacatctgtgaatccagcacccctctgggagatgagagatgggaggtggaggcaggatggccagatccacacagcacagcaggtgggaatacagacctgactcctgacctacatgcacaccatggctcaccaatgcccaaatcaagacatgcactttaatacttaaaaaattttaagttaaaatgaatggatacacacgagattctgtgtttaataatgaaattgttgaggaatcagtaaaaggtattccattaaaatatagaagtaaaatgcctgttgtcttagtcagggtctctattcctgcacaaacatcatgaccaagaagcaagctggggaggaaagggtttattcggcttacacttccatgctgctgttcatcaccaaaggaagtcaggactggaactcaggcaggtcaggaagcaggagctgatgcagaggccatggagggatgttctttactggcttgcctcacctggcttgctcagcctgctctcttatagaacccaagactaccagcccagagatggtcccacccacaagaggcctttcccccttgatcactaattgagaaaatgccttacagttggatctcatggaggcatttcctcaactgaagctcctttctctaggataactccagctgtgtcaagttgacacaaaactagccagtacaattgaccccttgtcaacttgacacacaaaaacatcactagtaagcctcaacccttacaatcttattcatccccaagatctaaataactttaaaagtcccacagtctttacatattcttaaattttcaatctctttaaaatatccatctcttttaaaatccaaagtctttttacaattaaaagtctcttaactgtgggctccactaaaacagtttcttccttcaagagggaaaaatatcagggcatagtcacaatcaaaagcaaaagtcaatctccaaccgtccaatgtctgggatccaactcacgatcttctgggctcctccaagggcttgggtcacttctccagccatgccctttgtagcacacacgtcatcctctaggctccagatgcctgtactccactgctgctgctgctcttggtggtcatctcatggtactggcatctccaaaacactgcatgaccccttcagtcctgggccatcaattgcaactgaggctgcactttcaccaatggccttccatggcctctcacagtgccaagcctcagctgctcggctcaactccttcatgccttcaaaaccagtaccacttgggtgactcttacacattaccaagtccagccacagcacaatgtacaaccttggctatctctggaacacagcctctctgtgctctcagaaaacacttcccagaagatgtcacctcaatgatgctggtctcttcttaatcaccgctaatttcttagctccagctaaccagcatcaatagtcccagtaatgcaaaagtttcactttagtagttctggtatcttgttaatcacagctgattcttcagccccagctaaccagaactacagaatcttcacaatcaaaacaggaatggccctgaaaagagtctttaattttccctctgaaatttcacaagccaggcctccatcttctgcactgttctcaacattatcttccaagctcctacaaaacatctgacagagctcttaacaacgaatggatcttcaagcccaaagttccagagtccttccagagacctccccaaaacatggtcaggttgtcacaggaataccccactatgctggtaccaatttgtcttagtcagggtctctattcctgcacaaacatcatgaccaagaagcaagctggggaggaaagggtttattcggcttacacttccatgctgctgttcatcaccaaaggaagtcaggactggaactcaggcaggtcaggaagcaggagctgatgcagaggccatggagggatgttctttactggcttgcctcacctggcttgctcagcctgctctcttatagaacccaagactaccagcccagagatggtcccacccacaaggggcctttcccccttgatcactaattgagaaaatgccttacagttggatctcatggaggcatttcctcaactgaagctcctttctctaggataactccagctgtgtcaagttgacacaaaactagccagtacacctgtcttagtgtttgccttttccttaataggtttctggactatttgtctgacctctgtgtgtccaatagcacggccatccccgtcactcaggaactcatctgcaaattcatgctgagccctggcaatgcggacatcctcattcagacaaagtaagctgctccatggcggtgtctgtcggagcacccctggctgaagcgtgagtcctaatggattccacgtgtcgttgctctccaggctggtgtccatgcaagtggagaaccccatggagagctccatccttcctgatgacattgacgatgaggaggtctggctttactggattgacagcaacaaggagcctcacggcaaggccatcaggcaccttgcccaggaagccagggaaggcaccaaagctgacctggaagttctgacctattacaggtattggggacactcatactcccatcgtgtaaccacagggagccggttctctcaaacctctgagaactacagacacagtaagagggcgtctaaaaatcacgtcagaaggtgggagctgaaatggttaccacccagaaatttcaagatgaaaattaacacccgtgctttccagttacattttccggcgagcttggggcttttgtgcaggaaggcttttcttcctgctcctgatgggacgtaggggcagacgagaagcaataagaccttggctgtggtctaaggcaggaggtggcagtgggttaagatgggatcttgtgagcctgtgctcttctgtactcgagaggggcaggtgtctgtagctcttaaaggtcacctatgtttagtagcaaaagcactggaggggttcctcaggggtcaatatgttgggatcagtagcttaacttgggggggctgacaggatggttcagtgggtaggcacacttgtcaggcgagcctgacaacctgaatttgatccctggagctcatcatagaaggagataactaactcccaacattgtcctctgacctccacacaagtggcacatggatattctccctccccttcaaagatgacaacaacaacaacaacaacaacaacaacaacaacaacaacaacaactgttaatgacctagctggctctttgaacttaagggataaaacccaaggcagaggttgttgagaaccagggaagcatgcagaactagagtctgtctctctgcttctgtatctctctaaaccaagccagcagggccccttagtcctagaggctgaagaacccattggtattaccatatggaatgatcctgttttcttttcaaaccaaatagggacaaagttagtgtggattctggagacctgtccctgtccccacagaggctggggaaggtggggagaggtgatttcatgggactcactctccattacaggcttggtggattaggacagaaagcctggcctcaagagggtgtagtgatggggacagagtaagacctgtattgtcatttatttacaaagagtttgactcgatattgtaaatacttataaacagttgtcatactcagaggctggttgtgctttgtctgttggggccataatggtggcgagagggaatatggtaacatgtctcctgcatttaggtaccagctaaacctctttgcaaggatgtgcttggaccgccagtatctggccatcaaccagatttcaacacagttgtccgtagacctgatcctgcggtgtgtgtctgacgagagtctgccctttgacctcagagcatctttctgccgactcatgctccacatgcacgttgaccgcgacccccaggagtctgtagtgcctgttcgctatgcccgcctctggaccgaaatccccacaaagatcacgattcatgagtatgtttggaaaccccatctcttagagtttccatttctatgatgaaacatggccaaagtaacttggggaggagagagttgattcttccacatcactgtttatccttgaaggaagtcaggtcagaaactcaaacagggcaggaacctggaggcaggagctgaggcacaggccatggaagggtgctgcttactgacttgctccccatggcttgttcaacctgcttttttatagcacccaggaccaccagcataggggtggggccacccataatgggcggggacctccccatcaatgactaagaaaatgccctacagtcttcctgagaccctgatcttagggaggtaatttctcaattgaggatcccccctctccagttgacataaaactatacagtacatcatattcattgctgttcattgctctgacagcaatgaggagaaatactttaatgagggaagggtttattttgactcagagttcgaaggctcagccccaggatcttaaggcagtgccaccttaatctgcacacaggaggcagagggagctcatgtttcatttttcctttttatttgctgatggcctcctgtgcagggaatggtgctttctacactcaaagcaggccttcccttttcagttaatcggttctggagacattctctagttgtgcccgtggtgtgttttctagaggattctagagcccatcaaactgaccatgaagataaggtgtcacagagatgttcaaattcagcagacaaatgcaaggtgaagtgtctttgactttggaataagaagcataggacatagcacatttatgttctcactgtcaacctgggatgccccctggccagggcaaatgccagctctctagcaggaagcatggttctggaagctagtgactactaattgtaacagccacagcctgcagagtgcatggtatgctggcagaccccacctggcttgacccatctcaatttgcagtagcccgtggtgagcagacaggatgctcaccccaagaggttgattgacgtgtccaaggcagtgcactctaggagtcagactgtgtaacagtcccacttctcagtcttcctcatcaatttaacttgctcttgtgtctgtctggccaggtatgactccattacagactcttccagaaatgacatgaagaggaagtttgccctgacgatggaatttgtcgaagaatatttgaaagaagttgtaaatcaaccatttccttttggagacaaagagaaaaataaactgacatttgaggtatttaaaaattactaaatttattttctgtgtgcctagtgcccacaacggtcagaagggggtatcaaatccactggaaccagttggttgtgagccaccatgtgggtgctgagaaccaaacccaggtcctctggaagagcagcaagtgctcttaaccactgggccacctctccagcctcacttgaggcatttaaaaatagttagacatggcaggtttgtgtattcttgctagaaaccaggtgcaattagcatcaaaggttttcctttgctctaatatttagagtatttgatataattccatctgttgatgataaaaatacagacttgctattttaaactttaattttgttcattaacttatttttgaaaccatatgtggtatgtagaaatgcacttcacatactaattacaccatgatcaagtgatttgatacggtttgaattagaagaagaagaaaataaaagaaaaactttatgttacagatcccctccccaggataagtttgtaaaaataaaagaaatcacattttctgattgggtctttgttacaaacatactcagtgactagtaataccaattcctagtatcccaatggtcaatagaattgcaaataagagcccactttatttttattatgccttgataagtaaactaccctatctcaatcatcaattaattataggtttccttgttttatttttgtttatatgtaaccattatgcttgataaacaagggcagttttggataatttatttatttattgcctttaccccaccttcatggaagtgatggtctcaccttgctgaccggaattgaagtgtgaggatgataataataataataataataataataataataataaaataaactagagagaggtccccatcattcatacctggtgtatcagttatccactgtcttcagacacatcccccccacccctccccagtgtgacatttctgtgagtcaggagcctgggtgtagtgtagtgctgtctattcagtctgtcctgtttctgcttctctcaggtgggtgttggtgaccctcctgctgtgctggcttgtcacctcagccctttgtcacatggtttttctgtggctgagtgtccttgccatagcacctggcttcccacagagagcacaagagaaggagggagggagggagggagagagggaaagagagagagagagagagagagagagagagagagagagagagagagagagagctctcacaagcagtgttctgtcgtctaaccttgggaaggacatagcatttttgctgtgacacacaccagcctgacatattgtaggagggacagcctgtactggagccttgtcttggaggctgcaactcaccctcatttcctgtattacccagaaggccacaggccagtgtagaggacatagaagtctgggccagtttatgactcatacttaataaaataatttaaccactgattaggtggaatccctctaacttatatttaattaagtggtaagtattgtaacataaacgttccttaaatcactttgaaggctctgaatcaatcctagatctgagttggtcacagtctgaaccgtctcttcccagggattttaattctcaggtgtcggggcttagaatgacttgggcactataggcattgattccatttccaacgcgcctctctccacgcaggtggttcacctagcccggaacctcatctatttcggattctacagcttcagcgagttactgcggctgacgagaactctgctggcgatcctagacatcgtccaggcccccatgtcctcatatttcgaaagattaagcaagttccaagatggaagtaagaactttgaggaatgtgatggtgtctttgttattaagcaggaggaagataaaaaccaaacatacagagaaatacacttaatgtgggtgtgcagtctgtgcaaacattggctcatgatggggctatgtgataacagggtagacataggagcactttcctctcacgataatgtgtgtgtgtctgtgtgtgtggtatgtgtttacatgtatatgggcacatatgtattgtaagcatgaagatgtgtgtgtgtgtgtgtgtatgtatgtgtgtgtgtgtgtgtgtgtacaggcttgaagttaacattaggtgtctgtttggacactgtccactttatcagcattttctgatgagtatagtaatcctggctactctgtgtattcatattcagcttctctagggagcctctgcttgtctctgctcctcaaacgctagggttgcaggcagctaccatgcctgcttggctttgacattgggttttagggatctgaaccatcaaacgttcagtagtgaccatatcataaccatatatatcatacataaaaactatattcataaccgtatatatgtattgtactggctggttttgtgtgtcaacttgacacaagctggagttatcacagagaaaggagcttcagttgtggatgtgcctccatgagatccaactgtaaggcattttctcaattagtgatcaagggggaaaggccccttgtgggtgggaccatccctgggctggtagactttgggttctataagagagcaggctgagcaagccgggggaagcaagccagtaaagaacacccctccatggcctctgcatcagctcctgcttcctgacctgtttgagttccagttctgacttccttggtgatgaacagcagtttggaaatgtaagctgaataaaccctttcctccccagcttgcttcttggtcatgatgtttgtgcaggaatagaaaccctgactaagacatgtatatatgtatgtatatatgtaaccacatatatacatatacacacacacatatatatttgtgcttgtaatatttgtagtggtattaggttggaaagtgccccgagataggaagttgtctctggggggaacacagaggactccaagctgagaagccattggtcactggtagctgctgggagaggaagagtttgatttctttgaggctggagcccctgctaagtcaccgatgctgtagtggatggctccatacttaagaacacaggagtgacacagattgtacttaatgggttaaaaaaaaaaaaggacatgaatttgggtgggtggcggtggatcctggaggaattgtgggagggaatgaatatgatcaaaatattctagaaaattctcaaagaactaaaaacgatatgaagctggtaaagaaaacaattttcttggggataagagctggccccagtgtcctgtcgttcatggtcatggggcactctgtctttgtactggtcaatctaagactattcattggctatattgtgtcttagggaaagacatactgtcttcaagcaagggccttggctcttagcagcttgcttagcctccaagggccatctgctctctgatttaaaagcactgactgtataactgatcttttggattcaatgccagcctggtctacagagtgagttccaggacagccaggactatacagagaaaccctgtcttgaaaaaaaccaaaaaaaaaaaaaaaaaaaaaaagaattgtgtcaggaagcactttttgttacacacaggagtggccaaaatgaatgtgaatataatggccgacaagtggacattctgggtattatttgcaagttgtacatttattgaattatataattgttttcttcttattccaaaggaagtaaagtccaaaggttttgtttttcccttttcatgtacatgtctgtgtgtctgtgtgcatgtatgcatgtgtgtttgcatgtgcatgcatctgtgtgcatgtgtgtatgcatgtgcgtttgtgtgtatgtgtgtgtgcatgcatatgtgtgcatgtctgggtgtacatgtgtgcatgtgtgtgcatgtttgtatgtatgtttgtatgcatgtgtgtatacatgtgtgtgtgcatgtatgcatctgtttgcatgtgtgtacatgtgtgcatgtgtttgcatgtgtgtgggcacacatatataagcatgctccatgtacaggctcagtgttgatgtcaggaatcagcccactaactcttatattccttgtactatacttctactacattccctgaggcagggtctctcaattgaatccattgctaatcagtatggatatggatggtctcactagccagcttgccccggggctctcttgtccctgcctcctaaggtgggaattactcaaggcttctaagtgcttggtctttggtcctcacacttctgcagcacttgaactgctgagctgtcttcccagtcttaggttttcctttttactgatgctaataataaaggttgccctacaattgtgaatcccactgtacctcctccctcctctttttgttaaaaattaaaccagttttattttaaaaaacaattaatattcacacatgcataaaccatgcttggatcaaactcacccctcactccattccttccaactcctctcttactctgctcccaagtatccccttccaactttatgtgctctctctcttattttgtttgtgcttttaacattatttttaattaattaattaattttgaattaaaaattttaaattacatcagttcacccttttctctccttcctctgatcccttctgtgcctctctgttcctccttattgttggtctctttttctttattagtgttacacacacacacacacacacacacacacacacacacacacacaaatacataaatttgttaatataacctgctgaatctgtttagagtgtcttaggcatatatgatttcagggttgaccacttagttactaggtagccaattaggtgtctcatccatgggagaggctaattttccctgttttcaaggtcatttgatgcttgtagttatttgtgtagtgatgagaccctgtgagatattttccttctatattagtttgtactggtgataaactgcttcaggtcttgtttgggaagtcataatattgaggtatcatgggtgtggcttccttgtcattgctaagagacacaatctcacagcaggtttcctggtgctctggttcttacaatgttcctggtctcttcttccaagatattctctaaactttaagggcaggcattgtattgtagatatatccattggggctgggtacttcatgatcaattgatccttgcagtttgattagttgtgtgtgtggttttttgtttgtttgtttgtttgttttgttttgttttgttttgttttgcaatggcctctgttttctgcaaagagaaccttctttgatgtgtgggtgagagctacacttatctgtgggtataaaaggttttagaatgtagttagaaatcacactatctagaaatgtagcagtgtcaggtcctcctctaagatctatgacatcactatacccgggctgttggctgggtttctgggaccaggcatgatttccctcctggtgagctgtccaggtagttagctgtgggttaactccaagtatgaatgccattattgactcttagagattgtcttacttttctattgctgtgacaaaacatgaccatagcaacttataaaaagaaagtattgaattgagggtgggtgcttacagttccagagtccatgacctatcatggcagggagcgtggtgacagggaggaggaatgggtgttagctgagagcttatgtctgatccacaacacagagagagataactgggaatgtgtgggcttttgacacctcaaagcccacccccactgacacatctcctccaacaaggccacacctcctccaacaaggccacatctcctccaacaaggccacacctcctccaacaaggccatacctcctaatccttctcaaacagttctaccaaacaggaactgagttgagtacatgcacacctcctaatccttacatgagccagtgggggccattctctttcaagccaccacagggttgccttgtcttgctggtcactgtcatttataggtgttacagctgggtgggaatattgattgctttattcttttggcagtttgcatagcaccttctggtactatgaaaactagaccctaggaggtttttgggtaagatagacccgaatcttctgagtcctgagaccaaagtgtgtggtccctttagcaatagggacttactttcaacctctgggaggcaaccaagggccatggcaatagcctatattatttgggagtcacttggactatcctgatcaattgcttgaatagaagtttctcatgcctggtactgggtttttgttagtcaacagctcttgtgagagtattgtcagctcaagtgatataacttcatttaatatgtgtatgtttgcaaacatagaataacacagttttttgaggctttaccaaacatccttggtgttatttttccctcctcaatcctccctctccagctagagccccatctgttagaagccatcttacctgcctgctgtttggatgtatctgggtacagagaggaagttaacccacaggatcagaatctgcccctgagtaccctcaggtgtagtgagactgcctaattaggactgtcctttctttttgtagttgtcacccagcccctgggccagaatccaataaggtgacagatcacaggaaacttctgaaagaccagacagccaaatggtttctctgtcatctatcgatttgcctttccatagctccgactttttaggggtttccatcgttcagtcctgacacatggccctttgccagccagtgactgtcacctccctactggggatacagggaatggcactggaaatgggaaatcactagaaaaaatccatggaattccattctgtcttatttccttttctgagatttcagctttggagagtgtcctagtgtcgtttctgttgctgtgataaaatatcctagaaacaagcaactcgggagaaagggtttgacgtagttcacaatcccagattacagtctatcactgtggggaagtcacagaggtgggagcttgagatggctggtcacaggcatccgcagctacggggtgagagataaaagcaagcatgcatgtttgctcagctttctcttcacttactcagttcagggtcagggaaatggtgctgcgagcattcatgtggttcgtccctttcaactaacccagttaagaaaaatctctaccaggcaagcattaggccaatctgaactaggaaacctcttttgagactcttccaaagtgattctaggttgatgttgggaatcatccttgatcagtcatctactgtattaactgaggcagggtctctcaatcaaatccagaggtcactgatacagttagtctcacttccccacttgctaactaaaccatggtggggatgaactgccttgggggcccagagaataagatatgggtaaccaaaatgcccgaaaggatcagagttgcctgggctgatatgtatgtagctctgtggcccaacacagggtagggagaggtcaggagcaagagtggtgagagacactttggacaatggggacccaggaggaaaccttgtgcccaaaggactgggaggagagttagagggcttggtggcaacagctgggcactccattcctgctttctccttctgccctgcctctctcctgtcctccccttccccttccctctcctattcctccttctcgccaccccttcttcttgcttttctattgatagaagttttctccatgcagtccaggctggctttaaactcaggctcttcctgtgtctcatgttctaggatctgtgcattaccatcacctgctatagaattctgtttttctacttttctcaagtttctcaaggaattcagtacaggacaggttgcatttactaaggatttttgtttagcttgctgtggtttcattaggtcaaaaaagttaaaacaaaaccagacccatcaactacaaacatgcctatatgagatatgtgcatcagagagacaaaatgtttcagaaaccctaacttacaaatacattttttattcattaattttaaaaagtctgtctcatctgatgtctcttggcctacatgattcagagaggaatagtcagagttattgagaaagaaaacagtagcagtggaaaatctgtgcgagtggattctgtgcctggttctaaagctcacctgtgtcgtgttttgtgcaccgacacgcacatttgtttctcacagatgtttacttagtacagtgtgtttgactatacacaaaatgtgtgctatacataaatatacatatttttgaatattaaaatagcattccaaatgtgatttgtaaaaattattaaatgacaaggtaacttagtaaaatgcatgtcatgcaagcatgaagactagaattcctagagtccaagtaaaggtcagatgttgtggtgtgtagggtaatcccagctctgaatctctggggctcgacagcctactagatgaaattccaggccagtgagagaccttgtctctaatcaaccaagtaaccaaccaacccacccaccaaccagtcaaacaaccagccaaccaacctgcccacccactcaccaaccaactgatcaaccaatcaacaagaagttggattatatctgagaatgacacctgaggttgacctctggtttctacaagcacacaagtatgtacagacttgcatacacatgaacagacactctttcatacacacagttacacacacacatacacacacaccactgcctggccttttgtacccttgagtctatttggcaacttatatgacatgcttttcctgcctcattttaagagaagaatcagatgttttcttcacctgtgtccatcaatactttctgtaggatttacagagtgaggagtacccacaattcatgttacaagacaaagttactctatagcatccttacagctctctcaggggttgctcacataattatggtataaaagctttttaaaaaatatctttcaataattttgactcaatagatacagaagatttactctgtctctgtctgaaggatttacttctgtctctgtggatgtgaggtggtcctgatgcctctgaagctcctgggcttgacaggagtaggtttaggcactgctcctcgtgtgtgtgtgtgtgtgtgtgtgtgtgtgtgtgtgtgtgtgtgtgtgttttggaattccatatattatggaatatgtattctcctacacctaaacagtcaaatatcaaaagtagtcatgccttatgtgttcatgaatgattgagagccacaggacagtggctttggtgttgggaagtactttggggaattgactctaaagggatctgaaggagtgttctgggtggtgggtatgttcgagtctggatgacatatggtgtatgtgtgtgcacgcacgtttttgtgagaaccctgaagaactcacatccgatgctaagttacctgtcaatcacagagcagtatcaaatccatgcatggctcatctggccagctgggagacattaaggatcagtttcacagattaaaaccctgaggtttggaatactgcaatgtcagtgtttgacaaggatgggggtggagcctggctatgtgctgtgaagatcctttcaggtctctagtatagggaatgggaaataattttctcccaagtcgtccatttaatatccagagaggatatcctttatctgtggctgttagaacaccccgaccacaaacacactgggaggaggaaggtttgtttcccaccatcccaggtcaaggtcactcagggtcgtcagggcaggaacccaatgcgggaaccatgtaggaacatggcttgctcagatagttttctatatagtccaagcatgtttgcctaggaatggtgccacccacagtgggctggaccgtcccacagcaatcaacaataaagacagttgccacaaggtaatctgatctgggtagtccctcaattgagacccccctcgttcagtgactctagatagcacacaaagaggacttcaaataaaataaatacaagttagctgcaggtgaatgtcagccatggttctgttaagtctcctgcttcctttaaatccacttaataattgtcaaacccgactgtgattcatgaccctgttcctgtagagagatttatgagacaaaaaaacttaacttttattttgtgcagcttcagaattacacaaatttcccatcacttcccactcttgtgaaactggtgagagacacttggcccatcaggatgataaaaacaaatgcgtctcctcaaaccaccctaggcttccgagttcccttgaggattcaggggtctgcctttttcccctaagcatttccctcccttttgtatttgtatttgcgtttgtattgtgatgagctacatagctctggctgtcctggaacttcctctgtagaccaggctagcctcaaactcaacagtgatttgcctgtctctgcctcccacttgcaggggttaaacatgtaagcagccacatcctttttatttttgacctaacagggatgattcccacttttctcaaattactcgacacactgcatctgtccagatgcttggtattgagttagttattgaaaaaaaaaagaattgaaattccagggtgttgattttccagaaaattaaaagaatatgtgttatttcctcagctgaaaagctctaagtgttagctctggttgagcagtacaaagctgctttgcataacattgaggactggccaccttggacttgtcttctaagtctagaattaaaatgaaaatttcctgtggtaaatagatctgggacatgatgtatgcctgagatttgtgtagtggatatgggacagtcatgtccctgaggtttgttcagtggacacatgacagccatgtgtctgtgatttgtgcagcgtggctgatgtttttctagctgcagaagttcacgatgtaagcctttgaattggagacctctgagttggccatacatggaagtttcaggagaatcttgtggtccacatgccacaggcatgtgagggtgtgggagggtgggctgtgccctcctatcttcccaactgcacgtgttacacattaagatgtttgtggcctctgggttttaatttgttgatgacagtatctatatttgggggaaagaattgtctaggctaaccttccttacaataatcattcggctaaatgattattttccatgcaaatttaaataagatgcagactctgtgtgccatagatttctgtgtgaaccaggagtaagattaacagaggagcctgttcttcatgtgtgagaagatgtcctttggaggctagcacgcaaatatactcagcagtggggtgaggacactagctggtgtcagtgacttaaaaccatcattgcctgggactatcagcacatctttggcacactttgccaaggtgtgggtgcaccacagtgattcagaaataatggtttggatggtttgagagttctggacagtggagcctttgcctcaaaattcttctgctagaaagcagagggtgctcacttcatgttgcccccgctttgtccagtcttggaaacgcttcaaacgttaaaaaaaaaaatcccattttctctttcggttatctaactagccatataacaaaagttcccaggacttcaagatgaaaacctagggtcatttctgcctgggacctgcatgcccatcagagaaattgtcattatttcctgcactccacatggtgttataaggatgcttcccttcatgatccccatgcatttggggaaggtgatgagttcagaggttgcagcctttccatggtgtacttgtgtgtggctgctgttgctcactgctgtctggtgtatgcatggtttacattcttttatcacggggagttctgtcgccctgaatcccatttttatctctgtcttggctcacaccatctacacttctggaagggaacatgctttgccagatgccaaggcctctgctttaggcagaagctcatgagcactcaaaaagtcaagactgctgtttgcgaagaaaagttggcatgtgttcttttgaattcagtggcttgctgtaagagctgagacataggaaacaagctgggacctaaatcatggtagtgaccgggtactccctgggcttgctgattgtggtcaatgcgaggaggtgtggttgcgaattgtgttctggtgtggatggagaaaatccatgagatgcaaactcagggagtgacagacagcaattcctcactgggcatgtttgtgttgttcacccctttctatactggtgtcagaagagatggctctccctgggatctgaacaatgcatttgaagacagagtagacaaatgaatgcacactctgggagaattcaggcttctcctgggatgaggaattttttacctttaaccccacttccaagttctttttgtgatatgaaagcccaaaggcccttcatctgggtagggagggaagatgcttgaatatcacatctgacactttttgtgctcttggtacccagccaggaccttgccaccctcctgcattgtaatttctaaagccatgagttttaaaacagagacttaggcagctgactctgaccctgacccctctaaggattctgctcaaagatatttatggggccaagagcataaagattgctttggtttgggacgcagggaagcccataagcaggtgacagcgttggtggtcgcacatgagaggcctgtgtagaaactatgtcttggctgcacctgctgtgcctgatgtcaaaagatttcacagctgacctcagaggcacaaagtgaagaggtcagctttagtgttttgaaccaattaagaatgtccccaactctctttttataaacaaaacaaccgactgaaaccactgaagcaatcttgtggatgacgctcatcaaggtgtttattgagcaatggagggctctgtgctgggggggtggggtggggtctgaaggggtggggtggggtgagtggggtggtggtgtctcgattctttatcacttagttaagtcacttctaaaacggatggtgaaaagcagtaagagtcagagaaaccacagggtgaattcgggttttctccgagcttccacagaatgcttgtgctttggggttttaaattctcttttcttttgaagcaggctctggctatgttgcctagagcacatgagctttgtctatccttctacctcagcctctcatggagggagcgacagactccatcctctctacctggtccctctagaggttaaacttgagggttgaaacattttataaaagagagagagaaaaaaaataaccgtcttaatttgcttacagggacttggtcacagtctttgattctccactagtaatttgctgtatcttagagacaaaaaacatttcttctcatttgtcaaaccattctataacactgtaactcccaatgcccattgcgccgatatgccctagcttgtacattaatgaatagcaacatagaaatccccaaaatgcaacgacgagttacatgtaggggtgtgaaggctgcagtcaagtcctcattagataatgagcaagccctgctgatgctgtggtcacccatgccttgtctgtgttgactgagtcctcttcttgtgccaggcaacaatgtcatgaggaccatccacggagtgggagagatgatgacacagatggtgctcagcagaggctccatcttcccagtgagtgtgcccgacgcacagcccatcgtccaccccagcaagcaggcgagccccggcgagcaggaggatgtgacagtgatggacaccaagctgaaggttatcgagattttacaggtatgtccagcattgttctctgtcactgtgtgtgtgtgtatgtctgtgtatctgtacatgtgtgtgcacacgtgtgtgtatatgtctctgtgtaatttgtggctagcctcctgcctcagctttctgagtgctgagaatccaggtgttaggcatgatacctggttttgctgtgtaactatgttgaaatgctatcggtgtgatatgattctgaattgtcactggtctctctttattctggaaggctgttgcctttattttattattacttttaggtgagtaacagctgacaatctcacattgatgctgctgtgcacacctaccccgttgttttgtcccagcaactacactaatggtatctagcaatcatggagggctttgaggtgctaacatagctttcctgtgtgtttattatcagctggttttgactgagatggaatatttttaacatttaagaaggattttaaggcaggcacagttaatgatgatatcctaaccacttttctgtgtttaattgcttgaaacatatttgtgtgttccacatatccagatttcttgttgtcacaggaaactcaaaaattttatggcagacacactgatatactcctataattttagcacccagaaggctgaggcaggaggatttctatgagttcaaggccagcctgagcaacataacaagacccttgccacccaatcattatttaccaaacatactaattgctgacttattactttacgtaattactttgtttctaaggggctggggatgcttttttggttttttgcacattagccaagtttaatacttagccttatcaatttaatgagctgttatttcatgcatcagacccctcctcacagaggctatgtttctagcattttcgctttggggtgagtctgggaaacaggctcatggtacctttgtgatagcatttcttctagagttgggaatggagcctgtagctttcaagattgttttaagatgtgaacagtttcccaaatctttcgtcatcaccgagcatagactgagctctcagaagcaggtcagcagtcctggaaggctccgtgcatttctcattcaaagtaattagatttatagtcataacacatttcccagttcctccagggtttccaaaggccatgtcctgagaaatgttggcagcctttcctactctgtgttcatggccttgaaaattcatgtcatgttcagcttaccctgaagctgagaaagggacctctgggctcagttcagtgttgtttcctgtctgtctgtggggtcccagccccctccatcccccgccagtggatgacctctgacatgtggcctcatcttcaacaccagtgcctctcacagtaaccctgaggagatgctgtgtgctgcagccacactctgctcactttagctgccatccagcacttggagagtgtcccctgagcctccttgcctgacttcaggcaagatctcctttttcacagactctcagagcaactctccaacaacccctggagctacactgactgctttctgccagctcttcctcctcaggagctgcccctctttaccccatttaaataaaatacgtttttcagtgaacattgtcttgttcttccctctgaccttattctctctctttctctgcatttacacattttaaattttatttttattttgctaagacacatttgttttgtgggctggcccagacttcatttaggctggtcttgaacccatgagaattctcctgcctcagccccgcagtgctgagaatgttgggattatgggtgtgagccaccatgcctggctttttctctatcttgttatctgtctccatatcttacactgtatctgcagcttcataattaggaacattagggggagcaaaggtcataaaacgaaatcctgtgagttctcatctccagcagaagggagagcttcatttgtgtctcatgttgaattcttcttttcttcctttgggcatctgagttttaaaatcccctgtgtactgagtacccatagcctggcttctgtctccactctcccgcttcaggaccaagccccaggctctttattagtcaatggttcccaatgttggtcttccctacaccctataaatccccattcactggagtctccctatccagcatatgttgtattcacagcaggttaatagaagagttgctgtggggtttatttttctctctggactttatattcatcaagagccacatttacaacctggcctcctgaaaatattatattaaagggatttttaatttctgtatgcatgtgtgtgtgtatgcatgtgtgtgtgtgcatgtgtgtgtgtatgcatgtgtgtgtgtatgcatgtgtgtgtgtgcatgtgtgtgtgtatgcatgtgtgtgtgtatgcatgtgtgtatgcatgtgtgtatgcatgtgtgtatgtgtgcatgtgtttgtgtatgcatgtgtgtatgcatgtgtgtgtgtgtgtgcatgtgtgtgtgtgtgcatgtgtgtgggggggttatgcacatgaatgcagatgcctgcagaggccagaaggcagcactggatttcctggagctggagttacaggtggttgtgcagcatctgacaggatgctgggattcaacttaaataccgcaagagcagcatctttccagtcctgcgggcactttttgtataccttaccatcttcctctgcctggcaaaccaatgtggatgaatttagcgaagagcagctgacgtgagcttgcttcctccttagtgaagcattaagacctttaaagtgtggagaagaggatggtggagatggagggaagaggacagaaagtgggtaggaaaggatggagatgagaggggaaagagggaggggagggaggaagagagagagaaggagagggcaggaagggggttggaaaggttgaagatatgagagagagagagagagagagagagaggggatggagaggggcagggagggaggggagggatgtagagaaagaggtcaggaaggggataggaaaggatggaggagagagagagagagagagagagagagagagagagagagagagagagcacgagccaggtactggccatgggatcataagtatcattaaaggagtgtgctgtgggtgctcacagtgtcttgagagcttactctcaatgggtagagaagagaatcaaggttccgtggactctcaacaagcaggaggatacaatgggacattgtgtgcggcacagcactcacgggacagagaagcctgagcactgagagaagaggtggtgcctggggagggccctggaaacaaacagaagggattgcctactgataacacaaaaggcaggttttctaaagccttggctaccatagtgttcactgttcacgaactggtaatagctatgctcaaaaactcaggcttatctcagggtagttgagtgaaggttactaaactcagagcacatcccctaaacagtcttctgtgatcccctggctcagccctgtggaccatctcacagcagagctatcccttgtcttcccagctcagtaacttgttccttccaggcagggattcccaatgttcaggttcctcaaggctcctagtgggagcttgggccttaagggttacttcattagtgtctacacatcgctgagatgataacagaatccagaggagacatgaacaccatggagaaacccaggagctaggatgtcagcctgcctgggctgtcagcctgtcaggcttctgggctggtgtcagtagagctagatcaactctactgcagtagaaaccacagcctttctgcacaaaagcagctctagcattttcttctcagcaaagaaaactgcaaatgtgtctgggaacataagagcattgcctcttagacccacaggcaccctactggaaatgttcagatcttgtgggcaccagatttccttgtttctaaaacaaatgggggccagatatagtggcacatatatatttgtgattctagcacttgggaaaagggacaggatggtcaaggttatcctctgatacacagggagtttgaggccatcttgggaggggatcttaaataaataaataaataaataaataaataaataaataaacgtggtctcagtaccgaccaatgaaaacatctccctttcctttatttcaaaactaatataaaccggcaaacagctgaacgtttatagttttcaggtaagatctttgcttggctcatttggaagactgagatatgtggttggtgtgtgtcatggcttgcattaaaaacttgctctgtttgtatggggcacatgtgtcacagtgctcaactctgcggacctggctctctccttccaccttgcctgggttccagggatggagcccaggtcgccaggcctatgtgtcaagggctttacccatagagccatttctccagcccaggactcgcatgttttaatgtcgtgctgatgcctgcactatcagagtgtagcggaatctttcagtccgcgctgatggaactaagttctccatactccttcttctagttcatcctgagcgtcaggctggactaccggatctcttacatgctgtccatatacaagaaggaatttggagacaacaacgacaatggtgacccctctgccagcggcaccccagacacactgctaccatcaggtatctctgtaattatcatttgcattctgtgttctttaaaatgtattttaaataatactttttattccttgggagtttcgtgtatctatacaatgtattttgatcatatccatctatcactactgccccccactccctctaatgcctcaccccatttcctcccccactcatttccctgttatagacaacctcttgaatccagttgaggctgccaatatgaacctgggtgtgtggctgttcactagggtgtggtctccttaccaatagccttgccttgttgtgaaggaagagtgacaacccctccacagtggtcatcatttgccaacatccatgctaggactttggttttttgactggcctgatctggttgcggttacctcagctgctgtgagttgactgcaccagccatatcatgtctacacatcaggatgtcaaagcgctcatgtctgcttgctactctattctttctgcctcatcttgagatgattcacccctagctgagctctcagtgttatttatgctctgtattttggccaggtatctgtattaaccatcatccatgggaaaataaccttctctgaccagagctgagaacagcattaatccatgtgtgcaagcacacatatgtagaaagctgtttgtcagcacaggctcttagtaaaacaacagtaggttctgtaatagtgcctgtgatctccccagtcatgggctgttgaccagccttgaaatctcttctggggtgcaggctttatatccaatcaaaaagtggctggctaatcctataactattatgcctctattgttcagtgggcacatcttgccagcatgtatcagtattgaaatacacagcagccagccttgagtagatttgaagtgtttcctcctgcaggaacctgcacagctcctttggcttatgtaagttagccagcaggaggagagctttctggtctattgaggttgtttcctctgtgtcttgaatccaaaatgagtgatgtctctagctactgggtcttgccgtttagtattggtgggcaaccaagggtaatgacaatagctgtccttggggccttcatactgtccttggggccgttctgatcagtaactcacagggagctattctgtgccttgcactaagattttaatttaataacccatgttttctagaagtagcactgtctacttatgcagggaacttatattcaaatttgatatgtgtgtatatataaatgtgtatgtgtacatgtgtgtgtagggtctgtatatatatatttgtatgtgtattcatgtgtggagtgtatatatgtgtgtggtgtgtgtgtatgtgtgtgtgcatgcatgtacatatatggattgcatagtcagagaacacacacatatgtgaatagtgtgtgtatttgtatttaattaacttacaaaataatggattgccataagacttctttatgatccttgattttgcactgtgcttttaaagacccccaagcactttttctatctatcttaaaacaaaagtgtatccatgacagaagacaacaatatctgtggttgaaatagggacagagcagtagcaaggcactgtgtcctgtatatgcctgttccctgtcactgcctgactgtaataggtagggctgctgtttattaccccatttcacagatgagaaaaacaagggttagaggtgcaacttggaaagaccagagtgtttgttatctgctcctgtacaaagcaacttaaatatttgttttgacttaggttttgatacttagggagatacttcctagtggaaggggcagcaaggggtggggctacttcaggatggaagggcagcaaggggcagggcctgaggtcacttggtctccacattcaggaagcagggaaaggtgagtgctggtatttggctcactctgagggatggcactgcccgcattcagagtggatgttcccacctcaatttaaccttcctggaaacatcctcacccgcacagccaggggtgtttccatggagactctaattctcagctggttggcagtgaggacatcaaagtcagggagccctgaggcctcgccagctcgagagcctggatcttttgcacattatgttctttgggtgagaatctgagaaaatgttcatgctggatcagagagaaacgtgaagtgcatctaagaagggcagtgtctgtgggcaagccgcagctagccagagaacaaagaggaagggctcaccacctgtggtggtacctgcgctttggagttctatctcacgcttaaaatctagggtgtttctgagacttggaacataatcccaaagagcatcaaaatggctgtgaaattttggggccgtagaaagggctttgtgaagactcagaaatattaattcaccttttacctggatggtccaggtcagtcctggtgggctgtaactacatcttagaatggagacagcagttagcaacccttctgaggctagccgttgtgcacaaagaggaactccccaccagtgttaggagccaccgtctccatccatccattggctggacaagaaagactcattgactgtaatgagatcggggaccagagtggttgcctctctgccctcctctgaccagcaggcagcctgccctgtggacaatggacagccgctgttccacccaggcgtggagccactcctggcacccctgcaacactgcagcttcccagaaatacagaccccaaagggctgtttccaggaacggtcagacagaaccagaaagccatgctggcgctgcactgacagaagtgtaacagttattggctcccagaagccagatttctggaaacatgagctctgagtgtccgtaaagtacccaagcaaaggttgaggcaccaggaaaatcctcgctctgatggagaagatgtctttctgagtgtgtgtgtgtgaaagagacagagagacagaaagtctgtatgtgtatgagtatgtgtgtgtgtgtgtgtgtgtgagagagagagagagagagagagagagagagaatctatctgtatgtgtatgagtatgtgtgggtgaccgcgcgcgcgagagagaaagactatatgtgtatgtgtctgtatgtctatgtgtatgagagagtctatctctatgtgtataagtatgggtgagtgagtgagtgtgtgtgtgtgtgaaagagagacagagagtctatctgtatgtgtatgagtatgtgtgagtgcgtatgagtgtgtgtatgagagagagagagagagagggagagagagagagagagagaatctttatgtgtatgagtgtatgtatataaagaataggacttttccttctttttggcatctcttttcttttcatgctctacagatacttgcctcacataggaaatgaccctgctctacaagaaaaagagacagaatttcaaatgtggcagaaagattacattgctgggaagtgcagtgactctgctctttacatgattttgattctttaaaaaaatgcctttccctggggcttaaagagacaacttagcttttaagaacactggctgctcttttataaccctgcttaggttcccagaacccacatggtggctcacaactatatgtaactcgagtccctgggcatccaacacccttttctggacactgctcataggtggtgcacagacatacacacaggcaaaacatccacacacatgaaataaaaataaaggagaacaaaattgtttgtctataccatcactagtgtgacatgtatttttatgtaggcatatacacatatatttgacatatcagatacatacacacatatagttacttataaataagaacacctttgtaaatattcttattgatcttttaatacatttgatggcagcaatatgttaatttaaagcatagtttatatgaaatagggagaaaactcatttgcagctctggattcaatatacagcatctaaatatatatgtacatatgtacagacttcaattaagatgcttaagtttgttccagctcttttttaattctgttgctgtgataaaatactctagcaaagagaatttaggagagaaaggggtttatttcagtttgtttttctaggctatcgtccatgtggcagggcagtctcagagcatacccttgagagagctggtcacaccacagccacagccaggacaagagagaaataagtgcacacaaatgtacatccttgtgctcagcttggcttctgcactcttcaacaattcaggatcttatgcctagggaatggcgccacccatggtgggctggatcctcccacatcaaggaacatttagtaatcaagtcagtccctgacactgcccactggctaacccactttatacagttcctcattgaaaatgtgttcctaggtgattctaggttgtgtcaaattgataaagcattacactgtttgagtggagccatagtgtaattttgtgaactattagcattcaatgtcacaaaaggcattaagataaaaaaaatatgtctgagtaagtgaatataatgtgaattaagacaaaataaaaatgttcactgtgtttcttcacagctcttgtccctgacatcgacgagattgcggctcaggcagaaacaatgttcgctggaaggtactgtaatgagtgtttatcttatatatgagtatatctcacttagaattttatccgtagtttgttatcattcatctttttacacatatttagataccctggttgctgataacataatttctcccataaatgaagctttaaatttattctagaggaaaaaagatgactctcatttaagccatctttaaaaactggcagaaatcgggtccgcatagttaactctctcagaattcttagcttttatttccttagatgatgagaatacaaatgtccttagctctgttatataaacattgtaacacatcacttcaccaagtcaagaaagtagcttcttttgatgttgtctttagctttatgcaggagaagccaggcatttcttccatccttaagtgtccatgatggaagaaagtaaggcgcctcaggaacccgtgcgtgatatgtgctctcctttgctaccatgtccctggcgtgtattgttgtgaagtttctttttcagaaatggattaagagcaaccacaatgagaaagtacatctcagaattactgaagttcatttttattacagacctcaggtagcccgaggagacaaaatgtttaccctgtacctttctagaaaggggaacaagaattaaggtttaacagaaccccaagatccacagttccgtgctagcctaggctacatagtgtgactctgtgtaggggaggagggtgagagagagggaagggaggctggggagggaatggagggaggaccggagcccccaaagacttactgtttagtgaacatttggtgtaagcttattttctgctgtgatactggcctttgttatgattttctattgcaatattttattattctggggcaaaaagataaaggcagtctgattttcttttctttttttaaaatatagccttttcagacttttctttttaaaaaaaattttatttattttatgtatgtgagtacactgtcctgtcactgtctttagacacaccagaagagggcatcagaactcattacaaatggttgtgagccaccatgtggttgctgggaattgaactcaggacctttggaaaagcagtcagtgctcttaactgagccatctctccagctcctgtgattttattgtcaaatgcagacatgagctgcataatgaccctggccagtgacaccccaggtgtaaaatagcaagaactgaaagattcccggagacagtgacctcatagccaccctgctgtcagatcacagtgtgttagtcaggagtctggagaagtgtgtgggaaccaccacacagctggctgtgtcagtgtgtggcatgtgcagtcacacgcagaatgtagcacttgcaagtgatagttactggtttatgtgttgagtatactttgtctctctgtgtgtatctgtgtgtaagagtatgcatttgtgtatgtgtctgtttgagtctatatgtgtatctgtgtgtttgtatgtatgtgtgtgtgtgtaaaagagtatgtgtgtatatgcatgactctgtgtgtgtctgtatgtgtgtctctatgtgtatctgtgtatgtatgttggtatgtgtgtataagagtatgtatgtgactctgtgtgtctctgtgtgtatatatgcatgtgtatgtgactctgtgtgtgtgtgtgtgtgtgtgtgagagagagagagagagagacagagagggagagagagagagagagagagagaatgcacaaccgcggcttacataccttgtctcctgactgtattacttctcctttgcttcagttacttttgtgctgctttgttagccctgatccaagaatcaatagattatactctgtcagtctgtctctctatcatctatgtatccatcctctatttatatatctctctatacctattatttaaaaatcatctgtctgcctattatctatgtatatttatgtatcatgtgtatcaattatctgtctgtgagtgcaactatctattgagctatcacttctctgcctaccagttctagttatcattcatccatatgtacatctatctgttgtctgtgtcctatctctatgaatctgtaatctgtctctctgtcatctctctcttcctcccacctatggaacccacatgtattgcataacacatatgctaggctatacagactggcacaattgcacaactgccacctataacagagccatctgagtatgtgcttcagaacacggtgcagcaccagcagcaacgcatgccttcagatagacctttcacccagtgaatcttgttcccagtcccactgtgccaagcacacagagccccaggggtgatggctgtgcactgtgactgtccctccccaactgccacgtggtgatttcttgggctctgggggaaaccagccattggttgatttcaaaagggggactctgagggataaagggggacgagtggaagggcaaggaagacaaagaagatagtgggaaaatttgaacaatgatctacttatgaaaatgtgataatgaaccccactcctttatttgtatgctaactaacaattaatgaagaatgatcttgggattactgaatgcctgcacctccctgtgttgttgatcgactcttgagattctccaggaaccacctttgtccctgtccctccatcaatgataggagattaagaagcaacaatgtcttccttttaatttcctgttttgggaacacaagggataaacgcttaaaaacgtgatataattgaaatgactttaatatagatatcatgtaatttgttgttttagaattacttttggttttatagaaaagaaaaaactccagttcagcttgatgatgaaggaggcaggacgttcttacgcgtcctcatccacctgatcatgcacgactatgctccgctgctgtccggagccctgcagctgctcttcaagcatttcagccagagagcagaagtgcttcaggcctttaaacaggtgaggctgggccagggtgctgctcacccagcacatgggctggggctggggctggggctggggctggggctggggctggggctggggctggggctggggctggggctggggcacctgtttgcccagaatgcgcaatctctgagttgagtcctcagatctatacccaagaaaatggactcataaagttgactggaccaagttctaagagtgtttggtgaccagccaacaccctccctgtaccccagcctgatgctagttgcagatgaggcttgaaccttgaactttgttgctgttgttgagacagggtctcactctgtagcaagaactggctcagaattcgctattttcagattgaccctgaactcttggtgatccctctgtctctgcagcctgtgtgctggaattgcaggcacacactatgacacctcttttattactgtttgttttgaaagataggtatggccttgtatgtgcctaacaggacctgctttagattgagtctcccacaggtgatcttcagtcagcatctttataaaaatgacagactctaaaatttagggtgtgctggagaacaggaacatcttagaaagtttgtttccgctgctgttattttggctacagaatttaatgatctatttgacaagccatagcttcaaattaaatactttgtgatttaaaaaatgcagagcctccaaggacaggagccatgatggggatctgggcttgtctcatgtaatgattggattgcacgttaatctcacagtgattagttgtgagtgtgggcatctcaccaatgtcttgtgtttagtggagtgcagacgttaaggagctaagtggggccatttagatacacatactttacatatgtgccatgtagtatgtataaattgcattgttctctcaagttcagagacttcctgtttatactagcaaatgtatatcgtagccattaatttttttcttccatggtgttttgttttgttttgtttgtttttttgttttgttttgttttttcgagacagggtttttgtgtatagccttagttgtcctagatctcactttgtagaccaagttggcctcaaactcagaaattcgcctgcctctgcctcccaagtactgggattaaaggcgtgcgccaccatgcccggtgggtgttttttgttttttgttttttgttttttgttttttgttttttgttttttgttttttgttttttgttttttgttttttttgactttcaaacagatacatgcatagaacacctcagaaaaactaacttgaaccatgaatttagagttaaattatcttttaaaagaattgtttattttttgtttcatgcatgggtatgtccattcatacatgtatgtgaagatatgtgtgcagtgcccatgtatgtatgtgcacatatatatgcagtacccatgtatgtatgttcacatatgtgtgtagtacccagagtccagaagagggttcagatcccttggagctggagttacaggaggttgtgagctgccatgttccaagcacccacatgcactcagctcctcacaagagctttaacccctgagccatctctccaccccctagacttttacgttaaattacttttcagcattttgaaatgtaagaattcccttttatgtgtgaacatattgcttggagttcacagatacttgcagctaagctttcagccaatacacatgtaaatacccatgaatgttctgtaaatgttgacctttgcctaatcagtatttaaaaatgagatctttggtgtacaggatctaggaatacagaagctgtgtgagaatattaagcaacaaagttctcccgtgtttaggtgcagttactagtgtcgaaccaagatgttgataactacaagcaaatcaaggcagacctcgaccaacttcggctgacggtggagaaatctgagctgtgggtagaaaagagcggcagctatgagaatggagatgtgggtgagggccaggccaaaggaggcgaagaggcaaatgaggtttgtttccgagatcacttttaggaggaaaattctttatttttatttaatgtgtaatgagtgctttgcctacatacatgtctgtgcactccatgcatgcagtgcccattgaggacagaagggggcactatatgccctggaactggggatacagacagttgtcagctgacctatgggttagcaatgaaacctgtgtcctatgaagagcagccagagctcctaactgttagaccagggatctagcccctacttttttcttacaaaacagttttactgataatatttgcatgagagctaactgccaccaatgttataatggctgtttctgaaatgcctgccttgtgtcccacttaggggtttgaatccaggaatgtaaagggtgtgtggaggcttacctggggcggccttggaagtactctcaacgtttcaggttgtagaacggggggcacagaaggtgctaactaaatattaattattgaaccgtcgaggggttgcaaggtagcgctgagatggtagagttctctgacaggtctcaggatgacggctacttgtaattcttcactctatctcctaggaaatttcctgtaatgtttacaagtgttagtggaatgtagactttctgatccataaaactttgttttataatgagctagggccatggagtggagacataaattcttctctaactcatttctaaagacaaaaaaaaaatgttggcatttattcagtgctctgcatgtccatggcatgaaagtcagatgtttttatacgtggattctccttttaaatgccaaacagactttggggatggcaatagggctaccttttaaccaataaacgagagcttggaaatccaagggctcccccaggctgcaaactctgggactcagccaacagttggatgataagatccaggctccttaagattgcactttctgacacaaaaataagtcactatgcttttacaaattgtaataccctttccttctgaaaaaaagaaatcacattttatgtgtgccctaggaaatatactgttgcttctcatgcaatcttggcttatgtgaggagaggtctttggctgggctggtgagacggctcagcaggtacaggaacctcatgccaggcctgctgatctgagctcaacgcaggcgtccaacggccctcggcatagttcactgtgctacagaaagacaagatgtctcacaataactcagatgagatgtaccaggaaggctgtaaatccctggccttcactcactgaggcatgatgggaaagggagggctcttctgctgcagagtggtgagtgcttgctattctgcaggaagcatctcaggtgctttgcccgtgagaaagaagaggggcgtgaggagtaattgcagacattctcaaggcaaaaccgtacagcttgcggtgtaaaaaaaaatcagttttccaatctgaaatggggggagctggcatttattcaccgagttccagatgtattggttcaaggaatggaaatcgttgtaggtaggttgcttagggtgtggcttgatacgaaagagttaaatattcagaaaacctagaattgggagaggttgccctggattgttggctttggggtcaaatgatcatagctctgtagggagactccattcatgcatgaggaggctgctttctcaacgcgtctgtggctttgtccgcctctgctgacccactttttgaaggcctgggatgcgacagtgaatatgacgctcttaagagacattcctgtctgctggaatttcctttttggctccctgaagttccagggagctgcctgctagcttcctcctggcaccttggctgccttgagctcaatgcactgggctggctcaggctgaattggatttagaattcttcactgcaggggagctggcagctgcagacaaagctaaggggatgtgaaagggaggctaggcctgagttaacaaccaacacagagaagacgatgcagaggcaatcagtagtggggggtagggtggcataaggggttggaatcagacaccacaggatctactgcttagcatgtgtgtagcttgctttgactttctaagatttgtgtttaccacccggaaaatgggcacacagtgcactgtaaggggtcattgagcaaacctctgatggagtgtgttagcatgcgggtttcttgtcactttgacacaagcttgggtcatttgggaatagggagcctcaactgaaaagataccttcatcagatcggtttgtaggaaagtctgtagagacatcccttgatcagagactaatgtcggggttggctagctcactgtgggcagtgctgcctctgggcaggtcctgtgttctctgaaaaaagcaagctaaggcatgaaagagggtcagtcagcagcgttcctccatggctctggcttcacttcctgtctctaagctcctgtctttagtttctgccttggcctcctttcatgatggactgtgacatataagattaaaggaatcctttcctccccaagttacttttagtcatgacatttgtcacaggaacagaaagtaaagtgagacagtcagttagcatggcttcagtgtgcattcaacaactgacgaagcgagcaagaagctaagattagatactaggaaatcaagcaacgagactccaactttattttattatttcttttaagatttggtttaatttatgtgtatgggtgcttgtggagtccagaagagggcgttggagcccccacagctggggtcacaggcagttgtgagctacccaatgtgggcgctgggaactgaactcagatcctaagagcaacaaatgctcttaactgttgagccaaacctccagcccctcacttgctttggttttgtcatcatggaccagtgggcttacttctgagctgctccatctcctgctcgtatcctagcaacagcattccagtgtcattatctgtgcacagcaccacctagaatgaacaggtgtttctgagtctcctgcttagagatgagggaagctatcctaggagttcttgctagtgcctgtccaaagcctggacacattttaccactaagccagtgtactaagctagcccactgtctttgtatttgtttcctacttgacacaagctagagtcatctggcaagaaggaaccctgactgagggactgccccatcgggctggcctatggacatgtctatgggaaaccgtcttgattgttcattgatgtaggggacatagcccagtgtgggtgacaggattcctgggcaggtggtcctgggctataaaaggaagccagctcaggatgtgcctgtgaaaggagccagcaggcagcattcttccacggttccctccatgatgccctgtggcctggattgtggcctgcataaacccattaccacttacgctgcatgtggtcagaacattttatcatagcagtaaggatcaaatttgaacagtgtgtatcttaagaaatagaaccctacagttgtgaaagccttgtggtctttctgtaccccgaataaaatcccacaagtttgttaacttcctagcttaatagttctctcctatgtgtagtatgtattaataaaacacaagaaatacaggggaaatacctcccccaggctcttctgggtctgctgtctcccatccttgttgaatatggcaataattaattcaccagagctctaatctgcattggtgcattgtcagacatggcgttttagtgagctggtcatggactgatattttaagaactttgctattaaaagcagcattactgtggcagcttgggcagcttcttcctcttgagcccattcaagaggtgcttcagggatgcacttaggagccaagcatcccatgtgctgtgtcctggctcacaccagtcattttctgcagatcaagtcttttcttccaacagtgtgtgagagttgccaaacctcccgtcccggttactgttggcatgcatgacaaccgtgaccgttgttattttgattccattaggtgtttcagaaggtcaattaattaattaattggttaattacttttattttttttgttaaagctaagttctgtttgggaagggaatgaggttctgtttgctcaggtgtaccagataatgaggatgggctgtagagatggctcggccgttaacatctttgccgcacaggagtttggatgccaggactttggatgtttagaacctatgggggtgggggggctgtaattccagcatcagaaggcagagatggggagcgcttgagcaagctggctagccagaccagtcatctgggtgggtggggagcagtggatgttattctttatcctctggctcccgctgtggctatgaagaggttcgctgcgtgcagttgtgtcttaatattgaaacgccagctaagtatatattatgccttactagtatttctgttggtgcgatgtcagtgtacatatgtatgttagatttcattttctttttcctcaagcctgtgacctcacagttaacactttatactttatttaaactcaaacttgtttgtctcacccacatcttatttggagtttataacacccagctgaaaatttaactccagccatggtactttttcataactgaaaaccgatttcccccccacatttgcctggcggttttcaccaggctttatagcttttaaatgttcaggttcatgtctacctgagattctgcgcatttgcttccagagtgaggtagttgggagttgcttttctaatttttaattttttttatctttttaatatatatattttaaatgtttatgtgccttttgcctacgtgtatgggtgtgtaccacatgtgtgcccggtgtctgtggtaccagaagagatgctcttgtgagtagctctctgagcacatactcggctaaggacatctctgtggttacgagatgtcggagctgttagatgaccgattctgagtcggcatgcattgatatccttctgtgggttgaagagggtgctttcctgcttgggggaattgtagctgctccagcctgttgccagggggcgctgttggtctgagccttcagagacctctatctgcatgccggccttgagacaagggtttatatgctgacctttgctgggtcctgcgctacaaagctaacattacacctgccttccgggtggtcactctagcctgtagattggagtccttgataatggcttctggttgtgtatccctccatccacaccctcactgaggagatggagggggcggggcatgtcctttttggggaaggcctgttttcagctgtctctgcagaagctcctgaggtatcttcattcaggcttttagtgcgggtgttgttattacgaaggtacattctgtgtggaattcttctgaggcctgaatttagtctggaggacattctattttgtagtcacactaaatatagatttttggtttgggattttgggggcctctttattaatggaaatcctagtcctagatcccaggagtgggcttttctttgtgtacaggggtttgagacccttaggccatggccagagtgaaagccaagctatctatgtacctttgtctgtccagtgggctgtgtcttccctaactcactgtgtgatgtttgtagatttgtggtttctggccagaactttgatctttcttggctactagacttggcccctctccctctctatctcctcctccccaactctccatctccccctctctctctccttcctttcctccctccctccgtctccctatctcctctctctctgtaggtgcctacccctaatattagaactcagaatgtaggttgccagcatagcctaagttcctaaggggcaccagtgaacaccagtgaatttctgtcctgaaatttttatgaactttcatgttttctgagttcctgttgaaaagaagcatcttaaatattttatcagtcacctttggatgttgtctagaaggggctcgtcgcattctacctggcagttgtcaaagacagtcagcgactctgtgtttccagcccctgtattcgtcccctggtatctgcactgatgttggagatgacccgtgtgggctacagctgagcctcttgttcttaactagtggttgtttctctggagtagagtcctttccaactctctgcctcgtgtagtatggaatctgcatgctcactacttggtattcataggacttcctcatttccattgctaaagtttgatgtctggactccagtctgatatttcagacatggcttctgctctgcaacaatgtacaaagcccaagcacacagcacaggcttgttctgaaggatagtcactaatgtagccaacactaatagcaacaggagtaagagtttgtactagaaatggctggaagctgggagaccctgaagagtttcaaggaaggagtgagtgttccatttggcagaatccagaatgtttcagaagaagcagggccactgtgggaggcgtccaagagccctttgtacacgatcaggtgtgaatttgtgaatgcatgagggtggtgggggttgggggtgagagaaacaggtaaacaggtggacagagaaaccagaagggtctgtctataatgaggtaatttcaggagatgaagaaggaatgtgagaaacgccagtgctaacttatacataggtgaatgagcttcattgtgagggaaccagcagccgagtgcagtggtgacaaatggatggaatccatcccggtgtcaggcgaagtgtctagcagcagcacacactagaccaggccgtggacataatcctttgtgtctctgggagtttcacggaggctctaaacatggcctttggtattgctctgagcaatccagctttcagctgtgtagaaattatgggacacataccgtgaatcctgggcttcatttatgtaatttaaaaaaatgccttcaatatcgtgaaagtttaaaaacattttctttgattttttttttatgtaaaaatatccactctcttacttttatgctcaaagtttagttttctcgtttgcatgttgacaacacagactctttaagggctcgaggggaaatatttcatttaaaataaaaccttatatggcacattagtgtttttctttgtgatttaggttgaatatactaatttttgaaagatgtttatcccttttttcaatctgataaaaactagtgcaacttctcttcaaagtgaagtttaacacaggtaaaagtgaactttcctagttggaaatggctctccatcctccattagataagcaaaagattccaacataatttaaacaaaaaagaatcgggaggagtcaccataggcaaaaatacgaagtgctttagctttatgtccttgggagcatcaatgttcagaagaggactccagatgaccccactgctggcgctgatctctaacgatcacagaggcgggggcagggttcacgcctgtgtctgtacaccgtgctccctgtgtgcagatgtgtcttcaggggccatggaaattccatcatttcgaaggtcagtgggctaggggctaagcacgcagtgtcagcagcatcagcatagtctctaattcatcaccttcaaatacggtgtctaaatttagaaagagagattaagcaaggaaggtgtggctgagtgggttaaggcaggattgtcctttctgcacacccttctctttatttagcctgagaagcaggtcacctgaacatgtcagtgctccagagagaaggccctgctccattcattttattattacagttatcacatcagtttgcttctccgtttttacctgcttctttctacgcaagtgtgtagttttcagtgttttcttgtaatttaaaatatctttgtatgtatgtgtacaactgtgtagttatgtgtacatgtatgtggttctgtgtgtgtgtatgtgtacaaccatgtgaatgtatgcatgtatgtgtttctgtgtgtgcatgtgcgtatgtgtgtatatgtgtacatgtatttgtgtgtgtatgtgtgtgtacatgtatgtgtgctgtctctgccttcccatttctgggattatagatatgctgttgatcttgacttacagcttttcataataaaactgcttaaccattcagtaactttaagtctgatatttacgtatctaccttgttttggactaagagcaatattttcttttgtcaagctttctagttgggtcttcttaatactcacccagtgtgtatccatgtcttttctttggcttaaagatcttttgttgtggttcttctagtggacacgtggagcaggaatggaatgaactgaacaataccctttgggactctgttgtctagacaaggggctgagactgtgtgggtacctgctcctctcttccagggctctttaaactaacccagccttgtaaggaaccagtggcttgtgcctgaacaggacaatcctgttttctacagatcccattgctggtctatcggaaaactcccagaggcagtacttgctgtagggcacagtctgggcatctttacagagacagcccactgccaacgtgtcagttatagagtttctgtgaggatgaaagagcagttccttgggaattagacctgctctgtgtccagcaggggatacagcatgtctctgttggcctttagaggaagaggcctcactttgtcttgctgatgcttggcttatagttccccctcctcagagagctggtcttaggcatgtcagggatactgtgggggtgaccctgaccacttttattccatctataacacattgtacaatcttgcagcaacctcagacaatcttaccgggtgtgttattactcagctctgtgaatgctttgatgtacagatgtccttcagcacagaagagagacagaactcattgtacagcacagtctgctttcaaggtgtgacagggctggagccagagggtccatcgacattgacatcgacatcgaaggcaggcattgcaccattcctaagtttctagaacagacagttttccttgcatgctttgttttgtttcaggggtctgcttggtttaactctgtgagcgggtatgtctttattctttcttagaaagcccccagctgtacactaatcttgtatggtatagggatcttggagctagggttagatagttatctagtaatgaccttctgggtacttcaggatgtcatagctcctttctgggccagaggcatgactcaggtcctgttctgagatatccacacagtcttgtggttttacaagctgctgatggaggggtcgtccaagtgaccccagacttgttaatatttaatgagcttctttacagtatcaagatctgaaaccctaagaccacccagttgacactggattgatccagctgccttggcctgaagttgggttgaaatgagtttagagtctccactctgttggctttcaacctctggagaccatcagggaatgcaggtagaaaagggtaggctgtgaagaagcattttagggtgagctgactatatacaggatgagataatgttaagatagttatcgaacacatacgattcaaagacaaataggatcactcctacaatcataaccaaatcccaccttgaaggcagagatccagttcccagctgttcacggtgatggcgcctcatgaactttgaatgtaaatcttgtagctcccttgagcagatgaagcattagttgaattgtcggggtgtctgcaaggtgttcaacattgataacatcacggaaggccctagaacagccttgaagaaacccaaaaccacgtgatttttgtcattattatttttatcttatatttttgtagagctatatttgcctcctcagaaaggtgtatgtgtgtgtgtgcacacccgtgtgtgtgtgcacacacatgtgtgtgtgtattcatgtgtgtgcatgtgtgtgtgcacactcatgtgtgtgtattcatgcgtgtgcatgtgtacacatgtgtatgtgtgtttgtgagtctcttggtttgaattaacaggccttgtgacaattaggtttatgacagaacttcctgtaggcggtaccatttgatgccttttatgccctgaaaaggccatccaccctggaagcccagaagcaatggaagcaggcagacaaacagacacagcagttctctgatgttctatcttgggcacaatctcagaaccatataaggagagagttctcttcttgagtttacagggtagaaacaaaggtctaggctcaaataaagagcgacacaaggcatggcttgtgaacaagtgaggaacagatagtaaccctgatgtgtctgcttgtttggccaggtatttaaggttctttaaatgttgactttcctaagattccacgagagaggctgcctccagaacagtggttctcaaccatggtcatgtgagaccattggaaaacacagatatttacattatgattcttaacaggtggaaaactacagttatgaagtagcaataaaataaatttatgattggatatcactaccacatgaggaactgtattaaagagtcacagcattagaaaggtttggaaacactgatctagaaggttccaattttagagttcaacttgggatccattaatgaatccagctaccattttctgggaccatggtggctttttttttttttcctaatgtaggaaatgcagtgactcagtagggacagccaggtaagctcagggcatgaacttaggtaggcatggtggcaggagctgtaatcccagctctcaaggttgacaggaaggtcagtgtggggtcactcttggttaaagtatgaggctgtcctgggatatatgatatcctgcctaaagcaaacacaaacaaaaaaaatctgtaaatcaatcatattcctagtatttcccagagcctacggaaaggaagctgcctagggcacatacattttgctgttttgtcagtgggatggatagacaaagaaatgtggggtattttgtttgactccagattaaacgttatcaaatatctgtcaaaaataatatcaaagaaatcaaaaaagtcatatttcggggaaagaggtaaggttggacccagagtgcattctctcaaggggaagaaatgtgggtcagggttgaagtaagacatctgctctggggctcacagcctcatgaacctattgtggatcctggctcaagtcttgaaacaggaacacatcttccagggaggcagaaactgttactcaagcctccatgatggtccaaattaatgctatatgcaaggccacatatactgatctggggattttagtcctcctgtagcctgccagacatctgcctacatagctggcattgctccatcacccggcaagggtctatcattcatttacctgatgggtgtgtgcaggggcagaggtgaaagggcagtcatcctgagtgccagctaaactgaagtcagactaactagcaaagactggccattagtgtgttttccatatcgtctgtagaaatgtggggaagggaaggcagacatttgccatcagaattaggggtaaggctggttggttaatggagccgcccattgtattaaagagtggttatttgtagaggcttggggcacagagggtgagcaggatgctttgcaggctaaaccactctattgagggtcgactcctgaaactgatgggtggggacaaggaaggatttcactgaactatttccactccacagttgtgggcacctcatggctctacttagtggaatctggaaacttctgtttttttttttttttggtttttggtttttcaagacagggtttctctgtatagctctggctgtcctggaactcactttgtagaccaggctggccttgaactcagaaatctgcctacttctgcctcccgagtgctgggattaaaggcgtgtgccaccacgcccggcaaaacttctgtttttaaaagctaagtgcctcctacttagattttagatgctggatctccactaacaaattccagtttagtccctccctgccacctctttatctctctccctccctcctttctcctcctctccccatcccttccttctctatttatccccacccccatccacgtttctgcattgagcagtagtcactgtgtctcttctgtgaagaatgccctgccccagcttctagactgatcttgggctgatgctgaccagctggtttataatgattgtgtagtgtgtgagtgcagtacttaccctgtgagatctgttagccaagcctcttccaatatccacctagaagaagtagatttaggttgtgtagctggtgaacgctgctggaacaccatttcagtccttcacggctctaagtgtcattgggtttgtgctgtaagcatggcaccgttctctatggtaacatcccacctccagcctgccgaggccctccagcctgcccagtcccgctcagccctggggtcttgcataagtaacacttctgcactttgcagtttcctaatattttgtctttggaataaatttagggctctgtggatttggtcactgacctgcatctaacattgtgtagaatataatgaacactatccatttctgttctctagggagaaaaacccttgaaatataaagatttaaagcatttccataacagtaatactaataaaaccaacgaaacccaactgtccttacacactacatagtttgcatccttctgattcccccgatccctgcctgggaaccatccagatgttctgtgggttgatgcttttgttcagcttagttactgactgattttctgaaattaaaaaggattgtttattggattctccagtgtctcctccctttgttaactgctggaactttaaattaaaatcattattcttcataacccctttacagagttgagtgattttctgtcttttcccttgggttgaaccaaagcacatgatatatatatttttgtaatattttgcccaatattacttttatttttttctttttgttggtgatgggatttgaaccgaggactgtgtgaattctagacaagtgctctgccactggactggacccccagcccaaggttgcttttttaacagcaagcctgcttctcccaaggttgttgtctcccaggctttgtctgttatttttagctgctttctttaaggttgacagagtgtgcaagagtagcgttgccagtcggagccatgctcacaccttactacgagtttgtggtacatggggccttcttccatgtgaatatgggctccacttttgtggttagaaaagggaatctggcttttgtgagatagagtcccaggtagcccaggcttagcgcaagctcctgattttgaatcctagatccccctgtttctatggtgctgaaattaggaaatttaattacatttctagagtatgcttcttttgcctcttacccataattcctttttgataagaagtagaaactgtgtggcctctgtctctggctgagcattcccagggagctggctatctgctctaccagtcttccacactagtctccccatacaggcagtgctaggtgctggtctcttcctggcctcaggaatgcacttttcacacattgtctggttgattgtttctcacctctccctgatccctctgcttagagtggaggctgtgctgtcctcctatttcctcatggcctctcggtggtagctggtggtatagctccaatccaccttgctcaaagcctgaaggctttccacaccagtctcttctatcctttgtgagcacagtcactttgaggggaacacgagagctgtatttagcaagaatgggaacacactacagagccgaatgcagaattgtaatgaggagtacttatgagtacttggcagtgttactgcagcgggggatgggtgactcttcgacccaaggccaccacatgagaccttgagatctgctgtgactgagttggcctcagcctgactacacgtttaatgagctgagagtcagcagatggttgaggctgctcacatgtcagagacaaatgggcaggaggcagggagaggaagcagggagataggattctgagatccatgactcaaaagttcagttctctgcgacacaggaggggcattctgggaggatgatgagggtgggaacaatgttgtttacagggttttcatgcttagcgaatggcagaggagattctgaaggtgtggggtggggtgaggttggggttggtggtggggctgcaaatagtgtttcccaggaaagaagcaaaggagaaatgcaaagctgaggaggggagctggcttcaagctgaccacacccttctttggcacatggtcttccttcagagtcgtttgactgacagggaaagcatctgcctatgtgtctctattacttttcctgagcttagaccgtggttcgcactaactgggagcctgacactgccaacaggcaggaggtcagggcgtttctgacccagcttgaccctgacattgatcccaaatgtaagaagaagggaccttctatttctctcagaggctctcacagtagggttagtgtaggcacatagtgagcctcaatagacattctatatgcgagagtgccaatgggtacttttgtatggtgattccgataggtgatatttatcatgtgcacatgtcctgggtttctttcttaatgtgaaatatcagataatgataatgataattatttatttttggcatctcagtaagtcttacagatgcagtaactcaaagtgttacttttaatttgaattgtttttctttcctcattgtcctgcacacacttgctctgttcccagtttgactcttgaggatgtcatggtaacctagcagcgcatcctggggttaagtgagccctgtctttcttctctcagctgtctctcactgcagcgatgtggttgctttttcattcactattctcttacaggtgatagatttatgctttgtgtgtccttgatcttgactgtttcccgtcctataagagatggaagcctacagtctgcctgcagcgcacatagttcatatagtagcagcaggatgcacggcagcctttatactagctttccctcatgagtgcacagcaatgccacttaccttgtaacgtggtcttcatgaggctgtagcaatgagcgtggcttattcaagctgagaaacttctgatgcaacaataaaaagggcacaaaattaacatctgggacagatgtttgataaaataactacaaattatatattttttttattataaaagtagtatgcctatgacaaacttagaatacaccttggtgttgatttcaggaatccaacctcttgagcccggtgcaggatggcgcgaagacacctcagatcgacagcaacaagggcaacaactaccggatcgtcaaggaggttggcagatgaaaccgcttcctctgtgcgcataggcacacggagactgcttttgcttaacctgtgtgacacggagctatgtttaatgtgatgcttcatctttccaaagatcttgattaggctgagtaagctctgtgtgcagaacaagaaatgccgtaatcaacaccagcggctgctgaaaaacatgggggctcactccgtggtgctggaccttctgcagatcccctatgagaaggtttggcctgttttactctctttcttcaattcagtgttacttaaaacgtatcaccaagtcatgaagaatttcctcccccctcaattgtttaagagggatccttagagatcctgggtgtctcaaacacccagcaccctcgagttccttctcttatttcctatgcacaagggcgtgctctttcacaaccctgatcagcattgcaaactaggaaagtatgacaaactctcacacaccatgaaggtttttcccatggtccctgccatgtcctgttgacacaagttcctgcttcagaagcagataagactcatggcttggttgtactgtgtgcttctctctcagtcctgaactctcttagattgccagttagaagagagtcctccctctcctaccatgctttgcttcagtttcctgtcttcagtgggaatatggaaggatgctaagttctgtatcgagcttcctagcaggcacacacaactctgatttgctctaatgctcgtgatgtgctgtctgctggcgtctccacagtgaggacctctccctctctttgcaacgaataactgtcctgtgtagaggttcttttgaagatacaccatctttcatctgacttttaattcacatttttgctagcataggtattggtgggtaatcagaaagtttgggagaaagaaggagatggtctgtataacaaggggggggggtgggaagcgtggaacagacagacgggaaaagggaagagaaggtgagaaatttctagaacacaggaaagagggggcagggcagatggaggaggtgcagagacacggagggcgtgaagagagaagagccatggaggaaagcgcccatggcggagggtggagtacgtgctatgtgggcttgtggagggaggggcctgcggagggtggggccagcagagggagaggcctgcggagggaggggcctgcggagggtggggcctgcggagggtggggcctgcggagggtggggcctgcagagggaggggtgcatgctgtgtgggcctgctctcttggggttacatgctgccctttgaccctcagaccgacgagaagatgaacgaggtgatggacttagcccacaccttcctgcagaacttctgccgtgggaatccgcagaaccaagttctccttcacaagcatctcaatctgttcctaactcctggcgtgagtacccggtggcccctgacacttacagtggagtgtgcgtcagattcacacagtgcgaatagagttttactgacctttgtacgttgtttccctcttattgcgattcactccataaaaccgagtgtttccatttgaggagactctttaaataattttaaaatttaagacaaatttctatatgtcaatggcagcctcgtttatactaatttaatgttagaatcagcatttgagaacatagacctaatttgatgataccatgatgacaaaggtaaatatgggagctggggtataggtcagcttgcctagcatgtgcgggaccagcacacgccaccccagcacacaccaccccaaacaagcatgcaagagctaaatgcagaatattcaaaggtcgcattaacgttggcttgtgaagagtgcatcggcagatcccggggctgagtaggagcattcactgtggacgtgtgaggacttgagttcagagtggccgtaagtgcccgcgatatcagtgctgtgtggcagagaaggcaagaggatcccaggagccagtgtaactggaataagatttagtgtcagcgagaaactctgcctcaagggaataacatggagaacaatagaggggcacaccaatcctgctctggtttctgcacatatatgtataacacatgtatctctcattgtgcacacatgcatacaacacacatgcatatatcacatgcacacaatgataaaaataaaagtttattaaacgatcttaaggaggagccaagttgacataatgaataaagtgtcctcaaggacacttggtgacttctgctctccagctgagtcccatagtgaggccgatttcttccagtggctgcattccacagaagacaggcattggcaactcctggtggcttcatgtaaaacgtgaagctgattgtaggcggggaacttatgcactgtagagtagacaagtgatcttgtcccggtcacaaaggtgtgctcctctgctcagctcctggaggcagaaaccatgcggcacatcttcatgaacaattatcacctgtgcaacgagatcagcgagagggtggtccagcacttcgtgcactgcattgagacacatggccgccatgtggagtacctgaggttcctgcagacgatcgtgaaagcagatggcaaatacgtgaagaaatgccaggacatggtgatgacggaggtgggttctcagtctgggtctcaacagcttcgcagaggttgtgctcacacccgtggtgcagggcgggcaggcagagattaccaacctgtgctagggagagtcttgctttcataatggctacgtaagcactgataaggtttaccctactgcagtgaagtgccttatgacaacctgccttactttagaagaggttgatgttgtgggcaagctgagctgctgactaggcacaatcgtgctttttcggagaactggtaaccagatgtcggctggcagcctgtgccccaaagcatcttcttccagaagatcacgttggtctgtggagatttccattgccatgtgccttccagttagctatgagagctctctctatgttgattccatgtaccacctagaaaccttaaaaactgatcccgcataaggccttgaacttttacatgtgaattattgtaaagaaacaacgaagagaacattgtaaagttataaaatccacccttaaggaagcctggactggagctggggggatggctcagtccatacagtgcttgctgcctaagtatgagatcctaggtttgagatccagcactcatgcatgagcagggcccaatgacgtgttcctgtgaccccagtgctgggggggggggcaaagacaggatcatcctggggcttgctgggcatcctttctcattgaatctatgagctccaggttagtaggagaccttatctcaaaaagtaaggtgggcagtgattgcatatgaggctgtgtccagcctctacatgaacacaagtgtacacatccctgcacacacacacattagcacaaacatggacatacacacaagccacagtgagctcatattaattcttcattacctaaaaatatgtgggaactaatttgattttagaatctgaatatcacagtaaagatcagatagagaaaggaatgcataggctcttcctatggctcctcctatcaaagggaatgcttctgtgtataaggaaatatttgtagtagtatattaatacataaccatatgtgggcacagacatttctttgcatcaggactgtcaaagtaagccaatcagttaactgacttattgatttaaatgttaccaatttaagtacaataactaagttcaaatttataaatcatttgtaacctgaccaaatatctcatatcaggtatcagtagtagataatagataacagcatggcaaatgaaatttgctactgtctggagtcctccagtaaatgcacacaacaaattaggagaggaagtcatgtcctaagcgttttcacctgatcatttcctggccatttcagtgctctgttctattccccgatgctttcccactaagtgaggagctttctagatttttataatgttgtatgtacttgaaacaatgtacaactgactacttacatacattaattacaaatgaggcgaatcctttcacattttattgttcactttttatgattcgttatattgttaatgggtatatgcatgtgagcacactgctctaaactgccaagtcatctctcagtccctcacctctccagttgagtgagaatagtctcagggcctcagatgcttgctttcctggtgctaggatcacaggtgtgcaccaccaggcctggctcggtgttgtttgattctcatcccatctgtggctctcacggctcctgcctggtttcagcagcactgatagctggtcacttggcatgtggttttgatctttccctactcctgccttaatgaagtcctgcttttgcaatattctctgtggctgtctgcaggcagatcaagcctttagaaacgtgctacatagagtctcctctcttcctttcagttgatcaatgggggcgaggatgtgttgatattctacaatgacagagcttcatttcccatcctcctcaacatgatgtgctctgagagagcccgtggggacgagagcggccccctcgcctaccacatcacccttgtggagttgctggcagcgtgcaccgaaggcaaaaatgtctacacagaaatcaagtgcaattctctcttgcctctggacgacatagtgagagtggtgacccacgatgactgcattcctgaggtcagccaacagacagacactcaccatctgtgcactgcgtgttcgttttgtaaggttcatctgaatgtcagacatctcctacagtactttttacgatgacatcgactatttagtagaggacttaactgtacttagtcatgcaatctataaaaagaacacaaaagtttctagattttatttgcgcagagggaagacagtccccttgactgagaactactagtgtcttaaagtctgcacgtggcagtgggcttccgggggaaggttcacttgtagtttttgagacagaaacatctggctcgctggtgactcacagtgattgattagcaagcctgggctggtacagcagggtttcgttagatgccacggcttcaccttgctgcacagaatgattgtctctctgagaacatgctcgtagcttctctcagcctctcttctacctcagctttcatgattggggcaaaatacctcatgagaagatggttatccatgaagctgactatccgtgaggctttccagagtacacagtgcaatggtttctttcttttctgccactatggtatgttacgacgaagttcatacatgtgtgttatccttgaaaagacattaaactaagaggagtcagggatgtctcagcccctattcaagtagccctggtgtatgctgcacagtaatgaacctgaagggatatttctctggcatgttagcacctcggggtccttcatgccttggtggggctgagatgaagtgcacatgggtgtggtggaggagaggagatccataggcttagcccttatctgaggccctcgtcttagccatatctgagccatatctgagttcctctaagggctctgctctacctcacagctccaatgagggtctgataggttgaagctttacttcctcagaggtcagttctctgctgtgcagatatggccatccacatctctcgtggaaagcaagctgtgtgtcttgtcttagctctcatgcctttcccaaagaggaccaggtgggagggtacttccagtcaccacaggagtatctgaggcagagcaagcttgtgtccagtgaattctgcaacgagtcgggatccttacgcactgtttcctagttgtgtcactgggtgcagcagtcacttaacatttccagctgtcaattcccacacttttaaagtcaagttattatctcctgcctcctagggctattaaaggattacgtttaataaggtgaggcacaggaaaggctgaagggtttcgtgcatggtgagctcggagaaaggactaactggtgtcgagatgctctgtgcatgtctcagctcttctgtgaccagacttgacgtgggtaccattgaggacgtttttctagacctacgtggcatagcaggaagccctatagcaggagagctgacccctgttccttacggctctgactcggtccaggagtccctctgggatgattgacatgatttgtttatatatatagcccttccttttgaggtcttcctagtgtctcaaggatgagtaaagctcttacttttcacaggaatctctgagagtaggggaatggaatgctagaacacaggctcgcccgggccagggtggaatagctgtcaaagagaagaaacacggaaccctacatatacaaaacaaactgtcatccatgacaggagctggtatacacagatggtatttagtggtgtagaacagaaggcaaccggtgagaggttgaacttgtttttgtgtttgaaacttgcacaggtcaaaatcgcgtacgtgaactttgtcaaccattgctacgttgacactgaagtggagatgaaggagatctacacaagtaaccacatttggaagttatttgagaatttcttggtggatatggcgagggtaagttaatgcctcttgatgtgcgggtaaggtcactaggattgattggcacggactgtgactgagcagtaaatatctagatgcctctgatgtttgatcatccggactgtttccttacatcttcactgggttccagtaaatgcatagttagagtgttcccgttttacatcatttttgtgcgaccagctagaagtcaccatgccctttcttaggtgaatcactgctagggaaacgatcccacttctcccacatttagtacatactatttatgtttgtggccagtgacctgtgggaaccttggctctgaccagctgcagcctactccgtccggagtccttgaagcaaaggataatttctgggctggtgactgagcttaaagttgttgcatgtgcagggagatgttaaagcaattacagatctgcagctgcggggttgcctggcgcctctaactggagataagcttgagaaagaccaaggtcacatccccagcagcacaggttataaagccaaaatggattttatgtttttaaaaccaaagaaagctggagataactgcctgacccagctagccctggaaacgctcctttcacttctgaattcggaagccactcctgcttggttttactgagtttgcctaagtgggtgattcgtgttatttattatataaagtgttatgtattacgtaaaggctgctggagaatttattatataaagtgctatgtattacgtaaaggctgctggagaatttattatatacagtgctatgtattacgtaaaggctgctggagaatttattatatacagtgctatgtattacgtaaaggctgctggagaatttattatataaagtgttatgtattatgtaaaggctgctggagaattcctggaatccctggctgtctgctctgactctcatactgaggctgggctgactgcagacgcctttgttttttcttgggttctttgtcctgcaaagcagggcccttctccagatgaacatgaaatatgcctctcttatgaggaggaagcccaggagcagacccctccttcctccagaaaggtggaggagccactgaaaactttcacatgctggttacaaaacaaccaaggtggccttccaggacagctctccacgaagcttgctaggccctgctttccagagtttgactcagcacttaggagataagatattcgaaacaagtcttagatgacaactgttagtcctggggctgccccagagagccactgtaataggtatggcagctaagggcagaactttcaatggagttactcagaccaggactcaggcacagactctgtctttctctcactggcttgcttatattgggaaaagcactgtaaccattctgccccccgagtttccttacaataagtacgttttcccaggatggagctggtgaggtaatacacatgtactcttagtacatgctgctcttcgcatagggcttggtgacattatgtcatcaccaggattaccacaggaccacaagaagccttttgggaagttttaggagctttgccgagatctaagtgacaataggacattgagagtgggaaaagagactctacacaggcaagagacatgctctgcttatgaagccagatgaacattaagttgggcaggcatgaagctgcacaaaatgaaaccaggcatgtatgaaaccaggcatgacagttacaagatatgtgtgaagccaggcatgcatatatcaaggcatgcatgaagccaggtatgcatgtatcaagacatgcatgaagtcaggcatgcatgtatcaagacatgcatgaagtcaggcatgcatgaaaccagatatgcatgtatcaagacatgcatgaaggcaggcatgcatgaagccaggcatgcatgaaaccagatatgcatgtgtcaagacattcatgaagccaggcatgcatgaaaccacacatgcatgtatcaagacatgcatgaagtcaggcatgcatgaaaccagatatgcatgcaccaagacatgcatgaagccaggcatgcgtgaagccagatatgcatgtataaaggcatgcatgaagtcaggcatgcatgaaaccaggtatgtgtgatgcagaccttctgggtactggaatgtgaaggaagccagctgtgtgtgaagctggccacgaattaagctggactgtgaacatgcatggaaacagatatcttagttatggtttctactgctataaagaggaacatgatcacagcaactcttataaaggaaaacatttcattgaaactagcttgtagttcagttcaggggattaagcagagcaggaagcatggcaatgtacaggcagacatggtgctggagaggcagctgagagttctacatccagatcagcaggcagcaggaagagagagacattgggcctggcttgagcatttgagacctcaaagcttatcactaagtgacatacttcctccagtaaggccatacctcctccaattagtgctactccctctgatcctatggaggccacattcattcaaactaccataccaggtatgcacaaagccagacctgcatgaattcagatactgtgaagtctgcatgcacacatgagttgatttaaactgctgcgaagggaaggagtcagactcaggagctaacagcaaacttgtaaagccttggagaactgattgatgtcagagaggaatgagaaaaagctagagatgagtttttctctaagttgggttgaaggcacccaacactgcaggggtataggagaagagtggtcagagcaacctcatattcagttcttagtgttagcatctacttggatatttctcataacaatgtcctaactatgtttgacatcctttggttttatttctgcacaacttatttaaagattcctacttcaactcaatgcttttcttcattatagtctctgccttgtttaacttgagcagctatgtgggggcaagttcagtgaagcaaagacatagtgtatagcaggagtcatatgtcctctttgccaggcccactttgaaattataaaatcatgaacctcagggaacttcaggatggactcataatttttgctcctggagtccagagacagtttgctccctgtctctcctgcttgttacagaatgggaaagaaagctcccactcccacccacagcagcatctccaatgtagcccttgagtctcccaacattttacttgggtctcatacgggtccactttggagccatgtctggtttgctgtttccacatcttttgtactccctctgtttggcctgagcctacacagttgtatttttgtagaaatttggagaacagtttctctaaaagacaaatgaagtctcaacactagcagctgatagtgtctgctccctccctctgtggtcattgctgtctgccagctcttgggattctcaaaaatcccccatggagtctcctgtggtttgtagcttccattttcctcttcatggcttttaccccttataaggcacaaagacccagtgagatggctcattgggtaaaggtacttgctgccaagcctgataatctgaatttgttccccagaacacacatggatgcagagaccagactccaaaagttgtttaattaaatttaaaagtaattttaaaaagacacacagaaaatctttcccgaaaaacagctcttaatcagtggtgttacattgtttcatgcgattatcctgttaataagccttgttacattgtttcaggtgattatccctgttccgctgtcctgacagagaccggacccatgagctataatacagcacactgggcagtggctaagctattagacccaggatagtcgttgcggtctttcgggccattaatgacatcccactttgatctatgtcctaatgcagcaaaaattggtgcttgtggggcagaaaagcttttcttcgtcttgataactgattgttgttgcagtcagggggcttgggccattatcagaaagtacctggaagggatggaagatgatcaatgctggtctgagactacaggttcagtttttgaagatgttcccaattcttccatcactttcaaaaccttacagcgaccagctgtactctgagtaatgttctgacagaacaaaattagaccaagaaataatttaggatgtgtgcccactcagtgtcccatcagtcatggcttaacaagacagcaagagactttgtttacagatagatcactctggccattcctctgttccctttcctaccaaatagaaaggagatgaggtagaatttatatcttctctaaatcatgctttccccttgtttttgttaggtaggattaaacaaatgtactgtgattattgatttttttaaaagttgaattagttactaataagagtcatttgaaagtattctttataggtggcccaagaagccagcatggcagagcactgaagcagcacctgctgtagcttttatcctgtgtggtacctttcccttagttgtagttttactgatctctctaacttttatgctgaattataatgatggtgcatgcctggaccggaggcttattattggactgttcttaatgatccagtggtgggatctcccgtatcatgtgctctgcgctttatatcattggcggtatctattctagttcatcagctcacccctgtacctgcccccttgtgtgtgctcgtacataggtacctgttaacttgtgcacagtacatttgtgtgcaggtgaatgtgtatgcatgcgtgtatggaggttaggggtcaacgtggggtgtcattcttcagaggaccttccatcttagattttgagacatggtctctcacagtctggccacagacccagctctgctcgcaggctggccagagaatgccacacacccacctgtgtctgcatccccaacactgtcttcacacgtgcgtgctaacataccaagatgctttttttttctttctcttttttagtaaaatgtattatggagcttgaacggaggtctttatgcttgaaagtcctatactttacaaactgagccatctctccagctccttaaatccttcctttgtgtccccagggcaattgggtctgcctgtctccctcattgtctctctctcccgcctcttttggccactcctcagatgcttggctgatccctctgtatcttcccaacttctggatactgaggtatggcaaacctggcgcttgatccctccactggctacaagcatttgcttgctgggatcagcagctctcagatctgccccagattaattgaagcctgggcccttctctgacgtctactgttgaatctaggtgtttacatgacatctccatttagctgtctggtttcaaactctttgttcttgctctgcttcagacctacccttcccgagttgtgggcaccttggcaaatggcaactctggaacttgctctctgcaccctgcaaggcagaatcttggtgccatttgcaaatacgactttgtacaccctaaatcagatccttctccaaatactgcaggttctaaaatagcatacatttgactagttctgaactcttataccataattgtccacatctggagagagggggaggagatggggtatgtgagggttgggtcaggccaccctcctttgcttagacagcccagcaacttactgcctttctgtgaattctcttccttctctgtgacctcctaatgacctagtctccccacagctggctctctgtcctgttcacgctggtctggtctccatggtgattctaatgatgctcccatcttaacacctttgccttctcctgggaggcttggctccaagtcttttctttctctttggtcagatcttgttaattttattgttctctctatggggcaatgtctggtataaacagctgaaaggatttgtttgagcttgaggctttggcagttcacccattacactgggagggcttgtggaggagggggctgtccaccttattgtagaggaagcagagaaaggacagaaaacactcccgagtgacattcttcctccagtcaggctctgcttcctgatgttacctgatgtcataggtagagtggtatgaagtataagctttcatcccataaggttgaaatgggggatcagctaggaagggagtgtcccaaagcaagactgaagcacatctgggcaagcatgaatcctgtagccatttaactggttcagggcatgtggtagtatgctgcagattcccagggcagatgacccctcccttggagccttgccatttcatcccatgtgtcttctctctcctgttcaacagatgaacctggtattgctaacatccctgggtcactagagacgctttgggttcatcctcacagctgcctgcaggggtcattctgtcaggcagcatggcctaacttcctcgcatttctttggaaatctggtagaaggctacgcagctttgtaacttgtgcatgcttcatgcttacaaatcagctccacaaggttgaggtcagggcctgccaccggcttgagcaatacccagggcctgtggactgtgagtacatttgtctctagggcctaggtgtctgagtgtggtaaagctgagtgtgcaactgtatagatcaggacttgtagcaccactctcatcctaaggaagtcttgtaaatattgtacatttttataaccccccgagtcggtgatggatggttctctttgatttcctgacatccctcaagatagtgttgtccccgtgcaaagcagagagcattaaaaaaaaaaatgatcctatgacattgctctccccgttgctgtgtgaaatctctgacaaaagcaatgtaggaatacaatgcttttatgttctacagtctcagactccttggctgggaaggcatggctgtgactgggaaggcgtggccacagctgagaaggcgtggccatggctgggaaggcgtggccatggctgggaagacaaatggtcacactgcgttcacactcaggaaacagtgaacagtaagaaggcagagctgcaaagaaagcgtcaagtcttaacctctatgacaacatttctcagcctgtgacctcaacccctttggggttgcatatccgatattttacatatttacattacagttcttacggtggggaggtcgccataccattaggaactgtattaaaggctgtcaacattgggaaggttgagaactgctgcttcatgatcttcctccataacagacgacagcatgacggggaccaggggtttggatatgtgagcctgtggggacatctcccattcaaacgacagtgggaacctttttaggaacctcgtttcccttgctcctactttaagctgctattttttctcaccaaactacatgctttccaagtctctctgctcggttttggttcctacttttaaactacaaatcaacgtagtcagagatagctgtgtctcggcccacgtgccgcttcactttgaaatttactgcttctgtagtaaagagaagagttgttttcgctcatggtttcaggggcttccgtccgtcatggcaggaaggcgtggcaggcagagtagggccagtgtaggatgcaaagtgagaatgttgcttttcaatatcttggagaggaatcggtccatatgctttggtaaacacaggcttttcacttaaccaggcattggaataaagccttatctagaaataggtaatctcattaatctacaacccaaacgggagtctctgggtggtgatttgccagtgcccagttccgagcaatgcagcccaatgtgaggtaatttctgagaggcatcccactgcacgggctgtgcctggacaaagtccgtggagctcatgagtgagagctggcctgctacctgctgaacaaaagggcagtgttagccgatcagaaaagtccagtgtctggaggatgctgaaagaagtaaaatcgtaactgacggctatcacaggaaagtcagtgtggtattcgttctgggccatgttagattttaattctcagttagcgacgtccagacacacagcctaacctaagtgtgaacagcatgaaagtgagagccgtggagcgggctcgcctattcagaggcattgacgtagttcccgattatgtctggccccactctgcgtagtcacatgttggaggttcaaaaacaagacctggaaaactccagaaataccttttaaattctgaggtgtgcgatgctgtcccaggtccgctttgtcccgccttcccatggtgcctgtgccgaccacagcttaagtcacgtggtagggctcttttaactaggtctactgtactgcagtggctgtgtccaggcagtccttgatttagttagcacagtctgtggtggtaagggaaactcaagttgataatctgtgccattgataatctgtatggtgtgtcttttaagtaagaaggtgactgaagtgggggagggggagaggaagaagaaatgttcacatacattcactcttattatgacatatcagttttaaaatttgttattattaatctattttctctgcaacatttgtgaatactttgtcatttaattattcagtgtcccaacagtgtaagttattacgaaagcctttctggtctgaggaagttgtattagtgagtctcactgtggaggaagagaaggctaacacagttggaagggttagacagaccataagcaaaccctgccctcatctaattccggtacaagccgtcccgttttccaagccaggagctctgggacacatggtttgagaagggaattttcctcttttatgaattcgtgtggcaagtgttagggaggtatcaaatgaaatcacatgcacttgttcttttattgaaaagtcaagcattacagaagaatgtgggtcgcccaaggacgtctggaacacatggccaccatccctctcatcctttgtccgtatttgttttctttgtcttccccggttcccagccttttctcacaccctctgctcccctctcttcttgtgtccgtatctcctgtgtgttttcaatcaggacccttcgctttcgcaatttgtcagccagacatttggaagggcagtttggcaaaggggccttgtttagtgaaatctgaagaacagagcaagggagggcgctctggtccagccccggctcagtcctactcttgccctcagcctgccaaggcataagccactcatgcgcatgccggcttctcagaagaaccgtggataagagagtgtgggaaggatttagatttaccctcccttaattttccattttccttccgtgttaacagcttttcttgcttctgtgatcaaacgcctaagaaggagcaactcagaaaggaggagctggcttcagctctcagtttgggggtaccgtctatgtggagggaatgagagcaggcggctgcatggtgggcacacctgtgtggctgggactcctccttctacaccttggccaaaggagaggcagggaaaagacaggaagtgggtggggcttccaaacctaccagcccttcacagtgaatgagtcacttcctctaacaaggctctaaatcgcaggctcgtccaacccacttatggctactgggacccaatctgcaaacattatgcaacacacacacacacacacacacacacacacacacacacacacacacacaattgtgtagggtaaacttcatagatgacagtgccctgtaccatgtaaaaatgttgggcatacctccacattcttcaaaatagccccaccagctagggaccaagtgtttgaaaccaagcccctatagaggaccctccacatgcaaatgtcatcacctcccatggattcctctcatctagttatactcacagtggctcttttcttcagtttcctctctgtgaatggatgcggttttcatcaaaatcaagcttgtggaccaagggagaggttggagggcaaagacagagaaaagagcaagttaacccaggtgtgaaggacgttggaggctgaagtgacagagtctgagggggaagctgccacagtcggatgtcttagtggatttggacgaaaatctttccaccagaagcagcttcatgaagcatagaaacagccgtggataactctacaggctggctttataaggttcctctaccaatttataacttggagatgttctttgctttctctctaggtctgtaacaccaccacagacaggaaacacgcagacacctttctggagaggtgtgtgacagagtcagtcatgaacattgtgagcggcttcttcaactcgccattttccgacaacagtaccagcctccaggtagctgaacccagtgtccgggagcactccctgcaggcgcttgctttcctcctctgcccgggatgcaccgtagtctgctaggaaggcctttccgacactctggatactcaccagatcttgtgtcactcagccaaacatcatcttagtgttaacttactcatagtaatgaaggggaatgggtttcacggtggcattttacatgtaggcacggttatattttttcacattctgtgcttttctctcctttttggtccccatgttttctgtgttgtcaagtctcttagcttctgcaattttgtctgttctgactcactttgaaatttacactttagcaagaaattcagtttatacatcacttaagcaaattgacagatgatggctccatccacaccccaccctccttcctaacccctgccctccctcctctcccctctcctgtcttgctgccccttccccaaccccaactttattttacacacagagacctcctcttgaagtgaaatcacttcctgctttccaaacactgtcagacatttcacatctgtctgtggagggccgagtcttggatcatggctgactgttcaggtggacttgcacctggcccacctgttagtaatttatcttaaaggttggcacattgagattctcatacaagcctttataactacttaaaaatatttatacttttcaaccttagatgtccacagatgaggaaacagcaaaatacattgtggcatatctgtaggatggcttattaaaacccatgtttcaaaatgaaaactaatgactaagaaaaatgattctctgcatagcactacagaattgcgttaagcatcatctaattttgtttgtgtgaagaacacatgtgctcaagcctgtgcgtacccacgagttcccacctgcagatcctgccaactttcaatcaacaatatcaggaaaaaatcgtaccgaacatttccagcctttggtcattagtctctaagtgtagtatgacaactctttacagaatacttacattttattaggaattataggctgggtcacagatgagcgggtttcctgtttgttgtctcttcctatgtctgttgctgtgagcaatgacatctttgaggtattgacattggctttctccacagtgaacatgtccatggacctgtgtcaggtccgagacaggtagaccctgaacttgcatttttttctgattaggacaatagttaaagggccaaggagggggcagaacgcttgttgtgtaaacaaggacatgagtttgattcccctgaacacaagcacaagccagacacccaagctggtgggtctgtgcaggatcagagacaggtggaccctggaactcagaggccagccaggtctagccaaaacagcttcaggttcagtgtgagatcctgcccaccaaaataaggtagagagtgatagaggaagctagctgaggtcagcctctgctgacacacacacacacacacacataaacataatgaaaaccaagtgaccagttttctgtagtgcctggcatgcctcctgtcattccatttgacacatgagacatttttgtcacgttaggtatttctgagtgtctctgaagcacacaacaccgcgtggtaccttattttatggtcctgtttgctaaggtatagctcagctccctcctctgtaggttaggggcttggtggcaccatggcttagggcatggggtgaccactttccttccatttttagacccaccagccagtctttatccagctgctgcagtctgccttcagaatttacaactgtacctggcccaacccagcccagaaagcctccgtagaatcctgtatcagagccctggctgaagtgggtaagtcatggtgtctgctttgacttttacacattctctgaggtaactgtgcttgtggctgagagctacacatgccttctcatctagaacctcacaaagaagtaaaatcaggcatagttttgtttgtttgcttgttgtggaattgtcttgtttgttaataatagtctgacattcttaatatgttcttttggcaataggtatttttgagttcttttaaccattccaatttgtataaattcggcactgtttaaaggtctattatacacggaaggcttcaaaactaaaaataaaatagaggcaagagatttaaactaaggggaagcaagtataagaatttttatagatgcccggctctgtgtttaaggtcatgtctgtgtatagttgtatattaatgattatataaaaatctgtatatagcagttgtgtttatgtggattatgtgtgtgaatgcaggcacatgcttatatagcacacatgtggaggtcagaggacaaccgcaagcattggtccttgccttccatctttttgttgttttttgctgtgcactggaccatggtttcttctgtctctgcctctcatcttactgcaggagggctgggcccacagatgcacacagctgctttatgtgggctcttagggatcaaattcaggttctcaacttgccccttaagcacttaacattaaaacatttttagtctctccctagtctatggcctgactatgacgagattatagattaacacaacttaactgtggcttcagtcttcaggaaatgaaacatcagttataatctacaaatatcagttgatgattaatctttagctaatagtaatatagtttgtctagggaattaattctaaataagaattctacctacaagtaagtggaataaataattataaataaaatttctactatgcttgcctcttcggcacacataccacgtcggcctgggcttccctgcaaggtactgctcaggagcacagagcactgagctttgatgctttcctccctgcgggccttgtggctcttggtgccctggtctggctattgctaggggttggattctattcctcagctcatgtgcgaatgctggggtacaccacccctgagccccatccctagtcctcccatatagcataagctaaccctttagaactatattgtcaccagtattttgagctttatgttttccacactatgtttatggtttgtgttgtgatctgagcctctggctgtatcaggggtgagtctgttccatgcaaactgtcacctgtaccctctcagctgactctgcactcagccccttgtgcagacttccagctcctttctgggccccagggctgtggaccatggctgctgtcaatgcctagctccactgcgctcttcctcaagtgttgagaactgagaggtgctgcaagggaaggaacacacagagagggagagcctccagtactgctgtgtaagagataaagaaagccacacccaactccctaggctttatttaaaagattcacagagcatagcatttgaatgtatttatataaaatgataacacctcccagggccagaatgatcagtgagatcttttatttgtttatgctttgacatactttctgaatttttgataatacattgctttttaagttataataaaatagcagcggagggttttgctttgttttgtggtggttgtggttgtgtgtgcgtgttttacaaaattaggaattatatcaaccaaagataccattgaaaggaacaacagatactgtttgctttcacacagagcttcactccagattttattgctaggttttgcttcctgctttccctacctctcagttattcctcctttagtggtcagcagagcactgggaactgatgccactcgacactgccgagcacttagaggaagtgcagggcacagcacttagaaatctcagacagagtcaggcacaggggtacactgtcatcctagcagagtcaggcttaggggtacactgtcatccagcagacagagtcaggcacgggagtacactgtcatcctagcagacagagtcaagcttgggggtgcactgtcacccagcagacagagtcaggcttaggggtacactgtcatcctagcagacagagtcaagcttgggggtacactgtcacccagcagacagagtcaggcttaggggtacactgtcacccagcagacagagtcaggcttgggggtacactgtcacccagcagacagagtcaggcttaggggtacactgtcacccagcagacagagtcaggcttgggggtacactgtcatcctagcagacagagtcaggcttagggatacactgtcatcctagtagacagagtcaagcttgggggtacactgtcattctagtagacagagtcaggcttagggatacactgtcatcctagcaggcagagttaggagtaagagtacaccgtcatcctagcagagtcaggcacagggtatacctgtcattctagctacatgggagggtagctacatgggatgatgcaggaggattgcaaactcaagaagacacagagaacctttgttgcaaactaaggaagattcatgaattaatgaaggctgggaacttcacttgtacatatttaatgaaagatgcatgaattaagggaggctggggacttccccggtgctcatcatgtaaacatgaacttggaggtgctcacagtgtacccagatcagttatttcatggcaagatactggagccatgggcataaataatcaccgaaactacactggcctaagtagtatatctttaagatctcattttctgtactagccaaagctgaatggttttgaagaaaagcttagttcctttttgtatgctaaaagaatacatgtgatcagaagttatagaccagttctatccagatccgcagctgagaagacgacagggagctaggctttggcacagtgtctcagctttatctacacaaggctggctgtcatcttcctcttccagttggtcccttctgtctcgtgctacagtcactctctgtggaggtacacagctgaagtcccatcatttgggaggcagaggcaggaagatcaggagtttaaggtctgctagattatatattatgaactacatgaaactatatctcaaaaaacaacaaaaatatttctgttaaagtttcttcatgagagtggattctttctgtcaccctcacagtgggctcttttccttgcggcttatactttccttgtggtttttatttgatcccagctcatgccatcacaagcatggctcttatctcattaggttcgagaaacaatagctaggatacaactgtcaagtagacactcatagatgctggagagagggctcagcagttaagagtgtgcactgctcttgcacctgggtattatacctgcacccacatctgatggctctcaacagcttgtcactccagcttcagggaatcagatgtcctcatctggcccccatgggcactgtactcacatatacaaacccagacatgcacacacacaaactatagttaaaaaacaaaatgaatcttaaaaaagactctcatggaaagatgatgccatataatatcatattccatgacatggtcatattatcacagaacgatatcatcacatcatatcatacatcatcctgtcatatcatgtcatcatgtattacattacagcattatcatatataatttcatttatatatcatatttatttataatatcacattatagcatatcatttaataatatatgatatcttcattgttttatatatcatgtcatattatatcatcatatatatcatgtcatatactatttcatattgttgtataatatcacactatattttgatatgtatcatcatgtatcacctcattagattgtatactatcctattctgtcctgtatcatcatgtcatatcatagcatcatgtcatattatattactatatattatactatttcatattattataatatcacattatattatatcatatatcacataccatcacatatatcaccatatgtcaccatattattatcatcatgccacatataaaatctatatatatataatcataaatatcatcacacaatattatatatcatcatgtcatattatcatattacatcccattataccatgccatcacaacttcaattatgtaatagcttcatcatgtaacatgtatcatcatgccatgttatattatcgcccatatatatcatctatatgcatatcatatcatttcatatcacacactcatcatatatcacatcatgccttataatcataccatatcttcatatcatatcatagattcatatatttccatattatcatatcatcacatcatgtcacaccatcattgcataccatattacatcatgtgatatcagtatatatcttcatagttcatattcagtcatatagttcaatcatctgtaaacctatcttcatatcataagatttcttctatttgaaatctcttgtttctcacttctttactgattgcttcttgttcaaaatggagactctgaaagcagggactttgacttttttgtcatcagggcctggaaatttgtttctgataaacaggataataaatgtatttgttactctctcgtcactgagataaatatttctacaaaatgacttaaggaggaagccctccctgaatgtctttggctgatgtttcacagacacagtccactgtggtgggaacagtgtggtgacatgtgtctagctgtgaccacaggagcccgaggtggttgttcccttgcacccacagacaggaagcagggagccatgaatgctggtgcttagctcattcgtttttattcaggtggagaccccagctgttgggccagagccaccttaggcagggtggttcttccttccttggtcaaatgtctctggaaacaccctcatggatacatccaagagcactgctaggtgtttctaaatcttgctaacaatgtgatggtaaccattgaatgggtgcacattgatttatcatagtctgtggactcgggagacattgccttggctagtttcaaaaggcaatatgacaacagatttgtgtttaaagatcaaattaacttgtgtgtgattctagggttaggcacctcacaccccccactccacacacagtataaaacagaataacttcctatgacctagtgaaggttggggtttcacagacagaaaggggctgaggagggcagaggcgggacactgagctggccagctatttgaaagttcctttctgtataacgggaaagcagagagacatccacagcatggcagggttggctccatctctcttggaaactggcctgtttctgaacccagtcaatacatccttctgattaggtcaggtgtcctgagacatcaggcagtctacaagtgtggcttcccatgaagttcagccattgcggggacccgtgtgaaactttacagctcagatacacaatcattttggctttggctttctttaaaaatacacagcaacactgagatttggcacagctcagacatttaagaatataatgtttaagggaatagagaataatatatatgtaaaacatggcacagcctgggcagacatatagttataaagccttttgatgcatttgtgaagtggtaaacacatttcttataaatgcaaatatcaagtgtagtttgcatgtgtgaaacacctgtttctaaagtattttcaaagtaccattagctcagcctgtctgtcatccaaaatcttcatcatgtatgcactggatacatacgtggtaagaagacagcagacctactcactcagcccttccctccctgtgagcagtaagcgcttgctgggtgctgaggaaggttaaggcgacagggatctgtagatgtgcctggttagacattgttcctcagttcacccattcctgtaagcacatggcagaaggcttccagcctgtgatatttgcagctcgatgcagggaaacaaatgcacacacatccccgtggttctgcattcttttgtgtgaccataaccaacctcactctatttttaaacatctaatgtttgcagtcatctctaacgtgaaggaagaaagtaaacagctaggagtggaccttctgagtcatgacgaatgctgtcctgtgatgttgttagcacaccagcaacgccagagaacgcctttctccttagcattgtgtttggagtttgttgatcttaaaaatattgctagagttttaatgcactttttctctgccatgtgtgaggaaaagaacttttccatatgattgagccaccagtatttcctttgctatgaaaggtcatatccggtaatttgagttcaaccgttacatagtaagaagtgagctctttgactatttggtagctagttttcttacattttctttgaaataatttatttttttagcataaggaatacatattcacatattgcacattatattatatactatatgttatatagaatgtgttataatgtaggtaataataacagggcttcttagtttgtgtcggtgtttgcacacattcctgtgtgtgcagttgtgtttagggcaacccttcttttagagaggttctccatgggtctgggatcttccaagtaggttagtgagtcctgggttctccatctgtgtccctagtgctgggtttcaagtgcacgctgtcacgcttggcttgttctggactgtggagctcggctactcgccctatgaagcatgcgttttactaagccgttagcccaaactgatttctttttaaagttcaattccattttcagaatagcgtctgtcgttctgcggtgttgttccatcctcagaggattttcatagttttggtttttccgtatctttctggtgttactgttaaaagccttgagctctgtggaagtaagtgtggtggcccatgtctgcaacctctgcactcagcagactggggccataaagactgtgagttcctcctggtcacagagagtgagataaagaaaggggaagagatgggagggagaggtggagggaacaagagaatgggagggtaggggagtctgacttcgagacatctagtatacacttacttacaggttgtgtggcatggactcagtgttatctttccagatgactagtcaggccttcctctcctgttcttgggtgaccgtaagaagcaggtgctttgttcaggtagaggattgcaggagcatccatgtggtagagttggagtgtcacacaggcagcatgtatccgtgctttcaatgttcttcctatttaaaatctctactgggttggggaaatagctcagtcagtggagcacccacaaggggacctgagctcaatctgtacagccatatgaagagccttgacattgtgccatgtgcctctaattccagtcctgtcaaggcagagataggaggatccctggggcttactggcccaattccaggctagtgagagaggtggggtcagtaaatacaggcaaagttgtcgtttggtctccatacaggcatgtgcacacacatgcacccttgcacacacacacacacacacacacacacacacacacacacacacacacatacacacacacagaggcacacacaggcacacacacacacaaaggcacacacacacacacatacaaacagaggcacacacagctacatacacacacacacacacacacacacacagctacacacacacagtgagtgctccactgtctgagctatttccccaacccagtagagattttaaataggaagaacattgaaaacacagaggtgcacacagccacacaaacacacacagccacacatacacaagaggcacacacagacacacacacacacacacacacacacacacacacacaggcacacatacacacagaggcacacacacacagaggcacacatagctacacacacacacagccacacacacatatacagagacacacacaggcaggcgcacacacacacactcacacacactcactcacatgcacgcacacaggcatgaatcctgtgtgcggatttattctgaggactttgcgctggagagcaggtgcagctcccgcccacgtcttcctcctccagctccagctgttctggttctgatgggctgacacccaagcacattttctaattaatgctcctctccctgctgcctctccccatacctgtcagtgtgtatatctaagcacttttccatggcacctctcacagagctgtatgtgttttcagaaggttcggtctggcagataccatcagtgactccagctagttaaaaacgttcacagaacacacaatttttaatgaattataattagaaatagattcagattacatcctaaagcccctgaagagacttgtcatatccaggaaaattttaggatttataagcctaattaggaggttagccttgtaataaaaatacccgtgaataaaggtggctcatttctgagaagtcatcttctctaggcaaaggtcccccaaagcaaagtgcctgggcattggcctctttcccactcatttgttagggacttggatgtctgtcctctggtgacacattcttaacaaggcagttgttctaacttagggacgaaaaaggaacacgtctttgtaggaaatttaatatgacccgtattacatgtggcaggcatgaggaatgactgggcatagcaggctcattagctgagtgttgttgttaaccatggggatttaccctgctctgtatatactgcatataccacagagcccagattgttccagcttgatggaatttaacttggtttggatcacagtgctgacttgaaaacattgttttcccagtcagtgctcctgtgcatgaggcaaaacaaatgcttttcctaatctcagggttcctttctgacccccacccctggtgccttttaaccaaccaactcagcacttttcattttgatttcaaactaatatctgtattgacagagcagagaatctgcctcaggctatgtttgtagaggttttttttttttttttttttttttaaatttaatttgtttgctgttgtcttgttttgctgagaagtgaaccaaacacttcatgtgtgatgggcatgtgtcctaccgtgagctgcacttctagcccttaaagtgttggctcactgttctgtgtgcccctggtgtctcccttggttgcagggttaatcttttgtggcttcaaagtcatggtttttaaccgtaggccacagtttacattgaggccaggaaagttgcgtattttacctggtgttcatattgtgtagttcatattaaggcaggacactaggtcggaatggtcacgcaaattggggaacagaaaaatattcgaacagttcacaatggtggagtgccttcagctttccctccatgtgccaccactgaagacgaggtggaacggctactcatgggtggacctggggtgggcatgtgtggctgtgcgtacttactcatacaagggagagactcagcactgaactaaatttccatggatgtctttggaaaagtcttcctgcagcttttccttgtatgtcatattattaaaaaagcaaacaaacatttcattgctgttgttctcattcatgcatatctcatgtgcctgcatgtgggtttgtgcagtgagtacagacctcagagtctggaagagggagagcatcatgggctctgagaactgagctcagatcctgtggaaatatgtactcttacccagtcagccatccctccagccctgtctgctgtattcttagcagctatccttagatgctgggagcctctaatgtgtctgacccatgcaggggccataagtgcacagtctaagcagagctgacagcctggctgcagtgctctgtcactttggttggctgggcagtgaccctgaaggagcaccattcagtgttcagttgctcagatcttcaaagccaatgctgctcatgtgggaaatgtccaagaaggagcagaagtctcagcagagtttgatcatggatcaagactgagtatctataaaaaccatgtgttgctcagcagtgtggaggctgcctgtcccggaaacaacgtgtcttgatgtagcgtgggagagggacatggacagaggcactgtgtgcttccacgggaagctgtcagggacagcaggggtctgttctagatgaatctagactacgttgcgctgggtcaggagggctgctcccagtgttcctaagccttcagctgaaacttgcatttaagttggtacctgactctgttggcagcagaaatttcttgtttcactgaagtgttaaatagcacttaactggtggtgaattttcaccagtggaaacagtcccatttactagtattttcctattaatgcaaaagaaaacctttctccctcccctccctccgtccttgccttcctccttccctcccccatctctctcctctatcccgcctctctcctctttcctcccctctctttcccatctgtctcctcttcctctctctctctaatctccctctatttccctattttcttctcatttccctttcctaccttctctttgccttctctctcctcccactccttcctcatcttctctctttgtctccttctcctctcacctttttctccctccctcccttctttccttcccccactctcccttccctctccctccctcttcccctccctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccaccaccaccacctccaggtgccccttatctgatgatgtttagagtcatgtcaatctctgtcctgcttctttgacagtcttaacaccatcatcatctagcactctccgctttctcaaaggaatgcttttctatttttctaactattctctgggtgagaatggatgctttggattctgagttgtgcccatcagagggaggaggaccttccttccctaatatttgggtaggttcttgagtagcccagatgacccagtgtgcctgaggccacaccttctactggctcattgctttcctgggaaggcctgcttcaagtccaggcttttgtgggctcgtttttctccattggcctggttacctcatcactgtgatagaaatgccacactttccttttctcatgacaagcattctgatttttcagcattattgtgactaagtctgttaagacgcatgtatcagtgaatcttaggaagaaagacaggccccttacaccaccttccaaggaaggtttgtttgttttttttttccttttaacttctctgctatttctgctgtgagatatttgatcgcatgcagttttgtgggcatacatatacacacatgtaaacacacacacacaccctctaattaagttagtagtttggcaggacttggctctgtgttttctgtctgggtttttattctctttggcatctgggaaagtagagacttgcatgcttgttagagggctctccatattgatgttggagtggagtccatctcagacgttaaccaccaggaaatcaaataggatcttgaaggttcagtgatcacatggtactaattggtctggagaactcaaataactgtggcagattttagcctgaaagtatgtgaaaagattacatggcaaagttggaagacttactccttccttccttccttccttccttccttccttccttccttccttccttccttttttctttctctctttctttctttttctttctttctttctttctttctttctttctttctttctttctctctctctctctctctctctctctctctttccttccttccttccttccttccttccttccttccttccttcttaaaaaaagtctttgatgtttgttagcgtatctggctaatgtttaaaaaactttaaccaaatcgagagctaaatgcttcccgtttttttctttttctttttctttttctcttttcagccaaaaaccgtgggattgcgatcccagtcgatttggacagccaggtcaacacgctcttcatgaagaaccactcaagtacggtgcagagggcagccatgggctggagactctcagctcgctctggacctcgcttcaaggaagctcttggaggaccagcctgggattacagaaatattattgaaaagttacaggtacaatgagaacgggaagtgacgtgaataatttctaaatcctgcatccttaaaatatgtctcataatacgatgaggttgaaaatgtcaaatttttttcttatttattttatgtatatgagtacactatagctgttttcagacacatcttcagacacatcagaagacagtattggatcccattacagatggttgtgagccaccatgtggttgctgggaattgaactcaggacctctggacgagcagtcagtgctcttaactgctgagccatctctccagcccccaaaatgtcaaatcttgttagtggtaaagctctcttctctgcttctctgtcaccgctaccccttaaatgagcagtttctggagcgattgtcttgactgacataactttttaatgagtatatatataaaatctgatgctctctgataatttcttaatgagtagtggtccttaatataaaaataattataatgctaatattacaattagtaaaaatagcttactctaaaaatagatgtaataaattaagtttccgtaatattgactcattttatcttccattgttcagttatatccctttggtcagagcgagccaatccctctcttcaccaggtccttgtatgttttttgcaagtccacgtctgtggtctggcctgtttgttcaggcatagtaagcgtggtacatggctatgattttctgtgcctgccaccataggcaggatgttttaagcaacaggaatgtattctgttagaaatctggaggtgggagatctgggtatctctcggtgggcttagttttatgtgagatcgccatcactaatgctagattcctggtttctcgttggtattccctctgtgccagtgtacacctgtgccccaatttctgtcagttatgtgaacaccactcagtcacactggattatacagttgctcgtatgaattcattttatcctagtgacatactaggcctcatccccaggtaagtcactcgctgactgttctgagacaagactttgacacatacactttgggaggagataggatcttaagggtggacttcatgaatgaggttagttctcttatactgtagacctaaggtgtggtgtttatcctccataccacacggggacactgcaacatggtctctgtgcacagcaggaagtaggcaccaagactgctgattccttatttttggattcctaccccccaagctgtgaacactgagcttggcctccgtgggcacttgtactcatgtgcacatacccacgcacatacacacgattaaaaataaaatatttagaaaataaggcagcaactgtaatggagagaggtagatagatttgagatggattttcttgtagggtcaggatggatggatgaatttcggggcaaaggcaggaggcatcagggttaccctaggcggttgcaattgtaccacttgctaagacatgaagtagcgcaaggttggggaggatttggagttggatatttgtctgccagccagatagctgggtgtgtgagtctggagtggtgtggacagatctctatgctgacagtatcaatttgaatgttctagtgtgaatatagtggtgacagccatagcattggacgggcggtctcagtggagatgtagatgcagcagaaagaaggatcctgagcaagcagggtgtagtgatggaggggtcaggacatcagtggaaaagtacggtgtcacagaagccaagggcaggtggccttataaagttaagtggcaccgtgtagagcgactagccatggcatggtgatgtgggggtggaagaggtacaccccacacacacacatgagagaaagatgaggtcatggttcatgcacatttagtaacaataggggctgacatctgaattgtagggtacatgcagcttgtgtcaggagctgttcttggcacatgctttaagtctccgtagcaaacctgggtggccactagcattctggtgtcatcggaaggacaacttcaccccagaacagcccaagcaccatttgttccacaacaaataatctagcaggctagttttaccagatgtggttgtttctgatgagcattcccctttatataacgcccacaccctctttatagcatttcatatagcatttcctctcatgtatacatagtttaaaaatctttaaaatatgcagatactggaagagatagagggagggggaggggcaaggaagtgaggagagactatgaatgaatgaaatcagactgtgttgaaatatgaacaacaaaaatttggtgttatgggaagccagagtctatcttgtatgaaacttcccacattgcttcctggttaatgttcttccgtgtgtcgtgtcttgaaaggtgttcatgtaggtcccctgtgccttgtcttaggatgtcgtggcctccctggaacagcagttcagccccatgatgcaggccgagttctctgtgcttgtggatgtgctgtacagcccggagctactgttcccagagggaagcgacgccaggatccgatgtggtgccttcatgtccaagtaagtggagccaggcggggtcctgctgggatggaaggagtcaggccagggggctgtgccaggatggaaggggtcaggccagggggccacacggggatggaaggagccaggctgggggctgtgctgggatagaaggagccaggcccaggttgttctgggatggaggagagagggcctgtagcagtctgctttcaccctgcatgtgaccacaaaatccagaacacctgtgatccttcccagaagacaccatggcacaaataatctacagtgtagtagtgactgggcctatgacagacacgggatgttgctgttagtgcagagccctgttggacagcagaggtctaggatctgagggtgagggagggagttaactaaagtagccaaagttgaacagttctgattcctgctgagggtggaggtggtctgtgttagagaagctagaaggagagatgtggggcagggggatgtttggcagtgggaatacattacggaccccacaccaagcagggttgccccattgactttagtagttaaaggcttcatctgtgttgttataattattttatggccagaggctcagattcactggtgtctgcccatggcttcccatctctccaaagagccaagagttccttccattggcaatcagagctggaaatctagagctcactcccattacgagccacgccaggccctggcacagctgtgcacaacactctaatgaagctgagttggtgaacgtggagcctcagccagggctgagttagctccccctacttcctccagagaatctaacctatggttcctgctgacggatggctctacaggagtgggtgggggacagccttggggaaggacacggattcagcttggccacaggcattgggatgggagactaggttagcgtgggcattcatctgccaggcagctggtttggatccactcagattgccatctactcttctgagagggaatctgtggttttcagacactggatcttcaggtctatgtaggcaaaggataatataaaaacatggcttagaaaaactataaaatgtaaaactatttctgacatagaaaggagggacttcggggacagcgtgcacacataccagcaatcccccgtatcagacccgtaccctggactctttagtatggcattctggcctgttcactattaatcatgttgtgggcagggccatcagcctcacctctcctgtttccattcctggccaggcttgccttcttccatgaccaactttaagtgctgtctctttgatgccttcaatgaccagaaaatccctggaacagaataaagatttttttttttggtctagtttactggcttttaaaagtacctctgtaaattttcgtatcccttgtcatgttggatggctgtgtgcacagcagcctgtggcatgctgggactccgtcctgaagccccagcggctcattggtgaactgcagcactcatgagcttagatgtctatctccaggtgtccccattagaattgtgtaactggaagcatgttgtgtcacctgtctgaacccacttcctcctcagcaaacttagtcagattctggcttgtcgtgaggtcaaagagagattccttggaaggtcctttcttcaactctgatggctgagaacattagctgggcactagccagaggacgaggcttatcagttatatcccgaggccctcattctaagaggagagttatatcctatagggctcttgccatgacactggaatccgtaatttccttcaggctacctcatgctgttcctctagggagatgtgtctcacagggttatgaaggaccagtttcttaacaacacaatctaatggggactgagttacacaccccaatctaatcatttctcttgatgctgactctgggattgttacacccatggtactgaaagtcttctggaaccccagtgcatgcttcataacagtggaaaaaagagccccgttcttgtctgaatgcatggtcactgtatactgaggaatggggcgggtgtgtgtgtgtgtgagtgtgctatactgtgtatactcctacatacgtgatggaataattgatgtggtataatgcatggaatataataaaaaatgtaatggtacattgtatgctgtaaatcttctcatactagcaaagtggatgggtaagagcatcagaggctgaacctgagaaacactgggatgtataaatatctcagcaaaatatatatgctggtgtatagttttcagccttttggcattatgtatccgatttgctttgagcccttggcactgtttcccctcccaggtagcatattgtatatgttttggtgagaaaaattggtgtccttttcaaggtttaatgttttgctttcaggctgattaatcacacaaagaaactgatggagaaagaagaaaagctgtgcattaaaatcctccagactttacgggagatgctggagaagaaagacagcttcatggaagaggtattcttttagtttttagtatttgaaaattagatttgattttttttttctttttaagcatttgaaataaagtaaaatttccagaatgttgtatctatggattgcaacgcgccattgtgcgcgcacttcttactggttgaataacacctgggtgttattcctgttagccatgttattgcagttttatggcgtttaccttcatgtttggtgttgagctcagaatgcagcagaccgaacatttctctcattcgctgtgctgcagtctgtctcagaagagtgtgttgtcctcttggatggagtattgggctgaaaggcctcctttgtggccctgggaattgaacccaggccctgtgcttgcaagtgctcgactaccaagctgcgtccctgaatctccaagtgacctttcgaggtgatgggtgattgaggtgcctggtctagcaccagcctgtagagagagagtgtctgtataggctggcatgtgcttttttcaaaattataattagacgtttatgttattttagatatattaatgccacgtattgtaagataatactgtcattttaaataaagggaatggttggtttctattctcagctgtattagtgaatgcatagttgatattcatagacatatcaacgtatagcttgccagtcattcattacaaacaacagctcaggtgctcattaagcaatagctagcagtgttttgataaccacggagataatcgtaaatgtgaaacaagaattttgagaagtttttcccttcttttcttcccttttctgtttcaaagctagttcctattcttttatgcttagcatcaagcaaattttgtacagaagtacctcagcgtatttttagagtatttccaaaaacgctaattgtttggtattttaaaatggcaaaggtttaatttttgttactggatatatgtgctttttaggtccagaaagtctgctgggattggatttttttttccttttgcacatcctgaaaagaaagaaagaaagaaagaaagaaagaaagaaagaaagaaagaaaggggatggaaaattggttgtcagtaggaaggactttgctccaaagtcgtgcattagagggggttggcgacatggctctgtttaaagttcttgtcacataagtatcagtacccaagttcagctcccaaaaccaaggtgaaaagctagaatgacggcaaacacttgtaatcccagagctggggaagcagaagaccctggggtcctgaggtaacctggcctactgggtgagttccagaccaaggagagactgtgtggagacaggagcaacagcaaggctgcacacacgtacacacaccctgttagagttaagtgtctgtattactagtcaaaatgccctctgttttagttccaccgtctgagcaacaaatcatttaaagggatgtcgtcagcgtcgctctagcaaccggctttttttttttttttgacataagattgaaggaaaccttacagacttcagtgtaagctatgggtctccttagggtttgcagctgctctcacgtgacccctcagattggtactgcctgttagctgatttcacgggtgccctaggtctccaagcagaacaattatgtcaacatagtttctctgacgagccttacagtttgacacaagagatcgattccgaatgctctaatggaaagaaggacagacatggggatcctgctctcagtgggcaagagtgttggagcgtcttccaggctgctctatctgaaattagccattcactctccctacctgctcctgctcactgaagtagtccagcctcctcctcttcctctctccctccttatctccctccctatctcccttctttctttcctttcttccgtctagaaaacactagtggctcacacacattcgaacctgcatgcacttacacatgcctaccacacacactgaagtaatagtaagaatagtaagaatggagggtgagagctgaagagatgtctctggttaagaacactgaccgttctcccagaagccctaggttcccttcccagcactcccctggcagctcacactgtgtgaactgcaggagacctgacaccattttctggcttctgagggcgccacgcacacacatggtcaaacacacacatacagacaaaacaaccatgcaaacatctgaaagaaagaaagaaagaaagaaagaaagaaagaaagaaagaaagaaagaaagaaagaaagaaaggaggaaagaaagaaagaaagaaagaaagaaaggaggaaagaaaaaaagaaagaaaagaggaaagaaaaaagaaagaaagaaagaaagaaagaaagaaagaaagaaagaaagaaagaaagaaagaaagaaaggtgacgcctgccctggtttagcgctgtgataaaacactgacccaaaaggaacctgggtgaagaaagggtttggctcacaggtcactatccaccacggagaaatgccaaggccagagccagaaactgcagtagagaccacggagggatgctgtctactgacttgttcctgctggctttcacagctagctacctttgttatacagtcttgtctgcttgcctagggatggtatcaactatactggccttccatatcaattagaaatcaagaaaatgccccaaagatgcccacaggctgatctggtggagggaattcttcagtcgagggtctcccttcccaggtgtgccaatttgacagccaggattggccatctgagcacttcagacaagcagagaatcagataaacctctacaaaaacaataaagatgtgtgtgtgtgtgtgtgtgtgtgtgtgtgtgtgtgtgtgtgtgtgtaaatgtgcaagggaacattggcagagggattagtgagtgccagagttcttatcttgctaattaccatggctactaacaacaaaataagacagaaatttgagtgtgcaactcttatcttgaagtcagcttctgggtgctttagaagcaggtgactccctgttcccaggtaacagcgtggaagagttcaagtgtctgcctccagacagcactgggtgcccccttgtgtccacgggtgactcaagcctgtgtgaactggtgctgggtagcaggctgggcagagcgactattctgccagtcactaggggtcgtaggaaaagcctgggtttcagtagtggaacaacaggcagtgtttcatgattgtcttacttccctgttcactcaaaccttactgtctcaaaatggtacaaactcaccatcgttcagatttggaggccaaaggttaaaatcagatcaacatgccagcagaggtatactccatctgaaggctgtggggccgtattcatttcctagtcctgtgtgtttcttgatgcctcctgcatgccttggttcatgtaccctgtcttagttagggtttctgatgctgtgaagaggcaccgtgaccatggcaactcttttttttattattattacatattttctttttttaaaaatattttttattacatattttcctcaattacatttccaatgctatccccaaaagtcccccataccctcccccccacttccttacccacccattcccatttttttggccctggcattcccctgtactggggcatatacagtttgcgtgtccaatgggcctctctttccagtgatggccgactaggccatcttttgatgaccatggcaactcttataaagaataacatttcattggggctggcttacaggttctgaggttcagtcttttagcatcatggcaggaagcatggcagcgtgcagacagacatggtgctagagaagaggccaagagctctatatctggcagcaggagagagagagagagaaagagagggagagggagagggagagggagagggggaggggagagggagaaagagagagagagagagtgagagtgagtgagtcctggcttgaacatttgaaaccccaagcccacacccagtgacccacttcctctaactaggccacatctcttagtgccagtttctaaaaattaaaatataagcctgtggtggctattctcattcaaactacctcaggctcttctatcttcaaagcccattcatgaacgccttcccagtcactctcccttctctttcttcttgttccttctccctccttgaatgggcaatccttctatgtgagactcttgtctccctcttctggttacattggaacgatttaacaatctggtgtaactcctgccccttgctgagatctttcacttaatctcacctttatctgtaaagtgcctcagtcacaggttctttaactagagatatcccaagttgtgggcatgtttggactgggcatttatccagcctaccactataacgtgcctatgcacacacacgggtgttgctcagggggaccacacgtcttccttttgtgtgttgagggtttgcaggttcaaatctgagtggagatttctttgagattgtcaggggccagaaagagccctgtagactggggtgtggggtggtatggggtagatgtgcagtgtcaagtcaggagccaagatgcataggctggagtgcacacggctctcttttctctctacctcagtaccagggagacagcaatgctgcctgtgaacccgggggaatattaaataaaacaatgtgcataatggattaagaaacaggactgacggatgctaagctagttactgttgcctttgaaacccagtgctgaaaaactgaactatagttatcatgcagttcagaacatcaaaatgattgccaaatgaactaaaaacactggtggcttttatgaatgtcttcttttcagttgctggggcatgaggggctatagacacagtgagtttggtctaatcgctgttgtgaccttactggaaatacctgaagttgttcacatcttggtggtgcgctctcttgcttcagaatctgagactgtaaccccctctgcccggcttgagttctaaatcgttagagatctaggactggaaggtcataatgaaaatcttgcctgtgctcagagactgactaccagctgtcatcttcacaaggctgctgacatggtaactcagagaaagccacaggcccaaaccaaggaaaggcaaaccaaagccaaggacagaggcaagaaacaagaaaagcaaaacacaagccgggcggtggtggcacacacctttaatcccagcactagggaggcagaggcaggcgggtttctgagttcgaggccagcctagtctacagagtgagttccaggacagccagggttacacagagatctcaaaaaaacaaaaacaaaagaaaaccaaaacactcagatgaattgcagcggtaatcatttctacctcagtctgacacagacttttccacaacactctacatgatcactttagcttcagtttgttctgttgggtttctttgtttgtttgtttgttttgtttttttggttaactaactaattaattaattaattaattagattcaggggcttactttgtagctctggctgtgctggaacctgctagcctggaatctacagagacctgcctgtgctgtctctgccctcctggtgctgacattaaagacacaggctagcacacccagccttgctgtcttttataatcatcgtggcatttatagggctgctgtttgtctgactttggaccttgctctaggattccttaaggatgatccctttgatgtgtgctgccagtttaaagaaactaagaacctgtccagggtgagacaggcttgtcacctaagctgcatccctgcatcccccgttagagctgagatcacacaaagtcctgtacccgcctccacctccccttgtttctatccacatgccacaccctgttgggcttcttgagggcagacttgatcttcactgagaagcgtccagtgtttagcactttgctgtgcacacaaccattgctcggcgatggccttcacacaggccttatcactgtaaggatgacagcagcctttgctgctctagcagaggagtcacttgaaatcctgctttgcatatccttgtgcccctacaagaggcaggtttctcacacctcacacacctgcaaagtcagaccagctgttcagacctttagcacaggaggcgggtggaggagccgtgtctcagacacagcaagtgtttagtgaggtgttgtagcgggcacccactgtgaggtctgcaaagcagaaaggaagatggaaaggtgtcataccccagaccctgtgccaggctcaatgggcgctcagctttgagaacaaatgtggttctgaaggactgccaggaggagggcttccattcccgcacccgctcccagctttgagaagagcctgggaagaatgtgctagagactcggctaatggccttgagaagacacaccctggagactttgagcctagagcaatccctgaacaaagccaggactggctgcagcatccctaagtgccgaccccaacagtgtcagagccccacagcctaacatggggtagatctggtggtgcaactgtttggagaaggaacaggcagtctgaagaaaatctgaaaatcaagcatcggcttgatctgtttcaggatgagaccgctcatagccaagtgaacccgcaccaaaatcttgttgttacttttttctcacatctgtatctagaagagctgtcagctaggtaacatgctatctgcatccactcagatgtagagacttgcagagactcagactcctaacctcccttttaaaactaaaaagaaaggcagagggggaaagccttccagtaagtggctcgtgcctctaagctggtagattgtgaacacaaatcccgagtttctcctgcttctttctactgtgttacattgtgagtcaggaattaagtaatgctgctagaccaaatgctgcttacattccatctcattctgtcaagctccggctgcagactcatttttctgcctccgtctttatttattaccacaggtagttcagataaagggtaatacaaggagtggctgtcccagaagactaaagctagctcaagataaagtgattagtctccgagaccacaaaattccagtctctccacagtactgaaattccaatttatccatcagtctgcaggcacaggttcctccaggaggcttttgtttacagccggacacagattcttctcaagaattttcatttatactgtaattcatttaaaccatgtaacaattaaatcacagagaaatcaccaccgagaaggtaacagatgtgtcagagtttacacagcaaagcacagtggagtcaggacagatcccagcccgtgtagctacagagtctacagtgagagtctatgttcctgtgtggggctgcctctcattgcactgaggcggcagccacagagctgtaggagtgctgcacatggctgcggagggagagagagctttttgttaaggcagtgcagaccacagaccacatttcatctgtgtttgatggttttcgaacatctaccacgtacttcagtattgcatcggcttggttcctgcctgttccacctggagcccaagactctgaagcctttctgggatactccctcctttaagcaaaacaacaccatcggtttgagtgtttgcagattgcccagtagagttggaggttcagttttttacagttgttagcttttgtctgaattgcaattatgattcaaatctcagactccacttcttacataagcatagcctgggaaagcaagagaaatgtgttaggcacatagcttggtatgaggagcccagggtaatgtatctagtgagaccttgggatgatttgaatgagagagagagagagagagagagagagagagagagagagagnnnnnnnnnnnnnnnnnnnnagagagagagagagagagagagagaggggcaggccaagggtactacagaaatgtgtacttaagtgatttctatttgaagcatcaagcccacttacttcaggttctcttgccctgttagagtatagtcaagtggggcgggtggggagagttgttggtcccatagcaagcaataatcccacaatgccagtgagggattgctatatcaatataccaacctccagggtgcatgtagccattgatttatgaaaagcatagtttgtgacctatggagaattggtcatctcttaggcggagtcagacgagacttctgcctcccaggctcagcgtcttatttctgaaaaggacagccctgatagaaatttcattctgctcttcccagtcagtgaacagtgcaaacctcaaaccctgtagagccaccctcccggggtgggggtgtgggcagcctttgtttcccacaggctttgctccccatctcccaagttcctcttctctccctctgtgacctgtgtcccttcccttttcctgggagagctctcttccccaggcccaatgttttctcagctcttcattggttagccactagcttctccctcatccttggagtcaggagctgcgggtgtgtgtgtgtgtgtgtgtgtgtgtgtgtgtgtgtgcgcgcgcgcgcacttctccactgctccctcagggctgattcctatcctacctttaagatcctagcactttctggggtggaggctttgactacatcatcctgacacctgccgatattccctcccttccctccctccagccgacccttaggcatatctagtgctataggcgacacccactagtaacagggggtttccttccataccatcctgctgttaatactctagcctctcagctctcaacctttgccccttctgtgacctctctgctccatcacccttcctgagacgccctgagagtttgcacctctaggagccactgactatgcagccgctaatctgggaatcccaacacccagccctgtactctgctgtccactccctttgctttcagctgtgctgcgtttggccatccctggacttaatcaggacttcagatccctctcacttcccacccactcagctcgttcatcctagtgtatattagtctcaggcttaatagtccactggtgagcagctgaggcaggagactagctatttatccctaaggcaatcttgtgtaaaggaggcagggttacttctcctaaggtgttggaatgttgttgacaaaacatgaggcaagagatgtgagatgggctacaaggacaaaacaccatgctttccccggcacaacttccacagatggactctcagatgaagtcatttggctggctttccatccgcgtctcacctctttctgcataaagccaggattttgaaagttccctttcaagacagcttctgcttggttgtgaacgtgggcactgtgtgatctccaagagtgaagtggctgagggatcctgaggctgagaacatatgggtgacagtctgcttcttctaacaagacatctgctaggctctcccgcctcggagcatatgctgtggtttgccaattgttttcataaatattaatctctgagatctcaactgacagacaagttgttctcttgggttcttttcttattttcacactccatgtttgaatgattctgccgcattacagtgaaaacttttttttttttaaatacaaagtttatattttgaaaaagggggctaccaagtgtttaaagacaaagcatgacttttccctttgcattgggattttccttctttcgtagttttaactaaatattttgtcttgcattggtttgtggaagcacgtgattcactccacccttcaccagtacctcaggatggcattgagtgatcggttggttgaggtaattattctgtcctcctctaaaaggataaatgcatatgtcttagtccaaaagtatgaattttaaacttgaatcatgattatggactgtgaatagttcagagactgtgcgcttgaatcagtgctctccagcaggtggcgctcatgagcgaggtggtggaaatgaggtcgcatctcattggtggaaatgattctccggggcggggctttgagattttatagtctggccccatctcttgtcctgtgtttgcgactacagacaccacgtgaccagatgcctttcactcctgccaatgccttctggttccctttccttcaagttacttcttgtcagctcgcagcaaaaggaaaagtaactaaaatatacgttaggttaacacggaattcccaatcagtgagataactgcgtaaccctgtatcgcgatcagcacgcccgctgcctgcactgttattttatggcggttggcagctgtattgaccatatgtagctctgcagtctctctgcggttcagaggaagattttaagccacgtgctgctgagtttcggcttgttttttatcatgtggcactcctcgcttattcaactgttttctctagaggccagttttcagagcattttaaagggtcacgattattgcaaaataataaaatcattttaatctcaagaatggaaggtatcccatccacataggtgcttgatctgaaatctgtcaggcagttggcattttgtgtgatgctgaggataagaaacagcagttgacaacatttgcaggaatgctgtgtggtcttcttgctgtgtggtcctattactgggttagacagtctccttaattagccacctcctaggcactggactcaaccagtcgtctttttccagggcatatttaagagccccccctcccccagtgtgtgttactgcatgaatgtgtggaggtcagaggacaacctctgctgtggtcagtctaccttgttgcacacggggtctctgtgtcgtttgccatgttcctgtttagcttttatggccaacttgatacatcccacagttatctaagttaacacatccagggaatcacttccatcaaactggcctgtgggcattttttattgctaattgatttaggaggaccagcctaccatgggcagtactatccctaggcagagggccctggactgtccaaaaaaggtagctgagcaggatcgagagagaaacaactagtaacagttactccatagtttccattcagttcttgcctcaagttcctgacctgacttcattcactggtggcctgtgacctggaagtgtaagctaaaataagcccttcctcccctaagttctttagtcagagcgacagagaaccaagctaagacagttagcatgctaaatgtaccagactctctggccctgagcttctggggactctcctgtgtgcacccctatccctggtgtaggatgctggggttgcaggcattgtaccaccacacccagctttacacaggttctggggatctgaactcaggtccttctgcttgcaccgtaagcccttcaccctctgagccctcttctcagctggaggggagatcttcatgagcgatctgagcgttggtttatctcttcactccttcattcttgattttaaaagtagaacaccacaacggaggagaagacatagataaagtgacctcttctgagagccatggaggagatatctgcatcctgcttctctggtgggcttgcaggtggctgtcatgtcccctcacgtcttcagtcattctgcctttgcatatatgcttatccaaattttctcttagcatgacattagttgtacagaattaaggccagcccaatggctgcatattaatttaatggccccttcaaggatggtttttttcattcagagttgggaagtggggtttggggcagcaggacttacctgtgattgtgggtggaatatgctcagactgacacagtttcgttctctggtcaccccactgtgggtcatatgtgaatgcctcctgtctgcttcttgtgtccttgtgcagagggcaggcacactgcggacagcaggtctttggcatacactacagaattaggaaggtgttttgaaacatgtttatctaaacatgttcaaaccaacaaaagaaatttaaaagggtttctgccttcctcttggatggtatccctacgttcaaacaaaagagctgactgatagaagtgttccaatgacactgagacctctgtgtggatgtctgagcagaaagtttgattgggtactgaaagagctactgtatagaaaaaagcaatgtgggaattggaaaatccatagaatttttaagttttcatggtcacagtttttagcccagtgatgcagtatgcagtatacagtccctccaatttttattgaccagttttaatggttgatgtcctttggtatttagcagttcttctggggtatcctttcatcagcctggtccctttcatagtaaatgcatgtataaatactttatccaggtccctgatgagagcttggggttgagtgtgtaggactgggtggtctgggtttgattgtcagcaatgcaaaacaaacaacaaacaaacagcaaacaacaaacacccttcgccaaaaactgtgccttgttatggagtaggcacctgtcttagttagggttttactgatgtgaacagacaccatgaccaaggcaagtctgataaggtcgacatttaattggggctggcttacaggttcagaggttcagtccattgtcatcaagctgggaacatggcagcatccaggcaggcatggtgcaggaggagctgagagttctatgtcttcatctgaaggatgatagcagaatactgacttcaaggcagctagggtcttatagcccacacccacagtgacacacctactccaacaaggccacacctcctaatagtgccactcgctgggccgagcatatacaaaccatcacagctccctacattctgtaagttttcataagtcacaaatgattttgctattcattttggaaagtagccagtctttaaaaggctggtggtcgcttctaagatgcatataaagcagtgttaggaaacagcagttttagccccagtgactgatacagctgcgtctccatgtgttattccttatgccctctatgagagataaaagtgaaagagtaagttctcatcattttaatgaagactgtgactcatgccagtgcttcatgaacatcttggcttctgcacttaccatgtcctatagcagcatcttacctctcagtaataaaaattctccatgtcagttatattttaaaccagcttgcttatcccagtaagagaggaataggcaatcagaattggggaaaatgaaacttgaaacctggcctggtgtctcagtcttgtaattcccagatagtcagaaggctgaggcaggaggattataagatcaaaatctacctgagtttaaggacagcctgagcaacttagtgagatcctgaggcaaaataaagagtaaagggtggtttgggggtggagcttagaggtggagggcttgcccaacatgtttcagactccgagtttaacagccagagcctctgcatgcatgcatgcatgaatgaatgaatgaatgaatgaatgaatgactgagcacaacttcaaggtatgagcagaataagccactgccctccagtaggtaccaacataactgtatggccatcgctggtggtttctgtttccttgatggtataatctccccctgaggtttcagggcccactgctttgctatgacacaggaagaccgaatctctgccatttagatagatttgtgtgtttgtatgagcgcagtaaacaccaccaaggaacatggtggcagattcacacgggtgggcgaggagacagcacctgtggaaggtgagactgagctacgttgtttttagaaacagaaggaatccaacctacagaacagtagccatgggaacagccccagaggtgctcctctgagccataaggagtgggggaaatctaggagcgttaagagaaaacaaaaataaaaacaaaacacagacagctagcaacaaacccagtgtttacgcctgcctgctgcttctgtgtttctctaagtttggtttttctccagcttatgactttggtgggtggaaaatgtatagttagaaacatatagataaatgtacagtcagattccagtgtgagaatctctctccaggtttattgttcaggaagctgacttaatgtcttatttatttattattgtttctttttgctgcggcatgcagagtttgtacttcacgctgcccaggtattttggtggacaggctgtgaggagacacctcggcagagtctggtgggccctgtgatggtagtctcagactcccagatgtagacgcaaacttgtctagttttgaggtagctgtcttttatcttattccttggggctttcagtagaaaaataatttactgtaactgatttaattagctgaatacactttgcagccagcatctacccaacccccaaaatgctgatcattcaatattaaatgtggctctgcctggaatattaaaagggcttgactgcagaaagactttaccctgcctttatctgtcatcagccacactctgctgatcataacgtttcatgagttaacacgtatcaagagaactttgactaagacaacaaaataattctagacagaagttatctccccccaccccccagctccttgctagactctgggatgttaacatatagattatgatgctcagagaagcaatgtaaaggtgagcttttaaccatacataacatttaaaaaaagcttcctgtttaaatttgaagctgggttcagagaagcctgtgaaaacagccaaaagttgaaaacaggagcctgtgcgtgtacaggtgatgggtgtggggagtctagtggtttatagacctaagggtaggtcaagccctcgggggtgtgggagtccctgcaaacaccaggacaagccaggaatatcctcaccaggcaagaaggaaatttagctcaacacagctcagtagcctgttcaaatgttggttcaaacttctgaccctgagcagtttattttagccatatttaaccaaggcaagtttttggaaaacagtttcctgatgctatttaactcaatcccatgcatacaacaaagcttaagacatgtttacattgaaactctttacaaagtacatgtggtctcttccataaagatgggttctgttgactcagaatcaacgtccagtggtcttgggagaatgactgagagaaacctaagagtgtgggggagtcaggagtaacctagctggccctacagagagtgcagatccccttagattctcagcattctgagtggaagacagatatacatctcctccgtggaggatacaagtctgtcacattcttggtttccgccgtgctgatctgtgagtccgtggaccagtcaagagaaggcactttgcaggattgataggcaagaagatcttgtgtggacggtaccaccagcagatgctcactgtagacaaagctgatagtagtgcttccaaatagaaccatggcccaagcatgtggatcagatggtctaaagtgttctgaggcccctgggtctgtctctgaggactctagtgagtcatcgagaaatcagctagtgttctggtctcatgtgaatggggaagcaatagtttactgcctatgtacgctacgtacagctatgtacagctatgagaaagcagatcttcactcagtgttgctctatgcagaccaacagtgacattcaaagtaaattgaaggaatggagtgtgtgtgtagggggtgtttctctgtggcagagtacatacctgccattcaacaggtccagatgtagcccccagtgccactctccatatgggagtaggtggggacagcatcagattcttgctacatcaagtcttgcctgtggcatcttacgcacctgggtgcccacctttatccttgtccttaatgcatatgactgggtcagatcttagagtcattccgcagccccagagtgttgacagctctacttctttttttttgtttgtttgtttttttgtttttttttgttttgtttttgtttttttgagacagggtttttctgtatagctctgactgtcctggaactcacttttgtagaccaggatagcctcgaactcagaaatccacctgcctctgcctcccgagtgctgggattaaaggcgtgcaccaccacgcctggcagctctacttctgtttacatgtatttgttagtgttgaggtttggtgagcctggttcggttcctttcatgtaagacttggattacaagggttgttcaggtggatatcaaagcatcagccttgttacacaacacgtggagccccagaggtaggtctgtgtattggcaagtattttcatgagactctaaaacatcagtgattccaggcgcatgtttgaattgaaagagatctgacctccttccttgcatgccaaaattgagctatcccagaatcccattgctcggtggtatcttgcataataatgtgtcagaacttgatacctggagacaacgtacctctcttaccactaaacaaacactaaaggctttctttgaactgtggtaccatgtctggaggcaccaggaggcactgactatggaggcaaaaggagtctgcacacccgtgcaggatgcatgccacgtgacttccagtggagaccaaattcaaatttaagactgtaccacccactaggtgatttatgttggaacagggctgggaagcagattggttagtcaggaacagatgttccacactggtttggggcagccaagattttttttttttaagattagattttatcattaatgtgtgtgcatgtgtgcatgtgtttctctgtgttggtttgtgctgtgagtgcaaatgcctgcacaggacagttgagggcgctagacccagagtcacaggtggttgtgagccactgatatgggtgctgagaaccaaacacaggttttctatgggagagtagccaatgttcctaatggctgagccaactttgcagccttttggcgtctattgttaggcttgactcaccagacttgaattactgagggagagctttcacatctatggatgactatcttgattattagctgatgtgagggtccagcccactgtgggcagcaccattctctaggcggtgatactgggctatgtaagaaagctacctaggcatgaccctgggtgcaagccatctatcagaattctcccgatggattgtgactcaaacttctccttgagtttctgctctgacttccctctatgatggatagtggtctggaagctgaaataaaccatttcttctgtaagtggcttttggcgggtggagtttcatgtcagcaactgagaggaggcaaggcacatgacctcccaattcctctgtccccacgtttgtgaatgtcagtctgctctttctgtaaaggttgtacagcatgtcttaactcatgtcatgtgccttttagtgccccacaagggttttctgttactggtcaagaggaattcacatttcttaccagattccatagggcccagcattccgtcgagcatcccagcctctctctcctgtgtgactgtcccgtggtcacatgtcctctctctttcttcattggtgctttttacattgtctgttccttttgcctggaatgctgttcctattgtagtccgtgtgcctggttgcttctttagagtcacatccagtgcctctcagggtgagcctatcagacacagctcctcacttactgtctgtcttagcgagtttcagaggatgtcccttctggatcacttctgttcttgtagttatgtgtttcctcaatgacagtgacttttatgagactaagaaccccgtgcgtttctttgactgcaatgtatacaaagtgtcctggactcacctaagccaatgaagaatgtagattctatgatgagaaagaggacagagcagtctgcatgaggcggagagcaaggagctggagactgtttggtactgcaatgggagccaagactcctgattcatggatgatgaatcccagcaggaatgttgacagcgatggactcagaagctgggttctgggtctggcagggttatactggtctaactaggtataaattgtgtcccatgaatggctcaggaatggagagagaaatgacactttgaagacttaattcttattgctttatgtatagaggtgtcttgcttgtatgcgtgtatatgtaccatgtgtatgcagtacctgtagagtcctaaagagggcatggcatcctgggaactggagttacagagggtacccagccaccccgtgggagctgagagttgaacccaggctcctgagcaagagtagccagtgctgttaaccactgagccgtttttccaggcccatgagaagagctaattttaagaagtaagtcttataggccttagggtcacggaaagagaaatatcctagaagatggggatcactgcctaggatggagcacaggcaaacgtatgcacacaccatgctcaggatacagtttgccgtgtgttgagtttcctgtttgtgaggtatggaggcttgtttctgtcatcctggagtatagatttggagagttcaaactatcttcccaaggtatgatagtcaaggctgtgagagtggaattcatccctgaacttactggcttgggggttttgatgagagctggctcactctttgaggtgtacctgatgtgatgacgttggtgagcaatacccaagacagtgaggtccgtggaagaggactgtagctgtccagaccggaacttctgagatgtatttgagatatatctgatcaaggataactttgtatgtctgtcataaaacccaaactaaaatgtatcagacagaaggtatagaagagagggcgtggagacctgggctttggaaagctttggtgatgggcaggccatagggacttgaggatgctgctctcttgctggtccctgtcttcatggctcacctcctggtagcaatatttacattgaaatcttttgaaaatcacttactatagtgggtgctgtggaggaggacaactttgtgagtgaggctggattaagcttaggtttgaaccaggcttacttgcctatcttgtcaggcctggattcattttttaagcataaattatttgcacaaactaatagcattatttgtgacatacttctgagtgtctataacatattttggttgctccaacttcaacacctgtgtatatggcctccctgcctccttagatgtcagtgggcagaccatagagcagggctacaattgagatgcaatatcacaagttaccagtaggcgtcactgttccataaatgatgtctcttggagtagctgagtacaaacctttaaattatataaatgttttcatttcttctcattgatactttgaattctcactatataattttaaatattcaagccaggtgagatcaaaactgtttctacctaaatctagttcaggttttattcagaattctagtcattggtgttattttaaacaactcttcccctgtttaattttagctactgtaatattaaatcgcttccttcggtattactttggtatttaataaagacataggtgcatcttggaatcctgaaaaacacatgtttgtcacttcttctgtgtgtttgtgggtagtctctgctttctcttcatgtgtcaagttcataccatcgcaggttgcctgccaagctcttgtttttgaaaatagcaggcacacattgattgctttatacctgggttcaggatctttgtatgtagatagactttttttttagaatgagaattcgaatacagaaaaggataggtgtccatttggcattcagtgctttttcactagggcccagcattagcataagagaaggcctgggggtgcgtagatgctcagtcacattcaccacactcatgtgagctcagcgttaacagagtagcatcaccaggaaactagatatactcatgatatctcatgatagtgcgtgttctgtccaagcgctgggaacaaaccatgtgtgtctggagttagttgttccttggggctcacatttggagaaacacttatgattgacaattggttatacttactataacatcttaaataaattatcccaatgtagccacaatctaaaagtttatttgaaagggcagggggagagttgtacagtgtacatttgacacctgcttttgctgtggcttgtggtgacttctgtcctgatatgatctgtatacagtgtgatcacttttaaaaaagacctctccctactggtaggcaggaaaccgtgtcttgtgttcactgccaagaaagtccccaggcacatgacaacacatgtgtacactgcatatcagagctgcagggtgtggttggaggagacacggacggctgagccactgaggcggctctgccagcagcagcctgtggttatgtaactcctgcagtgtctggcgctgtgcttcactggagacaagtcacgtgctgtgcaatgccattgcctgaaattcagttgctctgaaggatccgtgagtctgcgtgagagaagctttggccgctctgtactagaaagcagatgttgatcggctgcacataactgatgagtgtgcacactaattccagcaaggacatttgctgtctgtctgtctgtatctcattatgctcctgaagagagaaaattaagtattatgtaatacggacaaataatgaagtggagggaagcaactcagtcctcctcactagaaaaacttgtcccacatcacttaaaaatatttttatgatgattcagcaattaatgcaacaacaacaacaactattcctactactactacaaaagtaacatactggacattatttttgggaatttgtgtaggtagcaaccagtattttcccccaatgcgtggtctatgaaggaaaaaggaaatttgcaaattttaaggaacattagtgagaaaaaattaaattatgagttcaagtggacttttctttttaaaagatttttattttatctttgtttgtgtatgtgcatctgcatatgcaggtatccacatgggccgtggagggtgccagacccttggggcctttgtccttgtggggccatctttccggctcttcagataacctagaaggttatctgaagttagaaactttgggcagattttactttctttgtgagagttgtggaattgggaccagtcagaaattcacccttattatatggctgagacttcagattgcatctctcagaaggagatctggagtctgcaggaaggcagcggtcggtcggtgtagggagagaggctgagggttcatttatcttccctggggcctcacagagaacccagaatacagccaacttgggctcagctctcctgaccgcctctggcttcctgcctgcaggatttcagcagtcagaccgatgctaatggctgtgagtagaaatcaaaggccctgaagcccagactcagtccactctgctgtgtcaacagggattagctgttcagttctgtgattttgggtaggttcctcttaaactgtaacaaaaccaatgttgttcatttttttccctcttgcaaaaggtctttttatttttctcttattcgttaaaacctccggatgggagtttgttgaaatccccatttttattccaaccttatcgtacatatgtggattctgcgtgttgttttctaacacactcaaaatgagattataacaatcagctctttcatagatgatctgacttaggcgggacattcgacacacgtgtgtgatttactttcctgtcagcagaatgcatgtttgtaggaggcatgatcgttccactggaccaaagggtagcagggcagggttaggctgctagtggtgatgggatatgggtttcaaacagaccattgagtgtttcacatgtctgtgcaagtggtccacaccaacagtgtgcgagcggttcacacccacggctgcaatttagggcaatgctgattaattatccttgggatgcgggtcccaggaggtctgcttttgatttaatttatctaatattcatgtgcatgtgtctggtgcacatgtgtgtatatgcatgtttgcatgtgtgtggtggactcaggcttgcatgggtgcatgcggaggctggaggttgatatcaggaatcatcccagctgctctttcataccagacacaggtttctcagccagacccggagctctcccgaaaaggctagtgtctctcagcttgtcctgggggtcccctctgccttctgaggttgtagttacagctcacctgccacacttgtcttcccgaaagagtctaggaatccaaactccagcccttacacttgcatagagcacacactagctgcctagacaactccccagccccagcgatgctccctaggtggctgtgatgtgagactcatgtctacttcctgtctaatattctcaccttcagggacagcatctccacacctctatttatgctgtgcttctgatgtggatggatatgtttggccctcctgtgggttctacagagtgaaaacatttaaaagaaaaattgaaccaaatagtacttttttttattattttttattccataaagaatgtagaatagggattggagagatgggtcactggttaagagtacttgtttttgcagaggactgtggtttagttcccagcacccacatggaggctcacaactgcctttaactctaattccaggggatccaactctttttctgacttctgcatgttcctgtatacacatgtgtgctcacatacacgcatacacacacacacacacacacacacacacaataataactcagagacaatttcaagtttaccagtgaatatatgtacgttatatgcaaagaccatgctgttaggcctccaatgcaggtatgcacacacacacacacatatacagcatgagtgtgcgtgtgtgtgcacatgtgcttatgccgctcatcttatatatttaaccaaactacacataacttatccttgttgtttcttggcaaaagcatagtagaaaatatctctagtcaagacaatcataaactattctgcggctaacacagtgctggtgttctttaatagctgaatggcatgtgctataaaaaggctagctagcctccaggtctgcaatcgagactctcagtataactttgttaatgagctggtgatggaagggcagcttgttatcctcagctactgtggttttcctcttacatctttacgcagcaataaaggagctggctgtcctgcatccttcaattgagtctggctttttgtttatttcttttcttggctttatttaaatgataatgcagatccaataaatggctttggccaggactacctaagtctccttctttcttttttctttcctttttttaaaaattaaaattggttattgtatttatttacatttcaaatgttttctccctccccaatttcccctctgcacccccccatccttcctcttcccccttcccttgcctctatgagggtgctcctccacccacttacccactcctgcctcactgctttagcgttcccctacactgggggcatcaagccttcacaggaccacgggcctcctctcccattgatgccagataaggtcatcctctgctacatatgcagctggagccatgggtccctccatttgtactctttggttgatggttaattccctgggagctctaggtgtttggttggttgatattgctgttcttcctatgaggttgcaatactcttcagcttcttcagttctttcctgattcttccattggggtcactgggcttagtcagatggttgactgcaagcatccgcatctgtattgggcagatgctggcagagcctctcagggggcagttataccaggcttctgtcagcaagcacttcttggcatcagcaatagtgttggggtttggtgtctgcagatgggatggatccaaaggtggggcagtctctggatagcctttccttatattcaccatcccccatactttgttggcaaatgattatcttgttttgcttccaatatttatattagaggcggctattgagaaagcaaaattaaatctgtgtttcatgactccccagcatcatgaattaaactttgtgagtattgcagagggatctgcatacaaggaatgagctttaaaatggtcgtagttaataccagggcctatggagttactttgcacaaatgtactttttcctgagagtgtgcccacaatggtgcccctagcacacgacaacaaagggtttgagtggcagccactaaggtatatatatatatatatatatatatatatatatatatatatatatatatatataaatttcaactttggtatttgtaccacataataaataaagagcaaaccttagggtcacaagtcccttctggtcagtgccagcaccgggtcacctcgggcgcggagttggcagacacccctaaagtccctagaggactctccacacgatcttaggacctctggtgagtggaacacaacttctgtttcaatccaatcgtgcgggacctgagacagcattagggaagcagaaaactggcctgactagggtcacaagtcccttccggttggctagagtatctagtcaccttgtgtgtggagttggcagcacccccacggtccctagaagactctccacgtgatcttaggaccactgaccagacagccccacgctcctcaaaggagacaccattttcaaatactgtaacctgcccaggatctttgacaacagaatcccaggataaaaggagcttggtcacaccagtatttcagggtctcagaggaacttgactgccaagaactctgacacacccagaatctcaggttcacaggagcccacaagcaaaggatcacagagaaagctggactctgaggagtcctgaatcaactgggattataggaaggacaggctccaatcagatatattgaggacagcaaatacttgacataatcagatggcaggaggcaagcataagaacagaagcaacagaaaccaaggttacttggcatcatcagaaccaaactctctcaccataacaagtcctggatacaccatcacaccagaaaagcaagacatggatctaaagtcacttcttatgatgatgatggaggactttaagaaggaaatacaggaaaacacaggtaaacagctagaagcctttaaagaggaaacacaaaaatgccttagagagttacagaaaaacaataccaaacaggagatggaattgaacaaaaccatccaggatctaaaaagggaaatagaaacaataaagaaaacccaaagggagacaactctggagatagaaaccctaggaaagaaatcaggaaccatagattcaagcatcagcaacagaatacaagagatggaagagagaatctcagctgcagaagattccatagggaacatggacacaacaataaaagaaaatgaaaaatgcaaaaagatcctaactcaaaacatccaggaaatccaggacacaatgagaagaccaaacctacggataataggagtagatgagaatgaagatttttcaacttaaagggccagaaaatatcttcaacaaaattatagaagaaaactttccatacctaaagaaagagatacccatgaacatacaagaagcctacagaactccaaatagactggatcagaaaagaaattcctcccgacacataataatcagaacaacaaatgcactaagtaaagacaaaatattaaaagcagcaagggaaaaaggtcaagtaacatataaaggcaggcctattagaattactccagacttctcaccagagactatgaaagtcagaagatcctggacagatgttatacagacactaagagaacacaaatgccagcccaggctattatacccagccaaactctgaattaccatagatggagaaaccaaagtattccatgacaaacccaaattcacacaatatatttctatgaatccagcccttcaaaggataataacaggaaaaacaaaaaacaaacaaacaaaaaaaaaaaacaatacaaggacggaaactacggcctagaaaaagcaagaaagtaatccttcaacaaacccaaaagaagacagccacaagaacagaatgccaactctaacaacaaaaataataggaagcaacaattacttttccttaatatctcttaatatcaatggactcaattccccaataaaaagacatagactaacagactggctacacaaacaggacccaacattttgctacttacagggaacccatctcagggaaaaagacagacactacctcagagtgaaaggctggaaaacaattttccaagcaaatggtctgaagaaacaagctggagtagccattctaatatcgaataaaatcgacttccaacccaaagttatcaaaaaagacaaggagaggtacttcatactcatcaaaggtaaaaatcttccaagaggaactctcaattctgaatatctatgctccaaatgcaagggcagccacattcattaaagaaactttagtaaagctcaaagcacacattgtacctcacacaacaatagtgggagagttcaacaccccactttaatcaatggacagatcgtggaaacagaaactaaacagggacacagtgaaactaacagaagttatgaaacaaatggatttaacagatatctacagaatattttatcttaaaacaaaaggatataccttcttctcagtaccacatggtaccttctccaaaattgaccatatagttagtcacaaaacaggcgtcaacatatacaaaaatattgaaatattcccatgcatcctatcagatcaccatggactaaggctgatcttcaataacaacataaataatagaaagccaacattcacgtggaaactgaacaacactctcctcaatgataccttggtaaagaaaggaatgaagaaattaaagactttttagagtttaatgaaaatgaagccacaacatacccaaacttatgggacacaatgaaagcatttctaagaggaaaactcatagctctgagtgcctccaaaaagactagagcgcacacactagcagcttgacaatacacctaaaagctctagaacaaaaggaagcaaattcacccaagagcagtagacagcaggaaataatgaaactcaggggcgaaatcaaccaagtggaaacaagaactattcaaaggatcaaccaaacgaggagctggttctttgagaaaatcaacaagatagataaacccttagcctgactctctagagggtacagggacagcatcctaattaacaaaatcagaaatgaaaagggagacataacaacagatcctgaagaaatccaaaacgacatcagatccttttacaaaaggctatactcaacaaaactggaaaacctggatgaaatgaacaaatttctagacagataccaggtaccaaagttagatcaggatcagattaatgacctaaacagtcctgtatcccataaacaaatagaagcagtcgttaatggtctcccaaccaaaaaaagcccaggaccagatgggtttagtgcagagttcaatcagaccttcaaagaaatctaattccagttcttctcaaactattccacaaaatagaaacagaagttactctacccaatttattctatgaagccacaattactctgatacctaaaccacagaaagacacaaaaatagagaacttcagaccaatttccctcatgaatatcaatgcaaaaatattcaataaaattctcgctaaccgaatccaagagcacatcaaaacaatcatccatcctgaccaagtaggtttcatcccagggatgcagggatggtttaatatatggaaatccatcaacgtaatccactatataaacaaactcaaagacaaaaaccacatgataatctcgttagatgctgataaagaatttgacaaaatccaacacccattcatgataaaagtcttggaaagatcaggaattcaaggcccatacctaaacatgatagaagcaatctacagcaaaccagtagcaacatcaaagtaaatggtgagaagctggaagcaatcccactaaaatcagggactagacaaggctgctcactttctccgtacctattcaatataatacttgaagtcctagccagagcaattcaaccacaaaaggagatcaaggggatacaaattggaaaggaagaagtcaaaatagcactttttgcagatggtatgatagtatatataagtgaccctaaaaattccaccagagaactcctaaacctgataaacatcttcagtgaagtagctggatataaaattaactcaaacaagtcaatggcctttctctacaaaaaggataaacaggctgagaaagaaattagggaaacaacacccttcacaatagccacaaataatataaaataccttggtgtgactctaaagaagtgaaagatctctatgacaagaacttcaagtctctgaagaaagaaatcaaagatcccagaagatggaaagatctcccatgctcatggattggcaggatcaatatagtaaaaatggctatcttgctgagagcaatctacagatttaatgcaatccccaacaaagttccaactcaattcttcaatgaattagaaagggcaatttgcaaattcgtctggaataacaaaaaacctaggatagcaaaaactcttctaaatgataaaagaacctctggtggaatcactgtgtctgacctaaagctgtactacagagcaattgtgataaatactgcatggtactggtatagcaacagacaagtagaccaatggaacagaattgaagacccagagatgaacccacacacctatggtcacttgatctttgacaagggagcacaaaccatccagtggaaaaaagacagcattttcaacaaatggtgctggcacaactggcggttatcatgtagaagaatgcgaattgatccattcctatctccttgtactgaggtcaaatctaagtggattaaggaactccacataaaaccagagacactgaaacttatagaggagaaagtagggaaaagcctcgaagatatgggtacaggggaaaaattcctgaatagaagagcaatggcttgtgctgtaaaatcgaaaatcgacaaatgggacctcataaaattgcaaagcttctgcaaggcaaaaaacactgtcaataagacaaaaaggccaccaacagattgggaaaggatctttaccaatactaaatcatataggggactaatatccaatatatatataaagaactcaagaaggtggactccagaaaatcaaataaccccattaaaaaatggggctcagagctaaacaaagaattctcacctgaggaataccgaatggctgagaagcacctgaaaaaatgttcagcatccctaatcatcagggaaatgcaaatcaaaacaaccctgagatttcacctcacaccagtcagaatagctaagatcaaaaattcaggtgacagcagatgctggcgaggatgtggagaaagaggaacactcctccatttttggtgggattacaagcttgtacaaccactctgaaaatcagtctggctgttcctcagaaaattggatatagtactaccagagaatcccacaatacctctcctgggcatatatccagaagatgtttcaacaggtaagaaggacacatgctccactatgttcatagcagccttatttataatagccagaagctggaaagaacccagatgcccctcaacggaggaatggatacagaaaatgtggtacatttacacaatggagtactactcagctattaaaaagaatgcatttatgaaatttctaggcaaatggatggacctggagggtatcattctgagtgcaaactttatatgcctcagtacaggggaacaccagggccaagaagtgggagtgggtgggtagtggagtggggagggggttatgggggacttttgggatagcatttgaaatgtcaatgaagaaaatacctaactaaaaaaagagcaaatcttaattattattaatattgtattaattatcccactggatttgggtagtgctgctcatatgctgatggatgtgagatgatacatggaaaacctagtggctgccattcccaaaagaaaagtgactctcccttccccagaagccatcatcttgggggtggagcctttgtagcctctctctcacccctgatagtattgctgactgtcttgatcatgcgcaggtgaccatggctgcaatacaaggctgtgtcatgtccagaacccctcactgcctctggctctaacgttcttcccagttccaatgtttcctgggcctgaggttcaatgactgaaggaggtgtcctgtgcccacccagcaatcttatgacttctacacaaatagtggcagagggcttcacagtctgttgaaccttgatactgggcgagtcaacttttcttgcaaatggactaaatattaactttgcatagatgttggagaagcacattccatcccttgaatgactgtcagcaatgaaccaaatgcagtcagcgttgggaagcttgcttgggtggggttacacacctataatctcagcgctcaggaggtagaggccagagggtcagaagttcaaggtcctctttgtccacataagtagtttgacactggctccagatacagaagagtctctcaaaacaaaaccaaaccaagaagacttggaggaaagccccatggtagcctatgtaccccagatcctcctggcaagtgcagggacaggtctttctgagggacagcatagaccacaacctaccgaaggcatcactttggtccagagtcacccttggcctagaaggacatgtggctgggatggcactgaacaggttcagaagcagaaagtccacagcggagccaagccttgcttccactccttctgagcttgttctgctgtgcaaaagctgtcgctagtgattctcaggaccccaggatgtccctctgaggcctttacgtgaactgtctcatttaaagatcactttaattgtttaaaatatgtacttttatttggtaatatatcacaaagtacaaaaatacaatgaggatctacctctgttgcccttcttgccnnnnnnnnnnnnnnnnnnnnnnnnnnnnnnnnnnnnnnnnnnnnnnnnnncccctcccccctcctccctatcttctcccacccccccttaccccttccctctgtccaccctgtcagtggtgttagtatcttaggcaccctttctagtgggcacagatacacacaagccaacactaataaagacccatgtttctgatacaatgttgcatcacactgaacaaaggagttttattctgtttacctgacagcctaccctcatgatctcccccgtagcttgtcttttaaatctcgtcaccttatggggtttctcactgtctttattgtctttggtatttacatgataaacgggatttatctacaaatactcatagtttcttttttaaaaagtactttagatcatttctctctgctaactgttttgtactatacacctagcacatgtgagctatttatggcgatagcaaacatctttgcttcatctcagcttctttgaaattgtctaatatttctcactaagcataaggcaggcttttagaacatgataagcatattttgtctcattaaagaatcatctctagcttctctctcactctctctttctctctctctctctctctccctccccctctctccttctctcctgtcttatatatattgcatgtatatgttgtaatcagaaatcagattaaatctgtctatatggctatagagcatcattgagatcatgtggtttttctttttacagctatttcatgcagtgtgttgccttgaactccatgtttggttaatatgttcacaatacttctgatattgagccatctttgcatttctgggacaaactacatgtggtgtggaattcagtggcgcatacgttgcgtctgtacacacagggatgtctgtaaatatccagatatttttgttcttgatcactgccagaattttgtttcagtttttcatattttatttcatgagattaatgtgaattattttctaattttcttctgatctgaaccattcaaatagctggggtgagctctttgtaattttgctggacctttcctgtgaattctctggcttggagttctgaggtcctccctagacagttacttctgtagaaatcctgctcggccattttctgtcttacttggatttgattttgacagattatgctcttcttcaaaactctcacattttattctggtatgttgagaattgttctccaattctttatctttgtccttttcataacattttatctagagtcttaaccttttctaaaactagatttgtctctccctgctttcgaaggacgagtttctggaacttctcatagcccgagtttcctgccttccagcaccgcacccgcttctcctcggaatcacgtggttaactggattttagctgcttttcactctgagtgtggcatttaggtttctgctgaagccccagtgcacccctttagctccctcctccctttgttggggcttccagttttcttgcagggagcttctgaagccacagttaggtcttttcgctcccctcccccttttcttcttccccctttcatgttttcattcttttctagctcctgagattcagtttgcttttactctttaggtaagaagagatttcttgtcttcagcttaaaaacccactttcgcagttgtctgtcagttgtcagtgctctgtggtgtgtctccacgtcctcctctgctttggaaggctgtgtgctatgtctgtcaagctgatctgtctgtctgtctgtctgtctgtcattgcctttgacttccttccccagatcccatgttcatcgttgtctttttcttttctgtccacatttgactctgacggaatggcttattttactctgcttttctgtatccctcagccttctgtaactttctaacttatttatattgctaattatttattaatttatggagagattaatacttattttaattaaattaattaataattaaggaattattattattttaatttcacactatttttatcatctcttcctcaattccgctttttgtgttttttcttcacttttgttctgcatagtactattcctttagaagtggtggtggcatcaattaaaaaagatgtatttatttttattttatgtttatgggtgctttgcctgcatgtcggtctgtgtgctgtgtgcatgcaatgcccatggaggccagaagagggcatcagattcccagttacagatgtggtgagctaccatgtgggtgctgggacccaaactctagtgttctagaagataagacagtgctcaaccactgggccgtctctccacctccagtaatcatagttttaaccataaaagcagagagaacttaattctaattattcattaagccttattcttttctatgtattgtcaataaactaagtttgaaggagttgtgactataggttgcctcaaaattagttttcttgttaaaacatagttctcagcagcagagagaaacagataggatggaacctaagctccaggtggtaggttgcacacagtaggtgcactgcccacaatggccactcctgaagctgacagttcagctgataaacaagtcacccaagatgaccacccagggtactgttgtatccaaacagcccaggaagaagcacaggccaggcaacaggcaggcaggcgaaaaccacaatttgctttccaataattatcattgcttagagccaggctgggacttgattgttccagaacggaaaaacatctttttgtatggatttctttggagattagaactacaactgcagtaaatatttctgtaaatcgttaccgggacttcactataggaagtgactgtgagtactttgttcttcatgtacgagactcagttgacacaaacctgtacccaaaccattgacccgtccttccctttaccctctgtccctccttctctcctctgtcttttttttttttttttttttttttttttttttttaatctctagcttcttggaatcgttttccatggaaactgacaacactaagaacccaactgaagtttacttgctagctggtaaaataacaataaaaagaggggtgaggcctccgaggaggagtcttggcccccagctcctccacctctttccctgtgccttctgaggttgctctgtggttctgcagggagcgagatgcagccctgccatggtcaaccccaagacagtgctcctttcttcaggtcacacagatgtgattgtggaggccctacctggctgggcagaagaccggaaatggagtctggttctttctgcccctttgtaagggagaggatttggccaatgattggctagtccttgccttggggcctctcctagcagagaagagaagctgagagtcattttctgttctgttgagaagagcagtgtaagagcaagaaggtctggaggttctgtgagtctttgcaatacccacattgccctggaggggggggcccatctccccagagcttagaccagcagaacctttgagttgcaagctggaagagacccttataacctactaagtctgtgtttgtaggagtgtctgcctggagtaaggattttgtgaggcagaggtaatcaggggcagttctcaatgtgagtgccacagacccgttccatcagaggcacgagaactggctgactcccagcgcaatgtttgagaggactgaggaacaagaagctgagctctgacaatgatgttgtgaatcgtgcaaactgaatcccttagaagttcttggacgtaggaaagttgaacgagacatgtatacacttatgcttacacaaaaacgactgaatttatactcagtcccaaagatgcaccagcaaggacttaattacactctcatagtttgctgaggaaatagtcacagactgagtattttggagacagactgatcactcccggggagaatttcagagtgcagtaatgctgggtagcacagggtggggataaggctaggaaaggcatccagaagacacggtttccttccaggacaatgctgtctaagctgaggcttaaaggctgataaggaacagctgctactatgggtgtggccaccccatgatgggtggagttggtggaaacccctcttcttctgagaagctgggcacctaggagcagaaggtctgcaagagaaagaaagggagagacagaagtgaagaccttggagaggatggcaggtcacagtgggaaggctgtcagaatgggcctcagtgtgatgtttgttctgtttggtgtttctctaggccgagtgtgtgtgtgtgtgtgtgtgtgtgtgtgtgtgtgtgtgtatgtgtgtgtctgtgtctctgtgtgtgtgtgtgtctctgtgtgtatctctgtatgtgtatctgtgtgtgtgtgacattttatcaagttcagctcacagcacttcctgtgaacattttccagttacaccccctcagcctgtctttatttcatatgaaatttaaatgactgtattcttgaaacattttctgggaaggatacagtccagggctcaaaagatggctcagtcagtggtgcaagcacaatgactgagttcaggtccccagcacccataccgaatgccaggggtggtggtgtgcatcgagagagcagagacaggacaacccctgggcttgctagccagccaggtctatctggatcagctagccccagattcacaggaaaccttgcctcaaaccaatacagtggagaggtaattgaggaggacacgtactatcaacttctgtcctccatgtgtgtgtgcacatatgtacacatgtactgcgcacataagtgcacgcatgtgcatgcacacagacacacacacactgaacacaaggcagttggtccttgctactgagcaaattgttggcttcccgtgagggtccaataagaagatacctgtgatgctgttgtggtacacagcccaatgttaatttaatttgattaaaccattgagtcttttggcttcccttgctggtctttccacaatgcctggacgatggggtacaagaatccgctggcttctcatgtgtgcacaccatcctagtggctctaagacgcatctgccagaggatgtggggacaaggcaaaggctgatgggacatggcaaaggctgatgggacatggcaaaggctgatgggacatggcaaaggctgatggcacagctcttcagttctttctctaaatatttttgctactgttatagttgttgttatagggtcttgctgcgtagctcaggctggtcttgaacacatgatatggcctaagctgtctctagcgggatgaaagatactgtatcatcatgcagtcttctaagctctttgggatgtgaatgggcaggcgggtggtcaggcctccccagcacagaggtgtggcgagcgtctccattcctatggaagctgcacatgttcttctcatgctttgtttaattccgagactcttggcaaagggcgctgcggcttgcacaccacatctggaagacatgtagtcctatttcatgggaagggatgagcggatagtgggtgggggaacctgggtgtaattacagtgtgcgtttattgggaaagactagcatattagcatgcagtgggaggattaattaatctcagctggaataattcactgtcgttggtttcaataaaagctgaatatctttaagcccttgaggtttgcattaaacttatgctgtaagacatgtttcaaatgtctctccctctaacatgaatcctcaagggatgtacctgacccaaggtcagccttctctttcctcccacaaaccttatctggttatcaacaaaatgaacttaggcatcatcaaggagatgagaattcttgtgtgtgtgtgtgtgtgtgtgtgtgtgtgtgtttacacttaaaaggaaatattttgcaaagcctaatttccacaaagttgtgtagaattttgagtctctcctctggttgtgtgaggtttccatggaaactgtctagcctgtattcagagccatggactgtcttcccacacaggtcaggatgtgagcagtgccagagcctagctcagtttttttttttttttttttttttttgtgctttaaacattaggcagatttaacaagggaccggttcctaattggcacatgcaatttcatatttaattagcagtgtaagtcttactacattttagtagcagatgtgatgcccaggctgtgttctactctgatgcagatgttgcccagatgtgccccagagtgggacttggtctcaaatcacagcttagcaaaaaatatgggcagaagcaacattaatttccttaagtcaaaaaaaaaaaaaataaaagcagttctccttaacgaagcgaatggatttattttctatttttataactactttattgagatactcatatcataaatttttcccactagaatgtactgttcagtggttagttttcttgctctccctcccaaggaatctgccacacccagcagcagtgacagccctgtctctgcatccccagcacttcgaagccgtttctctactgtgtgtgaatctttgtgaattctcctattctggacattttctgtaagttcctctctgtcttcccattgtgactgtgctgttctcacagcgtcctcctgcggaggcttggcctaagtactctgtgcttttatattgagaggtagcatcccataatactgttcacactccacaccactcaccctcatcactgaagccatttgggatcctgtctgctctctgcctttaggagcaatgctgccatgaacattcccaaccattatgtacctcaggctggcctcaaactcatgacctctctgcctcagtcctctggaacacagggccaatagatgagacccgtgtctggctctgtgcgggtgtttttgtttctcttggttatatgctaaggagtgagatctctgggttcaaacgtaactccatgtttaatgattgggaaccgtgatgtagtttttcagcatagcagctcctgtcgtgcctggcctgtaagttatgtgggtcatgatttttccctgtccttgagtgagtgcagcactgtggccttttaaatcttaaccatcctagtggctgtaaagtgccatgaaggacaggttttttgaagaacagaagccaatatgtagttcacaaatgagttagatgctttgtattcatttttccccccattactcttgagggttgaggtaaacacacctcttgcatctacccacgatgttatttccttttctgatcttaacacaaacacaattcaggcaaaatgacataaaaaactttggatgctgtgagttggagcatcaggtagacaggtatgattagaaaggaaaatatctaaaaactgtttgagtaaaagatcaaatcttcaggttccaggtataatttcatctcacttcacattcgtcaaaagggccgcagaatcacaccacccagtgtgtgaagcacagtgatgctgggccccagaccttcaggctggggtgtagtgcatcggcagagtgcttgcctagcatgcgtgaggcgctgggttcattcccagcaaatgacacagatgtcttcattcaaaagaatgtatttcaaattctagtatcactaacaggcaaagcaggctgccagagtctctgacattcctttaaagaaacttacaattcataaatgttaaaatgttgaggacaaagtgtgaaagtcggaagatatagccgtgcggccatccatgcgcacctatgcagtcttactgcatcattgatttcataaacacccttcaggcacacatgcatactcagccaggagtggaaacatctgtgtgtgcctatgttacacacagcctacttactctagatagaagacaaggggagaggtacgtgttgactttttccttcctattctggaagttttagttcagtcttaacagactgacattcagggaaatgatctatcaataggcccgttcacctccaatctcatttattttgtgttttcttcttagcctgagaaagttttcccatgtttaacgcagaagctgatcacacaggtctctggtgatcacatgtctgactccaaggcaaggatcatagcgctaacaattgctgtctcttatgagtgaattggagtaagattttaccaaagaattcgtacccacaatacgcagattgagattggaggattttaagtttgaggccattctaggctacatagcaagattctgacttaaagataaaagcaaatgaaaattatcaaaattaaaccaatatgatttatacaataataaaagcactataattgtataataagggacatgaaagaaatgcaatcgtttttattttgagactacaatgagatgacagattgtgtttaattttcttttaaaaagtagtcactcatcgaaacacagtgtgttaagagaatagtagcttttgatttcattaagccaaaagattcacatgatacttggttattcgggaagtcagaacctgaaggtgggtccatgctttttagcaaggcaaaatcctatggtggtcaataccacaccatgggaggatcaggctgggtgagtgtgcaagggatgggatgggaggggaggggaagggttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgcaggggatggtagggtagggtgagtgtgcaggggatgggaggggagggtgagtgtgcaggagaggatcaggcagggtgagtgtgcaggggatgggaggggagggtgagtgtgcaggagaggatcaggcagggtgagtgtgcaggggatgggaggggaggatgagtgtgcaggggaggatcaggctgggtgagtgttcaggggaggagaggatgagtgtgcaggagaggatcaggcagggtgagtgtgcaggggatgggaggggaggatgagtgtgcaggggaggatcaggctgggtgagtgttcaggggaggagaggatgagtgtgcaggagaggatcaggcagggtgagtgtgcaggggatgggaggggaaggtgagtgtgcaggagaggatcaggcagggtgagtgtgcaggggatgggaggggaggatgagtgtgcaggggaggatcaggctgggtgagtgttcaggggaggagaggatgcgtgtgcaggagaggatcaggcagggtgagtgtgcaggggaggatcaggctgggtgagtgttcaggggaggagagggtgagtgtgcaggagaggatcaggcagggtgagtgtgcaggggatgggaggggaggggagggtgagtgtgcaggggaggatcaggcagggtgagtgtgcaggggatgggaggggaggatgagtgtgtaggggaggatcaggctgggtgagtgttcaggggaggagaggatgagtgtgcaggagaggatcaggcagggtgagtgtgcaggggaggagaggatgagtgtgcaggagaggatcaggcagggtgagtgtgcaggggatgggaggggaggggaggatgagtgtgcaggggaggatcaggcagggtgagtgtgcaggggatgggaggggaggatgagtgtgcaggggaggatcaggctgggtgagtgttcaggggaggagaggatgagtgtgcaggagaggatcaggcagggtgagtgtgcaggggaggagagggtgagtgtgcaggagaggatcaggctgggtgagtgtgcaagggagtatagagtagggtgaggatgcaggggaggatagggtagggtgagtgtgcaggggagaatcaggctgggtgagtgtgcagacacagatatgaaaacttgacacaatactgctcttgttcaccttcccataacaatatgtatatgtgaggagcccacagtttaaactatgctcttgctggccaaggacattccactctccccatcacttccctgaggcaatgcttattttttttcaaccatttaagaaaatattcaggagctgtctgcctagaacttaatatagctaagagcacaatgcccctcacatatacaatccccaatctttaaatagcactggggctttgatattgatatccacagatatccataactggtctcaggacggaagtagaattcttgagactgtgagctagcatgtagctgatcccagatctgagccaattatacaggtctccccagaatcaccgtttctatggtgtgcatgacttcacagctcagctggctctcacaggatggagggactgggttggaccattgtgtgctcattttcaattctcaagaccttcctttgaagttgagctatatagaattttttattttatagaccgcacaactatttctcttctacctgaagatttccaaatttaatccaaatttatttaaatttagtttctgtttcctttgtcagacatctccattgattgacaagtactcaaatgttgccttgctcctgggtgtgaagtacagtttgttcctagtagtagggtgcaatgacatgtttatcattcatgtgtgtatcattgttcatggtctgtggtatatgtgtagtatgtatgtgtaatgtgtatatgatgtggtataggtggtgtgtatgtatgtgatgtgtgatgtatgcctgtggtatatgtgtagtatatatgtgtaatatgcatatgtggtgtgtgatgtgtgtctgtggtatgaatgtagtatgtacatgtaatatgtatgtatgtgtatatattggcatgtgtggagtatgatctatatatgtgttgatatgtgtatatggtggtggtagagttgtgtgtgcacatgtttctccgtgtgtgagtggtggtctgcctgcatgtttctgaatgtgtgatggtgtatatatatgtatgaatgtatgtctgtgggtatgagtgtatgggagtatgttagggcatgtacatgcagtgggtgtggggtgcatggtggagcgttttccactgaattttcttggatagctctcatgaaccctgagatcctctcatagcctggcaatgcattctctcttggctgcacatatagcccatagcctggatctcagggctggtgctccaggaagatccaggaaaccctagagaagaggagggagagtggaggatggggcctctggccctgtatctacagctcttcacgcccagtcccaccagctctcagagtaggaccagtgtgtcagtctgcactcagtaagcttggaactgaagctgggtgctcactgctccaaccacttggggattttaacagcaaggaaatggaatacagtgtgaactttagattctctaaagccagtttgatgggccattggtgtcctaaaaataacacccgcatgagggagggctgacacgtgcagagagggattcttcagaagactatactcaccttgaactagcacaagaaagcaagcacgagaaagcaagcggttatgtcctgtcttatgagaggagctgttctccgcccccacccttcccttttgtataggaaacatgaggtgcatatcaaatatagccatggaggcaggggatcattaggtgatggttccttagcaaatctgtgcttcccacctggcctttcctgatcatagcttagattcagggacagacctttaaagctgctagctatggcttccccttgtccaagaggaaacatctcgacattcagacacttcctggtccttctctgttccttcctctctggacctgctttgtcctctggtgctcctcgggacctgctgtgtatcaattttggacctcactggacacttagctatccctctgtcctgggaattccacatgggtgcgtgcattgctggcattgctcacttttgttagatttctgaggcagcttaaagagacagaaggaagcaagacaacagtccgacctcaacagatagggctgcttgtttcaaagaagtgaggggcagggcctctctcaggggagagggaaggggacattggagtatatgtcagaggtttggggactagggatttaaagggacctgctggggttatgtcaagcctgcactctctcccttccggacttgtttgttcagaccagcccatttgacctttaggaattgtcttgccctggctatcaggaaatgaatggttgagttgggaatgtcagtgatggggaggggctggagtttcaacatggaggcaagaaagtttagcaagtcttggggcaggggttctcaaccttcatactactgtagttcctcatgttgcggtgacccccaattataaaaatatttttattgtgacttcatgtcttagggttttactgctgtgaacagacaccatgaccaaggaaagtcttatagaggacagcatttaattggagctggcttacaggttcagaggttcagttcattatcatcaaggcagggacatggtaacattcaggcaggcatggtacaggaggagctgagagttctacgtcttcatctgaaggctgctagcaggatactggcttccagtcagctaggatgaggatcttaaagcccacacccagagagacacacctactccaaggccacatctactccaacagggccacaccctctaatagtgccactccctgggctgattctgccttaaaaaaaaaatcaaacaaacaggaaaaccccaaaccaaccaaccaaacaaaaagcttacctgcacagcttatatagggtcctctcagctttttacctttttattcagatgaaaattatcactcaatgaataaacaacaacaacaacaacaacaacaacaacaacaaaatagcagcagctgcaaacaggctctcaagcttgctggtgagggctaaccctcatcctgcgctcagatactacaaagcagagcctgagtttaagacctttgacaacgagagtgtttggggttgatgttatgcaggccaaatgcttagggcttttatcctaccccaaagtctacaactacagcgtccttcacgcccctgttagcaaaagctccccagataccccattgctgaggttggggtatttgagaacctggaggggctgctggagtcaccagatagccagcatcatcagacagtttaaacatcgaaatcttaaaaatggaaccagatggattggtgagaattattcttcatgtctcagctttgtgtatttgttttttttttcctggcatatgttgctgttgggaacctctttgctagtcctcgaaacatggtagatgggtaataaatgtccttagaagtgataaaataggaggtgggggaagggattggaagaggattgccttgtgttgtgtgaataagcgtttcagttctagtcttcagttacttgttttcctgattagcttgctttcagatagagtctcactgcgtagcccaggctggcctgtagctgcatgtagctgaggctggcctctcagttgcatcaattcttctgcctctgcctctattttcagaagtactactttggctccatagtgcttttcaaggtgaccagtatgtcgcagtgttggtgtgcatggcccatccctgcgcacacgcaggccgtgattgttagtgagatttgagtttcccatcttacaaagctgagcaaaagtatcagcaaccaggatctctgggaagcctgctgatgtgctgtgatgtgaccttgtcatttacaaagttcatagttgataatgacaacagcagcaatggctgaaaacgtggccacgtgtcacataagtgtctggttttatgatgggcgcatctatgaccatctcgggctacagtttggatggacccgtgatgacacgattcccaattcctccacagagctccccacagtgtggttggttataacaatggacccagtgtaattccactaggatatagttaacacagcaccacacaggagaaccacatctcttctccacgcccaagcatttcagggagcatattcttagtcagacatgtagatgttaggtcaaaaggtcttggaaacactaattagcattaaatgagatggggctgtctggaggcgcatgaagttgctgcttccagatctatccacgatgacgagtagctaatcactaatctctaaggggaaaccctaagttaatctttaccagttgaaggatcagtgtttaatgatgctagcatatggtgttgtttcataaagtcttgattggtttccttccaatgcgaaacacttgtattagttctccagtttaaaggactcgggaatgttcttgtctaccttacagctgttcatatctataaatgcaagccatgcaaggcttctcagggcagaagaaaacctttagctttttctagaatgaatgctcactttcctctgttctgtccatgaaagacaaccgtttctgggttgatcaattcctggtaccttggacttcgaataaaatagcagggtgtggtcagaaatcaaagccctgggccgtcttccggtacaaacatactgtcagcatgacttctccggccacagagatgtctttttatggagatatttgttgaaatttcagaaggtggttgctagttttcttggcttcacagtctgcacatctggaatgtgttcctatgaagatgttggctggaagcagtgtcttgtggcctggaattgcctctgacagagagagggaccacggagcacaacctcattagtgggtcgaccccacctactactacagcaccttctgtgggaggcctgaggacggaagtcactgcggctaagaagacccagcccagaattcatacatctcatccccgtggaattattttcagaatgccattttgttcatttggtcctgttctcaatttctgctgtggcactcacagctcagaaatgatttaacaagcctgactggaatttctgacaggttctataattattctacctgacttaaagtgatttagggacatatcccacactactgacaccatctcatctcagagaggacagaccatgggtgaccctctgctgactgtggcacagcacttgcctctggtttctgggaccggaacttcataaatgacaccagccatctgctagcacctgtggtgtgccaatatgggagtctgccactcttcagtagatacgtttgtcttagctgaaaactagccatctaaccaagatagaatttttttcactttcttggaaataatggagcctatttcccatagtagtgtgagtacatgctttgggccgactttcccatgtttagtcacagtgattagcagggcaaacgttaggatttggaggcagttgatctttcctcccactcttctcagcatcttagacaaaaatttttacttctctggggaagcaagatcaaaaatgacctaggcaaactttaaactctgcatctccatgtctgatgtcaaaatgctcttctgatttccaactcctttcagctttgttgactgcaaacagttctttctcttgggttggttctactccattggcagctttccttggcaagtatcccatatcaccatctctatcatcttggggtcttcaaggcaacccaggcttcaccttcacagcttcacacaatggtctctctaggcctccatgcaggggcatctgtgtcacacatctgctttcagtggctttccttagcatggaaggagattccacaacccctttcttctatccttgagtctaaagccagaatgatgtgaccaaagctgccagcgttctgctgcttgctggggctggaacatgactcttcattcaattacgtcttcatcagctttctagattggatggtttccttcactgcctacgcttggctgtcctgaaattcactctgtagctcgggctggccttaaaatcagagattttcctgcctatgccttctgagtgctggggttaaaggcttttctttaattgcttttccaagttggaagcagagctgggtggggtcctgccctgaggtcaccattccatttatccactttttctttagtctgtttatcttcttgagccacaacttagctccattccacttcctggtgtccccattctcctcaaactgtacattctgtatttctccttgctcaacctgcttctcttcattatagatttccatacgcataaacactaataaccatatgacagagtcaatactaggcttttaaaaaatttccttttccagtgcaaccaatcccaaactcttcaacacagcctcaaacaggctttctggacaagggcaaaaatcagccacagtttttgtccaaatatcacaagaaccacctctaggtcacatattgatattcttattgcctgaaattttttgagccaggctcccatggttcaaatcacacttaggactattgtactccatgttcccactaggatggcccacaacatcctactttaagcattcaactgtgtttctaatccaaagttccagagtccacattcctccaaacaaaagtgtggtcaggcctattacagcaatatcccactcctggtacttagtttcggggttttattactgtgaagagataccatgaccaaagcggctcttataaagcaaaacatttaaatagagctggtttccagcttcagaggttcagtccattatcatcatggtggaaagcacagtggtatgcagacagacatagtgctagagaagctgagagttctacatcttgatctgtaggcagcggggagactgtgtgttgtattggcaagccttaagtgtaggagacatcaaagtctgcccccatggtgacacacttcctccaacaaggccacacctactccaaggccacacctcctaatggagccactccttgtgggccaagcattcaaactcatgagtctgtggggaccattcctattcaaaccaccacaggtaatttttaaaaagatttatttgtgtgtgtgtatgtgtgtcttgcactgtgtgtgattgtgtgtgtgtgtcttgcactgtgtgtgattgtgtgtgtgtgtcttgcatagccttctgggattggcttcccttgcgtgaagtcttccgtagcacctcactataaactggtggatggtgtgttgttggttacttttctcatcactttgacaaaacactgggcaaaaggtgctgaaggatcggagggtttatttctctcactctcagcctgtcatggcagggcagctgtggtattccagtgtgaggcatcccgttacagacaagaagcaaagagagatgaatgcgcattttcctgtttattaattctgagactgcaatccataagatagtgccactcccatggggagggggccatgtcttcctttcccagctaaactttctggagttaaactcttcagggtactccctgaggtgcgttgccaaggtgattctaaatcccatccagttgacagccaggaagcgtctgccttcttcatgtaggatggtgcctgaaggagtaggcttcccaggagcatggagtctgcagagggaaggcaggccttgtccttaagcaaacaggaaaatgtagaaaacatatcttcatttggtttaaaaatagcgtcagaggaacctagaggcttccatggaaaaggtaggattcagaagccattgtcaacgtggttgaagctgagtccccagcaagcagccagggtgattgaaatgttattatgatgggttgatatggaagggaaaacaggtccaagagagaagggatgtttctgatttctgtgccattgcaacttaagagagagagggaaggagtctaacaggatgcttaggtatgcaaggtggggctggaggaggcatggtgggctgccaggcccgagtgtgcaaccaaggaagagcagtagatgggaagaggaaagcttgggggggggggcgggggcgggcaggagcccagcacatgaccccaggcaaaccgcttaggaactggagacagaataactgaagaacacagagtgagcgagagacagaatggctggagcactgtgtcacggctccagagagggtatgtgagatcaggagccaggcacatggaaagcacagagaagggtgtgggcacccggacatgcctgggtttgaggtcagaggactgaaccccttgcttgtcacctgtgagctgtgtgtctgcagtcagtcattcaagccagggttccctccctggaatctgggatacctccacaggagcagggctaatgcaagtaaaagttacatataccttttaaagtaatcaatctctagttagcacagaaaataatgggtctcatgtgacatcttgtatgtatttatattatactttgttcatactcccacacagtatgccccttcctactgtctcctctccctcccaacatagcctcatcttcatgttacacatgcacacatgcatgtatatgtatgatgtatgcatatattttgattctagactccatatatgagagaaacatggtattttatttttctcccctccttcacatccccaccccccatctcttcctcctcctagtagtaaagtgtggaaggcaagatctttaaaatatctatttctaaagaaatatgctgttctttattccttctcttctcaattaagtccagagtctcagagtctgaatgtaattcactatattttacctggtttaattgtttgggtcgcacctgtgtgcccagatctcacttctttgtggttagtctctctaaggctgcattcaactcctagggtgtctgttatcttctctaggcactactgatattctgctcaatactaggacgacagcttttcccattgagcaaacttacatttatcacattggtttagtgtctctgtctgtgtgtctctctctgtgtgtgtctcacatggcatagcgtgtgactaagagctggttcacttctaccatgtacgtcccacagatggaattcagtggtcaagcctggcttcaagtgcttttactcctgacacagctcaatggcctctaaatatatgtaaaaatatttaactagtttacgatattcacattgcatgtgcatgtcacatgtgcatgtcacagcacacatgtggaattcagaagacaccctgtagaagtcaggtctttcttccaccaagtgcatccagggattgaagtcaggtgttcaggcttggtggtaagctcctctacccaccgagccagctccacggctctccagtcagcccatatttaatgtgtacagcttgatgggtttggggataagggaacatctgcacagtggactctaggaacctcatcatccctcacactacttcacttattataaaagaatttattgttgttatgggggtgcatttataattacctcagaagatactaatttggtataaaatgttctcatgtattttacatcagatattgatgcatttagcatgttgacactctctgcttttatttataaaaattacgacgggtctcctttgcctctagggtagcacattacggcgaatcctcctgaatcggtacttcaagggtgatcatagcattagtgtgaacggacctctgtcaggagcctatgccaagacagcacaagtgggaggtgaggtctctcgttttccccgtttcagggttctatggcatgtcttcctgacagtgctacatgtctgtcttccttaagtgcaacgtggaaaatattcacttaaaacaccagtgaaaacctttgtgtggtttggggttcacgaatccacaaatctgaacaatatagtggattggcagtgaaacagtgaaaacactgtttctcagttcaaacattacagacaaaaggctagtttcctttcatagggtattttataaagatttatttatttttattttatgcatatgtgttagtgcctgcatgcatgtctgtacaccacgtgtgttttgtctccttagaggtcagaagagggcattgtatccctgggaactgcagttacagagggttgtgagccactgtgtgggagctgggaagcaaacccaggtcctctgcaggagtagccagtgttcttaactgctgagccatctttgctgctctttctgggctacattaagagaaatatttagtaacgttgagttatctacctgttggacatctctttaagatttccatgcttaatgacttacatttgtaagtgaactttcctgtcatattttaagagcttgaaaacactgtttgctattaaaagcaatgtctgtgataaaggttgatatttcttgtttgtttttccctgaccataggaagcttctctggacaggattcagataagaagggcatttcaatgtccgatatccagtgtttgctggacaaagaaggagcatccgaacttgtcatcgatgtcattgtgaacaccaaaaacgacaggatcttttccgaaggaattttgcttggcattgccttgctggaaggaggaaacacacagacccaggtacttttctgtcaccccaggtgttccggttgtcactgctacttttcagaagatgagttttgttttttgagaatttcatacaatgtattttgttaacatttaccaccctccttaactcttcgcacttctaccccacatccccactcttcccccaacttcctgcctccctcaccccaatcctaataaactctggacaccaattcatgctacccagatactcctgggtgcagagccatctgctggaccatggttaacttaccaagagtaggttaatccccttaaagaaaactgattctccttgccccagaccccagaacacatctgtagagccccagccagggctgagggctgcaagtcccttcccactccacgcagggacattggctggcttgattgcctgccacaacttctgcgagctccagtgctctggtcctgttgtgtccagatgatgtgggttttttggtggtcctctctgacctctgactctctgtctttcctgtttcttcctggcttgttgaagaaaccaagggaaagttctctcagcttctccttgtgggcagcccctcccccagcaacaagcaaacagtccccctcctcacctccccatcacatttctgtgagaacttatttgatgcacccctgaaatgacagggcttcctgcttcctttagacagagcatccttggaagctcaccatgcactgcggcaagagccagcctgccacggcagtgagcgttgtgctcacatgcacaccaagggtctgaccctgtcctgccagcacacctgtgcctgggagacctggaccctctgtgcccaacagtgtgagctctggagactgttcccagagagcacttctgagcttttttgctcactgctcagtagcctaaccttcctacattctcctaggccagtggaggcaatgcatagctgcatctggctagaaattcccaaccccattcaccccccccccactctgtctccccactgggcagacagaagcccagtcagatgcagagctggggcattttgccttagcttgtcaccacatatagtcaatagcaggagctttgaagtgtgagatacctgtgtgacctcaggagctttggggacaaaggcctcaggggcagcaaaaagacaccagtatgctctggccttgaactggtgtctctagcagttgtcacatgaatgcactttttagagttcccaggaccacagagggtcagccccggcatcacttcatcctctcatggatgctgggcaagtctcacttttctggatgaagctagccagcgccagggggccataggccacaattttgaatgcctgcacaccattcccaaggtccattccttagtcttattcgccctgtgtttctgtggcactgatcactgggaaagcttttgtccttctggaaccttcattacctggatcctggaactctcctctctctggctccccttccagcctcctgcctcaccagggctcctctccccatgcactgcttctccccaagactgtcactctgtcttctggttgtctgaccaaaacgtaaaagttactctgggctgtaactgatcaccctgactccctgctggccatccctggatggcaaacctgggtgtttttgctcctctgacatctctcatccctaacccttcaatctctgcttctccagccatcctcacagatccctcgaatctctcactgtcccgtgagcacgtttcccagagtctgttctctaacattctctctgttgcctcccatgacatttttaataatatttatgttatacacctgcttcaagactctccctccaggagagccagacccctgctggagactgtgaagttcttcccaatgcaggttcctcttcagcaggttcttcttccctctcaccctgcctggcccctcctttgctctctctctgtagttcccgggatgtcaggctggttgccctgcttctcattggctccgctcagaactgtttccagccccttgccattgggcaggactacctgctagatgcttcatgaccttgctgtggcctggagatcctctggggtgtcacggtcatgtcacggtgcccctccaggtgtggcccagattccatctagtcaatgacaaatccttgaaggtttggagcacatcttcctctctatgctgctggtgtttggaagtctctagtgcacaataactgctcagtggtagatatgctcatgagagattgattggtcttgatgaagccttctcatctagctgagcatgtggctcctgctccctggtgagcctcacagcaacgctgtcgggattggcgccttctctctgtccctttgctttactgtctgccgtacagtgtgtctctccagttaattttcaatgttttttaattgtatgtgtggagtgataccctactttttatttttgtggtcctatatagccatcccaaacacacacacacacacacacacacacacacacacacacacacacacagacatacatacatacatacatacagaaacacatgcacactcacacacacacacacacacacacacacacacacacacacagtgggctggttatacaaacctgtaatccctgctactcaggaggctgacacagaagaccacacattcaagcctgagctacagagcaagctcaaggccactctgatgaacttaatgaaagctggtctctatcatagctcagccgtaagcatgtgtgtaggatttctgaggccatgggttcaatctcttatgcaccatcagaacaaacaaataaaacaaaactcacacagacccattgaagagacagcacaaatctgcatatcacaatcctctcgtggattaacaagacttcatttcctagcttctgctgttttggtttctgatttaggtacatgatcctgtccccagatgtcagctgtgtgctgtggctttaggaagcctagatcagaccagctgaatctgcctctccctttagtgactcagatgtgtccctccctgtgtcgcttccctatgtcactttctgttgctgtgatagatgccatgaccaaagcaactcacagaaggaagagctcatggctcctgagggagagtccattatagtcaggggagaaggcatgatagcaattggatagaacaggaagctgagaggtcacatctccatcctcacacaggaagacaaagcaaactggaggtggggtgagggagcctatagaccctcagagtctcccgacctcatgccatactttctccagtaaggcttcaaattctaaagttccttacaagcatcagcgcttagctgggggactgggtgttcagatgtacgagtttacagaggacatttttcagtcatgagcttataggggactgtgagcctccgtgtggatgctaagacctgaactcggatcctctgtaagagcaatgcatgctcctaaccactgagtcatctctccagccctgagcttcatggtctttagtgagcagtgctcacttcccagttgagccgctgttattctgaaccagagtgagtccctactacgtgagttatttcttgtgccaaatgtacttgattagatgagggctggtggctcttgagtactggaaactattcttacatacattagtttggctgctcctcaaacaacctatgatataatgtgtattatccctagattatcaaaggagaaacaggcagatctaagctctcatggctacttagagacagagctgggatttatcctctgctgtctggctccagattctgcatccgtagccacaatgaatctgtagccctaggagggacagtggctgaccaccctatgtgtaagccttggtctttctcagtgggtcagttaccaactcaacataatctagaaccacctggaaaaagtctcagcgaggattggtctggataagattcacaggtggacatggctgtgggagattgtcttgactgtgctgattgaggtggaaggatctgcccactgtgagtggcaccattccctaggcaggggatctgaagcatacaagagtggagaaggctagctgagaacaatcctatttgattcattactgattgtggatattctatgcccaagtccctcaaactcctgcttctgcagctttcttgctatggttacctctaacctagaaccgtgagcaaatgagccccgtctctcccaagcttctcttggcagggtgatttatcccagccactagaaaggaagctaacatacatactagtttttatttcataattttacctctgccctctactactcccatcttctcctcccccacaggcagattcttcttctaaaacatacttcctctatatcctttgcttttggctcctgcagaaagcctcggtgtgtcctctgacactccctgttgtccatagtgctgtgacatctgattatcccatgaaacacacatgttcatccctcccccaacactgttctgtactgtagagcttgctgtacatgtaaatagtttacatccactgctgcagcacctggcttatgtaatatgtggcaaatccctctgcctcacagcatctcatttcttcttatcaatacaatgtgcatggagtgagaacaccccacccatcacactgttgggctgaaagtatccacgagagggtaggtgtgaacggaccccctgactacaaactttgtcttaatagagctgcaacgttccccagacttcctcactaaccaacctttcactgcctcacttcacctcccagccacactatattaaaaagattagaacttaatttgtgggaccacagaggtctgtagatgctgcctgtatcccgcaagccgtaggcaccagcttgactattccagtgcagttgccatggttactgagggctttttttttttcccccatcctgcttctatacaaggttgctagccccttgtttaggagtatcccctaacagacatgatgctgacagggaaggctgtgtaaaactcactgtgtgtgtatgctgcatatgtaaacatggtgagctgggcagagccttgcctgagttagtgggcctggctccagttgttcctgaaggaaaacatgtcagtaaccgtcagatctcccaacctgcctgtgcgtggctggttccacttaagtaggaaatcatgtgggccttggagtgcttcttcacactgactcttagtacgtttacagaaaccgccctctctctgttaccagagggctgtcatctttcttgatctttattgtctttctcctataggtatcatttttatatcaatatcttgctattgataccttaaaatttctccacccacttaaattatatctcttctggaatatattcttctgctatctcctatcagccctctggattcttctataatgttattaagtagacagtgactcgtaaccacagctcagtatttccccatctcaccaaggtacattttaccacacatttgatcttaaatgctttctgcatcattattgatgataaactagagcttatttgcagctggtttccccataaactgcatgaaaaggatcataatttatgaagtagcaaaacaacttaatacccatttaccagtgggttcccatgagtgaggttgtcatggtaacacaacctaaattaaatttacaatcagttagacacaagagaaaatatctttctcatgtaacagggagccatcacttatacaggatcctcataagtgagtggcatggctcacgctgggttacaaactcatgtgggcaggaacatgtccactttctctttttgttttgtctctagcaacaaaatagtgcccaatgcataataaataaatttagtaaataaatttaataaatgtgtattggaccagtgcatggctttattatactatcagaccaaaaaattacttaatatgacaacttactatactattacaattaaaaaaaatacatgtaggaaggatatatcaaatagaatataaaatatgctacattttagtggaaggtactaaataaactctagccattgttattaatatagtggaaagtattattactgcgcattaaatggaatgagagacggaaagccggtatatattttttggaaaaagcgccgcacactgtgtgcttttatctataagacctctgctgatttcagaataaagcaccattttcttgcctcagggactgagactttaaactctgctttctctgcagtattctttctaccagcagttgcatgaacaaaaaaagtcagagaaatttttcaaagtcctttatgatcggatgaaggctgctcagaaagagatcagatccacggtgaccgtcaacaccatagacttagggagcaagaagagagaagaggacagtgacgtcatggccctgggccctcggatgagaggtgaggaccttcctgggaacccgaggaaatgttgtgggggaaggaaataataaaatgaagaatctcatgtagctttgtcattgtctcgattcttggggtttaattaccccttgtgcttccagtgtggacttccatctatagaggaatttggtcatgaggatgactctaaaatagccctgcaggaccaaactaaattggagtttaattggtgtggcgcaactggcaatgtgaaagacctttgagttcactcttctgtgcagtaaagaaaaccatctaaaactttctaagcacagaaattaaactccaaggatggaatttatagtgtttatatttgaaataaccaaattattgtcagttaaatactgtagagatgttatcactttatagtttatcattttcccatgagatctgtaggaattcttgaatgtgcacacacgttttttgatacattgtgttctctctgtgtgttccacatgtgtgtgagttctgcagaggccagaagatggtgtctggtcccctgcaactggagttacaatctaacatggttgctgggaactgaactcagtcctctggaagagcagcaagggtcttaaccactaagcactctgtactcgttggtttttgttaatatattgctagatataactgggaagagggcatgttaattgggaagatgtcctcataagattgacctgcagacaagtctgtgggggcattgtcctcatcagtgacagatgtgggagggccaaacctgttgtggatggtgcctctgttgggtcacgtaagaaagtgggctgagcaagctgttaagcagctttcttccatgcctctacttcagttcctgcctccaggttcctgccttgagttcctgccctgacttcccttacggatagatcagacagttgtaagatgacataaacccttgtctccccaagttacttttgttcatggtgttttgtcagagcaacagaaaagcaactaacacaccacctctccagccctttggcacatcacttgtaaagtcacttgtacttgttttacatgtgcttatgggtctttgagatatacttttatacgtcagaaaattctgaaattggctaagtactgagacctttccttctggtcactgtgttagctccttagctgttactcaccttcctttcaggaaactgttgagcctcttcttaggtaattttaaaattcagttgtggaaaattcgaatccctatggcggttgggtttttattttcctttagtcagaaaaggaaaaagaaggaaagagaagaaaagaaattagttcagaaatagaatcactgcttgcctttcagtgagagactcatcactacatttgagagaaggaatgaaagggcagttaacagaagcgtcttcagccacatccaaagcatactgtgtgtacagaagagagatggacccggaaatagacacaatgtgcccgggacaggaagcaggaagtgcggaggaaaagtctgcggaggaagttaccatgagcccggccatcaccatcatgcgtcccatcctcaggttcctgcagttactgtgtgagaatcataaccgggagcttcaggtacttcctgtgccatgtgtgtgtatgcatgtgtgtgtatgtgtgtgtatgcgtgtgtgtgtgtgtgtgtgtgtgtgtgtgtgtgtgcacgagcacacacatctctgtgtgtgtgcaaatgctgaggccttaggctctgagtagcccaattcaagggaagctaatatgtagttttgatgggaattctagaggaatcaacaaagacaccaaagcccagttgagattgaaggaataaacccaagagaaaagtgcttatacattaaaatccaaaacccccagatctacacactgtcttcctgtggtccagatctcgaatcttcccgcccagtgaacaccatctactcttcctccgtggtgtttgttcagagagatcatctttgtctcctctgcctttcacagctttagactcgggtatttatgtctctcccaatccatagttgttgagtacaatattaagtatatttgacatttcgttaggaacaaagtaatatgagaaattttgtaaaataaatgttatatatttttaaattatttactttacatcctgtttactgccccctcccagcaaccccctcctacaatcctttccccctcacccctacccttctcctctgggtcagtggcaacccccaggtatcccctcatcctggcacctcgagtctctgtggggctaagcatctcctctcaaggaattttttatgatagtgaaagttacttcgcaaattaatatagtccacatcacgatatctccaccaccacatttcctctcagatggatggactagggctgccttcaaactttgactacctctctggcgtttttgtatgccccgcctatggcagacaccatggcaaaggcacacggagagagcaattgtgattggcctggttgagggagcatggaatgctcccctgaagagtttgcctccaagatagacactcgcccttgccagccagcttcgcagtgccactgtagctagcatagccgggaaacggttttattaatgaattacagtgactggtggaggtttccacagtgggtcctgcctaggattagaatagggtccatgttgatgagatgttcccgaatgaatggtgggggaatgtggctcattgggacgagctgaccgcagcttagatctagcttctgtagggtgtgcctgccagctagttctcatcaatagaccctgacagtgtggggcgtggatgagcaaaatagatagaataatatctggctttctgttaaccatgaaagtgtggctcaagcactcccttagagaaccttttctttcacagtagcggtaagaagaacaaatagcaaaaaatcaaaataaataaatagatagctacaaatgcattaaaacaagaaccctctctccctctatttctctttgggttctttccctagccttagtccccaaaggaagtgcaccaataacagttttttttctagaaaattctgtgcacatataaacatcagtttgtgcctataagcctaatttctgttcaagagaatatacgttctatagtgtctgctttttcgtttagtcattttttttaacattactatagtacttattgcttggtaatgcttatcacacacatggaagcatttcctaagagccacacccatcacactgccagcaggggtaaggctccagcttttgctagcccctgtctgtgctaaccggcagtgagcagtgaatctctttagtgtgcaggtgcagagatggaggactgcttgccgaaatgcttgagagagctttcatgttgctcctcctatgatcctaccccgactgcaccgtgacaggcaggcttgtcagggatgcttcgcatggaagttggactccgcctccacgaacagtctgtttcccttctcctttctccttctcacacttgtttctgccctctgtagatttccagtgaggacagcagggcagtgtttagtgtgacttgtttggctgaatacttttgctaggtctcgaaggggagggcatcaacgtttaaacattattcaattttaaattattttaaagttatcttgaaaaacaatgagtctcattatggcattttcatgcacatcattatgcttagtcatagtcacacccattatgcccctcattacttctctcttctgctggtcaccttcctgcccccagttgtctcactgtcttataaagaataattgaattctatactggcaaggaatctctctctctctctctctctctctctctctccctctccctctccctctctctctctctgtctctctctctctctctcacacacacacacacacacacacacacacacacacacacacacannnnnnnnnnnnnnnnnnnnnnnnnnnnnnnnnnnnnnnnnnnnnnnnnnnnnnnnnnnnnnnnnnnnnnnnnnnnnnnnacacacacacacccaccacacacacacagaagctaaacctgacccttttcccccgtgttttgctttcagtccttcagctgtatttgatttccccttgcagaacttcttgaggaaccagaacaacaaaacaaactacaaccttgtctgtgaaacgcttcagttcctggactgtatctgcggaagtaccacagggggtctaggcctgctggggctctacatcaatgagaggaatgtagctctggtcaaccagactctggagagcttgaccgagtactgccaaggcccgtgccacgagaaccaggtaaccagagagtagcgctgcctgagccatgactcagaagcagcatgccgggtgaggcacagagcccacctcacatgctggtgaagcctcgttgcttgttctgcttggtgtggctgcttttctcaaagaacatacaaaggccgaggtgtagactagcacatagtaggctacattttaaattgcattataaaagaaagttcccgtgaaaatatttaagataaaaagagttactgaaagaagggtaagattgtatttcttcccaatgttgagtttttctctgtatctccagctgtgtggagttaactcgctgtggctttggctccaatgcagtgtgtacatgttgtggggtataatatccatgttacacatatgcttggttagcttatgaagtgggtctcatggctgtcatcttgctgataaacagcttcagactcagagatcagctcagagatggcagcactctgagacactgcaaaaacagaaaagctacagactttcagaacccaaacaatgagccattttgatttcggtgcacatgcacatgtgagagacccgacgttcatcctggtccccagagtgttttgctttgctctaaggacacactgtgggagatgacaggacaggagatgtagggaagaaaggcatcttgtaatgtttcttaccagtgtttagtattcagaaaacacctggagcgggcaaggttcaggggcagaggctccatgtcatacatttctggacataaaatttaaaggtgtgattgataccaaacatcaatggttgctctaggaagaagatgtgaaaaagtcagcttttctattgcagatcatatgactgtccacacacacacatgcagtgcctgtgtacacacatatacacgatatacacacacctgtgtgttcatttgatgcaaacacattgaccgttatcataacggtattgttttcttctctgtgtttatgacagtgagtttgtacatgttttccctttattttcaagatcacattttagtttcctacaatgataaaggtatccctgacagttgatttaaagccgaggtaaagtgcacaaattcagaggtcgggttggctggtaaaattctactctaaaataaaaaatatgcacatacatgtttctttcatattttaccatttttgtgaaaaatctgccagaacctcccctactttgtggtggaactgagtttcgaaagtcctgaatccaagtaagttctccaaggatacacttgtaataagatagcatgccttacctggataactccctatgctctgaaaatgcacagaagggctttaagaaagttctagaaatgatttgaaatagattccctttgggttttgcagatgttcttatgagcagaaaagcctcaggacattgccagtgttgcacaggaacacacctttcctctgcacagatgtccttgtataaagaagagataggaggcccaggccaagctgctctgttggctagggctgccgtttcttgtgtgactcctcagggttttagattcttgagctgcttgggtggcttggtagcctggtcccatgaatgtggccttcaagctgcttccaaccaacgaagctcaaaatcctggcacactggatcttcaccctcagagcaggcatatcgctctctctgggcatgtttgtactttgctcagccacatccctccaagaatcctatgagctttcccaccgcctagcatacgcagaagtcaatgctctgtgttttgtgaaatccatatacaaatctcctccctcctcgtgtttttaggttgatcataccttaaaactcagattaaagatctccttttgtattggtgggtctgctgagatttaatgcctggaagagttttagtttacctgctcatctttgaaattctgctgtgcttttcacagtgtaatagtattctgcacccggagacatttaccaataccagtcaatcaacagaccctagccaaaaaatctaattcaaatctccaacattgtttgtacacagtattaaagttcaagccttattactacttccagtgttgtgtcaaaaatagcatgttcttttacaagtgtctctttttctagacctgtatcgccactcacgaatccaatgggattgatatcatcatcgccttgattctgaatgacatcaaccccctgggcaagtacagaatggacttggtgttgcagctgaaggtagtgtgacttgcactggccatgtacaccttctggtcacagtgaattctaagttgtcaagtgactgtacaaaacaagatgccaccattgtctcaggtggtgaacaggaaagaggagtgaacttacaaggcccttgctgtgtgccagggaaagcagggtccacctgcaggccgcagtcatgtgatgtgaggctctaggctagagatgttgaagcagcccctaacctggccaactgtttttatttcctattgtttcattataggcagcggtgaaagggtctgaatatactttatcataaaagtcttggtgagatcagggatacaaggcacatacctaaacacaataaggacaatatatatgccagccaatagccaacattgaattaaatggagagaaacttaaagcaattccattattcagggacaaaagaaggccgcccactctctccatatctacccaatttagtacttgaagttttagcaataagacaactaaaggagatcaaggggatacaaattggaaagggagagttcaaagtatcactattcacagatgatgtgatagcttccagaaactaccagggaactcctacagctgataacgtcagcaaagtggctggatacaaaactaactcaagaaggatctttcaatttttatttatatagtagcccgatgtattcaaacctatggaaatcagatacatcaggctgcaactaaagcaacaaacatgtcttgcttctcttgaaatactttaaatatttaatgactaaattgagtatagcctttaaatctaaagactttgtatatattattgcctgaacagagcatctgaagagagcctctgtgaggcagagcgatatctgttggcaagttgggaacgttcatgagataacacactttaagtaaattatgtgtaacattgattcaattcctggattggctggcttaattatccacaattttggaaatataccttcaacataatatagcactataaataaaacactatgtgacataatatagtttaaatgtaatattacacaagctacagttttaaatacacttgaacaagtttctaagatgtctatcttgttctccagcttgttgccttcatgtttgtagctggtctgtgaatgcaaagtgccaggtttgttaagaggcgggatgtgttttgtttaagaagaatctgcttccatggaaggaaaatcccctgctaacaggagcactgtgtgggggtttttcagtgtagccaggctcatgtacttccaaattggttcagatttcagggggtcatttgcaaggtttctttctattctcagaaaatgtgagaaagaaaattggttaaaagcaacacaccgccaatggcattcagaggctggatgcccttttctagtggctctgcaggctgtggctcattagaggacgcagcctgtgttgctggttacctcttaattctgtaggggtctcctcacagagctctcaggatttactctctcctctaatccctatgctttaggttttaaggcatagcgttccaaccctagattatgaaagtaggactgtagaatttgaaatatctgtaaaatatgagaatagtacagaaaaacagaaaggaatctgactcccttcactgaaatcctccatggtagctgtggcactggtgtggcctgtcaccttcattatcttcagattcattagacatccttttaaaggtggtatcaggcagtcctgggagccttggacagaatgtggaaccaaatgtaaccagagataacttatacaaccttgtcaatttagtgctttgtccacccccaccaaacagtgattcagcttaacttatgtcgttctaaaagcatgtgaactctgagtctcttagaaacatctctaaacggcttctccctctttccatttcttagtcttatcaggaatctgtagagtgtaaggttttacctgacagaggacagaatgcttccagtgcagctctggtgcccactcaggactgaagattgcttcacacctcgatatcttaagtaacaatacttgagataatgtttataattaatacaatgcaacacatcggcagcataaaccgcttccatcctttattaagagaatagagcaaaatgttattctctgacatactgaataataaatgccgtgaaataagcacactatcagcaaatcattctctctctaactcatgaatttaatttcatatatctattctcaacagtgactcacacgtttatgtgcaatttcagtatgctactaatattactacttcattttttaaatggttgtgctaaattctctaagttctagccgtgtctataaaatgtcattgatgcctgttcatctgattgtcttattaaagtatcattatagaaatctaacggaggaagcactaaaagaagccatagttctattcagtgtggtgtgtagccactttcccattaaaaacacctgtgatttaaaatatcctcccatctttcatgacttttactttgtatcaacaatgaagtaaattaaaaccttctattttcaaatgttagtatgacaaaataaaaataagtttcagctttcatctgattgagaatatgaaaagggctgtgtgatctgagttcccaccaatgcaggggatttttgacctgtgctgtggactttgtatgtgcactgaccccgtctttgtcctcagaacaacgcctccaagcttctgctggccattatggagagcagacatgacagtgagaatgcagagagaattcttttcaacatgagacccagggaactggtgagaacacttctccaggctatggcagttgggtggcatccaccctgctctgactgggttggtaggagcaggatgactggcactggggagcagaaaacacgtagtgaaggcccttgtgactcaggatggtggatgcgctagggtgttggagtgttggatgccctggagccagagtagagaacctggatgtgggcgctgggaattgacctggggtcttctgcaagagcaggaagcacacttaatcctgagctatcaatccagcctgatatattttaagcacttttcttaactaacttgccatgctctacttagctatatacagatgccttttgatatatgtttattgatgttgatatatatatatatatcaacatcaataaacaaatttatttatagacatattttttggccttagtttaatgatttctgggtatagttggctgttagcttggtgagctcaattagattcgtgcatgggtacacagtgttcatgattagacaacctgaagcattgccaccacctttcagactttattatttatttatttatttatttatttgtctctaggtggatgtcatgaagaatgcctataaccaaggcctggaatgtgaccatggggacgaggagggaggggatgatggtgtttctccaaaagacgttggacacaacatctacattctggcccatcaggtgccatgtttttatctgcatctgtcttgcttgtctggctattgtgtctcatgcccacgacttactgttttatgtttacaatctggtgctctgatttattcggtgcctgccctcctaggtttcagttggagaaaatgctaagtcctcagcagggctagtcatgcaattcagggtacactagggagcaattgacaagagaaggaggctcgggcagacggcttctgactaggacttctggctaaggaggagttgaaagggaaaggaggcttgggcggacgacttctgggtctggaaggagtaagcagtctcaagccagagccgtaggacagggaggagaggcttctgtggacgcagaatgtgaaagaattgggtataggtgctccacaccttagccagggctagcccagcagggagctcagtcctaaatcacagcttggcgagcctttaatagaagtcagtaagtttgctcttcacttgactatgactgaaactaagacttaggtttcttcagagtaacggtttccgttctgttgtttgtaagtatcaatatttgttaggagttacttgataagctcaattctacaaacacattcaaatttaagcttatatcctctaactcaggtttaaaacttaaaactttaagtatgcacataatgacttgacttttgtctccaagaggccctatcagttttagagaataaagttcaggtttttgaaaacatctcaaacgtcccagccacttcctcccaccagccccctctcctacctgctttcccatccatctcttctgttgattaagtaaacaatgatggatggaaggtcagattctgaacagttttaaaggttctttagttttaaaggttgctctttggacatttcctgtgcccttctacctttgtgaccatctaatgggtataaatttgaataatgtttttaaaaagtcttcagggaagaaatcagattctaaaagctaccagctcaggttgctgcactttggtgaagcagttgatgcagtgagacacacggggttctcatagactgccaggacacagacacaggcccacagggcgagggcgctaagttacagctgcagacatggaaaggcatgttaggtatcgaggaacaaaaatagaagctgacagacaagttgagggaagtagaaagatggagattcaggatgtgggaaagtcctctttcagagagaaagaaaagtcaggtgatggaggctgagtcaaactagggggaaaaaaaaagaacgagagagaataaccttgaatgtgaacagaaataaataaatccccagatgagagttagcatcacgtagcatgccagaagtaatgctgagacacaggaccacaggaaggagggagttgccttagaggctgaggccagtcaggggaggaggcagagattagggcagagcagggactagaattgctacatattcttcctgggcagtgggtcctgccccatctgtggtggctgtctcttggcatgtgtgagtagcatcatgcatcaagcaaacttgaagtctgaggacaccggcataggagtggacatcaaacctgagaaaagatcgtgttaggtcagttccatcttagtagggaagagcagaaaacacaactaaagaatgggtcttagctcgaagagaacacacaactaagaagcaagtgtgaagttcactgatcccaatgaattggggcagtcagagaggtcagagaggaagtgaggaggtggcagatgcggaaacagccagggtcctgcagagggctttgtaaaaacttcccccaagcaaaactttggcaaagcagtagttcacagggcaatgagggtatgccacatcacacagctacatgaaggaagccaggcttccggacagagagaggaccaggctgagtaagggaggaagtgggttgtgagctgctgaacacatcagccccgtgctttatctgagtccacagaggtccttttagaaagtcgtcgtcgtcagggtgaactcccgacatggacatcgtgcaggctccattctgttgtgtgtagccgatggtacagctggctgcttctttcatttagagaaataggaaatcattccctcttcggcatgtgccactttccttatggagttaattccaccactggttttccatgaaaagattagcaactttcaccgaccttgggctcttttgattcttacatgagtggaccctgttgcttgctttaggctgggacattgtatttggttttctggtcagccgtgttccctgtgaacctactatgtaaacgtcttccgcgcatgcagagagtgcaagccgggccagctgtttctcaggaggggctgtggatgggtcctgcctgtgcagctttcctcataaggtgggagcgggacaggaaggcagctgatgaccttgcagatctgtggctgcctctgcacagcccagtcattcgagaactgaaccgcagctccctcctcggttaccataatcacctttcacacagacagtttattttggtgctctcagacttttnnnnnnnnnnnnnnnnnnnnnnnnnnagtttattttggtgctctcagactttcgggttttgttgctaatgcttttcatggcagggacgcggttctgcttctcagcctagacaaccccctgggcccttcctatggtcaactttacaagaaacaaatagtgcttcctgtaagtgtcttgtctgatctacataaaactattaatatatcacaaagggaaattcttcagctttgattctgcagtgtcctgctgtgaatttctttaccaccccgcagccctccctgcctttagggcttgtctgtgcactggtctccattttcctgtttccacccatcccttctctccttgggatttcttttggaaacagttgttacgactgtctagggcatttctcattcctctgtctacttcatcatgtcttaagccacatcacctctctggcttcatcgggcaacttgtctgctcttgtctgagtctctttacttgactcttggctgaaataagatgtatatgaagagggctgggtgtcatggcccatgcctctgtaatctcagaactcaggtggctgagacaagtggacagctgtgagttccaggccagcctaagctttagcatgagaccctgtttcaaaccacaaaataacaacataagaggaataaatgaagaaatgttagatgctttgtgggcaggaagatgtgttaaatagaaaaccagaagaaaacaggaataatgctcactttaattggttacatggaaatcttctcaaaatgaaagctttaatttttttcatgagcatttttctgaatcaataaatggcctttgaaaatgtaattttaatatctgcataattaggcatcatttgaatgtactgtaatttatataatcacttgttattgttaagcatttggtttcctaatataattgatattataaattgtgctgtgattaacaccctatacattaatctttgtctgctgtcctgatgattttcctagggtaaatttcaaggggtttaattcctgtggctgttgatacacagtgtaaaattacttttcacaatgtacttacgctattgaactctaaacttcatgttgttcaaaagaaaagactctgctgaactgagtgtctgaaatgtagctctcagttcagatctttgttgactagatctgtgtgtggcacgtgaatggagacctcagacctatgtgtgaatggagatctcagatccctgggtgacaggagaatggagatctcagctctgtgtgtgacatgggaatgcagatctcagacccgtgtgtgtggcatgtgaatgtcagatcttgtctgtggtcacctcctttgcagtggttcccagccttcctaacactgtgttgagaattgccataaaacatggcgtaaaacaaatccctcgaaacacggtggaaaaggttctagtacttttatttatttacaaacagcaaaaagcaaataaatggtagaatggacctgcactcgttcattcacacacactctcctcactaacctttctggcctggcaggcgcagcctaagtcccggaagcactcaggtaaatgcaactccatgttccttgctttcgggtcctctggagctgagctgcagcagtgcaggctttgttggctaagcatgaggtgtccgagtgagcatctgcgtggggtccatgcaggttatttctcaacacaaggttttcacctctgggccctctagaggtgagcaattttgccgtgccagaccggagttattaagctaaattcagccaattacaactagggtgttccacacagtacttcatgcacttctttatctctcacgagcatacacgcgctctctatggcctgtttttcatagttatcgagggccgccagcacatgcctcacctcgggcaaggggctcgggtggtgggcatgaattgttcttttatcacttgtgcccattctccaaggcttggttgtcatgactatctgtggccgcaggaagtgcagctatggtggcctttgggctggcaacttttacagcttcaggtaaaatgccctctgaggctatgtgttctttacaagctgtgaccctttaatcagtccctcatgtcatggtgatggtccccccgccccataaattatcttcttattacttcataactgtaattttgctactgttatgagtcatagtaaatagctatgtcttccaatggttgcaggttacccctgtgaaagacttgtttggaccccaaaagttgagacccacaggttgagaacctcttctttagggagcatctaaaatggactgtgtgtgcattcttggattcattgatcatttgcatttctcctgtgagttacttgaaggtctatttatcctttatcaggtctcctttgtcttttacaattttaattaagactcataaccattcatctatcatactaattatatctgttttccaattcattggccaatcctttttgtccatctccttaaatctgtcaaaaactcccctgggtggtctgaaactcttctctagagcaggaagctggtgtatacctctgccagccaccagcttgcccacagcatcctgggtcccgggttctaatccttccaacatttcaaaagaagcctgatttagaaaacatttttaaattgtgaaattcaaatctttaaaagttgacctctctctctctctctctctctctctctctctctctctctctctctctctctctctctctctttctctgcatctactaccctcttaactcccctccccatgccctgaataaactctattctatacttaaaaaaaaaaagttggcaactcattaaaaggaaaaagaaatgtgaagacatgaggcaggctagccaagctgaaagcagccaggagccattggcttacctcgggtagaacccagggctctcattcctcattcactgagccatgtagatggaacaagctgtgtggctgccaggctgtggccacattctcacagcacagtagtgatgacaggttggtttttggggtgatgcgaaatttaactaggaacagtgaaggacagacaaacacacaattagcagaccggtatcagccatgcctgctgaggattggaaatcaaagctgcatctaaggagaaaaacaaaaccacctgaagtggagatggagggacccttagaaactgtggttcagtggcttctgaatggcatgaacccagtgtgtctacagggagaatgtaagacccatatatcaggtctacacagagcagctgctgtcacttgagtgttaggcccattgagttcattctgggttcattcatcataggatagcagttattgatctccgctatgtcaggcatcatgctagttgctgagatgaaaagataaatcagtaaacccccagggaagtaaattctgcgaggggagggagacagagaaacccccataattaaagatgctatgttgaaatgggaaaagtgcaagatgtccgttcctggcagtcagagcgagggaggagggtggctgaggcggagagactgcttccctgagaaggcaacgtggctacctgagagtggcgctgctctcaggaatctgcacagcaacctccctcttgtgcagatgatgtgacaatggctatagtgattgggaccaagtggccatctttgtcaggtaataagcagtcacaggtatgtgccgtgaacatgggtgaacagttgaagggactagagggtgactcaggcttgggatctggtagttttatgtgtaataattaaaatccaaatacagacttttttttctattatcattgttactgtggtaaaaattaatgataattcctaccaccagggtttagcatcctttaatgctgatgcaatgctttttctgttttcttggctatttccacacgaatgtggcaattagcatgcggtggttctcacagggaatgctgaggtggtaccccattgcagcaggcatgcatgctgatggtgtttctatgtagtataggcaccaagaacgatcaatatgatcctgcattgtgcagtcagggatcttacccacctggtgctggcgacttatcttcaccttatagatcgttctttgacaatcttcttactcagctctgtgcagacagggctctgtatagtcttccctcttgctgagcacttttctaatgtgccaacaacatcatgtttctcttgagccaatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctttctggcactccttaacatcctggataaattgaaaacgattgttttctctgtgttcacattgtcgtatttgttatgttcgcccaaaccacctatttaagttcgtgctagactgtaaagtgaagtgtttctcacaagctcctgtgtctcaacacttgatctccagatggtggtactgtttggggaggttctatgggaagtgaggcctagctagagtaagtgaatctcttaggggtgatcttgagatgttatagccgtccctacttcctgtcctctctctgtttcttgatctgtccagatgtgagcaagcagcctcctgctgccacaactgtgagccactccaaccaccataccttcccatgtggactgtacacatccaaccatgagcggaaaacaaatccttccatccttcagtagcttgctgcctgttgggtattcagttggccacagcgttaaagcagagtagccaacaaatgctatacataatgctagaattactcccaattattttctgcatattgaattgtttatgcacgtttggtttgtttactcacatgcaactgtttatgcatatttaattgtcattcatattcaattgtttatgcatattcagcttttgctggtttaattgtctgtgcacactcagttgttcatgcatgtttaattgtttatgcatattcaattgtgtacattcaattgtttatgcacatttaattgcttatgcatattgccttggatatttagttaatagaaattcacaaatatggatacttatgagttacctttttttcctaagaaactttacaaaaaaaagtatgacaataataataataatgatgatgatgatgatgatgaagcctggacatgttagatttaaatccttttttataaacacccaaaaaccattcactgagcacctaagagtctaggttacagccacttgtgtcacctttaaattttgcagtcagcaaaagcaataaaaatacacaaaggaggaagcagaatcaaattgagctctaattttgagccagatgaaagtattgagaagccaggttcaggaggagcagttacgttttgcttaatggtcaccttttgtgagttgcatatttctgtccctgagacatgattatcagagcacaggtctgaagcccagcaacgaagcaggtcgttgctaagtgtctggctcccctcccccctcacacccgtgttgactgcagctacttccacaggattcagagtctcctgggacaagaacatggccaggtagggaggcttccatctgtgtcctcagtggtcgaatgcagtgttggggtggagggagcagcaacctggagttcactgtccagccagttcagctgaatcgatcgatgagcccgattcagcatgagaacctgtctcagactataacctggagagcagtggagcaagcccccaaatgatgatctctggcttccacatgtacacacacacacacacacacacacacacacacacacacacatacacacacacacacacaaacatacacacactaggcatcaagcaagggcaatatccttttcttaattctgggtgggggtggagtggagggtggagccaaagatagtaggcgtggctttggttcttctctactgggagagtttgttatcccaacattttctagatatctgatagtcttcattaagccaccttccccttaaaaattctatttcattgctgcaattacttgagcttaagggctatgcatataaattactcttaataccctgaaatcagaggaagtgtgtatatcactcaaactgcttgaagtgtttcccttgagacttgagcaactcacctcttccggcttctgccttcttatgctaatgtgtagtaatcagcatggcttcatttactttatttgtagcagcagaaagatgggcttgtaattggatccataacttccatctctaatatctttgaagggtgttaactaacttacaattacttcatttctattaccattgctcgtggaaagtgggaaacacagctggatttttgaactcccaaaagcacgtggagtgcgataatatgtcagcagaaatgtgcaaacggttctgctgatgctccgtcacatcctctgtcctctgttggtgctttccagtttctatgacttcagctttctcacccataaaagcgctgtgtgcctttgtgagcttcgtctacagggacctacgtgaacaccaactcacctttggacatgatggctcctcggatggattacagtgtattttaaataacgtattggcccaactaaccagctactagatcttcctgtgtttgcacgtgccttatctgcttacaacagggatttgaggttaaatgagaaatgcttgagtgtagttgtgttcttagaatataaactcagaagccttggaagggaaaatgacctaagtgttctgacggttgtggctggcacactttccattttccagtactactagcgtggagtttataggcaacaaaagagttaaaaatgatgtgcagtgctgtttattagtgagcatccttttactgatgttgaaagggaattgaaaatgagatcagagcacaccacccagaggacagaggctcctgataaagtgctgcaggctgaactttatgggattctgcctgttacattttcagtcccttgacataatcaattattgctttccagtccgaatggagagtaaataaatggggctggggagatggacttaccaataaagtacttactgaataaaggtaaaaaactgaatccggatgctaatacccacttaaaaagctgtaatcttagcgtggtggtttgaataagatgtctcccataagtcttgggcatttgaatacttggtccccagccggtggctattgggagtagggtgctttaggagacatggccttgctgcagaaagtatgctactctaggcaggctctcggggttcaaaagatcatttcaagttagttttctcagtgttcaagatgtgagctctcagcttctgctccagctgctccctgcaccctgctatcatgaaccctaccctctttttttttatttacacattttatatacacatgcatatacatgtacatatacacacatatacatacatatatatacatatatatacacatcacacacacatatgtatataaaatgatcaagcctgtcactctagacaacaaatcacttctttatgttgggaacatgccaaatcctttcttctagccatttcaaaaaacaacatatcctgacctctgcaaccatgattctgtggaaacaacattttaaaatgtgtgtagaatatgtatgtgtttgtgtgcatgggtgtcttagttaggaattctattgctgtgaagagacaccatgaccatggcatttaatgggggattgctacagatcgttcagaagtttagtccattatcatgcatggcagcacgcaggtagacatggtactagagagatagctgagagttctacatccagatctgcagacgtagtgccagggaagtattatgaaccccaaaagatcagacaggagccgattcagtgcaatcatatcagggcctttattcaagctggcttgggcccctcagcccactgccaacatggttttggtggagaggagccctgaacatctattggggtaaagttttatagaaagcagcaagccaggtggggtggtgtgtgtgtgtgtgtatgtgtgtgtgtgtgtgtgtgtgtgtgtgtgtgtgtgtgtttctagcctggcaagcatctaattggagtgctcccatgtcctttagcataattggctggtgcacgaaccctaccctcttaaggcccaaataaacccttccttctgtaagttaatattggctgttgtattttatcacagcaatagagaactaacgaatatgcagggaggcagaggcgggagagctcgctggctggcttattttgcagaagcaattagacctggtgtagacctctggcctctacacacacatgcacacatacatatacacatgctccccaaatacactaaaaatgattatggttaatctccagaattgtttacatagtgagcacacgtgtgtaagatacgattgttccataggtgaactttgataatgggggaaatttccactgaatgaacttaataaaacagtttaaaaattatcttaaaattataagagttggatgtagtggtaacacattaataccaacttgagggggtgaaggtcagagaacagaggttcaaggtcagcttcagctgcatgagacccatcacgtaaaaactgtatggttgtcatatgaagttgcaaaacctaaactggctttgattgtctgagtatacaatattccccggcttgctcacagtggtgagggtaaagtcatcagccgttccccccacctcagcacacacacaccccacaaaccacacacaccacacagatacagcatacacaaaccacacacaaacacgcacagacacacaccacacacataccacacatattacatacacaccacacacacaaggcaccacacatgtacataacacacacacacacatgcaacacacgcacataccacacagacataacacaaaccacacatactatacatacacactacatacacatacatacgcacaccccacatgcacataccacactcacatgcaccatgcacacacaacacacaccacatgcatgcacactcacaagcacacatacacataccacacacacactacacacaccccacatataccacacacacaccacacgcactcacactcacaagcatgcacacatatgctctgtagtgaacttacactctgtagggatggttcccttgcttgatgtcacattgtttgttgtgctttgcctgtgttcttcattaccctcttaaagtcaaggttgcaggtgtgggttgctgtgcctatctcaggtttggggtcttagatattttttaaatttaggagtactctgtctgcatgtacacctacatgccagaagaagccattagatccctttctaggtggtcgtccaccatgtagttgctgggaattgaacttaggatccctggaagagtagccagtgttcttaactgctgagccatgtcatctcccttctttaatctgaggtcttattcttgaatgtcactaggtgcctagtacttactgtgtttgtgataaagctgtttggaaagtagttcttttctggtgtaatggccgagagaattgtgggtatgtgagcctcatagattgctcaggcccgtctcttgtgtctgttgatcagtgtgtgttttagaattactcaacgaggcacagaacagtaccaggaaactgcaataaaataatactggatctggatggtaaactgttaaattaaggagagcaacccttcacaccaaaaccaaaacaaaacgcaacacaacaaagcaaaacaaaacacaacaacaacaataacaaaaaaaccaaaaccctgttaaattatacagtagggggaaatttttgaaaagcccctggataatatttctgttatcaatgaaagaggctccattgtagggatataaactcgattattttaggggatgtcatctggccatctgtctgtaacgtatacaggcatacccatccatgtttaagtatttgacagctgcatgaggcttggaaaccattcgctagttggtgccactatatggggacttccccagtgccagctagtaaatattttagggttgtgaggccatcctgtctgctgcacacactgtcttctgcagttctagtgttgaaacagccatggtccacgtgtaaacaagccagtctgactgcgttacccaataaaactgctttttatgaaacaggcaccagaacagatatcacccatgagggctgtgttgccaacccctgcggtaaatggcacttataatcttcatagtttcccatgccccatatttgaaataacctcctgatgactgtctgggtctgcaagatggctcagcaagaaaaactcttgtccccaaacctggcaacctgagctctgttcccggaacccacatgatgtaaggaaagacaactcccacaggttgtcctctgaccaccatgctctgtgacacatgtcccatcccccacaggtaaagaattaggtattaaaaattgagaaaaaaaattagtcatttatttttgtagttgtttttagtctttatttttgagtcagaatctcatgtagcctgagcttgcaggaacttgctatgtagccgaggatggatttgatcctctgaccttttaccttcacctctagtgtattgggattctagctgtgaccaactatatacagtcaaaattttaaaagtgaaagtgtgtgtgtgtgtgtgtgtgtgtgtgtgtgtgctgattgtggagtgtggaggttcatggaggcccttatgagctccctggagctaaagttacagccagttgtgagtcacaccacatgggtactagaaacagaggccaggccctctgtcagatctctgtgctcataactgctgagccacctctccgactcacatttgtactttttaatttcaccttgttttcttttttggcggtggtgctggggactgaactcaaatggccaggccctcgaggcaagggctctaccgccaggctgctctccactccagcctttctctctctgggtggtcctaacccacacaaagagcggcatacactttatgtttctaaatagacatgaaaggaagatgttagaggttaggtttctattgctgttataaaacatgaccataagcaacttgtggaggaaagggttcctcttgcttacacttcaacaccccagtcttatcactgagggaagtcagggtgggaactcaaagcaggaactcggaggcaggagctaaaacagagatcatggagaagtgctgcttattggcttgtttcacctggcttgctcagcttgcttttatatgtatcccaggaccacctgcctgggggtgccaccacccatagtagactgtccccatctccccaccaatcagtaattgagaaataaaccacagacccatctagtgggggcatttccttaattgagggttctagcttccaaaatgacttgatctggtatcaacttgacataaaaccacacaggacttaggattccatggttgtaagacttgcctataccatggaccgtgggaccactaactatatagcagggcaggcaggtgtatgttacccggtgggtctggaagatgatcacgtcctccgtgaaccaagaccgtgactgaaccaagcagaaacgaagcaggagggaagatctaggggtgaaggcacaggacaaaggggtgtctagcacgggccacagatgtttcttgcttgtgcctgatatggacttgagaaacatttggaagcaaacgggattctcagatggagttagctcaagttccctgattctgtctgctgagactcgggttgggtgcatctccatgtcacccttgaccattcacccagggtctctttactcaagctgtctcaaaccacagtttttaaaaacatgtctctgaccttctgcccatctcagcttccttctcttggtgtctgataggccaatcacctgaccatacacaactttccactcttttccttcctcccttctgtgtggttccccctctttgctgtcaccccaacctgacagctgcttactttctctctgtccgcaccttcctcttctcagaagttaaagaaattggcctccacctatcaagcagatatttatctcctaaaaaacaaacaagtaagcaaaagtctcacaatgaaagagatgaaggaaagaagcccgtgtctgtctccttctgtctgcatactccttagcatgataaagtactataagactctgcagctttggacaatggttggacaccaggcagtggggtgggcggcatctgacccagagcacgtgccagtcttactaagggttttagtcttctgcttggcccttcccagcttctcctccgggacctgacattttcatttcctgtcggcagtaaaccctgtgtgctgaggaggaagggaaactgtgacttgttctgaagtcccccctccctgtcctccacaccccagactctttccgttgctagctactttaccaactggaatgtgctagggaaagtgaggatgaggcttggccagctcctagggaaagagttggctatgggtagatgacgttttctgagctggaggtaggaaagcaggggagtggaatagagcaatgagcttggccctagcccatgggtgcttgggaatcaatgtgacattaagataaagcaatgtaagggtccagctgcgagcttcattcctgggaagagaagctaggcttgaacatcaaggtatacagatgtatgtatagatggtgtttgaagttgtgctatagatgagatttccgaggaagcaactggaacaaagggagtaagccaagagaaaaacctagagagatttcaaatattaaagagggttaaggggacaagagaaaagaatccctcaggaatggctggaaatgagagaactggataaagacagggtagtgagactcagcaagaaggccagacaatcggcctcaagtactccgagaggaggtgcacctctatgtagctatcccgtgatgagcaatctgtttttctggctggcatccaaactggaccctaatgagcagaggagctgagaggtcacaccggtgacaaaggacaccagagactcagggaagcagccatccgaagcagtttaacctgtcgaaccccactttaagcagagtgaaagaagaatctcagatctaagtcgtcattaccaatcaagtccttgtcccctacctctaccccctgcccctcacccctgccatgtctgggggtcaaggtgactggtgctcatcattctgagcatctcccagccgctcttcagaaagtgtgtgtgtgtgtgtgtgtgtgtgtgtgtgtgtgtgtgtgtgtgtgtgtgtgtgtgtgtttgtgtgttatcctgtttaaaatatccacatgccagggttctttgaactcttcttactggtgttctcttaggccagtggcattgcttcccagggtcctgtgtgcaagagcagatctctgtccttgccaagggcttgtctcagtgagtcctcactctgtgtgaccctccgtggctctcatctgtgaggcacgctttggaccctggtgacagtgttaattaaatgtctatggacttgggagtcacagcgaggccctttgcgcaaatgtttgagacaaagctggagggatagaaacatgaccatccaggaactcattagagaatggaagggctcagactcacccaggggttcacatgctaagtgggcgaggcaagagaacctgcaaatgacctccagaaggagtaaagaaatctgtctgctcagctttcacagtgcgcagtttctgtgggtaagctttggtggttggttcctctctatcaaccagttttactgagtctgtttcagattccaggtcttagcttgttttcagccagcgttggtcactcccacacctttaacacctaatttagacacgagtgtctccaagcttcaggatgtgagtggggccaggcagccaggcccttcctggcttctcctcggggacctgacatttcccgttcctgtaggtggtagaccagaagtactgaggaggaaggaaaccttgtctcgtctcctctgcctgcccctaggttaatctggctccccttcctcattgaatggtttgtcctataagcagtcatccagggagaaatccatgttctcttggatccacccacttccctgactagactgttggaaggccaaccctcccatgagctctgcactcctctggcagcctctgggctccatttccactttaacccttttcagtcactcttcttaaaaaagtcaaagtgacagtttgctggagatgcttgtcttgtcactcagcctgaagcttttggctggcgaggtctggctgacaaacgctccagctttcgatgttcattatggttgcgctcatggtacccgtacattttgtttacttgggtttatttatttgggttcctgtctaacaagtccttagcatctgccctaagtctcctctggccagctagggatcctctgtgacttgtaatgccaggatgcgctcagtaacttcactggcagagaagagagttggcatgcagaggagctagaacatttggctctgtgtcttctcagagcctgtgatgctaactgaactcttgagacccctgtcccgtccctcctgcccccatccttcaaaactgcttggtcagcttcttcaacctttcctctaattcaatcataggggttcccaaattcactccaatggttatgggtgcgtgtaagtatctgcatctgtctcagtcagctgctggtagggcctctcagaggacagccatgctaggctcctgtctgtaagcacatcatagcatcaataatagtgtcaggccttggtgccccctccccccaccatgagatggatcctaagctgggcaagtccctggacagcctttccttcagtctcttctccatttttgtccctgaaggtcttttagtccggaacaattctgggccagaaattttgactgtgggttggtaaccctgttcccttcacttggagctctgtctatctctggagatgaactctgccagttccctctcctcactgttggacattttagttaagttcacgcctattgagtcctgcaagtctctcacctcccaggttcctgggactttctagagggcgcctcacctcccacccccaggagctgcctatttccattcattctcctggtcctgtgggtttcactcctgttcatccaccctataactgatcctgtccctcttttctcctctccctcccctctcctacccagatttctccatccctctgcctcccatgattattttgtttccccttctaattaggattgaagcatcctcactcgtgtcttctttcttgtttaactttcggtctgtggattgtatcctgggtattctgtactttttggctaatattcacttatcagtaagtacataccatgcatatcctttcgagtctagtttacctcactcaggaggatattttctagttccatctatttgcctaaaaaattcatgatgtccttatttttaatagctgaatactgttcccattgtataaatgaaccacattttctgtatccattctttggttgaaggacatctgggttgtttccagcttctggctattacaaataaggctgctatgaacatagtggaacacatgtccttgtgatatgctggagcatcttttgggtaatatgcccaggagtggtatagctgggtcttcaggtagagctatttctaatttttctgaggaaccatcagattgatttccagagtagttgtaccagtttgcaattccaccagtaatggaggagtgttcctctttcttcacatccttgagctgagattcaccttgcctgtttgctcctttgctgggtggatgggtggaggttcatctgagcagtaatcccttcctttacaaatcactccatggaacacaagatgacctttctagtccctgttactcagttgaacagagagacagtggtgtcgtgatagatctcatctggcgtagctcagaaatagaaagctagagagatatccatggagagagagcttctctcagctgctgagactccacccctgattttacatctgtctaatttgtgggcttcacattgctctctgagcctgccagtggttttgtagactgcagtaggactcaccactataatttcaagccttcaattaacacagtttgcagtggctttgtcaagactatgagcaattgactcactcttccaagaggagatctgctgagtagataagagctggagagtaatcgggcttctctgatgagcaagggagtttgcccaggcccctgaggagccacaggaactgtgaccctccagaagttttctgctgtttgtgtcactgcaaggctccctccatgtcttagaaaggtcaagctgtgatggaaggtcggcaggaccagaaatagtcgctcaacgtggatgagcccactcacccagtagttatgctgcatgcaacagttcttagtttcccgggcaagcagaagtgctgctgtggtagctcagactcccccactccttccacaggcagctgctcatctctccatcccctgccctgaggaaaacacagagaatattggaaacagagacagaattagaatgcttttggccagagaagcgtgcaacatccttcctggtttgggtatcattatgaggaattatagtttggttctagaaatagcaattaaaatactttctaaaatttacatagaatatgcccatttgtcatttggaaagttaaacataggggtcattttaaagttgaattgccaagtaatgaaacaaaaagtaattatgctatgtagtcatctgtcacccaacgtccagctgtccatccagcaaccgttaagcatcccttgtctgctaaccacatgtttagatacgaggggtataactgtaagtaaaaccacagcagtccaaggactcatattctggacgagagagacactatcatagaataaggatgactccacacacctgtgtcaaaggcaacatcctttcaaattataaaaaccaattttattattgaatccatatctactgtatattacatacagtctagaaaactttctataagataattattatgtcaatggtagtgaagtaactttatccattttaatatagagagaacaatgagcttaggaatgagagctttgggcgagggctcgctgtcatgtggtttatgaaatacatcttgtatatctgatcccaatttcagttcctttttgaaaatgtgtttagttcacctgttagtaaggatctttttgtgtttatatttttctactgttttaaaggaaaaccttaaaaaaggaaagtttgttaattttagtttttaaaaatgtggatttttagtggagagtccaaattgtttctagtgataatatctgccgcgaggacagaatttggcaaatgttatttaggcagaagctacgtggtggaatctcactgagtttctgagtcagaaggagggggctgggatcttcttttccagcttctacatgttgctcctgccttccagcaggcacagtctgtcagggggtatgaacagtttggaggagagctgtttccccaacgtgaaaactctggtgtgttctgaaggagaacttaataaacacatttttttttctggatgaaaaatgaatttcaatctttactgcatagagaacaataaagcttctactcttaatgctatgtgaattaaacccaagtttgtaaaaagaaagctttgttcctttaataagactaagcctgccttctttgtaagaaaacacctgttgtgtcccatggtaaggagaagcctgcctgctccttctgttctctctgcagcttctattttcccccgttttctctgcattctgcacattgctctatttacttatttatttgtttatttatttattttattaaactagtaaaatttattttaaaatatacaattttgtattggcatttttaagtcatcaagatattttataatagttaaatgcctcttaaatatacatgatatcttctgaagctaaaagtaatatgcattcagccagttttaaaaatctatttggaacattaaacatgataaaagtaggaaaaaagtttcttatgaagtcctctatgaaaggaaattgtgacaggttcctgattagacagaaactgttccatctccaagggagaatatgcagtgtaactgtggcttcatagaacaggttgagttgtgtttcttatgtttctattttgtgggatagtttgaagagtattgattggtattaggtcttctatgaacatctgatagaactctgcactgaatccatctggtcttaggcttttttcggttgggagacttttgatgactgcgtctgtttctttagggcttatgggactgtttggatggtttatctgatcctggtttaacttcggtatttgctatatgtctagaaaaattgtccatttcatccagattttccagttatgttaagtaaagacttttgtagtaggatctgtgattttttttttaatttcctcagtttctgttgttatgtttcccttttcatttctgattttgttaattagcatactgtctctgtgccctctagttagtctggttgttgattctcaacgaaccagctcctggttttgttgattctttgtaacgttctttttatttctacttggttgatttcagctctgagtttgaatatttactgtggtctactcctcttgggtgtatttgcttctttttgttctagagctttcaggtatgctgttaagctgctagtatatgctctctccagtttctttttggaggcactcagagctgaattttcctcttagcactgctttcattgagccccataagttttggtatgatgtgccttcattttcattaaattctaaactgcctttaatttctttctttatttcttccttgatcaagttatcattgactagagcattgttcagcttccatgtgtatgtgtgctttccgttgtttttgttggtatttaagaccagccttagtctgtgatgatctaatagagtgcatgggattttttcaatcttcgtgtatctgttgaggcctgttttgtgaccaattgtatggtcaattttggagaaggtatcatgaggtgctgagaagaaggtatattcttttgattcaggatgcaatgttctatagatatctgttaaatccatttggtacataacttctgttagttttaactaacagaacccatttggttcaacttctgtgtctctgtttagtttgtgtttgtcttacctgtgctcacaggggtgtctgactcctgagagacctgctctgtcctggtggtatttgggtatggagcgctgtggcacaggatcagctctgggcactgtggcctactaaaaacattttaaaatacttggttccattgggccatttctctctctctctctctctctctctctctctctctgtctctgtgtgtgtgtgttgtagtacatgtgtctgtctgatgcttgtgaatatgtgatgcatgtatgtgtatattgtggtttgtgtatatataggtgtgtgggtagtatgtgtgtgtgtgttgcatgtgtgggtagtatgtgtgtaggggtgtgtgtgtgtgtgtgtgtgtgtgtgtgtgtgtgtgtgtgagtctgcatgtgtgttggtgtttgtcttgctttgaaagccatttcctcatatcattaaagggtttttctaaaactgactttgccataatttaagacacacccttacaattgagtttagagcatctgaaaattaagagctttcacctgtaataattaactctgctcaactccttcttacttttgcacattccctttgtcttaacttccactattatggaaataactaccagatctctaagagttataatggatttttaaaaaaaagattagatctataaaaaaacaagtgttttcgaaactcttggtaaagatactgtggcgatccatgccagcaatcccaacactctggcatcaagagacaggaggattgcctcaagttccagtccaggttgtgttgtatggtgtgctccaggccagcctaaactaggtcctgtctgagtggaggagagaaacggatgacgtataagtaaaatgattgtgggaagaagctctgagtagatgtcggcattctggggtccctcctccaatcctactgtggttagggaaccagttatcaattaatgtttccttgactctcgtgtcatgagagaacaaatgaaccgagagacacagacagtagaggtttatttagcaaagccaaggccagtacattccagaaagaggtgggagggcttgggaagggctgactaggagggtgcatggcagctccctgtgctccgtgctgtacattttataaagctttatgaatattcatgaggtgggtagcatattcatggagataagctggcctttccccttccaaatcctggatgacctggatctcccttttaaggcatttcttcgcagaatcctcttgagaaggccagaggatgtaaacccacagtataggtgacaatgtggtgaagtgtggtctcttaaggatgcataccctttgttagtacatacgtgtggcatttgggaacgtgttctgatgtctcagtttttgaaatagccagaacagcctgcagcttcaaagacatttgaccacaagggatttctcaccttctggagaaggccaccaagatgcaactgcagtctccttggttacctcagcactagcttctggcctacccaatctcagagaaacagttccttatttcatgtggatgagtggtgtgtgaatgcatgtgtgtacatgcattcagtgcctgtgtgtgtccccaagtgcatgtgtgtgtgtgtgtgagagagagagagagagaaagagagagagagagagagaaagagagagagagaatgcatttttgtatgtgtgtgtgagagaatgtttgtagtgcctgtgtgtgtctccaagtgcatttctgtctgtgtgtcttaagtgcatttgtgtgtgtatgtgtgtctgagtgcatttatatgtgtgtgtgtctgagtgtatttgtgtgtgtatgtttgagttcatgtgtatgcgtgtgcatgtgtgtgtggagagttgtgtgtgtttctttattttggggctctggtctttcagcctggaggtctgtgtatccttcccagctgcctctgggtgctcagtcctggtttgtcaagctctctttctcagaaatgtcacctgaatcttcttctctgccacagccaaccttttcacgaaccttgctttctttgggttcttaagagccatttttggatgtaaaaggaaacatcgtttctctctttctggtccagttttgatgtaaaatacattctagacaacattggattggagagcaaggatgattgggcaagaaacaaagaactttgtaagaaagaaggatggcttattttccctcctacccgtttgatctgttggtgaggtgtggggcttcacggcttctgttgttcttcctgtcccttctctcctgtctcctcactctggtgttctcaccacctcccttcgggaaactctgcaagttccttctccgtctccgtctccgtctccttctccttctccttctccttctccttctccttctccttctccttctccttctccttctccttctccttctccttctcctttcttcttcttcttcttcttcttcttcttcttcttcttcttcttcttcttcttcttcttcttcttcttcttcttcttcttcttcttcttcttctttttcttcttcttttttttttttcccgagacagggtttctctgtgtagctctggctgtcctggaactcactctgtagaccaggctggccttgaactcagaaatctgcctgtctctgcctcccaagtgctgagattaaagacatgtgccaccatgcccggctgcaatttccttcttaagggaagactccttatgttccccccaagtcttgttcaacctcaggcgtatggtggaagcccgcctcctggactctgaagactggaggcgagggcatgctccccgctcctgggaatgctttcttgagtggctgaatgcaccctctctcagcatctgagtgttttcttgctgagagcacagagccaggcttcctgtggaaacctgttctcagctgccctttccctgctcctgactgggtagcagttggccatcaacatcttggaaggagagccacttctgtgggaggtgtcttatgaagggctgtagtggtgggtgagctctgggcaccatttccagtcagttcttcttaatccaggatttccttctcaaaacagaaggatggcagagagtctatttcatcttgcacggagaagtttctttgcagcctgtttgtactgtttcacgcagactcccttaccgtaaagcagactcaacagatcaaagcagtctcaaggttctagtcagatgtcataatcaggccgtcctagacctaagctccagatgaaggctgagggaagcgtcctttccgcccaatttcttattttctggctgtttttggcagccgagacatatgccagaccccattatccaaccatcacatgacactgcttgtatagacccgtctgagcctgtgttttcctcttatttaggcatactagctaatggattagtgttcaaactcatatgtaccagggctaatatatgaatgggatttttttgatataccatgtttagtccgaaattatcggtgcagcgaatgtgtgatattcttgaaagacccattacctgttcattgtctatgtttatatataaagtttatgtgaagtaagactctgagctccacacacggccattgagtgtggccttttttctatgcccactcactgggacttgtctcacccagatctttacttggaacacagagtcacagctttgaaccacaaaccactttctcctgtttctttccctcctggggacattgcagccattctttgaaactcatcacaacacttcttgtgtgattctttgcctactgccaaatgcagtgtgaatccctgcgctttggctccatctcacctcacaggaaccacagaccggcagccattttagctccttcagtacccagctggcactttgcttaggaagttggtggatggacatcttgtttctctccaaagccacagcaattagacctgggttttgtctataacggcatcgtgtgatcagaagaagaacacttgnnnnnnnnnnnnnnnnnnnntgtggccttttttctatgcccactcactgggacttgtctcacccagtatctttacttggaacacaggagtcacagctttgaaccacaaaccactttctcctgtttttttccctcctggggacattgcagccattctttgaaactcatcacaacacttcttgtgtgattctttgcctactgccaaatgcagtgtgaatccctgcgctttggctccatctcacctcacaggaaccacagaccggcagccattttagctccttcagtacccagctggcactttgcttaggaagttggtggatggacatcttgtttctctccaaagccacagcaattagacctgggttttgtctataacggcatcgtgtgatcagaagaagaacacttgttctgaagacaaagggtctttctgttttacagagagggatttcctcaagcttgctctgtcttctgctgctgctgttgcttcaggtgcgaatgatgccttctgtggaagcatcatcacaaaggcagtcatgtgacttcagacaatcatgtgactttaggcagtcatgtgacttcaggcagtcatgtgacttcaggcaatcatgtgacctcaggctccagctcactctttgatctggggaaaggcaaactctatgtcacggttttactgattaataatagttgaacacacactgaaaaaaaatatccagagattagaagtactgaggtggacttaccatagaactgtattctggtacaaattctggctttttgttcaatcctttcttggagccaaatgaaatgaacatagatatcctggtggtaagaagacatatgcgaaacagacatttatatcattttcattgttactggagttgggactttctggtctgtcttcattccctaacttttgatttaaaaagtatacagtgatcttcaagaccctgttgatggatatctatatttaagggttatgttatccatatacatgtattttatgagtgcacatacatatatttttagtgttgcatttatatttttactttaaaatttccatnnnnnnnnnnnnnnnnnnnnctttctcctgtttctttccctcctggggacattgcagccattctttgaaactcatcacaacacttcttgtgtgattctttgcctactgccaaatgcagtgtgaatccctgcacgttggctccatctcacctcacaggaaccacagaccggcagccattttagctccttcagtacccagctggcactttgcttaggaggttggtggatggacatcttgtttctctccaaagccacagcaattagacctgggttttgtctataacggcatcgtgtgatcagaagaagaacacttgttctgaagacaaaggtctttctgttttacagagggggattgcctcaagcttgctctgtcttctgctgctgctgctgcttcaggtgggaatgatgccttctgtggaagcatcatcacaaaggcagtcatgtgacttcaggcagtcatgtgacttcaggcagtcatgtgacttcaggcagtcatgtgacttcaggctatcgtgtgactttaggcagtcatgtgacttcaggctatcgtgtgactttaggcaatcatgtgactttaggcagtcatgtgacttcaggcaatcgtgtgacttcaggcaatcatatgacttcagacaatcatgtgacttcgggctccagctcactctttgatctggagaaagccaaactctatgccacggttttactgattaataatattgaacacacactgaaaaaaaaatccagagattagaagtactgaggtatacttaccatagaacagcattctggtacaaattctggctttctgttcaatcctttcttggagccaaatgaaatgaacatagatatcctggtggtaagaagacatatgcaaaacagacatttatatcattttcattgttactggagttgggactttctggtctgtcttcattccctaacttttgattttaaaagtatacagtgatcttcaagaccctgttgatggatatctatgtttaaggtttatgttatccatatacatgtattttatgagtgcacatacatatattttagtgttgcatnnnnnnnnnnnnnnnnnnnnatatgcaaaacagaacatttatatcattttcattgttactggaagttgggactttctggtctgtcttcattccctaacttttgattttaaaagtatacagtgatcttcaagaccctgttgatggatatctatgtttaaggtttatgttatccatatacatgtattttatgagtgcacatacatatattttagtgttgcatttatatttttactttaaaatttccatgtgtatgggtgttgtcttagtcagggtttctattcctgcacaaacatcatgaccaagaagcagttggggaggaaagggtttattcagcttacacttccacattgctgttcatcactgaaggaaatcaggactagaactcaggcaggtcaggaatcaggagctgatgcagaggccatggagggatgttctttactggcttgcttcccctggcttgctcagcttgctttcttatagaacccagactaccagcccagagatggtcccacccacaaggggcctttcccccttgatcactaattgagaaaatgccttacaactggatctcatggaggcatttcctcaaccgaagcttctctctctgtgataactccagctgtgtcaagttgacacaaaactagccagtacaggtgtacatttgtctatttgcccagcccatgaagtgcctgctgtggccagggggttatgacctaggactggagtcacagatggtctctgtgagagctgccctatcagcactggaaactgagcccaggggctctggaataatggattgagggatccagggagctgagaaaaggaagagagcagtttgactcaaagaattggggtgaagaaaataggaaagtaactgactgattgccaagtagttactcaggcttgtgtttggtaaggattgaagccaagagagctccattcattgctaaagtggacgggcactggccttggtgagaacttggcctgttagctctgttggaagttcagaccactcagctcagcttagtgacctgaaacttctgtgtggtatagttcagactgctctgttgggtccagggtactggcctctggtgacttttaattttgcatccatttccttggttgtggctccagacctgaccagcccattccttggtttcctctacagtgacactacaagctctaggtttctagaagcaaactttgggtttctttcctaatgtatttctgtatttgattgaagtaactggcacaccttgcctttcccctgttcatgtcaatcgtcctggacttacactaagcagattttcaactctgtagtggaatggctaaagtaagtgacttatgaggagggaagattcattctaagtcacactttcagagttttttggccatggctgtattgcacatggctctattgtacaacatcatggctctgtggtgggctggagaagatcatggtagagtagagctgtctatcatgttatctagggagcagaaaagaggaagaaatgagaggccgtgagtttgataaactcttcacgggcacacaggccctgacccaccttcctcccataggccggacctccagcttccaatggagtctccagccttcagcaccaagctgtgtgatagctcgggctggaagcacggcgagtgtccttgcctagtcatccacacatttctgaccctgggaatgttagtcatgtgggtcttgccagtttcgccctcagaaccagccacttcttgccagttggtaatatgcccaggtgattacagcaatttcctctttaaattctcttagactttgaggatcacctacaagtcacagcaagtttcatgcctctggatggtaataaaaatgatataattcatgtttagttgaatataaaatataagtaaaataagacatcattttttttctgcgtggtccataaatgaccctgaaaggcatttctaaagtaaccatttcaaaatgatttgttctggagtcagtgagatgaatatttaattgttcggattatcactttgcaggatgttaacttggtcttacaggtctggattattgcttaaatttgtgctattttatggccccatttatattaagacgctgtaggtatgtatgctatgtttatagccttgtaacaccaccaagaaacttgctctgaagctactgtctgtgtttagtactgactggctttgccagtttccagctatatagttatagacaaattcatactccctgtgcctcagtttcctcatctgtaaaatggaagcagtgagagtgtccacgccaggatttcaaagtcagagctgatgagatcttatacctggcaaaatgagccaggcacctccgggagcaatgtgtttatgtaacacagccagcctggctacaccggtgagctctgcacttactgagaatccctgtggcaaagtgagatagagagtgatagagatatacctgacgttgacctttgtcttacacgcacgcacacacacacacacacacatacacacgatgaacctgtgtacacatacacataaaaaggaaaatatttatgatgagattattgttttttaaatgctcaatttcacatataaatgaaattgaaatctatgcccataaagtgccagttttgacttggtaatctgcagaagtataggttaataagtataggttacacactgtaagaggaagccttttggaatgcagagccctgtctacatgtcatctgtgttatttctactgcccactcttctgctgccctgctggtcattgatttacctgtatgtgtagctggtcattgattacatgtatgtgtagctggtcattgatttacatgtagtgtagctggtcattgatttacatgtatgtgtagtttgagagtatttcctcaatgctaccatcagcatttcttctccttggcacatttatcgcagatgtggattatccacaaatgagaatgactgatttttatgcattgattatttattcatttcaaacatagacataccttccctgaatatggctaactactgtcaccccaggactgtgaaagacatgtgcacaaacagacacagtaacttccaagtctcaagaagaacaaagaggagacattaacccttcattttcttcccggcagttggcccgccacaacaaactgctgcagcagatgctcaagccgggatctgacccagaggaaggggatgaagctttgaagtattacgccaaccacaccgcgcagatcgaggtacctgcctgtcactcttagaaaggggcctatggtgaaagaatgcatttgcttcctacctgaagccattttcatgatttttcatagaactgtgaaataataccaagtgatttaaatggaaaactctataccacaagctgaggtctaagagccatgtatagaaaccgagtctgtccatctcgagtttctctccccagaaccactctgaagttttaaaatggaatgagtaaagcttttctcctgtttgggtcacggaagcagatagggtagaggattgagtggtattttagagacaagatagtagagaatctgcctcttaaaagtaaatgtaacttttatttgccagatgcaattgttgtcttagaggcttcctgctgaataagctcaccctttctagctctttctgagctctgcctggctggtttaactcagctgctctggctcaagctcctcttcaagctgaatgattcaatctggcttctctcagcttctcaatgttttgctctgcttggcctcaaactaactctggcaatgtgttctaatcttctgggtgcttcttattctctggcttctgctgcctctgctgactgcactgaactgcactgaactgcttggactcatggaggaactcaactccaccgcactgcattcactgcactgccctcactgcactgcactgcactcactgtactggcagactctctctctgagctgctcttaaatagcttctctctcctgggctgttctcctgagagttgggcctatctcatctctgtctcattctgttaaatctgtctctgatccatcactttgtctacccctcaattatatgtcactttcaaatacagctgcttccttctacaaattaattttaccttaaagtgtatgctaaggatgtgcctgtgttccagccagatcacacaggtctgagtcttcagatgtgatcacttgcaagagcagctatgtttctagattaaaattcctctacagaggcttcttaagatatgaatctgtgacctaacagagtttttgaagacaggcatagtggcacataagtggcatagctcttaggagacagagtcaggcagatctctgtaagttccaggacagtctggtttaggaagttacaggccaggtacatagtgagaccttgctttgaaaaaagcaaaagaaaagtttatgaaagtataggaaacatagaagcactaataaaagtttcatattggtatcatgcactcaaaagtttgctgtttacacatttattgtctgacagctgtcctctccctgctccataaatgagacattatctaatgtcctatagcagatcaggaggtgtgccaggggactcatcaggctgtcacttctagctggggtatcattgtgatgctttctggcagaactaatcaggcagaagtgagcagagtggcaatgcctgtcactcctgatttacggccataacttcattcattctggtagatggttttttagttttcggcagaatgtgtcatgggcacttttgcctctaatgggtaatttctatgtcttattgtttatttctaccaaatctttgagcattactaagctttatcacttcatgtcagaagtagacccctgctcatatgtataaacatcaacagtgccgcagctcagtgtcagatttgcctggctgagtcaattgcagaaatgggtattatcaagaacggtagcttgtggcggtcagtttagtagccctgagaagtggggaggtgcttaggccaaatcaccatccaagaaggaggcccccaggatctgaatcttatttccagattctctcatgcgccttgctgcctctgaagaaatcgtgtgcggttttaagcaactggtcattggaaagattctctgtatctgtgaatcgcactagaccattgcaattgtccaccattccccgtgtttgctcccctcagggtggtagcttagtgtgtgtgtgtgtgtgtgtgtgtgtgtgtgtggtcacattcatgtgtagcaagaggcccaaggttggtgttgagactcatcctccatcctcttcattcttctgcctttctcactgaggcaggacctctcagctgagccgacagcctggtaagatggccagtcttgctaaccagcttgcactgaggaacctctgactttgccttccaacactggggttactggaaggctggcacacccacccagcacttgtgggtttgtggggctctgaactctgaccctaccatttattttgcatggcacgagctttaaccactgagccgccccaccccccagcctttgcctctaacatttcaagagccgccatgcttctcagtttgctcctgtctatattggggatcccgttggtttttttactttcagttccccagggctcctcagctaataactgaataagcatctgttgaatcacctaggggaacgttaaccatatttggcttccttttgggtaaagcatttcctcctttggtttctctggtttgtcattgccctttgtgaaacgtgacaaccagaattaaatatgtcattttatgcaaggactgaatattttcgcttatctaatcacagctttatttctttagtaagccctaagaatcaaaaaaaaaaaaaaattacttgacactgttagatcaagcaaaccttttaaaattcttttcatgtggttgcctactgtatcaaatatgcctcagtaatttatgtaattgatattttaattatttttttaaattagcacataaaggggctgcagagatggcagagcaggttaagagatggcagagcagaggagtttaagagcactggctgtggttacagatgcctgttttcggttcctagcacccagctattactcccattccaggattaaaaccgagttagagaagagagagtttatgttgactaaggttccagaaagagagtccagaggcagggaaggcaaggcgtggagcctgggggcaggggccatgttttatgtgtatgcaggagggtaggggagagagtaaggctataagccctcaaagcctcagcatggctctacttcctaaaggtcccacaacctcccccaaactgcgccactaactggagaccaaatgttcaaatacataagcccatggggaacatttctcattcagaacagcaggctggaggcagaacacttcagtgataaaaaacaaacaaacaaacaaacaaacaaaaacctctgtgtacagagaactgaagacacccagtgctaaggatttcacttggtacccagaagcccctgtcaggaagaactgggcacagattcttaagttggagttcagggtcaccccactggctcatttttcatgattggatacataaactatcactcataagctcattgtcctagcttcatgtcttctgctgtgattataaaacactcttgccaaaagcaccctgggaaggaaaggacgtatttggcttacagctctatatatcgtagtatgtcattgggagacattcaggcaggaacctgagctaggagcaatggaagaacacggtgggtgtgctgcctctgtgcttagtcagctttcttacatgtgccaggagcatgggccaccgggtgcttccagatagttccaaaccctaagtcacactgagggctctagttaaaatctccatgaaaatgggaaagagatttgtaaggaagaagaaggcacctggagcaggagatggataactgggggtggggagaaaccaaaacatattatatgtgtgcatgaaattgtccaagaacaaaatttattaattaagaaaaaggaagttaaaaactgagtctgagactgaggtgtgcaaaagtctgaaaccgaacgccgatcatttccagattgtgcggcatgaccggactatggagcagattgttttcccggtccccaacatctgtgaattcctcactcgggaatccaagtaccgagtgttcaacacaacggagagggatgagcaaggaagcaaggtgaacgacttcttccagcaaacggaagatctctacaacgagatgaaatggcaaaagaagatcagaagtgagtgtgagacatggggggcggggaggggcagggtcacatggccagagacagaggggcagcgccagggtcacttagcccaatttatctagataattaattggatttcttgtcagtttaatgtccctgaaatcatctgtaggctggagtgagcccctgttgctgctggagccaaaccttctgcagcttggtggacttagaaattcccagtcaaccagatggcccgcagctgctgcagagcgtgtttttttaaatgtgttattagctgcaaggctgcagctgagctgttgcgctgccggatgactgcaggtgtgaagtcctgtgttgacccctagacttcaatagtcagcgcatggggttgggcgacgtctgccagagccctctcactcagtgtcctctgtgtgtgtttagacaggacctcacagctcagcctgtcctcagattcattctgtaccatagatgactccacatcccaagtgcttagagttttcgtgggagtcattctttcttcctccctccctttttccatcgaaatctagcaagcctgtaaccagagcccagtgatattgtagtcaaaaccatcaccatgtagttctctccaattggagcgcagatctcccatgtgtttggaaacacactgagtttccgatactttttaattttaaagttttaagtcattttaatgaggctggggagatggcctagaggtaaagccacagggtagctcgtagccatccaggtgcctccagggcaccgagtgcacagagggtccgcacgacatgtatgtgagcaaaacgctcgtgcacataaaataaaataagcctacgttttaaaagtcaaggctcttggagttaggtcctttttgtcttttggagactttcccaggtgtgacttggatttcacaattcagtttgctagactgttcaccaagagacactaggtgagtggagctgctcaaaggctcctttgggtataagatgatgtcacgcaggtttagattcctaagacactggcgttctttagaattttaccacatagaactcagcagaaaaactgggcatccattatatgtagaatattcagaaatttttatttgagatatttgaaaaataatttatccatattaattgaataataaactcaaattaattaaaaaatcaattgactaacagactgaaactctaggatctgtgttttgtggcaaacattttatttatttgtttacctatttattacaaaaataaaacttaaaataattaccagtgggcatggtattttaagtcttagaagcagttgatcacaaggatattgtctcagtgattctgtggacttgtagatagagaggagtgggaacagcacaggtgtctacagttcacgatcatgggattgcccagtaaaattcccatcacagcctcctccactgtggagtattgcccaagaggaggaaagtgagaactcaggagggacacaatcccagacaacagagggcccagacagaggtatgacatagatccaaaaagtacacgattttccctgtcataaacctcaccctactgactctgatattttgtctttaaatttttaattatgatttttaattatgtgtatgtgcctttgcttattgtggtcttttacacatgcgtatagtacctgcaaaggctgaaaggtgtcatatgccctggatttggagttacagcaatggtcacctacttgatgtgggtgccgggaactgagctgggccctctgcaaaaacagtgcatgtcctaactgctgagccatctctccagccccaaactctagcattttcatcttttaggttgtttcgtttgaaatagggtttcatgtagcccagggtggcttcaaactcactctgtagcttaggctgaccttcagctactggtcttcccgcttccacctcccaaatgctagggttatgaacaaacaccaccatgtccatcccattctgtatttcaatcctatgtcaagacattacaagatgaatggtagacaagacccaaaggagccacaaagcgtccaatgtaggctgataatgtagctcctctaaaccacttgcattacaaatttccacagctatttagatgtggaaagaactgagtttctgttaaatactggtagatacatttattaactcctttctgatgacaggcattttccctttctggaaatactcagcaaattattgacttcttactgtggacttttctcccgtggcttcaaaaccagaacataattagaaacattcaaattaaaagtgtagataatactatagcatttttaaaaagtggggtctcactgcataaccgaggctggcctcagactcccatgttgctatcaaacttgtaggcatccttctgcctcagcctctcagtggatgctgagactgcaggcctgggaaaccattatgtctctctggttcccatgcatgctgagctgcagtgctgagactgcggtttccaggtaactgcacctgtaaaagtctttccagtagatatatacctgagtctgccctcctggcttttatgaaattacatcgtgaggataagaccatcctacccatcagtattatcagtcctccagtgagtggggcccgtgaaccatttgccacgttcccctaatttgcatggtccagaatctagggatttactgtagaatcacctttgctcacactcttgaaggataaaaaaggaactaagaaaaatgcctttaccatctggtcttataatatgctttctaagtaagtcacggtttcttcagacgcacttctgtgaccagtcacaatcgcattgcccatactgttagctcggcagggctcctgtgttgacggcagcatatactggccattctcacccctgttcttgttgcttcctagacaaccccgccctgttctggttctccaggcacatctcactctgggggagcatctccttcaacctggctgtgttcatcaacctggctgtggctctcttctacccattcggggatgacggtgatgaaggcaagtgcttgtctttctgcaaaagatggatgcctggggaaaaaaaatcacaaaaaaattctcaaattgcattccttaagtctctagagcttcaaaacaaagaagcttagttctcaatgaatattttttctgtattcattgagagtgtagaggtagtaagtagagtagactgaaaaccgtggccagtagaaatgttgttttacagaaatttcatgaatgtgtaactactggggggattatgttgcttccacataattagagtgatcaaacatactttattctgcgttatcgcagttatgtaagtgagagcctgatgcgcaagtattttgatgaaaggatcacaattatattttactttctgtcttgtctgggtgttttgtagtaagcatacccacaaaatacatgttttgattctataatactgtacatttataacactaataatctcatccttagaaacacacagcctacaatatactgaaatggtggacaatgaaggatattgactatgaaattggtatcattaatctggtagtgcatgagcttttacaaaagcaaagacaggaatttgaagtgaagcatgaaattccataagaattgggtggggtttttgaatattgttcaggtttagcaaattgcttgagaacaatctgttacaggtatgaggtacaacctggagagtaactttggaatgggtagaagaatgggtgggaggcaaacatgagagaaataagcaaataatagctttggagtgaccctggggcacatagggttggtgagatgctgtcagcagagcattagcagttcctgactgttggaccaagagtggttgttagaaggtgaatactgtcactgccatcctgagggagacatgagagatggtaccataacagcaacagctatgtaagcaaatctcagaggaactggagacaatgaggagagatgggagcccaagaacaactgaccgttttccagtctttgtcagatcccatgggcatcaaagccttcatcttagctgcagtttgagctggcatagttgagcttgttgtgtttctgagtgcacagcagggatgggggaattgtgaacagtagagcaggcaagtcactgcatagcaggagaacggcaacgaatgcatgcatccatcatgtgggcagaagtggggatgcctttctctccccttgatctggtcttactttggtgatgagctcttagtacagaggaacacagatcttgagggtaagaacccatcacaaaatgatcagttactatctcctgtgctcagaccactgaggttacatggcagagccctagtaaagagaaatacagtctttaagatggagacagacctggacatcatctaatatcaacctttcatttgacatacagagccatgaaaacccagtgaagaccttcagcccctaaaagaagcagatataacaaacatgaggctggaagacacagatccctgggccatgtagagcctggttactgggaacaagtgtaaacatcactcttgaaaaagatttttgagtcaataatagtagcaagatggaggctcagtcctaggatgccagagtgtgggtgcttcttagggaaggcagagcatacacatagggcaccataaaaccccatgatgagtctgagtcacatgactacagtctgtgtgagtcagctcatgacaactttatgactaaggttaaagtcttgatcaaagtcaccacaacctctaagtcttgaccacacactgcatatatgggcagagtgggcagatatgcgtggccacattgtgcagaagaaaactgctgtgtgctggtgacagttcttgatgctggagtttttcaaacaggctaagcacctgttctttaggcttaattcaaaactgtgtaaagacagggcgaatgtaaatcaaagttctcctagtaagtgccttggagtgatgggggcagacaacacgataggctccaactggaaaggacttcagcagacagatctgagaacgttttgaaaaaaaaaagatcgacagtcgtatactataaagcatagaataaaaccaacctggggtctgtatgaatagggaaaagatgatgttctttttgctactgtcccagttaagaaagttgaagagtgatagaaattgtatgtcaccgtttggctagtcataatactcaatgaatgctcaaaacaaggggtgactatgaagaaaaaacacaagagcgttgtactttaagaatctgcccgtgatattcttaagcagtaacaatggggagaggagtaactgtaaaacagagaaaccactcaacaatcgtgagtgatacccagggaaggcaatcgtgaaagcacccagcaaattcaggtcagacagacgtctgttaacgtgggctgtactgtccacccctactacaatctgcttcagagtcaccgagccatcatggcaaggggccagcagaggcaggttgctttcctcctccagacatagtgaatggtgaggtgtcaaccatgctctcggaagcaactcaggctcaactgtctcgtacacacgtgggttaccatgttggagaacaacatccttcaatcatgaggatggtgtgcagtgactcaaggaagatgtttcaggggagatgttgctcagatgaccaccctgagagacaccatccacgtctactggagctttaactgctaggcttctgtggaatttgtttatgctagggatggttccggccatgccaactgaattgtcctggcaaagtagtcagtgttttttttttttttaatcccaagataaacaagatttttaaacctagagggagttcttctttcctccccacattttgaatgtacttcttcctcacaagcatgtttgctgaggaaaataaggttcttcaaggtgatttcaactccctcagtttcacaagtgttgttgggtaccactgtgcagtcggcataatgctaggctgagagaccctaagattagtaaagctgttttacctcagagatctcaaggtctagttaaaggaccaagagatgagaaagacgcaagaccaatgatgaccagtggatttatggatggatgttgacttgatctggacctgggtgtaggaagcaggagtctaatgagcctgcccaggaagcagagggttggggagagcctagagtaagaagcagccatgctggacaggaagccacagacaaatcatcatgagaccaagctgagttccaagatgactgacattgaattttcttttataaaggaccaacttcttacttctgagatcttcaaaagtatagaggaatttctaaagacatcatcccagtaaatataagatatgcttattatgtgaaattaatagaaatatgcaaaacattaaagaaaaagattcccacctgatggctaaggattggctttagtgatttatattgcttttgctttttattacagttacttgtttgtttgagagacagggtttcactgagtaacccaggttggcctaaaattcactttgtagctcagcctggtgttgaactcagagcaatcctcctgcttcagcttgccatgtgtttagatacaggcatgagttaccacactccactgagactagctttgaaaaatgttagacctgtctctagagtgacaaagaggttatgttgttgtttgttgttgttgttggaggaggaggaggagaggttgtgttgttgttgtttgtttatctgtttccccaaagcatgactcatcagattggaactaacctgatggctcacagagtttggatgcccagatctcctgtagaaagccaggtatagctgcacaacctgagtgttaataaatatttagccacttgttcactatgaagtccccagagcatattttgtctacttgataaacaagtattgattgattgttgcaaaacacagtgtgtcagggtagggctgccccacacatttgtagattttgtgttttaatggagacccgagagtcatcacaaacactggaatgctaaagaaactctctgtattcctcatggaaagctgcggagtcaaggcagatggcttgcttttgctaggtagagtacccataaaccagtgtcaaatgtaagtcagtaacctattttgatgaggaagaagatgaactctctctttccaatattttaaaaattatcttccttccttccttccttccttccttccttccttccttcttcttcctctttctttctttctttctttctttctttctttctttctttctttctttctttgtgcaggtgttttgcctgtgtgaatgtctatacaccatgtgcatacctggtgcctgtggaggctagaagagggtattggattccctaggtttagagtcacacacagttgtgagccaccattgctgggaattgaaccagagtcttctggaagagctagcagcaagtgttcttaattctgagccatgtctacagccacacaaccttcttttaactcctgtttatttgaagctgccacaataacaaaaatattgctctaacaagatacctgacactgtgtatttcatgagtcaaatgtctatttagttccctgctctggatatgggaagtctatgatcagctatccctgtctcttcactccaggtggggaccctccttggttatatcacaacttgatggagaagcagaaagggatgtggctgtgggtggaggggttatatgggcaggggagccacactttgcaacatgctctcaagggagtgtctggtgcctgctatgccaacaccaatcccttccaaaggcagtagtctgtaatctgagttccctgctgtaatgcatcaatcacctcttaaagattccattgcctctgcagtatttctccaggtccaagcttgacatctgggagcctttgggaaagcagtcaaatcatacctaaaccacaataaaaagcattgttacagagccagggtttcaaagcacacctaacttaatattgttcatgtattgtttggggtagttacaactgtctgacagaatctttgtaatttttagatgcattggtcctcagtgaatacaaaattcatcaaaggatatgtatgggttcatccagggttttgatgttaaccccaaagccttgcttatgaaagccctcagtgggttttgtgtcagaagtcagtgttatggtaaaaatagatgtggatgacagagcaagcatcgttgttgaagttttggcacaggaagctgtggagaaatctctagcttggtgttttcctcctgcccgtgtcatctggaagatgatgacccatgtcatcctgacggtcctggtaccatcagccaagccaatagtatagtgcctgaagttacttctgcagatgcagcacaccccagccactcttgaaagggagtcaatgaattgcacttctttttcaatggaagattgtttaaacttcatttgtgagaaatttctaaggaatatggtttattatatggtccatttaaaaatcataggaaacttttcttttacctctgtgcatgcatgtgcatgtgtgtatgtgaatgtatgcctgcatgtatgtgtgtaagtgtgtgtatacatgtttttgtatataggtacatgagtgtataaatgtgtgtgcacatatatggaagcaagaggtcaggctcagtgttatttctcatgacattattcaccttgcattttgagacaaggtccctcagtgacttgggattcacccaatcagctagactgactagccacaaagccccagggttctgtctgtctctacctacatagcagctggatcccagcatactcaccattattactggggtgtagggggtcaggttcagattctcatgctctcgatgcaggaactttcctggcttggctctctgcccagctccataaagcttttatttcctgatgaataaataaatagcctaacatatgtttggaacttgagtcagtgttcagcactcatatgtggacacatgtatgtgtcttttaacacacgaagcttactcatatgtagatatgtgttttaacacttaaaatactcatgtaggtgtgtgcacgtgtgtttttaacacttaaagcatttctattttataaaatctaagtgttctacaaattaggtttctttttttttttttacacttaagtatttatctgtttgctgtgtgtgtgtgtatgtctgtgtgtggtggtcaaacaacctgtaggagttgggtctcttcttctgctgtgtggtttctggggaccagactcaagtcattgagcttggtggcaagtaccttcccctgcttagccatcttgttggcccaaactgaattctttcaagaaatccatagtatgacaatttgatactagaagaacaagggaagtggatgctcacagtcatctataagatggaacacagggcccccaatggagaagctagagaaagcacccaatgagctgaaggggtctgcaaccctataggtggaacaacaataggaactaaccagtacccccggagctcgtgtctctagctgcatatgtagcagaagatggcctatttggccatcattgggaagagaggccccttagtcttgcaaactttatatgcccagtacaggggaatgccagggccaagaagtgggagtgggtgggtaggggagcagggcagggggagggtatagggaactttagggataacatttgaaatgtatataaagaaaatatctaataaaaaaagaacaagggaaacgatgagttaataagaaatgatccttgatttttcatgaccattaatcgtgaactttgacttgaggtccccaagtgaagcatatctatctaaaacatctcaccaatccctcccacaggagagaaatttctaagacctgatgcaaagaatgttaactaataaatatttatgtagcctgaaatcccctcacaaatctttggaagtagaaggaggagtaacatattctgaagtgtttcctcggggtagaacatggaatgggttgttctgagatccagcgtaccatggctttatctgcacatgaagcacagaagccaagatttctgtgcttttcctgtgttattgctgacaagtaacccgttcgcatttccaggcacactctccccgatgttctcagtcctcctttgggtagcagtggcgatctgcacatctatgctgttcttcttctccaagcccgtgggcatccggccattcctcgtgtctgtcatgctcagatcgatatacaccatcggtctggggccaacgctaatactacttggtgctgccaatgtaagtacactgcttagctttgtatcttatggaattcagacatactaagtgtgaatataatctagctgtatgcttttattcttgtgtacgcagtgaattctggtttgctgtgaatctctatcaacaagagtatcatttgtgaatgctttaatttattgagaaagaacaagaagatgatggatacattgatacatttgcgcagccttgcagcctgactcaattctgctgttcatcagttttaatgtcctttctgtgtcatacgtgctattattgtaaaaaaaacaaaacaagacaaaacaaaaatgacctagctactgttaacatgcccaagaaggttctaaatcatcccaaaagattaaattatattcaatagatttctatcaagtgactcaagagggaaaaaagactgctagacaaaaagtaagatgcaaaattgtgctccttttatatgagaaaatcttataaacttataaaaggaataggtgagatttctctccttccctaccgagttctagtagattagaacaggaaaggaactttggactgttagttcagtaagggtacaatgaacagactggaagtgtcaggccaagaagcaatcgacagatttgtagaaataatctaaacaaaaaacaaaacattgaagggactctgtgccaaatttatgcaaagtgtatctgtaaggagatgaaattggtaaaaatgacaaatggtcagaaatcacataaatattgttatatctacctaattagtacctaaaacactccctgtaactttcattgcaatcttaactcagtgtcctatgccctgatgtcttagctggggttatactacttcatatatttattgaggatggtagttgactgttatatatctggtttatcacaggctgtctataaatattttttaataagtcaattaatcagtgaatgaatggatgagtggtcaatatttattaaaaataaataaattactcaaccaacttttaaggattatcaagatgaggcaacataaccaattctgttttctcagggtttctgacgttgatttttatcacaattcttcaaatgttgggcagtattccagagctcccagttgttagaatattcaaaacagccaacttctcagttactgccagtgaagagggttcaaaaagtgtcacacacacccttctctaggtttcatggagactggagctgtcacaccagtgcatgagtccagtctttgctcaccccctgaccttgtttctgtgcaatctgtttactatacttccctatctcaatggtgctaagcatcttactcctccaggctcactcgcatctccacttccctccagcccgcccttggcattgggacagaagtgattttacgatccgagtttatactgtctttgctttgaatgtaagctagataactagagaaccatcatgaatatgtataaatttgtctacaccactgtctttggcttagtttgcttctctagaaagcatactgagcatgaagttatatgctttgaggaagtaaatattatccataaattgatcattgactttcaataaggcattaacctaagtgagaaataatccaagtttaagaaagtgaaggaagagccaggcagagttgtacacaagataacagatatttgctgcacctgatgcatgatatggtagacatgtagaacaccaagagtggagggatgcttcttgccatctggaacgcatgtgctttggcgggggtgggggtagggggaatatgtagacagaggtaagggataatatttgaatgtttgggctgatggtgaactaaaaacatctggcgttcctttcctgtctcctgtaggacaatataatgtgataacttccacgtgcttgggtgggaatcattccaccataaaaataattattttgccaaagccaggtgcttatttaatagctttatgagaaagtattaagcatatagacatgtctgtgttactaactccatgaattttccaggattccaatagcattaaagcatgttattcagccacacactaccactacccagggatcatttaaccaaagaaaataatctatgttgacttgaggcaaatataataatttaatgaagtcactataatttaatactgctgcagatgttaatataaaagtttatatttataattatatttggtagcacatagattaatataattaatttagtgaattgtaatctattttccctcttcacataaattcattacacaagtatcttgatttatctttacttatgacagaggaaaattcaaataagaacatgaatcttatttttaataccttaggtattaatatatgaataatttaatttgtacacataacatttgcattgcataacaggtgatgctgtgacttctaaaaataatagatattagacttgaaaaaacaaaagataatttggccataacaagaagcagccaatctctgattatatccctcttgtgagtgaaagtgtagtgtggacaactggtctaccctcatctggctgctgaggttagttgaaaatcttggtgtggaaaatccagaaaagatcagttactattatacactggtaataatgtctctcatgtactgtatctgagaatctgatattcaaaccactaattaatcagaaagtgttgccaccatgatgtgtttgtgtcttagctctcatagtaacttgtttctagacatcgtccctcagtgttaagcaaatatgaaaagttttacaggaaagaatcataatagaggtaagaaagatcttagtatttatgggattttagtttattatgataaaatttaatttatttgcagagcctgaaatatgtctagatttcagttagattttcccatcacatgtgtctcagtgattctgagtgttgcaacatacatgttacacaattacacagttttcttctcatgcatagtgtgataaccttagctactgttgatatacattaacgttctgagaactacagggtccgtgtataaacctggggcactcaccatttgcttacatcattgaacatattgcaaacttcatttatacaggtttagcatctcctgttggttaaagaggtttctgatgctttatatggatgctacatcctccttaaccactccactcatctttgcagcttagattctttgtaagaaagaataacacagtaaatataactaaaggtttccttctgatgctaggaactgaatcctgggcaatatactacgcaagtactctactacagagccataccccaagtccacataaatgccctttagcaacatctgaaggcttactacttttggtatttttgccctttctaataatgtctgggaaactctggttcactcaatgcactagtctttctcacagttattttaatgtggaaatgctagcatttgttctacctgctttgcacagaggaaaaccaaatgagcctttgttttgttttgttttgttgttttcttttattttgttttgttttgtgtttagaaccaggccattaacagtcaccagagtgcttagcagaatgtggtgttcttagctgtgtatctgcaattttatgggtgactgcatgccactgttaatttgtagagctgagtcctgtgatgccttctctaaacacacaagccccaatacatattctgaaccaaaacgttcctttcacattctgtctttgagatgcacacacaatgttttgttcaatgtggtcactggatgtcactgtttctgtaacacagttctcaacatacagatcttctccaaagctgagctgaacatcctgagtggtgctggtcaccctgcctgtgtttactacactgccctgctggcagttaagaagatttccatggtgatatttgactgcgtgtaaattttgctttctatactgaccttaagattttatcctgcctaagttgtgacaccgttgacgtagagattatggagttaaatcatcttattttttggtgaaatggttggtttccacagttgatgaaaatgtggatattattagagacagtgagtgtagttttaccttttcaatacctcagcactttacaattttttcttggaaaatagatcatgtttttccatcgtaacaaattagatattctgatcagggacagagtcctgaatgagaccaaaggaacaacacaaataccaacacaaagcagtggtcaatttctgtgaccacataaaacagtgaaaagggacaaaagttatggagccaggaggcatctttagatggattggctctggggctggaggtatgactcagcattaagaacccttgctgtcttttcagaagacccagctcagttagttcccagcaccaaagtcatgaagttctcagctctctgaaactccagatccaggcgtccatcaccctcttctggcctccaaaggcactgcccacacttgggtatactcaaacatccttatgaataaataataaaataaatcttaatgattaatgtctagacccatctgtacagatgtgaacaaaaccctctagaaacagagggttgtgtcaagaatgaagttagtgctctgggccatgtgaattccatctttgcactttatcacgccctgaaaatcctgcaaagatgtgtctaccagttgtgaggacatatgaggagactacataactgtgtggtttatttacttggatgcagtcaatgcttgccctttaccagacactaactcatgagcaaacattgattttacctttgctgtgacaagaactcttggtaaactgtttgggtagtgtgctacttttgaaagaccctgagagcttccatggagctgtatctccatccttctatccacttcattatcattcaggtcacccccaaaggtgacactgcatgcaactctgaggaataaatggaaaaggaagcagagtgggatatgttatggcatgctgtggcattgctgtttcaaggttggatccaccggctcagcagggcatggccctgtagccatgtcttcacaccattgcttagcatggcctatggggaagcttgccatagaactgactggctgcatcatggtatccacacagaaggcccagttaaatgttgtcaatgaagtgatgacacaaacagggagaatgtgttcaaagcttgttcttctataaacagccccagccctcatggaaagtactacataaaagatttacaaatttcttcctgtcatagaaagcaggattccagccctttcatatatgtatatataattctggcatttgtttgtctttggcatgaatgtcttaaacataatgacttcacccatctcggaactcaatgggaacacttggagaccactgctcctgtcaaccccaccccacttccatatatctctagagaacagaaacatatgcacccagctatgggtcaaggctcatacaatgcccccactgcaaacaagcaaagcaagactctttatttttcatactaatacggccacgtcccattcaggcagaaatgcatcctgtcttttatattatccaactaaaatgtattttgagaatttagtttagtctgttactctctggcatgtccactttataaatagtttttctgcatattttttgtaactcatcttagttgggaaacgacatgcgaaccatatgtctgtgtcatataatttatccttgtgaagagatgatttttagttctagttttgtagaatctctttctacatcacattgatggaccagggtaggtgagttgacataaggcagttgtgtaaatttgaacagggtcactcaaaaaccattcagaggaagggtttgacattgctttttcagacacacattcttaccttggctgtgcattcaacttgtcagacactggacctttgtcatggatccattgctttttcagcagttttctctagtatctgattcgctcttgagcagtcattgtgaagtctccatcatatctcagctctactgagtgagaatggaaatggctgaccagtaaaataaggcttccgcttgacgtctgctgaagctgttggcacgaaggtgaaaggggtttgaggtgattgataattgagattattactgattattgagattattattgattatcaagaggatggacagttatctggggaaatgtaggaaaagattctgcctatagtggctggctgtgttgttggtctgattggaccatcacaacatgacatgcaataattaccagtttttcatcttacctgcactgattcagactttaggacattgatgggaaagatttcatactctctcaagtttgataagatgtatatgtatgcatgcatataatgtacataaaaatcaagtattacaaagactagcctatcttcgaaaggcataaatatagaaacatagtcataggtatctgaggagcatttgaagagtcatggcagtaatcattgtgaatgcttggtgttatctacctatgaaggggtctgtgagctaagatattggatgacagtttttcagaaactgttgggcttcccatggcaagaactaggtaatccaggaataaggaagagccaggtttacactcagtcggtgttgctggcattctctgccctgagagcctcaagggaaccagttgtgtgtgtgcttgtttagatgtgcatttgtgaactacctgaaaaccaacgcaggaggtcacagagaaatgaagccaaagacttgggaatacagtgtcttgttctatagatgagcttgaagcactaaaatcctaccttcttcctcccctttagctatgtaataaaatcgtgttcctggtgagttttgtgggaaaccgaggcacattcaccagaggctaccgagcagtcattctggacatggcctttctttaccacgtggcctatgtcctggtttgcatgcttggcctctttgtccacgagttcttctacagcttcctggtgagtactgccttatagatgatcactgccaagcccgggatgaagcctcgtacaccttagcctttgggattttgttagttttttaagcaagcataagttatgctatttttggaatttcttaggagaagtatgtatcatcatgttatcattgttaggttatgtcatcatcattagcttaagcttagctgtgcatatttaaatctttagacagtgtttttttcagattcttttggttttttttctgagatgacttgcttcactatgtagcccaggctggcctctagctcacaatcctcctgcctcagtctcctcaatgttgggctagtgcctgtgcatgaccacacccaatttcacatccttctcatcgtccccaaatgccacttccattttccatttacttccctgtagtcgtgaacaaggaaaggagttggtatgaacattcagtaaagttgaatttgtgagggatgtttgggtgtcagtcctcgcccacccccttgtctggggcagagtttcttgtttcatcactatggacaccatgtgctctggccactgatgagttaaaataaaaccccctcatgtcaaccaaagtggtgaaaaacgttggagaagccagaacattgacagtttcaaggttgcgtttacgataattagttcatctttatcaaagaatattgacttcgattctgacaatagctgcacttccccagagagaaacagatagcaaagtagtgactttttaaagaacttcactcatcaaatgctgtgtcccaaacacaggctgtgtaaagcagtgattgacgacgccctgattacagtgggaagtaattgtgtaacacagcaaactaagagctttgaggaggaaacgcagtgcctcactgacccggccagcccgacacagtttctagctatcatctccagaaagcaagacacaagtcccgagcctctcagttttgaagataggattaatttcaaacattttgaaaatgaatatagctttttttcttttaactagatctcattcacttgctaattcgtaatttcagttttttaatgtagcaatatatgataaaatggttctcaacactggctgcagacagaagccatgtgcttgagttttgattagtgagtagagatggcctcccattaaagacagataataacgggttagaggaagggaattggcaaaactgttacttttttgtttgtggctctgctttcaaaggtataaatggacacgggtttgtatcctcatttgtttatctttttagtaaggaagagggtccgcatttcccaaatattttagattcagatattttctatggcacaggctcataaaatttctcttcgtttcattttcagttccttgaatggatgataaatttaatgaatttgccaactgtccataaactacatgggcctaagattataaattctctaagttcaaatgtgagcgagtgtgcagttctgcagggtcacaacaaagcgtgtaacacctattatgaagccaatgtatgcacattacatgctaccagagctgtctacactgaaactgtgccttgttttccagctcaatggttggtgggctgcgaccccccccccccgcatatcagatatttacattacgattcataacagtagcaaaattacagttataaagcagcaactgaataattttatggttggggtcaccacccatgaggagctgtattaaagggtcacagcattaggaaggttgagaaccaccgttctaactcaactgtttgggtttattgtaaaatgttatttgtttgaaggttatttttttaattattattatttctgtagctttttgatttggtatatagagaagagaccctgctgaatgtcatcaaaagcgtcacacggaacggccgctccatcatcctgaccgcggtcttggctcttatcttggtctacctgttctccatcatcggcttccttttcttaaaggacgacttcaccatggaggtggacagactgaaaaacagaactccagtcacaggtagcctccctacgctcagagctcttccctgcccttgtaacttgtccaccccttgttggtgggatttcggacaatctgagataaagttttcacttttgaattgtggtcttgtttaccgctgctgtggtttgagggccgggcgtcctcctcacctcctgggtttgaacatctggtccgcatgtgctggccctgacttagccagtggagcctcacagaggaagtgattgactggggtgggccctgcggttgggtagtctggcctcacttccggtctgctgtccacttcctggcagctaacatggtgtgaccggctgcctctgcgctgccttggctgctgccttgtggctctgtatccctttgtactgttagccaaaataaacttcgtttcttcctccagttgctcgttgttaggtgcttgatcccagcaatgattaaagtaactaatacagcatgtaagagccgaggatttgaaatactttagcctgcacacgatcagagtggttgggaaatacacgggagaaatcatctgtgctccatcctacagggtttcgtaatgctgcgtgtacagcaggaggcagcggcagctttgctgcaggagacccgaggattctcttgttcctcttctttccgtttccccaaaggacctcagagcggccgctcggccattatcccgcaggcattgcattatatccaaataacttaaaatgataaatgctttgataaatggtgatcatcaggcagtactaagtgtgtttgagcagatgaacaccagagctgtgcttaaaggaccccagtcttcagtgcatggctgctggagtctctgcatgacgtttgccacccgatcgcttagacagcacccagtgttctcactgagaggccttggcaccaggagctggcctcccctgttgtcactgtcctttgcttctcacctggcatatatacccttgttgctggactaatccctttcttaacctttcccctggtttgcttgatagaaaccatgattctacattgtgctgttttcttgctttcacaaactactgtttatagagatgggaaatcacaaaacgacatcactttctctcccaaaccattgagatttaattagtggaaacatttgcagtgtcctgtctttcctttagcatgtaatccttaattacaaaattgacagtgtatggtgatgtctttaataagattatggaatgactaagcaggggctggtcatttattagtgagtctaaatgggctgcacaagccacagaaacatcagctttacacattttaaattacaacactgggagatactcttgaactccacgccgagtattagacttagttcttgggaatgtgaatgctgttgttgcctcataggctttctctagagtttcacacgcatgctgccagctttccatctcttgtaacaaaaagcccaagaaaataactttaatacaaggaaatgacttattttggcagctcatgttttcagttaatggtcatttagcctcaacacctgagacctatggtgagacagagagtattgtggttgagcgaagattctcgccctgttgtgactttgaggaagagggagagagaaggttcctgacaccccttcaagggtacagccagagtgacctctcactacacactaggcctcacctctcaaaagatctgatagctcacttggatggtgaccaaggcctcgttttttatggcctttgagggacactgaagttgcaaatcattattacattacacttcctgtgtgtggagaaaaggcacctttgtaaggcccagatctcggttctttctaaactccttaggaaccgtctaacctcagcactgtatgagcctcaaattttaattccttgctagattagaggcctggccaccgtttgttcagtggagaaactgaagcattaaaacttacagaacaaaaatgtacagtaggggctggttttcaaattcgatggtgaatattttaagttcttggatgatgaagttagtgctatattatgaatgtacattttttagaaataggaaaaaggcagtataaaacactaaagctaaaatttcaagctctttctctactgaaaatacatatgcaccattttatagaaatcagtcaaagaaaacttttgtaagtactatgaaagtgcagcacatagggacagccagcagacgtaaatccctcatgctccatggttggaatagtttgtttcatagcttaagagcctagaaaaaaaatcttggtttccatattttaaatttcatttctaacacatcgtaatagcatctgtcttaagtctgctttctgttgctataacagattaccggagaccttgtggcttataaagaatagatggtggcgcacacctttaatcccaggcaggcggatttctgagttcgaggccagcctggtctacaaagttccaggacagccagggctatacagagaaaccctgtctcaaaaacaaaacaacaacaacaacaacaacaacaacaacaacaaaaccaaaaaatcccaaccccccccccccaaaaaaaagaatagatgtttatttagttcatggttccagaggctgggggaaatctaacagcataggactttaatctgcttggcatctgaagagactgttctggtgatggtgacagcatggggtgggcatacacacacacaaacacacacacacacacacacacacacacacaaacgcgcgcgctcgcgctacagtgagaagaggcgagctagactttatgatgaacccacgataagctagtaaggcacaagtgcgtgaatccaagcatgaggagagagcccccatgtcttgtcaccccttaaaggctgcccctggttctacccccagatacttcacaaccaggcttcagactgtgttttggtggaagtatctggactacactggatctcggttggcacatggtttctttgttctttgccttttggacactgtcgctcacaaagctgctcagctttgtgaaattattgaggctagcacactccagcagtgggagtcatttgggttgcagatcagaaaccccacagacagggaggtggtgagtcagagctgggctgtgtgtaagtaccttggagagctggggagagtggaggacacgtgcctcgcaggtatccacaggtatccttggagatttaggagtgtgtggatccctcctctggacctaccatctgctgctaagtagtcaggaagctgccactccagcatggccagaacagtgtcatgggaaagcacatggaaggaaaggtcccttgacaagtacacagcactcgtcacacctgtccctcccccattctcatctacccagagtcaagagaacttgccttcctggctttacaacctatgatttccctcctgccaatcccaaactgacattccaaccacagctctgaggacccacaccacctgtgggttgcttggtggagaacactggactagaagcttgtgagactcagcctggtatgtccattggtgccctttggtcctatgaatcccaccccagtgaccccctgggtcccctgcttcatattcatgttcataaatcctgtggctgcattatgagtccttctgcaaaaagctcttttctttctcctgtaggtcttgcatccccctcttcgattgtattattttgtgttaacttttctccatctgtcagctcttgttacaactctgctttttcatatcctgtcagttctccaaagccttggactctgggctgtcagagccttgtgggatgcatcaagcactaaaggaatgccaccaggggtcactcagaactccatctctgtccctctctgaccaccagccatgcgctcttgcccatatcactgccaaagataacactccttctctatgatgtcgcagcacaatgtatggccgctgctgcctccctagccttcccattcctcacatctccttgtgaccccagatcatatttgtaacttttcctgcaatcctctcagtgtatgagtcgaactttcaagtcaaactttgtttagtacaaatcgaaaggtcattatcttctcgccagagaagccactgaaagaggggttcctggggactcaggaagaacagggacctggagtcttttatccttgggctgtttgaagccttttttctctggggccatacttcatagagagaactgcccacccaaggtcctttcctcagctacagggctggtagcgtgagctacagaatgctcactgccctggggagggaacagtcctggcattccagtcagagccctgaacccagaaccctgaacacacctggccgtagaaatgttagtacttgtggaggtttaggtcaatggtattattactactttatcacagccactaaaagaatggaggttttgcacattggcgatggatctattccttatttataaaattgctttagcaggcaaaactcagatctccaggctaacgttaccaaaatgaagttcagttaccctggactcatatgccactgtggctacgttcacttggtcatgtatggacatgctctatgttcttccaggtaatcacggggttcccactatgaccttatcttccatgatggaaacctgccagaaggaaaactgctcacccacgatcccctcttccaacacaggtatgtactggaaaccagtttctttggtgcgcagtaaggtatgttgttgtgtttgtgagagttgatcttggaatttcatgtgctgaactagaagaacagagggcaaatgaccagcataattcaagctagagaaaggatagctctgcacttgttattctgaactctcctgctccccacaatctttccgttcacctgattctgatagattcattttatttaatgtgctgttcccaaacagcagcccacgtgaaggggttttcttctgactgcttggcttctaacaagggatgagaacaacatgagttctgcactctagagacttggctgtaacccctgacctgtcacattttcagcttatggtgtccatgttttcagaacgatgtccagatagcttattgacagaaaaatgaatgaacaaagtctccttcccttctgaggagcaaacagatacataaaaataactttggttctaaactgttatcttaagatgtagcaagatgggctggagagatggctcagtggttgagagcactaactgctcttccagaggtcctgagttcaattctcagcagccacatggtggctcacaaccatctgtaaggagatatctgatgccctcttctggtgtgtctaaagacagcaacagtgtattcatgcatataaataagcaaatcttacaaaaaaaaagatgtagcaagaatctgggaacatggcatgtatgatgtttcccaaattataggaaaaaataatgtatctctggaagtggggaatgaaattgggactatgcctttgtttggaggtaaggacagggcaagtgctctacccatgcgctacagccagccttgtagactgtagatatttatgtaacttaaaagttgacatagctaaagaagagtggagtcagatgatggcaaaatgaactcagagcagatgaggcaagtgaaggcatagactgtgagaggatacaatgtgtttgctcaaggatacttgcagctcacactgatgtcgcaccttgtctcctaggatacaatgtgattgcacaataatgcttgcaggctcacactgatgtagcaccttcctctaggatgcagtgtgttagctcaagaatgccttcaggctcatactaatatagcaccttctctaataggatgcagcctgcttgcttaaggatgcttacaggctcacagtgatgtagcgccctctaccctggtcacgtttgccttgagatgttggattgttggtcagggatgaggtgtcccttccacttactaaatacctcatgatttctgacctagagagagaattaaacacttgtatttgttccatccagtgctcaacaggtatgggtacttgaaatgcttccagcgaggtccttttaccatactccctgtcaacgctcagtaagagccagctcttcttggcttacatggtgttactgagcacacactctctaaagctgtataatgtgtcccttggtttaaacacctcagatctctccatctttccccacagatcacagcagaggctcttgacctcttactcctgggcaaactgctgatccctgctttcacagtggatggcgggagcccccgctagagtcacctcactcaccctctctttaagatttacatttgtttgttttctatttacatatatggcatatgtgtaagcatatgcagaggccggaagagagtgtcacatcccttgacttggagttacaggcagttgtgaactgcctgctgagtgtggtaggaatcgaacccagatcttctgcaatgacaatatgtgcccttaaccactgagccatctctcccagcccacctcacactcttgatctgcatttggctgactgttggcaaaaatgacattctttgatgatggtctaactgatattcaacaaatatctactgtgggctcagacgttagggagtttgggatctcacagatgaagcgatatttatttctatggatctctaccaacccatgatgtgggggtgtggcagatccttctgtgagtatattaggacccactagtctccaggtttcagcatccttccattatgttgaaccctgattctattcttccctgccaggtcatcttggctttggcaagccccaggtccgagtgtagagaatcccactcaccattgtccttcctcagctcttgagctaggtttgtcccaccatccctaactctttgaaggaagagatacaataaaaggcaggagtgacccaaagaccccgagaagcttcatctgcatccttacaagttaaacccagtccagcttctgctctggctgtttccacaagagatgctgggaatactgcaaaggaaacctggaaacactcggatgttcactgtcctgttttatgaaattcttcagctacctagaaatatgtcataaatgggactggacaagtggctcagtcagtagagcactcgctgtgcaagcatgaggttatgatttcaattcccagaacacacacatgcacacatacacacacatatagctggtcattgcagtacacacttgtgaccccaaaactgggaggaagggacaagaggatcctagggctcgacagccagccagtctagctaggagtgactgagacagacaatcacgattggcctctagcttccacactcatgatacacacacacacacacagacacacacacacagagagagaggggggggtctctaataaacggtcattcaatgtgtgttctctctctctattttttttttaatcagaaaactccctgtgaaagcttactagtcagggaacacagtgccagctcgtccccagttccaagtctgtctgtgctgctgcttgccaccatccccacttcccacccccaccaccaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccccacccccgcctagtatcctgtcaaggacccacttgagtatctcctgttagcatcagagtcatttgtcagcagttttcagagtctgtctccatctcaggtccctgtaccttccttttcttttctttctttctttcttttttttttgtaccttccttttctaaggacaaataggcacagtttttcaccccaagtgcagctccctccccccagatctctgtcatttggggtacagaggtggtagcactatgtgaatcttgtagagaaagatgccagagtagggaggaaaaatgggggctgagttctggcccaggaggtattggagacagtactgaagctagaggggtggggtgagctttcctaatgggggaaacccccaatctgaccaaagaacatggaaaagccacaccaatgtccatatgcattgacattcgtattaaaactgatttaaatgaaattctccttgggaactctctgaatttgacttttgtttccataatttaagggttcttttgttgtttgtttgtgtttgttttttaagtagggtatcactatttagccctggctgtactgaaactcatgtggatcaggctagccttgaactcacagaaatccatctgactctgaatagtgatccgacacccccacacacacacccagtggattttatcttctgaccttacttcctttacattttgccaatatgaatagttcctgtaatttgactaaatgtgtaggtttgatcttcagggctttatttcctctaaattttagcaatgtctagctgcagctatttgattgacaagcctatgggtgtgacctcctggcctccttgaaatgttggcatgtgcttctagtcgcacgagtagagagaagctgaagtctggcctttgttgcacaacaagtgtcacttagatttaaaaatagtgtttctctgtctagggctgggacacatttctaatttgtgaactgtggtgtgcacttgtgagggccttggtttactgtcctgtggccatcgggtgcatggcactaaaggcccaggtgcccagtgtgggtctcagaggctggggttggctggcagccagagctccggccccagaaagctcctgaagatgtgggctaggtcatctttccagcagcagagaattcatgtgacaactggccagtaattccacttgaaagacactccaaaagtcttatatttcatttgcttcaagcctgctagaatctcagatggaaaggtttacctaaatccacccaaaattgactttttctagtaaacacaagccttctttagacaatactaaaagtgtaatcacaggtattttgtgaatcaatgccatctgaatgttcaggggaataaaaagttcgcatgtgtttaacatttatgactaccagtttcattctcttggtaccccactttaatagaaaaaaattggtgataatataatttgttaagctaacatatgctatgttttggattcccgtttgggtatcaatattttaaaatgctgttttagttacaaaaacatttaagatcagtgtattcaaaatggatcaattatcattaaagtttaatatgagaaggttttaataacactcagaatttcaagtgaatctctcctccaggacactgtatccatgagagccacaaactacaaataatttaattactaaagtgtaaaatgaggacatcaataagtatatatgttcaagcagtctaacatttctaagatgtatatttgtggttttgtgtattccaagccagaagaaggcattggattccctggggtggagttacaggcaatccaatcgtgtgccacccagcatgggtgctaggaactgactctggtcctctagaagagcagcaactgttcgtaacccctgagcatctccagccagtggctagtagtctttgtttttgtttttttttttttgttttttttttaaataaactgaccaacaccccaggtgagaggagaactgcttctgatctgtagcatagatttttattcctttcctcaaatgaaaccttttttttttttaaatcatgaattaagaaaaatgcttttctggtaatctgctgaaaatggataacctcacatcactcaagtgtcaaacttcttacttgtattaaaaccacgatttttcataagatttaacagccactctacctgggtaattgataacttgtattcattgggccctaacaatacaccaagcactgttctaagttgtgtgtgtgtgtgtgtgtgtgtgtgtgtgtgtgtgtgtgtgtgtgtgtgtataggtgtgacagcccattgtatctgcagggaatgtcttcacccctgatggccaggcctgcccatctgatgctaagtgcagaggccatgccttaggatatccaggcttctatgtgtttgctcatgcgctaacccaactttccagggaaccttaaggctcctgtaggctccaacacttaaacctttatctcttttcttcacaccaaacccttgctatagtgtgataatccaggtaggtgtggcatgaaaaagaccagcttgtcacacacctggccacaaggtggcacttacctatgggagccctgacagactcaggtcaaacagtaaaaccttctaatgaagctcatagaggctgctgtatgagcccagcacgtctgtgtggctattattgagcaacatgatgggaacaatgctgacttgggcatcctccgacagcatgcctgccacagggaaagccagacctcttgctgtgtatttgtagccaacctattttataaagttctattcatccaattttctatatttcaaaaatgtaagtaaccccatgtgtcttttgggttgttttctgagacacggtttccctgttactttggctctcctggctgtccaggtgtgtagaccaggttggccacaaactcacagagatctgcctgcctgggccttccaataaaggcaggtgctaccattgcaggatctgttttgattcttaagggcagccatctgatatagagtgagatgagacctcaatgtagttgttactaacattcttcttgtggctggtgatggtgaacattttatatgtgcttcttggcagccagtccattttatttcactgtggctaatcacatgtagggtgtgtgggattccctagctcccttcttagagaataaatagctttatttcccgtcgtttccatttacccaccaaaccagcacatagtaggttttcagtggcattttctacaggacaaccagacagtcaccaattagtaagtgaatgtatcccattacagttgttcttcatttgctttgattgacagtccatcttctacaaggcagcagtagctatatttcatgacctccttcctggagcccagtaacaatttaacagtggctttcattcttatttctctcttgtttctgtcctgttgatctgtcaccaccacaagactgccccagtacccgttgctccttcctccccaaattccttcacatttctaaatcagaatcagcttgaaggtgagtgcctacacactgtcttgcctgtctcctatgctgtgctttgtgtaagcctgcctgttcctgcatgcagccctcctggccaggggttttccagcatattttaaaatatgtaacttggactcatataaaaatatcagggcccctcttccatataaaatagaatctgttcagaagagagatgtcagccttctaacaatgtgttccacaggcgttggcaatgggccatgcagtgagataacagttccttccccagtgtcagcaggttctataatattcttgccttgacatgcagactgtagccccgggatccatagcctagggtccctagatgcgtacccctgaggggaggctctttaacattgtaacaaaataagcctctgtctttctactcagttctaaaggagagacgctgggctctcatgcccagctgagcaacaatccctgtttcaaacaggttttctttgttgttgttgttttgttttctagcaaaatcttttagtattgggtcaagtctcaggacttttccgatacattatatcttttctctcttctaattcctaaacaggatttcatctctagccccaggtggtcccacaaaaaaatcttgaaactcacttcaaataatgacagaaccatggcggcccccatcataagatcctactactggcgttttaacattcctcacgtggttcttggctaaccctcaaatccacaacattttcctcattttgtatatgaggctgctgagctcagtgacttgcggattcatccgtctgcatgactttacatgctgggcagagagctatggtgaccacagtctcctccactacagttgggcgtatgagttttaaccctgtcattttccaccaagccaagaagaatgaaatctcaagatattatatgcatggtggtacccatgtcagtcatgcgtggccacatgcatgtgctacggatgtcacgtgacttaggaaactgtgctgtaacacatcagaagcagattctccgatgttcacaatggtgcgttttcaaaactctttcatggttgtgtttctgcagccggcgaggaaggtgaggatggcatagaaaggacatgtgataccctgctcatgtgcattgtcaccgtgctgaaccagggcctcaggaatggcggcggagttggggatgtgctgagacgaccctcgaaagatgtgagcaaaatggggtttgctttaagaagcacgtggctctttccttctcacctcccctcggtctctcccttcttgccctccctccattgcttccctcccctttctccctccctcccctcttttctttcttcctgtattggggattgaacctcaatacatattgaaacatatccccagcccactttttacttttaaactttgagactgggagtctcactacatttgtagcccaggctgttcctgaactagctttgtagcccaggctgtccttgaagttgctgtcctcctgcctcagcctccctgcaaagctgggatgacaggcccagagcgcacaggcctggtttattttttccttactagtctggtctggattttcagaactgcagtatcatttgccttaaaagtgtagccgtggctgcaagaccagccaattgcagtgaaatcacagagaaccaggggtgaactggaagcctagggatgtcagttgggctccagtaggaaccttgagttctgttacagcaacaaaatcaaggccataaactctgcaggcgcggactgttatgtaaatcacagctctctgtgtctacagaattcccaggtgcaaagctttactctgcttccgcataggcagagcctccattactcacattgatgagtacagagggtgggtgagttccaacaggatttcatacattgaaactgcaaagcgaaaacatttctcaggaactgtgaacgttgaggcacaggctagaagcacccacagttttcttctgcagctggcctgttatataacatccatctatcttgctaatagtctcggctctcttgcattaaacaactggatcccgtggtctctagtgtgcttcaatactgtgtccaggtagggtccaggtgagctgtatgcacttgactttgtaagaacaagaaaggaactgcagaaagatcaccaggttctcagctggccgtgggttgtgtctgactccctcttgcttggtgtccaggataaacctgtgcgatgattttgctcactgctgtgacaaaatgcccaacccaggcaaattaaggaaagaaaggcttgttttagtcaagttttgttggggtcattctagcatcctggggaaaaagacatcagttagagacagtgttgtgggaagctgggaaggcaggtggccatgttgcttatgcccttaagaagcagagagtaatcagagagcaggtctgttctagaaggcctcagggcccaccccgtgacccatgtcctccaatgagctgccacctcctgacagtttctccacccaccccaaacagcaccatcaggtgagggctaagggttcaaacacatgagcctgtgcagacattccacgtctaaaccacagcacggaggtggggagtggagggggcattgtgtaaaacacaaagagaaatagaagaatcctgagagcaagcctaagacattttcccatagtggagggaaaaataaagacagaaaaccgttccattttccttgctgtggccactatttgtgttctcctggaggaaagctgttgactatctgctgtatgccagacagcgtgccaactggacagctgtgaagcaggggtgtgttctacgcgtgttctgcacttccattgtaggagcgtgtgttctgtgtgtgctctgcatttctgctggaggagcgtgtgttctatgcgtgttctgcgcttccgttgcaagagcgtgtgttctatgtatgttctgcgcttccgttgcaggagcccttgtttgctgcccgggtagtctacgacctcctgttcttcttcatcgtcatcatcatcgttctcaacctgatctttggagtgatcattgacacgtttgctgacctcagaagtgagaagcagaagaaagaagaaatcctcaagacaacctgcttcatctgtggtaggtccccacccccacccccaccccactcacacacacaccgtgctatgacaagagatgggcgaatcatctccaggtgcaggataacgggtggggaaactgtccagccggaagaggaataacaatgattttcatttttcatctgttaggaaaaaatgctattgtgaaggctggatacaattcaggttatgtaacgtcacatgagactggcattctccgcttccaaaaatagatggaagaaccatcccaaatgcttctgtcattatttcttcaatttatacagtcctctggctgtagagagtgctgccagatgccgggaggttctaccaactggcaaatgggtttttaatcacagtagcatgttgagtatattatggagtgacgtttattttgctagattatgaatacaaagattctgctcattgatattaccgtttaggatgcaaaactaggcattcttctagtgttatagaaacacatatgtacatatcatatgcatattacagaacacacaaacactgtagaacacacatgcatacacacacatctaccataatgccccacacagccacactacacacatgtacataacatatcatgcatatcacagaatgcacaaatactatagaacacacacacacttacatctaccataatgccccagacacctacactacacacatgtacataacacaatatatatatatcacagaacacacaaatactatagaacacataccataatacctcacatatccacactagacacatcctacaggctgaacacacacacacacacacacacacacacacacacacacacacacacactgcacatgagtgcacacatatcataccttttttttctgcctatcctcatctcttaggatgaaccaactttctcttcattgtggtctcctctcagaccctctccctctctctctacccatcagccctctgccttcacttgccactgtagtcctgtctctgaaccccagactccatcagttacactcacccctcctttctcctgtcctttggtcttcagtacagtggcctcttctccccctgcctcagatttgcttgatcatctcattctcctctgtggctcttccaaatgttttcatcatctctctaactgggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccctcccatcttcttcttcctcctcccccctgcttctcctcctcctcctccacttccccctcttcctccctttctttagtgcatttgtatccatttttctctcattaatctttcaaatctcagtccatgtgcattccttactgttcacatcctggactctagtgtattcacagtagtgggagagtgttctggttgaaattccaaacccatatggtaaacatgggggctcctgaatgactgtcatttgcctctgcccggtgccatgcaccctcacgctgtagaggccatgtgaactccctaggaaggtagacattgtctcccacagtcccgcaccctgactatgtaaccttggccaagcattttactctgagctgttctctgctcctctggtataaggagactctatggccatgctttggtggtgcgttggctatgataaagatcttgtttataaaatctcctagcactgtgcgaaggtgaggctcactgaagccaagtattcttctttgagagacataggcccatgtcataaccattatacctccatttcatgcatgggtctcattcgtcagtatttgttgatgatgactagacagtaaatcagccccacatctacattgtctctacacttgtaggacctgtcagttacgcaaggaaagtaaggcagagcaacactgagttgatctgtattccctatcaaaaacctaggtgcaggctagggagatagctcagggaagtgcttgccaccaaagcatggagacttgagttcaaatgcccagcacacatgtggaaagctgggcccagcagtgtgagcctgtgatcctacttaggaggagaggcagaatcctggggctagctggccatccagtcagatcacaagcaaagtagaaaagccattgagaaaacacgtggcatctacctctgcctcactcacatctgcacacacatgcccgtatacagcacactggtatacacactaagcccaggtctgatgattacagatagtttcaatttttgccacccagtgggtattgtctcagtgtcatgacattcccttggggatacatgtgatgtgtccataagttcagggtgatattagatcaaccaagtcaatagtgattttctggaagctccatgcttattcaaaagccagggtggggggggtcatttggtaactcaatcttatcagatttttatattacaacaagtagaatatctttaagtaaagcaaattagtgtttctatttaaaataagattgaaactttggttaagcacttggctactatgtgtgaaagcgcaagtttgatccctttgaccaaaggaaaatgatgtaaattagggataagagtgatgtcacagcagtgaagagcacacactaagcttgcacactggactgtgggtcctagcatctgggctgtcatacactcatcccaaccattacaggcttacaagtacctgtgacatcagcttggggattttcatgccctcttctggcccttgtgggcacctgtatacatgtgcataccagcacacacacacacacacacacacctgggtttctctaccaggcaggtagatgtggaaatagaacctgggaacaaaggccagtctgggtggtaatgaccaggactgttatggctgcccttgggactgaatgccacaccacaccacagagagcagaacctgtgaggatgaaggcagcatggcaccctgtcatgattctcctctgttgtcctggctccttgccctttccagctgttcccttctactgtctcctaatttctgtgtgagacgcacttcacggataattctgaagctgctgtctctgcctggaagtctgaagcaagaagggaaagtgtagttttgaatgtaacgctctctagctctttatgtgtgtcccatttattgttttgagtgccacagcagcggaatgaggctccccacactgggccacctaccttcacctcagcttccccatagggactcttctgccctcgtggccctttagagtcaggactggttttattcactgctgattcttcccacaactggaggagttaacttggaccaagctgggtctgtttcttgatgagtataaacgtcatgttggatgctacactatttggatggctttgtgcttgtcagcagaaataggtgctcgataaaactctggaggcttttacaagcatttacctcttccttctaagagtctgtgaagtccttggagctgtgtatcatcttgtccccctttaagcccccttggccatgcctatggctttagtacacagcatgagtctcctgcttccactaccacgttgtaggctaagctatgataaaaccattactttaacattattattttattactttgcaaacaggagaagcttgaatgtaattctgggggattttactttaatactttcctttgctaatagctgcatggagatggaattcacacaccttacggcttgcccacttgatgtctacagttcaatgcctttaatatattcagaactgtgtatagaacatcgggatccattttaggacatatttactgccccttccagtggcactcctcagcctttatccatcgtgttcccagcagcctcctgtcaccctgtgccctgggttacactgatctgctctctgcctctgcctgttgtgaagattcagtcaagatatctggtctctatgaccagcctgatgctttgaaggctccagtctgtggtagacacttttctcgtgactgacagagtctgacataagcagcctgaggaggaggggtttcctttggctcacgttccaggagatgtacaggccgtcatggcagggaggtgtggcagtggtgctggcacctaagagcccatggtggctgtggaggtcttcttgcttatatctcagtagactgagaaggggcggcagatgtggtcatctggcctcccaggactccagcccaagcttagggtggtgccattcacacttagggtatttcctcacccctcagctaatcctccctggagacaaatatctgtagtcagaaaacacacggtaaataataactaccagaacaggcctggtagcacgtgcttacaatcaggaaacggagcattaagattataagattgaaaccagcctttcttacacatcaagtttcaagccatccagggctaagtagtgagatactgtctcacaaacagaaataaaatgagaggagaaactgataaatgtagatgtacatgcagatctccggtaagcacattccttccatcagtgctggcctgcagtacgctctccttagcaatcatggctttttctattaccttggatctgagatccagcgcaacttaacaacattggcacagctgttgtcagtctgattggatgtgataagcaacacaggatgggagggaagagtgacaaggagcctgcgagccagcaggataggaagggattggctgtgtgaggaatggcattgtcatctgtgagggttcaacagcaatgttcccagatgagataaccaagaacacacagtgaaagagtttcacagccagacaactgcctagccacagcccttgatgaaggagtctgactgtagaatgcaagaagccagcatgactgcctcggaactagcaagggggtagaggcaaggaggcaagatgagagcctcagtgggccaggccacatgggagttagaacataaatgttgcatgagacacaggcaaactaaagtctccattgtgtttaatgttctcatctctaggaatgagcaccaggcaaaacctctgtaaagaaggagtttatccgagctcatagttcagaaagtacagaagacacaccttcattgcaggcaaggcattggcctggaccatagcctgccagagtctgagggaggcaaggccttggcgtggaccatatcctgcccaaattcaaggggctgcttgctcgcatcttggtagataaggaagcagaaagcagatgatgttggtgctcagctggctttctttttccctcttgtctgtcctttgtgcctggcctgtggggtggtgtctcccacatacagggcagtcttcccatatcagttagccatctctggaaatagcctcatggacatgcacaaaggtatcatttaacccaatcaaattttaatcaatcagaaattgtggagatagttcagtgggcaaggtttcaagcatgagagccttgagcagcctccacaggtttgttaactccagcctcgtgggggcagaggcatgagcatctctggaggttgctagctgcctgttatttccagcctcgatatgagaacctgtctcatgtgcataggtcagagagtgagagagaagcacatacacgtgcactagcacacatgctcacacacacaagcacatgtgtgcatgattatcacactgcccacatggaattcagctgtaactagatgtcgatagtttacctgacatacagtttacttaatgcttatgtaaggccttcttacaggctattgtgcagggttgctgcaagggccatagtcaaggacggtcatcattggtcaggctttccaagtcattctagcgtctgtgctgagagaagagggcacaggggacacaggcatgtccaggcagccagtgagatgatccacatataagggactgcatcagcagagtaagtgttcaacacagacatgaatacgtgctgaaggaaaacaaagaacaagtatttcagcgtgcattgggcatggagtgtgagaagcagagcgatgtcagggtgattccccaggcttatgatgtagacaatgatgaagtggcctcgaagtaaagagatgaaggctgtgtgtggggggcggggtggtggtggctagagctcactgtggcattggtcaagggaaaggaggcacagctgggttttataccatcttcattaaaaaaatccaataacataattttaaaaagtcagctcatccattggggacagatatcttaaaatgtatttcttttgtaactttatgcctaagtggcttttgaaccatgcccagagaaggagtagccaggattggaaattcagtctgctgactccttccccagtatgtgaacatcaagggcaaacccaaccccggcatctcatccccacaccggtaggacgcagttttccacagatgtttctcttcatccctattcactttctctaataagcttctcgcttcaagaggaaaatgtgactacttagatccttcccacaattccaccagaagctggaaatgtggctcggtgtgctggctagttctgtctcaacttgacataagctagaatctgagaggagggaacctcaacttaaaaaaaaaaaaaaaaaaaaaaaacctccataagatgggggtgtaggcaagcctgcagggcattttcttaattagtgattgacgtggagggcccagctcattgtgggtggtaccatccctgggatggtgctcctgggttctataagaaagcagcacctctcatggcctctccatcgggttctgcctccaggttcttgccctgacttccttcaatgacagacaatggtgtggaagccgaatcaaccctttcctctccagattgctttggtcagtgttctatcacagcagcagggttactaaataggccataagtgtgtttggggaaggattgtgtaaggactttagaactttgtagtctacaaaagccattgagtgttgagagctcagtgggatgttctgtaggagcttagaagacaaaaatgttgaactcagtgcagaagatggaggcctggcttgtgatcttccaaaggggagttcaaagaccatagtctgtttgtttttgcgttaagatgctgtggttctggttagctggggctgaagcaacagctgtggttaacaggggacagcaccacacaagtgaaacctttgctgacaattgatgctggttagctggagctgagacaatagcagtgattgagaagggaccagcatcactcaggtgagatcttctgggaagtgtttcatgagagtcagcacacagaagctgcgtttcagagatagccaagggtgtacctcgtcttggcagccaaggttggtggtgtatgagtcactcaagtgctactagttttgaaggcacgaaggggtcatgagaagcggctgaggcttggtgctaggtcaggaggccatttgtgaaggtgcagcctcagtagtagttgaagacccaggatttaagggattatgcagagaagagaggcttgacatcataaagagagcccaggagaagctattggtgaaagtgaagcccagttgcagcagaaaccccagcattttggagatgtcattaccatgggatgaccaccaagaacagcagcagcagtaggttggggcctgcccaagcttagaaggctagctgtatgtgctgaagagggtggagccagataagtgacccaagcctcttagaggagcccagaagatcattaatgagtcccagatgctggacacggagtcatgtgtactattggagcttgattttgctttgatctgattatgactgggctctgactcttccctcttgaaataagaaagtatttagtttattattattatttttatgttataggagcctgactacacttgagagactttgaatttttttattaaaaaatgttgaactttaaagtatttgaatttgtaaggctgtgggactttcaagtctgtgaaacgtcttatactgtgacatttatactagttaatgtgtaatcttggggatgaacaagaaaggttatgactttacagtggtgagtttgtgtgtcaaggtgacaaggggtcaattgtactggctagttttatgtcaacttgacacaagctgaaaggaaggaacctcaactaagaaaacacctccataagactaggctgtaggcaagtctgtagtcatttcttaattagtgattgatggggagggcccagctcattgtgggcagggtcatccctgggttggtggtcgtaggttctattaagaaagcaggttgaagagcctggcgtggtggcgcctttaatcccaacacttgggaggcagaggcagaggcaggcagatttctgagttcaaggccagcctggtctacagagtgagttccaggacagccaaggctacacagagaaaccctgtctcaaaaaacaaacaaacaaacaaacaaacaaacaaaaaaacaaacaaacaaaaaaagaaagaaaaaaaggctgagtgagcaggccaataagcagccctcctccatggcttgtggatcagcggttgcctccaggtttctgtcctgtttgagttctttccttggcttccctcattagtggacttggtgtggaagtgttagccagatgaacctttctttcctccctaacttgctcttggtcatggtgtttcatcacagcagtagtgactctaactgaagtggccacccatccccaacttccccaagtatggtggtctaggggcccagaggagtgtccttgtccctgcatgatggctgtctcgggtggaaggcttttgctggttctaagtgactctaaagacatggctcagttgccttcctttaacccaaggcctaaatagaaaggaatctcttttgtttttccgccatgatgagccagtattttttgtttttgaaatctttgtgtatggctgtgtgcgcgagcacacttgtgtctgcgtgcatgtgcactggcctgtgtgagtacagacatacacatgccaaagtacatacatgtgcagatcagaagataactctggagtcacttcctgccttctgccttgttttaaggcagggtctcttctgtgtttctgaagcctgtgagcgtccaagcagttctcttggctctgcttcctgtctcacaggaggtatgctagctacagaatcactctactgaacttgactgttcatggattccaggaatcaaacccaggtcacctggcttgggtgacgaatgcttttacctcctgagtcatctcccaatcccaaaatcactctttctgaatgatggctcttgcctctctccactacacttttgttctggctgagtcggatggtttttctatgactacccttagatgacctgcccctctcatacctgatagaactgcacattccctaggaccatggggagagcacagatgttcactgggagcgagtctataaaccgcagcctcttctacctagagcttttgtatactgttgctttcaattatagaaacattttaaagtggcacgcttccccagaaaacaggcttgttgttgattttcaataatggctgtgtctgatctttatgctaagaagtcctgattaagagaaaggtgacctacacagtgtttgctgtgctttgcaggcctggagagagacaagtttgataacaagacagtgtcctttgaggagcacatcaagtcagagcacaacatgtggcattacctgtacttcatcgtcctggtgaaggtgaaggacccgacagaatacacagggcctgagagctacgtggctcagatgatcacggtgagtaaggctgccttgcctggttctgattcccaagctgtgaccagatcacagctcagaggcccatcgcatccttgtctcccctaccttcctctcagacaagaagtgttctagccctggatttgagcctttaaatatgcctgtcaatcactggacattttccacattgctgtcgtcacccttcttatctaagcaaatctgtccctggtgcatagatagcatccttccagtggtaatctgtgtagtgaagagcttcccgttgatgtagtgaagagcttcccgttgatgtctctgacctctgaccccataaccctgtccccaagcttcccgagacacttaatcatcactgggtcccattactggatctctcaggctccgaagctggaaccttgacattgttacttgtaaacaaaggaattatgtttcaagagattccttgagttttccagaactaataattcaagaagtcctgtgtttgggaatgtgttgttctaagggagctggtgaagagagcgctgccttctggtattataggacatccgactggcccttgggctcagtcctaagagtagtgtttgctcagcacctgtgtgggagagaggggtaaagagtgagataagggaggcaaaggaaacagaaggaggtaagggaatggggtaaggagagtgtttctagacttgaccctgagggaataggtcacctatttaaagaaacaaaaacacaatactggtcacagcatgtccatccatccatcatccacccatctatcatctattgatccaaccatcaatcatctaatccatccatccatccaatctatctctccatccacctatcatctatatcatctaccaatccatccatcttctatccatctatctgaatgagtatgtacacacacacacacaccttctatctatcaatatatccatccatctgttcatctatctgggtgttgtcttagtaaaagtataggttgccacagtgctgatttgcctgccttcctgtcagtagccatgtgtctccagagggctgggtataaattgaccatttctagctcagcatctttcttttgcatggaaatctttcagaggatgcagtgtaaagaatgatacctccctcttcagtagaactcagagctcggttctgaggaacaaccaactgaaagtgagtgtgccaggtttgcccagtcatgtggtgagaatctgtagaggctgagagtcacagagtgatatccagtgcagaaaggtgatgggaggtgtctgtctgtgtgtcctgaggagtgataaatatacatggcagaatttgttctgtctgtgtgtcctagacgtgttgtgtttgtgtgacccgaggagtgatacacagggcaggactgtgaagatggggtttgtctgcttgacccatgagttcctgaaaggagcagctggaacagcagctggaagtgagtcacttggaccctcagaggtattagttagttctcaccatcactgtgacaaatgcctgacaaaactcaaaggaagaaagatgtgtgtgtgtgtgtgtgtgtgtgtgtgtgtgtgtgtgtgtgtgtgtgtgtgtgtnnnnnnnnnnnnnnnnnnnntgtaaatataggagaaaagtaatcaatgcctttaggcactcacccttccttggatgtggttacacattctggatagtgtttgtgggaaacatttccatccactcgtaaggagaaaacacatctgagatacagaacttaagatgtgaccccacagctgctatttcaacatttgagtagattcactaattttgtgtttatttggctcctgttaagtcttttgcatggaaatctttcagaggatgcagtgtaaagaatgatacctccctcttcagtagaactcagagcttggttctgaggaacaaccaactgaaagtgagtgtgccaggtttgcccagtcatgtggtgagaatctgtagaggctgagagtcacagagtgatatccagtgcagaaaggtgatgggaggtgtctgtctgtgtgtcctgaggagtgataaatatacatggcagaatttgttctgtctgtgtgtcctagacttgttgtgtttgtgtgacccgaggagtgatacacagggcaggactgtgaagatggggtttgtctgcttgacccatgagttcctgaaaggagcagctggaacagcagctggaagtgagtcacttggaccctcagaggtattagttagttctcaccatcactgtgacaaatgcctgacaaaactcaaaggaagaaagatgtgtgtgtgtgtgtgtgtgtgtgtgtgtgtgtgtgtgtgtgttgtgtagggggtgtgcgtgagcccgtgcactgacatgtggtaggggattgtaggtgtgttggtgtatgtgcacatgcctgcacacgtagaggccagaacttggcaccaggcatctaaatgtgtcactctctacattatatttgttcttagacagagtctttcatcaaatctagatgtagtggtttgaatgagaatgcccccatccccagctcatatgcttgactctcgatctgcggttggtggaattgttttgagaaggattggaaggtgtggccttgttggaggaggtgtgtcactgagggtgggttttgaggttttgatagctggcacccttcctggttaactctctctgccttgtcttgtggatctctgggagagtgctcagttgctgctcccagcaccatgcctgctgccatgttccccaccacagtgctgatggactctaaccctgtggttccatagccctgtaaaccttttcttctataagttgctttggtcatgctgacttaatcacaagaacagaaaagtgactatgaccctagagttcaccatcatagtgagattggctgagtgagctccaagcacctacgcatctccaccctacccctccagccctggaattgctgtgctgccatgcctggcttttgcatggatgctaaggatacaaactttagccttatgctttcaagcactttgcctactgaaccatcatctaaaactgaaaggtttgttttgttcgtggttctgagggttcagtccatgaccacctggctctgtatttgaggcccagggcaaagcaaggaatcctagcagtggtgtatcacacaggaggctgctcacctaatggccaacagaaagcagagctgtctacagcttggcccacaagaagcagaggagaacaggaagggaccagggcaagatggagaccctaggggtatgccccagtaacctattcttccccatgagacctcaccttccaatagtctactcagatagcaaatccaccagtgtattaatccactcatcgggtcagagcctggtggtctaattgcccaatgaaattgacagtcaaggtcaatcaccactaagggcctccttagttccccagtctcactgttcatgactgtgactcacttataggaagttctgagagatggcagaaagccagctgagcaacaaatgttggcatctgagtgtgggttcacaagtaacagaaatccactgattgttattgtcaaggggatagtgtggcctagcatagcatcaggcaggggtgcaagctcatgggaacggagaagataaaaacacagatggtgtctagcagtaagagagagtgagatgacaccatgggaggactggggaggaggagggccagacctaactggaggggaggagggccagacctacctgctctgctgaggggccctggggcttgtgagtgagtcccgaatctacctctcaccatcatgcaaagtggagaaactgctgtgttctccccacagacaacagtgttctgcagggacccagcagccctgcctggtacagcgctggtacatggactgctgctcttggtgattgatcccctcgaatgtgttgctttgagacgaggccttgctttgtcatccaggttgtcctggaactcatgatcctccttttttccactcccctggtgctggcactacaggcctatgcagccactatccctggcaagtgtagcaacttaaacagttcttactgtgacagcccacatagggtggccatcaaagccgataggtgaggcgagtgaagggagacagcgtgaagagaaagagatagaggccaaagcagggctggaaaccttctgcttaggagactgtagacagacagacagacaaccgatgagtaagaagacctcagaggccccaagggcagggctgggatgtcagtgttggagttcaacggccacaagaagccagaagggagaggcaggtgtgagctctggattctgtgagatggaaatctctccctgcagagaaatccacagcgaagacctaacacacgccatcaccgtcttcagcctgcacattctgagcaagcgactttatcaggcaatccctcttgcgtgtcttagtatctcagttcttattcatagtcctgcccatgccttcatacgtcagagcccttttccagaacaccccaggagagataagaagagcccacaggctcaggccaggaaaagccttgtcctggctgtgtgactctaagagaacaggcttcttccctgaattttaatggacaggagggggggatggcatattagctcaagacagctcctacagagagcatctagcacatgcaattccacatctcaatcatgagctcacagtgcttcttggggttagaatcagaaaacatgttaccagtgacagaatctatctaatattaatgagacctcgtctgtcttaacgagaaccctagaaacatgcgtcttagtaaccagggcacagacaaagcagatacttctgggatgtggttaaggaaagtgttggcagctcaaagttacgtgtgcacattttctcctggcaagcaaaccttcctcagtgattggaggagtgtcacttggcactactgttcagtggggacagaatatgagaaaggaaaaagttggagcagccaagaaaagctggggtcgagaggcagaattcagcaagctgggtgaacatgtaggaactccgcagcttttctaggtaaccgcctttgagcaccatgaagcctgtttgctcttcctcttaccccaaagtaacaggatgtctgaggagcagcaaacagaacagagactgttagacaaagtgtgtaaggcgtctagctgaccccccccccccaacaacgggggacattctcccacactcagtgtcattgcagagatgcattagggtctttggtgatactcgctatttaatttgacaaaccagcactgcacatgcaaggaggtccctgtgcatccagggaatctatctgtctcatggtgctctgatggcactgtctgccccttggaccccttagttacttgtcctgtgactgtggcttttaaggccacttgataaaatatcacacttttaatcccgtctgctccttcgactcttaaatgactagtacttcccaaatttcaacatttttgttagtgtgatgacctattttaatgaacatacacacaactatacgttcactgaaggccataccaggcatgttgtggttcatttttctgcatactactggggtggctgatatctgatataggtattagaagcagttcagtagacatgggttatccccaacgtgctagcaactgtgctaaaggtttagtatacagctgaaggagttgccatttcctcagggaagctcaaagcatttgctgaatgaataaacaaaacaaccaataaatgaatgaacgaataattttgttttagccctctggtagctggatataatagctggatataatttatagaaacatgcaccagaatagttatgacaggaggttgaaatttgaatttctcgtcctgaaagcactgtttcctctctttaaaaccagaaggtgaagataccaccacacaggattatgtcacccacactgtctttcaaggtggcctctccctggtgctgctgcagcccagcatcagcctcccacatacatccacaggagggtacctcactctctcagcaggggaacagggacatgaatggggaaggggagcttccagtttatcttggtctcaagaatggatagcaacaaggaagagtttctcactaaatgcccagagagcagcttacgagaggaagggtttatgttggcgcatggttcagggagtgtagttgatcgtgcatggcttgatagcagtagtacatgagaccacttacttggcgagtcagcagcaggggcaggaggatgcaagcgcttggcttctgctcaccctttaatctctttattcagtctgcagctgatgaggagcccatgaggaggtgactcacactggggtgggccttccctcctcaagacaagtccctctggaaatgccctcacaggtgtcacacccagcccgtgtgtcctctaggtgatgctaaatccggtcaagctgagcctgaaggcgagccattagaagtggcatcgcctttcctgtgagaaaaagaaagctaaccactcaccactgtagccacacaaggagcgggaaagactaatgactttccacatgttgatttcagtctgcaactcgaaatccatcttgtttagttaaaccatatttgtgagcggtagcccccgagggcagggggtgtttgggttcacagaagacatcacattgtctgaggtttatgtgtggtttgacggtgccattttccaactagatctcctcctgcgttattgttatgtgttataattatgaaattatatgttctgactccattcttttaatccacactgattgtgtaattggatttaatgaagccaattatgtaactgcttcatttttaactaaagcacattttaaagatttgggggcttaataagacacttttgaaaatgtttccatggcagggccagccacgcacttgcagttcaagacacacagttaagtcaccacgcacatgcagacagccaccaccttcactgcccacattgtaagtggagatgtgtatcttcagctccagagggctggggtatgtcgccagcacgcaagcccagtacattgttcttaagttctacttagcatttctacagaaggtccatgaattgctgccttttaacatatgtgttcatctctttatcgtcccttccgctgttgctattgtgtgacacaagtgctgtgtcagcagtgtgactgcctgtcaccgtggggatcctgtaccccacactctgaatcccaatgctaaatgtggaggtaaaaggattgagcttcatagcatcaaaatgctgttggtagatgaaagtgacctgggggtggagctaagggcaaaataatcaaggtaaggccaccacccagcagcagggcactaactgaactgatcagaaacttcaggaagttgtcaataagccttggaagtggggtactggtgcatgctgcgcctttgctcttgaatttgccaattgattgatgaatatatacattgggtcagtcagaacttggaacagaagccaggtggactatataaaactgggagtatcccactgtccctggctgtcctgtggtaggcattcatggtggggaacacctttgagtcgggctcagggcgacagggagagatgacatctgcagagcttgagacggtgggtaattccacaacaaggtgttctgagctattttagtattcacacaatcccatctctgtgcacaagttagacatggtctacaggtgagcaaagcccttttgaggaatttccatgtagattcaataagatcacacatgctaatgaccttgaatcttcatcaaagctgcataacagccaagggggttctgatagtgctacccccattatacatttgagcagattggggtagtgtgctggtgacacaccacacaggggagtagtcagcacaagcctgttggtcaggacccctgtataatagagaagctctgcagacccagtctgccagcccacgctgtcctcagcccacccagtggcacactgggtcctatacagaggagtgattttaagaattcagtccacagggcaggagtagacctggccgggagacaggaagtcagatgacaggcccacagtggcagggaagcctgagaggaattctaatgggaagagagaattggttcccagccggctggcgagggagggaggctccctgcaaagacaagaagaatcataattgcagccatgacagcacagactgtctctgttgatttgaccaggatttttctggacagcactctgcaccagatcatgataaacacaagagtcgagcatctccttcctcccatgatctatagtgcagattcagtctggagagaggtaggacagacttgccgacagccagagagatctcaaaacaagtcacacgtgtcattgttcccccacagaagacgctcccatggtgctaaggatggcgttcctccctggacctcccacacaccctagccccagccagctttgctggtacactatagctatcttgatttaaaaaaaaaaatgctctggccacaggcttggtccttgtgtgcaggctgcaggaccttccattgcccagcatcacgggcttctcttatcatcctccatccattgcttccttttctttcgtcctcactgccttttgttttatatatattctctccctctccctttctctctccctctttacctctcccctcctccctcttccccttattcccctcctccctcttccccttctccccctccttctccctcttcccctctccttccccctcnnnnnnnnnnnnnnnnnnnntctatctcctccctgccccccccctctctctctcatttttctggcttttgagacaagggcttactcaatagtaagtccagactagtcccaaccttgccatcctcctgctccagcccctggcatgtcaggattctaggcatgagcctcccaacatgggtatttctattaatccttgtattattgtacttgcgggcttccttattcatgctacagcacaaaccccactggcacatttacacatttgcacagatgtgttgttctctggtgcattcctaatccagaatgggtgcctggtgcacagtaggcacttgcatagattcactgaacaaagtaaacggagcagagaggacagagcagcagattctgcacaagggggagttcacagatgagaccctgagtgaagctgaacctgaaaactgagggttttgacagaagggccagagagaaatgtcgtccaggcaggagggaggaagaagggacccacccatccaaagcagtgtgtctaagctcccacggttgcacagccccttgttaggtcactcaatggcacctgtcacaggaagattgaggctcgttcaaggtggtcggtgaagcggagtccaacccaccatccttccaaggccaatgtctgtgacttaactgaagccaaatacacacaaatcgaatattaacggaggaggagattgaagtcagaagctaagactgtcgggggaggggaggaggccttctgattctcctgtttgcagaaataaagatccctagcatctaacttaacagtcctagaagtaccatcaaaaatgtcttgaaaatgcaagcttgctgtttttagtgtctgaaagacggatcccctcaggaaatccaagtgagcccattatgtgttccaggcactacgttggacctagggtggcaggacaaaccctagggggggataatgtgtgtacaatccacaaagataacattttagtctttttcttcaatagggtttctacacagtgtcaacagcgactgttatagagcagatacaacataaagatttcttagccaggaaagatagctcagaagttaggggcacttgctgctcttggagaggacacaggctctattcccagaaccccaccccacccccatggtggctcacagctgtcataactccaatctcataggatccagtgccatcttctggcctctgtgggcaccagacccgttcaattaatatatataggcaagcactgttacacataaaataaaaatgattaataaaccctcccaaaagtattcatgaactgatgatgataaagtcatatgtcactcccgtgtccttggtgggtttacaaggttgccagggagactgtgtagagtgggtggaggaggggatgctagccctccagaaggcgccgtgatgacagtgtcttgaatctgattatgctgtgtctgtgtgtctacacagatctagtttaacacatgtagaaccagagaggagaaaactttctctaaaagagtgtaactttcatcagccatgaacctagacatgtctgaccagtcagataccttgtaacccgagatgataaggttttctgtgaaattaatctgcaattccatgtgtttagagaaaatgacccagatttgttgagcatggaccccctagtcatttatcttctgcttacagagtggtgttcatatctcatattcttatggccccagtgaaaagctctctccctgctgtgccaaagaaaggtctcatttcccagtcctggtcattactgtaagatcttgttgagttctcggctagctctctggaataataataataatatccacactgttaggactgatacgttgtactcagaaatgctggctttcttccagggagtaacagataccgtcacaatgtgagttgtgggaataagaatgtacagtaaatccgcaggaccttagctgacagctttaataggccagaccagcccgagctgcattctagccggttagtcaccccttagatagtcctcgagttaggtaaggttatctggcaagctcatttccataggggttttgtgctaactatatctttctttaaaatcttggaaaaattaatgctgaatgctacaacagtgatccagcatttgttttttcagaggtcagccgcttgatttcatgttgttgggctctgatactctgagatttagagatgaaggtgttttgaaataatagcactggagttaagtgacctcagctccctgggtctgtctcctcacctctaaatgatgagtgtcttctatactgagatcctgtgtggatttacgtgcaccctcatgtctactgaggtgtgtggctcacagctattgcacaagtgtttcattgtcccacgcctactgaaaaatctagtataattcaaataccatggccagatttaaatactaccttgcatttgtgaagtattcttaggccacttaatgcccaaccactctgctataaggacgtacttcccaataagtaatcaataaaggctcagctttcctgtgcctgttaagtactgagcccctgtctttgagcctctgttaacctgaaagtcagggactgcataaaaaaactgtattgccaggaactctggtccacctgagctgtcaaggctctaggatagttgttaccccacgccatgaattgcaaagaggcctgcagctttgcaaagggataatcccctggggttttccttcagctgccttgggtatgccaggctaggctctaaaggtcctgagtcctgacactcagtagccctgtgactgtgggaaaggatgaattccaaggacttggatgataggaatctaggtgatttccagggactctgctggcttgcttctaaaattctggtaactctaatatttgatgcatatctttacacctacttttgagagttggcgtttattttacacggtgaaaaaaaaaaaaactatagcaagggatgtgaaagatgcagagtagccgaagcctgtttcttcactgtggttggggtaggtgtggtatatggacatgatgctatgcttggagtctggcagttgtagcggaggatttggatttcttcactgtgggtggggcaggtgtggtgtgtggacttgatgccatgcttagagtctggctgtctagtcacattcacctgtcacactcatggttacttctctgtctgaaccccagaaggacaaacctaatagggacagaccccaagtttctctcaaatatctagagcaaagccttctgaaaaaacattccagtgcaattctagtagggtaggagagctgggacgtgcctcagctcctcgaatctccattctcagtcaaggacccagtgtggaagcaagaaattcagtctgcaaatggttctgtttcagaactataggcccttggtaacttggtccctatcacgtgcctgaattgagggtggatttcatgaaggcatatgtgcgatatagcaaagccattcacaccacagcagctgggagggaaaggagaaagggcacggtccccaaatccccttcacagatatgctcccatgacctgctaccttcaaccaggccttactgaacaccaagcctctaatgtggagtcattgaggaacagaccagacccaaactagaactagcccatagcagcctctcctggaataaacctggcacttcttgttatttttccaaagttgcatcttagtttgtcttcattgctcatttttcgtttcttcatataacttctttgttcctttcattttcctatctacatttcatgagcttttcttttctccaatttcatgtcccaagcaaacctgattcatgaaatcgaaccctttccgatcttcatctgtgtgtctcactctcagtagcatggtgggtgagatgtaataaaagctgaaatcaaatcatctttaataaagaaaatacagtttggagagcacaggtgaactggggagaaagaaatcaaccaggctgaaagaaaaatcacaagaaaaatcatgaaggtttcccacagtacttcttgaaggagtctgtggggaagacagttaaaatgtacatgaagtaagagccgctttgttgggcctaagtaaccctggtgcattgtgaaatcctgtttccaacaacagtctttgaatttcatagttaccttgagggtctttagagataatagtctacacccaaggatgtaagtcaggcagacccagctgtagagtagaacccactgccgttgtgctgtaggattcagagaaccaagaatcactaagaattgctttagaggctgagaatttgggataagttggggtttagaattatcctccaagctcaaagttcacatggtggtggtggtggtggttggttggttggtttttgttttttgttttttggccaatccaaattcagaggagttcggggtgacatggcattgacaggaagctctttgcaagtggtaccgggtgactttgggtggggcccagtacccatctaatgttttcttctgttcactggagaaaagacgatgctggcttacagagctggaaaagtcgtcttctggggttagttgaaaggacaaggagggtttgtctccttgtgttgttgaagcattagcctgggctccttttctagaacagtcctcagtaggttgatgttattgtaacttctcaaaagggaacatccccgtgtagatcacatgggtcatttcgtcccgtgacagatgcatgtgaaggtctacagtatgggtgagtggaatagtctccccaatactgactttcttgggctagggatatagatcagtgtggagtgccagcctagcatgggtgagggcaagaatttgcgcctagaaccgcaaacagcaaaaacacattttctctttagccttctaatcttaaatcctagaacagcagtggagaggaacatgatggcttgttttcatggtaatcaagcaataagaagagagatactttattctgaagttaaggcatacagagggccaaggctgggtaatctcactgaagatatcctgccatcaaagactctaagcagcatctgaagggacaatgttctgcaaaccatgctctgcaaaatagataaccgcacatatgaatatatcaaaccaaacttcatgaaggaaatggcagcaaaacttcattaaagacagccacgtgagcatgaacctcatcgcatttctagtttagttgactttctaacatctccattctgttgatgtaattaggtactaatctagcagaaactgtattttctgttatcacagggtgatgctttttaagtcttcaaagggaatggggagtgggccacactgctttacaaggtgtagggaaataagaatatcgttacattaccactgacaatgtgcagtcagcacaagaggatgttttcttggtaataaggtggattctcttctggtgacttttaaaaagatatcctatatctatgtcgggaaccagcctggcctagaatggtttaagtgggacacagtatcagttacagctttaaagactgatggtctctggccttttagatatctaactatactgaatgtttgctgataacttctcaacaatcctaaaaactttcttgcttattaaatgttaaaaatcactaggtccaaccacccatttcatactttccacggctattcgtgcatgcttacatacacacatgtacctatacacataaatatagacagacatatacacttggctggctggctggctggctggctggagggagggagggatggatggatggagcagagctccccaaaccaaaccattcaaccaacaactttatttctttggtctggcctttttgttttaacattcttagacaaaagattctttagaaatttcctcatagataaaatgttacataaaatgggagttacagaaggatgttgatagtaagttcaaagtgggatttcattctaacatgctcggtacaagttcaaggtaacagcttttacatgaccttgccttatcatagtgcacacctgtggctatatccttggacctaaatgttttcccttgaacataaatttttcccaagtctctttctctttttagtgtaattatgaaagcacattgtatttcttattatgtagcctttacttactatatgaggagtgggcacattttaatcttggttttacctttattatatctttctagaaatcaactatgactgtcccttgaaactttcttcttaaaattatttaaattaaatcaggaattctatagaatcattaattcatctaaacagcattaattcgtgaaagttcatctttatgttgatctccagaaaatctgatcaatagggtgggctaatggccagggattattatattggtttaataatgacaggaaagcatatcagttgtgagaagcaatcctgaggtaaaatccctttagaatcttgccggtgagcttacccatcacagaccatgcaaaaatggtgggctatctccaggaaggtcacctcctaacctcatcctatcctacatgattcttgacaccatacatagtttttatgatctagtgtaaaatcacttatagttctcacgataaatatgacagtaaacaagattaccataaaaaataaagaaaaccattcacaccaagcatggtttcctggcttacattcctggctagggtgctcacagtgtcaccacttcctgctcagggtctgcccattgtgtgccccctggattgctggccactgccacctcatctttcattatctcactcaggtagaagagccggcagcagcatcctgtgtgagcctttgtaacagcagagctgcctttgccgatggtatctatgcctttaacgagtcgagagatttacccagtttagtttcccgcagcaaatcattggggagccagagtgacagctcagccaataaaaggttcattttgcaagcaagaggacctgagtgtgattcccagaatctgcatcttaaaagccaggcgtggtggtgcataagcgtagtcccatcactggagagtgaaaacagctggtcactgtgacctgctggccagccaaccctgattaccccgtgacctctaggccaatgggggacactgtctcaaaacaaaatccaaacccaaggcagatggcacctgaggaatgatggctcaaggtgacctcttgtgtgcacacacctacgtgaactcctacccacacacttgtacacccccatgcacgagcatgcacacacacacacacaaggcaattctttattacatcttaatttctagaacaagcacatgtgggttggtttcaatgagaatggtccccagaggttcatatatttaaatacttggcccctgattggtggaactgtttgggaaggattagaaggtgtggccttattggagaaggtgcgtcactagggtgggctttgataattcagaaagactgaatctattcccataaaccatattaaatgctttcttttataagttgccttggctgtggtattttggcacagtagtagaaactaagtaataagacactgaaacaaaattttattttaagacataaaacattataaatttacatatggaggtaaacaagagcaagcagctcgacatgttagtttgaggcatttacttaacaagcatctccttttgtcctgactttgaggatgaagtatgacattgaaaaaaacgtaagtctgagagatggggagatggctcagtagttaaatcactcaccaccaaaacaagaagatctgaattcagatccccagaattcatgtaaatgatatgtgggcatcctgacccaggtggcccacctgcaattttcagcctcaagagatggagacatggaccatgcaggctaggaaggacagctcgcatcagtgagctctgggtttaagagatcttgccttaaaacataaggtggaaaagcaatagaggtagatttaacattcaacgtagggtgtacctgcttgtgtgcaccagtacacacacacacatacacacacacacgagcttacacatgtgcatgctgcacaggtatataccatacacataaagaggaaaaaaaggaaaaatataagtaaaaatggctttgactttcataaaataaaagattcatcttattaaagcttcagcagccacttcttaaagctctgcatgcattggggatattccatgttctacacaagtaaaaacattttagctacccatgctttggctcttatcaagtttctagttacatctcattttttgtggtggtggtggtattctgagttcctctcactggcatgaagatggtttgtctggcttaaaaagagcccgtgtgaaccttgtcagagagacctgaaataaagctgtggcgtgcccttgtgttcacactaagtcaggttgatctctgtgtgcctcagctcacaattcacactcctcactatcactcccaagcgacaccagatatctgtagtcagagcactgccttgctaaaaatagaacacagtgatacccaggtaccacccagggaggccgcctcgcaaagcgacagatggcctctctggaacagcaccatgccacaggctctctcaggtgacagagtgcagatctcgtgccagcccttgccagctctgatcctagatgctatcgggcacacagaatgaaatggataggcatcccctagccagacttggaaagcagcatgtagagatgccagagtgtccttgattcagcaaggcaagtgatcatttccagctagtacacagccggccattgtatttcccgcctctgaggagccaggatacatccagaaagttgcttaatgagcagaggttgggcgcgggggagctaactggctggctgtgtgatgtgcatgtttagtggaacagtcggggatgtgttgctgtgaccttgttattcagcacaggttcctgctagcaagtagatgaggccaggaggacgagcatcttggccataccatgtgctagctctgaggttactggaaatcattgaacctgccttggccttgttgtgaaacctagttcatccagtcacttgtttaccaaccacatgacttgcattatgttgggcacctgccctggaacaacagtaactaaggtcacatgccctttctacagccatcacaacacactgagatcctatacaataggctgccactaaagcaaatggggataacaggagggacaggaggttctgtttcaagtgggttggtaggtagaaggtttacattgtatgtgacatcaactatgtgtgccctgtgaaaccccactttgcaagaaagtggaagtctctttggtaagttctttctaactttattgcttaatctgatggtgtacattaaaatagtttgttttgtttacacactggtcttattaaaatgttgcacataatatagttcgttttgcaaggcaaatcttcctttcagtgtgcctaatgaatctgctactcaaagaatcccataatggtagtttaggggtgttctgccaagcgtgtatgaagccctaggtttgggcccccagagtatacaggaaagaaggaaggaaaggggggaaaaggagaagaaaaatggaaaggaagggaaaaggaagagactttatatcaagctgccctaaatataactgtatcttaggtcaccataataaagttatcattattcctgaactcgttggtaactgttgccacctatatggtgacaagctgggtcatcacggagtcttcaccagatctttaagggaaccgaaaaggaattaggaggcaatggggcaaggtgggagtaaaggttattctgaagagcggaaaagaggagttccatgtgcaatagaatctatacgctctgatgagggaccaagacatagccttctctgtgatgatactgagcaggtcaaggaccaagccttagccttttgctagatgatgctgagcagacaagagggctttagcccatctacccagtgtccaactcagccaaatgtgaggctcatggcactgtgtgggataaacaagcatgctaattattttaaaaaggaaggaaagaagaaagaaaagactgaaacattaatttaaaaactcattctatgtgtatggatgtcttatcagcatatatgtctagcattgaatgtgtgcctggtgactatgagctcaggagaggatgtcaactcccttggaactggagttacaggtgtttatcagccaccaaatgagcacctgggaactgatccagggtctcctggaagatcagcaaatgctcttaactgctgagccatctctccaggcctgcaaaatattaacttttgaagcactaactacaatgtcttttataaaatattgatggggatcacacaaagatgaggccaattccagtaaaactgagccagagaagtgccctcgcctgcccagtaaggcactctggctggggagcaggagaaaaaagtgagttgcatggggcctaggaagtcttggctgcaaacactggtgacacaatcccttttccattctgatgacaaattttaaattctaataaatcctatttgtgaggccactaaagagacctgtcagctcagaagtagctatgcattcacagtcttcctacagaagccacaaactgggccaaagtgcaggcatctccgagaatctaatttccaagtgtgatgtagtgccagagccatacatggctccaagagatggctctgagtgtccggcactcttccctgtgtgactggaatcctctcagagctcagacccatttgacttggtgattgcaagtagctctttgagaactctctgggtgtcatgaccagtgaaggaggaagcccaggggatcccccagtatgtgtgcccctggacaaatcctcggcactcttctaaagcaatcctcccaatgtgtgaataggtcaggcctgctgactgttcagaaaaccctctttccttccgaagcttaatcagaaaacccttatgaagaatggggatataaatagaatccttgaaccccatagtgggtttctcaagagtagattttgaaagtgtggcaatgaggaatttgttttcaaaactttttatttttttaaaacaaaacaaaactatctaggggacacagaagaaatgactggtctcatcctgaattagctagcagagggtggagcctggtagatagggagccctctgaaagtcccaagttgcaagtggcacagggaaattgcaaagggcgtgtcagcgtgactccttgttcatgtctctgaaaatgtgttaatttggggaatgtcataaccccatgaggtggtgacagagcatacctcccactctctgggtactttgccataaccatatggtgacacatgacacacctagactgcctgtgccaactctgcccactcctcctcccaccccccagaagcagagtgtgaacacaagctttcttcccccactctccccacaccatcttcttccagcgtgttcttaaatccataggaagcatgcaggctgggtgttacttacctactgtcagaacgatcaaatacttcttgaggggtaaaagtgggagtcacagactgcatctccagccattgccagctttcttagctctgcaatcagagtcctctatccaggggctgtggtttttaccttggttactgttcatgtggggcaggtagtgactggaatgggagaaaggcaagggctgagcaggctggttatctgcctcccctgtctttcttcagaaagaaatgagaaagataaagatacacacaatctgtctgccttgccgtgtgtgtgtgtgtgtgtgtgtgtgtgtgtgtgtgcttgcacacgcctgtgtgagcacctgctgtgctttagttttagaggagtaccagcatcatcaatgtgtataatactgaaaattgagtcctgacaaggacatggcaaacacacatagataactggtttactcctcaaagctctggcaggctgatggatggattccaattgatcttaacttgtcaggcagagtaggtgaggatgcaagagacctcagaaagcccacaacccaatagcatcttgtccctgttcaggattcaagaagagaacatgtaaaataagaagcacctgtccagggagcattgcacaagggagaccttgtgggatcatgtctgagctacagtagctacagctgtgtgtgtcccatcctctgtggctgtctgcaacatggccatttattagctcctatctctgggtctcagaccggcaaacacaagccaaggaagtgtccaggtaactcggtgaccagaatcacctgccttcatatctttaccctccctcccacaaatgttctttccttcatgcccgtacaggagctggcacagacagagttggtgaactagtgactactcaaatgccagctggccagtttctaccccagcttgtgaatcgtggttcgctatgggtacagccacccctaggaaacacaaaccccacaagtcatgggagaggacccccagtaagacatccaacttgagctattctttaaggctacctacattccaaatgactgactgtaaattttggggctgcctccatttggtcaagtttagtaatttgctataactactcaaagaacgtaaaacctactattctgactattgactggatccaaataaggagggcagccatgtagaagtacacatgggtacagtctgaggaagcacagagcatccaaccctctctgcatattgcctttcatcacccagcacagttttaccagagtgtttgtgcttagaactgattggatcactggccacaggattgaacttggtcattagcccagaggttgggttgtctggaaatcctgcctctgggatcatgtgtgccttgtcatccaagaacccaccttgagtcagctcattaggacaaaaccagatgtaatcctggggctcctgagagcaaactcacctctgtcacccgggaaattgtaaagatttgtggctatcatcataggaatcaaaaaaaaaaaaaaaagacccatcaaattgtttattgaaggatggtacatagcttcagagggtagaccgggaaggggagctgggatgggagggaaacatggatcgactaaaggaaaatgatggagacatgtttagaaagtgaccatgcccctgtggcaactgtgaagtcttactgaagaggcaataggttagacttcaattggaagcagataaagagttggtcaacatgttaaacctcccaggcaggctccatgttcctactaaaactgagtacctgtgtcaaacagccaataaaaacaaagcattataagactgcatctgactagctccaatctatgtcagaagcaagctttatatgtagaaaatgctttggctttgttttgactttcagagtatcctattgagtaggtaatcaattaatcataaaatcaatcagtgagattcttaaagaaaaccatagaggtgtgccaagtacatgaaactcaagtggtcttagcttaaacatgggaagcttattcaccaaaccacacccaaatcagatctgccaagcctatgggctaatgagtggcagcctccctgttgcacacgcatgaaactgcgctgtggagaaaggctgcaattcctgccctccaatgcctgatctctctgtgactaggcatattaaagttatgctcagcttgaggtcattattccaagacagcctcctgcttccagaaaggtacacacatctccattctctctcacttgtgctcagccaagtccactgtgtggcttcatcctttgaagtttcaccctttatgctcctaggagtcgcctcacttctcatgacagctgccagttgtcacctgagggtgctgggtttactgctcaaaccatgtggtataggactcatgcgtccgtcggtcacttcactcatgagtccgtcggtcatgtcactcatggcgactctggtacttttctctttgtaccaggaggctttgcagttgaattttatggtggaaaatctagtaagaagcagagatcagtttgggatggccagcatgaaaatggtattatgagagccccgcagcacacagccttagcaaatggaggctgggcaaggggtatcagatggttagttggtactcagctgcagaaccgagtgcattctattctctgtgttgcctctcagtagtgatatttgaaagccctctgccaaactccaccatacttccggcattttccttcctcacctatatgtggatctctgacacaatactgacaggacatgtgcttctgatcttcagtaaacgaacctttagcataccctgcaaaagtaacccgagggattccagttgcaatcatccctgtattgtttgattttcccactgagtttagaagctgggctttctggagcggaggcctgaagcacccagaagctgagccacctctagccaccttctgtttctgtttagtctcaccaagtttctgggctgagctcactctgtagctgggccaggccttgaacctgcaatccttgtacctcagcttctgtagcagccaagtgccagtgtctccgtcagacatggagagcagttcaggaaaggcagagggactccaaagaaccaaagcctgactcagccactcaccgttctgtggccttgggcaagtaagtaaacttgcttcatgttgtaggccatggagtaagatcatagcaacccttgttctgtggaattgtgggtatcggccacaacaggaccaaatgccaggcactcggaaggcaaggcgggatctgttgccgtgttacagaaggtcagaatttcatttccctccagcttacatatatacaggtgattttcataaatgctaatacctttttaaaaagacaaatcctcaatgtttggttggaccaaaccagtcttattacttcttaatctcattctgacatagcaaaaacttactcacacacatgctagcttgggctctgtgactcagggctgcttccagccttaactctgtgtgtttaaactttgataggctcaagtctatttgcagcaacttgaattttaaagctttaccttgcattcacagctcacgaagcacagggcaggaaaaggtatggacacacctagaggggcattcttgtttcaccgagaagcaaactgagccttagacagtgggacacccatccgccccatacaggaaatgctttcagttatgacgaagtcaaagcccaggttgttctatctccccaattggtgcccttccattgcacagtactatctctgctccaggaatgaagtatcacttgaaaacactaaatgtgaacaccacacagggtctctaagtgacagactctgactgaacagctgtagacatcaatgggtcacgctgacctactattaaaaggactctgaaagattcttgtgacttctgtccattgctctggcagtctcctagacaagcacactattatacaaaattatccccaggaagaggattatgggtcctaagtgaacgtgtcaggaacgacaaattcatctaagagtcttgcattttagaagcctctagaagacctgcacttcactgagttattaggaaggatcaaccctgcagcctagaagtctggcagctaatcttcttccctggcttgaggctaccctgtggtcacatgtattcagttctggtgaaatgaggaaatgatatcatattgactaaccagcaccggcctgggaatccgataaccatgtgcatgaccacaagatatgccacgtaaagtgaaatcagaccactgtgttaaccaggagcaaagcacaggccagcggcgtgaggaagctgtgcaggggaaccctgctggacgcatcaggcctgcacttctgtcttagggtaaggtagccacttcaccttcccctccctcaaaggaaaggacactcccttactgaaaaatgcacacacactgttttgtcacagactgctttcaacagaaaatggaacacaagaacctaaaagcatatacaatacttatgtttaaggttgtttctgtgaaaagaaaacttttctgtactgatttttaaacgcctttttaaattttatttttctcttaaaaatttattggttctttgcaaatttttatggatatcccaatatatggagtcctttgcccaagaccagtatatgtggagcatatgataggtctattatcagccttttgaggaacctctacacatattttcttagtggctgtaccagttcacccccctccagttcacacacctccagcaaagaatgagtgtccccagacccagtgtccatgctgccatttgtcaccatttgtttcttgaccgtaaccattctgactgggcttagatgaaacctctgagcagttttaatttgcatttccttgatggctatgtatgttgaacatatattttcccccctggactctgtttagttttgtcccgtttaggttttcttgaatgtttaattttgagctacttatatattctagatagtaccactccttcaaagatataactcatgaataaaaaatgtccagtctgcttactgcctcttcagttgagcgatagtaccctttgctgttcagaaacttttggtttttgaggtcccatttattaattattggtattaaataaagcctttttctatcaagatgctactcaaaacgtctgttcttatatcagtgagtcaagcctaggtccccttgctcctgtcagagttagagtatctggtcttgtattaacatccttcatggatttggagtagagttttatacaagatgaaagacacagttcagatttgatccctcctctgtggtcatccagtttgacaagcaacacttgttcaagatgctgtcttctctccaacaggtatttgttgacttctttgtcaaaagttgagtggatgtaggatgtaggagtgtgggtttatatgtgagtcctcagttttgttcctttgactgacaagtctgtctttgtgccagtaccacctgctttggtaaggacagtcatgctcacaatgttcattgtaacaatgtatatacatgggaggtttttccactttctggtttcttgttcaatttatttttttcattcttttaaaagattttttgttgttgttgtacaaatctttcctgtcttcgttatacttattctagatattttacttttcttgaggctattatgaaaggtatttatttatttctttccccgtatgtttgttgtttgtatgaaggccaatcctttgtttttttgtttttttttgttttttttttaactgatttgttaatttgctgaaatatttatcaggtgtagtagtcatctggtggaacctttggaaagttttacataatagaattgtatcatctccaaataaggatactttgacttcttcctttcttatttgtatccactttaccttcacctgtcttactactctagctaagatgtcaggacttgcctacttaaatgggagtaggcaaagggattaccattgtgtccctggttctagtggaactacttgcagtttttccctgtttaggaagatgttgtctgaggaatcctgtatgctacctttattatattgagcttataccctctatccctcatttctccagcacttttattgtgaatggatgttggatttttgtcaaagaccttttctacagctagagagatgaccgtatggtagtttaagtttcttgaaccatccctgcatctctgggatgaaactgacttgatcatggtggacagtctttctaatatgttctcaaattagttttgaaagtattttattgcgaattttcatgtctttgacagtctagtagacttctatagtgactccatctggcctgggctttttagttgggagattttcaattactgacatctcattgcatgtgacaggtctacttaaatcatttaattcatatttgtttgattttggtagctcatatatatctagaagttcatccatttcttttacattttccagtttggtggaatcaatttttaaagtatatttgaataagcctctgaagtttttcagtgtatgttatggtgcctcccttttcttctctaaacaaattggatcctctaattcttttggttactttgactaaagggttatcaatctcttcaaatagctgtttcattgaatctttgtatttactttcattctgtcattaatttcaactgtggtttgagtgtctcttccgatctattctttcttgtggtttacttactctcatgtttccaaggcttttgggtgcaccactttgtttttaattgtgatctctaacttttttatataagtacatcatgctgtaaactttcctcctgtggtggctttcatcgtgtcctagaggttttgctatgctgggtcctcatttttattcagttctaagaatttttaaatttccttcttgatttctttaccaaatttttattcaaaaagtatgttgttcagctttcataagtttctgtcttttctattgttgttgatatccatagcgatcagataaaattcaggatgtaatttcaattttcctatatttgctgagacttgcattgtaatctatttgtaaaaatcccttgggctacagagaagaatgtgtgtactttggtttttagataggatgctctgaagatgtctgctaggattatttgatgtgattgaactttacagcttcctcctttttccaaatgaccgtgtgtttgtgagagtggagtattgaaatcacctattggcactgtcctgggattgatctatgtttttaagtttaatggtatttcttttatgaaattgggtgctctgatgtttagtgcatatatgtttaggagtgaaatatcctctgttggggttttcctgtaataagaataaagaatcccatgtatctcttgtgattagttttaaagtctattctgccaaatattagactagctacacctgcatgattctgggtttcatttacttactctgtcactgatgcagaagacggcaaaaagatggatcctgtttctgataccgtctgttagtctgtttctatttattggggagttaagaccaaattaattttattgttatcatttaatagtaagagctattcttgaacagtgcatatgaatttctgtcattttgttgattatatgatattctttcagacctcttttgattcagtgttctggaactgttttgtgcctttctgtgcaggttgatcctgttcttcaaacctgagtattctttccagtatcttctacagaggtggattagtggtcatacattacatctgatagtttcactgggtatagaagtctgcgctggcatctgtgtggtctttcataacttgtagaacatgggtccagtcctgtcagactttcatagtctccactggaaaatgaactgttactctggtggtcctgctttttgtataagacttgattttttttttcttgtcattttcaacctctttgttttgactgttatgtgatgtagagaatttctattctggtcctgtctatttggtgttctgtatgcctcttggaccttgataggcatctcttcttaaattggggaatttttattctataattttgctgaaaatattttctgttcctttgacccgggtctcttttccttctatacttatttattttgaaggtttgagtttttatagagttgagttcctatgtgctctgttcttggagtttgtgggggtttgcgttttctttgtccaagtgatctaattcctctattttgtcttgcagagttgataattctctcttccatctggtccaatctcttgataaactttcctctaaattttttgttagacttcatgaattttggattcatgaattttgcattcaagggccatttcattttggcttttcttaagagattctatctctttattggattctgttttcatgtcttgaattgtttgttattttatccaactgtggttttttttttttcttttttctttctttcttttttttttttttgcaatctttcaatctggtattcgtctcctctctgaattctttgatcatctttcattatttctacttgaaccattatcatgtgtgtcatctaagttgctcttctcaggggacattacacagggaggactaatttttggtagagacttactgtttgtttattcgtgtttgcaatgggatctaggcatctggtagtgtttgtagaaaccttgccttttgtgttgagtgggtggctgaagcactgggtcctattactccaatctgtcagataattgaccagctgctgtatggggctaagggcccagtgtttggggtatcagtagtagtcttggctcacctcaagctcagtgaggtttctaaacccagagcagactttctgtagagttagaaaatgctcatagctaaacttcaggcatgagggggttagaacttttcttcaggtaacagttcctggtggaattggcaatgctaatcttgaatcccttgaagaataaatgagaggaggcaagcgagggcatgtcatcatctccatgcctactgcaggggtaggaggagtcacatgtgcaggtatagtgcccctccttgaagggagattgagccttaaggtcatgggtgtgggtacagcaggggtgggcgcagttgaggatgaaagtctagcctcactgatagtgataaggagcaaggatctcagcatttcttaattttaagcattgtacagttacccatataccttcatttcagatatggtcagttgacataccagtagaggaagaaacctgacaaatagagtagccagaaaatccaaagtggggaaagagaggatggagcccagagggcagggacagaccttctttgctccctggctcctctgccatacttgtccttgcctttgacagctgtgaagggctggggattagaggagggagaggctgggctgggtgttacttaccattgtttcctggtgcctagcacaggctcaggaatcacaggcgggaattatgaaaggaacgagtaaacaaagggaccaatgcagacagagcagagactgagagtcccatggccccgcagctccagcagcagccgctgagagagagcctctgttattgtttccccgcaaagcaggcggctttgaacataactgacccagcccggtagcgcctttctgaagagatggtttcacatactctatcttacgttctccgtctctttggcagaggagtgatctgctgaggacattctgcctctgccctggaaatgatggcttttctttccctcgatttaggatcatctgactctgtcacctgatgctctccaacacttgtgccccaagcaaacgaaaggcctttcttcctagtcacatgtacaccctcttaaatatccacgctgtcttaaacttccttttcaccttcttgtggtctaagaatctaaacttaactctagattcttccgatgatagaaaacacaccatactcatctttgaatctggattctttctcttaatggtctcagttctacccatttccctgctttgttatgcatttttattcagacataaagaagttatatagcaagcctttatttaaatcccctgagttttttccattttctgtcccagacatagtttctcctctggaagaacccagtggtagccatctgtttatctcacacactcaccccaaaagagctggaaaattctgggactctgacatgaggaaattattacacctttagcatcttggcgaaggcagctttctagcagtcctctctgctctctagtctcctcgaaagcctagaagggggtgtctctcttactatctgagatgttggctggctcactgcctgaaggcaacgcagctggtcacttgcagggactgcaggatttgtcctaagaatatgaaaattctgatagtttcactgtgccagaaatcagatgatgttagctactgccttcactgttttaaatataggtctgcagcagtcaggtcatttacatagttgcacaaacatcatcacccctggcttcagaagatttcaggccaaactccattttcccgggccagagggatggctgaacaggccatagtttgattcccaggacccaactgatgaaaggagagaactgactcgggcagtttgtctgacacaggcacaaatgtgtgtgcgtgcacacacacacacacacacacacacaatgtaggagtgactgagtgagtttgtcactctgaacttcagagaaagtgatggtcttcctttgaaatgctagtgagttaccctgtttaaatgcaattctctttgttttttttctgtaatcctttatcattttttttctgttactgatgataaggaaccatgaagaatcaatcaatctctctctctctctcctacacacacatacaccatgccaagatctagatggaaattgtaaagacccccctcccccggcagatctgatggtcctgtggttccaagctacttggaagaggttttctcagccaattccccaacttacctgggagggaaagagctataagcaagacgctccctgcagggctgtcagatgaaggtacagagaaacaggcaggccggcagggcacacccacaaaggcttaggatcccagctctgacatgggtgattagcctgctggagatggggggcacattagtttactctgcagtaaatgaagattgataaatacgtctaagttatacagtgtggctctctggtgttggacagttaggcagactttgagacatatgggtgcctaccgcaagggagagaaacacacagaggacacacccagtctgcccagaaaatagcagaagtggtgccagctattgccatctggggaaatcaccccactgtaatacagtgcttccaaaggggacagacagaatagccccagactgtgcccttctgctcccttcttccccacgggagccacaggccgcaaagctggtaaagaaccttaggtgaggatggaagcagggacccagcatgggtggctggaaccgaaaccctttcttctgccaactctgctcaagagcagttcatgcccctctctctctctctctctctctctctctctctctctctcacacacacacacacacacacacacactcactcagtccactcttgctaccatcagaccctaccccatcctccatcagaatcactggatgcctgcttcatcaaggaccatctgggaccctggaggaagtcattgttgacaaggtctttcttaggccatgaggaccagagtcttaaccccttgactccaatcctgcctctttctgcctctagccagagagggaccttttggtatatatacttagagagattttgttttgttttttcctctgagacaatcctgctatctagcccaggctggcctgaaattcaccttgaagtccaagcaatcctcctgcttccagactgctgggattaattgagacactgatttaaatcccaacagtcatacgtggaaacattctttgtggttcctccagctccctctcacactcactatctggttcctgcgcatttattttcctcctaggagaagaatttggactggtttcctcggatgcgagccatgtcacttgtcagcaacgaaggtgacagtgagcaaaatgagatccggaacctgcaggagaagctggagtctacgatgagtctggtgaagcagctgtcagggcagctggcagagctgaaggagcaggtcagcaggctcaggggaagggagtggggaggggggtgatggatgtagggaggctcgagccatttacctctgtgagcaaggggacccagagactccaggaaagaaacctccccaagtatgccttgcagtgtggtggcatctcagcaagcaggtgctcccccacaacccctgcaagcatttttcaccctgtggaaagacagggagggagccctttgctcttggtgatagattttatcctgccaggcttcagatagccaagctcattggaaaggcaggtgttcctaatggctgccactgtaacatcccgatcaaccctctatcatatgacggtccttaacactcataaaacagaatatcaccaggccccttggtagccgttaaatgcttacagcaacggtgataagaacacaacagatccgtttcctaaccacagagacaatggttgctctttctcactacctctgtttatggtaatttagttttcaaaataatttcttttgtggttatcatatgtggaaccagacagtgggctcttgggaaagaaaacaagacctcagtggccggcaggtactggggaagaactgagaaagccagctgaacacgctctctctctccccagatgacagaacaaaggaaaaacaagcaaaggctgggctttcttggatcaaacacaccccatgtgaaccatcacatgccaccgcactgacaccatgggggcacgccgtgaccagcctttcatcggatgcctgcctcatcacagagggatggagatggaggggagcgaacagtggctattgttgaaaagctaaaaacaaccaagtgccaagatgctgagccatttagctcccagaacaatccgtaactgtgtttgcacgcttgagaagattcaagcttagagaaaaaaagaaaaaaagaaaaaagaaaaaaaaaaacgcatagggcacagactctctcggtggggcaggaagtagccagcctgaggggctgttgggggtgggagagtctggtgtggagcagcagacctccccctgcttgatcgataggccttggatttgtctcacacgctgactgcagcctccgtcatggctggttggaatttgttcgaattgtggcactcaggtcatcgagacaggaagccacactctgctggctaagtctgactaagaaaaaaaaaatttaaaagattaaaaaggagaattgaaaagatgtcattaaacttctgaaccttacgtgttagctggacattttcttcttggcacgagacacaatgggctcagagcactgcccctcagtgcttcagagttcataccccacacactgaaaaacataactggatcagggtggctgtctccaggactctgtgcgggcctgtgcaatgagaagctttcttagaactggctaagagtgtgcttaaagtcacgtgcgtgctaagatgttaaagacctggagaagggaagcttaaccataaggcccaggaagtaatgttttgagtgcctatgctactaaaatatataggcattgaaaggaaatctcgggggtgacgcaaacactccgatggccttgccttttaaaagcaggttggcttatatctgtggtgcctgaggacctgaatgcagtccctgcagctgtgggagagaagtctaagaattgtattgactacataaaaatacacaacaacatttcaatggcctatttaagactattagagtaacagcttttcaagacgtaggcagctcataattccttcccccaaactgttttcacgttgagtcatacaaccagaacttgtcaaggggaaaaaatagcctggaaggagggatttctcttggagactcttcgaggtgtcagaggcagacaaataatgaaagtgtgaggtggtcttgtggtgaggggccaccagccaagacaccacatgctgaaccagagaccctctggtctctagatcctttaagctctcagccaccaagggccaggtagggcttgttacaacaacttttaaagctttatggcatttcaatacagttttagctgttagctcctaaaaagtaaaagcaaaaataaattaaacactggatgtatatgaaccccactgtacaggcaggaacctgaatggcttaccttctaatttcataggtgtagccttggaaccactgagacacacttttgtaactaaatttactgggactcaacctccacaaggaccacccgaagttaccaagtgctcccagccaggcaatgctcctcctagcctgaagtggaaaggtgctaagatgtcagtgtaccattgacctttgacccttgtcagagacctgtctgcagttacctttaattctttgctacaacttaaagggtatcacccaaactaggctaagacagccatgtttaaagcccagggccaggaacgctgcaacagtacaatccgctgggcaatcagaagggcaggtgctgcttcggtctgctgtggcctgaccgcccagctgtgtgccagcaactcagagttcagcactgtggtttcccctgtgggaaatatccaaaagatttcagctggtgagaccctcactttgtcaaaattaaaaccttttcagctgcactttttcttcccctgcacaagatgaaagattataaagcaaaatgttaaaaacatcaaacaaagaaagggcactttcaaggacactgaattaataaagatgttaaaaatgagggaatttgatgtcaggtgagagtttatatttgttatgcatgtttgttaatgcagctggagtagttggcagacgttgggtatagtcggtattctcatatgtatgtagtgatagtaaaaatacagtcacccctgacttctaagccagggagggcttttttaaatattcagattattaaaacccatactggttaaaagtcacagttcccgctgaatgatatttttaattttacagaagggtttgctcccaggtgtgctccattctgcatctcaagagcttaatcgaatacatttcctaaattaaaatgattgagattagagatcgtgcactgtctagagatataacatgcaaagataccatttctacccctttgtcacaaaggacttagtttcacaagtctgccattttctctcctcccccctcccccccatggataaagatcaccgtttttggtagattgttgataatttcaggaagctagttcatttgaatcagaactgatattgtgttaatcctcatattccccacttctaaaagttgtttaattagaaactgtaaagtgctgtggccccatccctgggactaagtgtgggagttgatgaagaagactaaggacttcgcttcccaagatgctatttaatgggaagggagggccaagtgcccatccctgggacccagtagatcagagtattcctgccagagtagtaatgacctcacagctcagaacccgtaagcatgcagacagacgtgccgtgtggaagagtaactgtgacagctgttttaaagctatattgcaatagttattgtaatcttctggcctggagaccccttccaaatgactgtgagatgagacacagttagcccagacggggcgggcatcttaaatccagactggatgtctgcagagccaggtgaagaactaagctgcttgcagctctgaggccctgccctgggcaggggcgggaaggctgtgtaagccatgctaagctcgctgttttcaaagtctgacagccaattccagaaaacactcaaggctacctgagggctcatactccctcaccctgctgctgcctctgaaataacacttgatagaactcctgtgtagaagacgcaatgccaaaatcaaatggaactaagtacgcatgagaaccgagagccccgaagaggactccaggtactcccctccctcggaactgactcgactaatgaatgaggtgactgtgccaggcaggactcacctcaccaaatggattctctgtcctctggcagtagagaatgtctatatcgtctttttaaaaggtgatttttaacatgctgtcaggactgggtaacttataagttaatattaataaaatgaatttgtgtcttgtgtgcacctcattcttctcttgccatgtttctgaataagatctccatgctgtgaaaggcatcatagtcagcactgttttacgcagcaaggctgagacacacaccaaaggccagtgagcccagggtctgttgggaactggccaaatctcctcacgcacactaatatatctacacttcagatccccagaagtggacacagatcctttgccatcttggaatctctgtttcttgatatctgctctccccaaaggtagtgcccccttcaaactgtgattctcaacctgtgagccatggcccatttgggggctaaatgaccctttcacggggtccacacaagaccatcgtaaaagacagatatttatattatggttcataacagtaacacaattatagctgtgaagtagcaaggaaatcattttgcggttgggggggtcaccacacaaaaggttgagagccactgtcttagaacaaaactcagtcttctgcagcccaagtcccacccaggggatgtgaagcacacgcactctatgaatagatttctttgctgtggatacttttcagttcctcgaagcggtgtggcaagacctgctttgatttgctccagtcagaggaaaggtggctcagaggaggacaggaagtgagttcctcttccagtgacagtgactggcaaccacaggaagactctgcatgcagagggagctatgggcaagtcccaggccatagcctctgtctactcaactaggtgttttgaggaagtctcaggaggactaaccccaggctagaagctgggtgttagtgtctcctgtggccctccccgactggagaagccacagcttcatgcagactttgtgacagacaaggacaacagagaggagagcaggtttgactgaaatcctctgaggttttagggggttgggagtgggaggtgattcactttatagcccttgcttgcctgaaattcactgtgtagaccacagtgtgcagcttcaaactcagagacccacctacttctgctttcagagtgctgggattaaaggtgtgtgtcactgtgcctagcacctggtgctccaggcaagtccagtttatgatttctctggaacagtgtcttcatctgggattgctcattgattttgtaacagagacaaaattctgaggctactgtctaatacctgcctttggctttgtggtttttttttttctatcagtcttcatttgaggcaatcatagcctcttttttctgcatcaatacctttttccttgcctctttcaacaggagttgtgtttgtgggctcatcttcttggcattatgtacaaataaaattctttgaccatagtactgtaaagtaggcctgggtatatgatatatgaatatcgatttttgttttatcagagaatcaaagttactgtggctaacatggctgagagattatagttgccttagacatcatggctggcatgaggaaggtgacaagctttagggaatgcaagtgcttctgccacaagacagggagtcagtccctggggctggtggatggctggaaagcctggggctgggcagaggagatacaggagaagctggaaggcaaactggagttgtctacagtgcaggtgagctgaaagtgaagctggcacccttcccacgagccacatgtgcttccacgcaggactagagagtgataaagaagggtgtctgctgggggctgcagacactgaaggccacttcctgtctcacagtcagcacatgagccaaaagaccagggtgagccatatgaaacctgtcatctgcccctttcaaactaagtcactacaacttcatgccatccattacccagatttcatgaaaatatatcctgcaaacctaacatagacaaccttacaaacaatgaaactctgggaagtgttattccaacttagctaaattcacataaccccaaatcatcacttcctaagttcatgtccgctaacaatgacggtgatgcttatttttatattaatttatataataatctatattagttgacataatacaggataacttggaaacagagtttcaatgaatggctgtctagctcaggctggccaggcttgtctgaggcagttgcattgtctacattgatggagatgggaagctctactatgggcagtaacattcctgaggctgggatcctaatctgtctaagagagaagaatgcaggctgagcccaagcatacatgaaatcactgttctctgttcctgattatggatgttgtatgaactgttccttcacgcactagccactgtcacttccatgctgtgatggtctggaacctagaactgcaagtgacaagacctttctcttctaagttgctgctcacaagcaactggaaagaaagtaatatagtgatgctattcacatcccagtatgcaatgcagctaattccaaccaatgggttacaagcgcaatggacagagtgccaggatggagcaagcctcctaggagtacagacaggcctgtgagtcaggtaggaccaccactgctgctcagaggaacatacctgggaacactcaggacacaggaaccaagggagctgcctggggacagctgcannnnnnnnnnnnnnnnnnnnnnnnnnnnnnnnnnnnnnnnnnnnnnnnnnnnnnnnnnnnnnnnnnnnnnnnnnnnnnnnnnacctgcgaacacaggtaagatcacgacttctcttcaaattcctggcccaagagggaccctcacagagctatcaagacacaggatcagttggggacaggatccttctagtctctgtaccccaaagctgaccctgaccacagctctttatacccaaattcctcccagagagaactgttctcctaggaatactgacatacaggcttgcaggagggacaagccaaagtcagagacagcaagactagctaacaccagcaataaccagaggtgaaaggcaagcacaagaaaataagcaacagagaccaagacttcttggcatcatcagaaaccagttctcccaccaaagcaaaccctggttactccaacacactagaaaagcaagactctgacttaaaatcacatctcatgatgatgatagggaactttaagaaggacataaatacctcccttaaagaaatacaggagaacacaggtaaataggtagaagcccttaaagaagaaacacaaaagtcccttaaagaattacaggaaaacacaaccaaataggtgaaggaaatgaacaaaaccatctaagacctaaaaatggaaatagaaaaaataaagaaatcacaaagagagacaatcctagagttagaaaacctagaaaagagatcaggagtcatagatgcaagcattaccaacagaatacaagagatagaaaagagactctcagatgcagaagataccatagaaaacattgacacaacagtcaaagaaaatgcaaaaggcaaaaagctcctaacccaaaacatccaggaaagctgggacacaatgagaagaccaaacctaaggatagtaggtatagaagatagtaaatattcccaacttaaaggtccagtaaatattcccaacaaaattatagaagaaaacgtccctaatttaaagaaagagatgcccatgaacatacaagaagcctacagaactccaaatagattggaccagaaaagaaattcctcctgtcacataataatcaaaacaccaaactcactaaacaaagaaagaatattaaaagcagtaagggaaaaaggtcaagtaacatataagtgaagacctatcagaattacaccagacttctcaccagagactatgaaagctagaagatcctgggcagatgtgatctagaccctaagagaacacaaatgccatctcagggtactatacccagcaaaactttcaattactatagatggtgaaaccaaagatattccatgacaacaccaaatccacacaatatctttccacaaatccagcactacaaaggataagagatggaaaatgccaacacaaggaggaaaactacaccccagaaaaagcaagaaagtaatcttctttcaacaaacaaaaaagaagataaccacacaaatataaaaataacaccaataataacaggggagcaacaatcactattccttaatatctcttaacatcaatggactcaattacccaataaacagacgtagattaacagannnnnnnnnnnnnnnnnnnnccacaagacagggagtcagtccctggggctggtggatggctggaaagcctggggctgggcagaggagatacaggagaagctggaaggcaaactggagttgtctacagtgcaggtgagctgaaagtgaagctggcacccttcccatgagccacatgtgcttccacgcaggactagagagtgataaagaagggtgtctgctggggtctgcagacactgaaggccacttcctgtctcacagtcagcacatgagccaaaagaccagggtgagccatatgaaacctgtcatctgctcctttcaaactaagtcacgacaacttcatgccatccattacccagatttcatgaaaatatatcctgcaaacctaacataaacaaccttacaaacaatgaaactctgggaagtgttattccaacttagctaaattcacataaccccaaatcatcacttcctaagttcatgtccgctaacaatgacggtaatgcttatttttatattaatttatataataatctatattagttgacataatacaggataacttggaaacagagtttcaatgaatggctgtctagctcaggctggccaggcttgtctgaggcagttgcattgtctacattgatggagatgggaagctctactatgggcagtaccattcccaaggctgggatcctaatatgtctaagagagaagaatgaaggctgagcccaagcatacatgaaatcactgttctctgttcctgattatggatattgtatgaactgttccttcacgcactagccactgtcacttctatgctgtgatggtctggaacctataactacaagtgacaagacctttctcctctaagttgctgctcacaagcaactggaaagaaaataatatagtgatgctactcacatcccagtatgcaatgcagctaattccaaccaatgggttacaagcgaatggacagagtgccaggatggagcaagcctaggagtacagacaggcctgtgagtcaggtaggaccaccactgctgctcagaggaacatacctggaacactcaggacacaggaaccaaggagctgcctgggacagctgcacccagagctgatcctgtgccacagaatacaagagatagaaaagagactctctgatgcagaagataccatagaaaacattgacacaacagtcaaagaaaatacaaaaggcaaaaagctaacccaaaacatccaggaaagctgggacacaatgagaagaccacacctaaggataataggtatagaagagagtaaatattcccaacttaaaggtccagtaaatattcccaacaaaattatagaagaaaacttccctaatttaaagaaagagatgcccatgaacatacaagaagcctacagaactccaaatagattggaccagaaaagaaattcctcctgtcacataataatcaaaacaccaaactcactaaacaaagaaagaatattaaaagcagtaagggaaaaaggtcaagtaacatataagtgaagacctatcagaattacactagacttctcacgagagactatgaaagctagaagatcctgggcagatgtcatctagaccctaagagaacacaaatgccatctcagggtactatacccagcaaaactctcaattaccatagatggtgaaaccaaagatattccatgacaaaaccaaattcacacaatatctttccacaaatccagcactacaaaggataagagatggaaaatgccaacacaaggaggaaaactacaccccagaaaaagcaagaaaataatcttctttcaacaaaccaaaaagaagataaccacacaaatataaaaataacaccaataataacagggagcaacaatcactattccttaatatctcttaacatcaatggactcaattacccaataaacagatgtagattaacagactggataagtaaacaggactcagcattttgctgcatacaggaaacacacctcagtgttaaagacaaacactacttcagagtaaagggctgaaaaacaatttaccaaacaaatggtctcaagaaagaagcttgagtagccattctaatatcgaataaaattgactttcaaccaaatatcatcaaaaaaggtaaggaaggatacttcatactcatcaaaggaaaaaaaaatctaccaaaatgaactctcaattctcaacatctatgctccaaatgcaagggcacccacattcataaaggaaactttactaaagctcaaagtacacattgtacctcacacaataattataggggacttcaacaccccactctcatcaatgaacagatcagggaagcacaaactaaacagagacatagtgaaactaacagacgttttggaccaaatggatttaaaaggtatttatagaacatttcatcctaaatcaaaagaatataccttcttctcagcaccttctccaaaactgaccatttaatctgtcataaatcagaccttaacagatataagacgattgaaataatcccatgctcctatcagatcactacagattaaggctggtctttaatagcaacaaaaacaatagaaagcccacatacacatggaatctgaacaatgctctgctcaatgataacttggtcaaggaagaaataacaaacgaaattaaagactttttagaatttaatgaaaatgaagatacaacatacccaaatttatggaacacaatgaaagcagtgctaagaggaaaactcatagttctgagtgcctccaaaaagaaactggagaaaacatacactagcagtctcacagcacacctgaaagctctagaacaaaaagaagcaaatacacctaagaggagtagatggcaagaaataatcaaactcagggctgaaatcaatcaagtggaaacaaaaagaactatacaaagagtcaaccaaaccaggagctggttctttgagaaaatcaacaagatagataaacccttagccagactaaccagagggcacagagacaatatccaaattaataaaatcagaaatggaaagggagatataacaacagaaaccgaggaaatttaaaaaataatcagatcctactacaaaaggctatactcaacaaaactagaaaatctggatgaaatggacaattttctagagagataccaggtaccaaaattaaatcaggatcagattaatgatctaaatattccatatcctctaaagaaatagaaacagtcattaacagtctcccaaccaaaaaaaaaaaaaaaagcccacgaccagatgggtttagtgcagaattctatcagaccttcaaagacataatattaatactcctcaaactattccacaaaatggaaacagaaggaattctacccaacttgttctatgaagccacaattactctgatacctaaaccgcacaaagacccaacaaagaaagaaaacttcagaccatttcccttattaatatcgacacaaaaatactcattaaaattcttgcaaacttaatccaagaacacatcaaaacgatcatccatcatgatcaagtaggcttcatcccagagatgcaggggtgcttcaatacacggaaatccatcaatgtaatccactacataaacaaactcaaagaaaaaaaaaccacatgatcattacattagttgctgagaaagcatttgacaaaattcaataccccttcatgttaaacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctacctgttcaatatagtactcgaagtcctagccagagcacttagacaacaaaaggtcaaaaggatacaaattggaaaggaagaagtcacaattatattactatttgcagatgataggatagtatatataagtgaccccaaaaattccaccagacaactcctaaacctgataaactatctcgagcttttgtccccaccggaaagaacacgctcaggacaaccggaatcttctgcggcaaaagctttattgcttacttcttcaggagcaagagagagaatggcaaaaccctgtcccttttaaggagaattatcctccgcctaggacgtgtcgctccctgattggctgcagcccattggccaagttgtcgtcatggggaaggcagagcacatggagtggagaattaccccggcacatgcacagattatttgtttactacttagaacacaggatgtcagcgccatcttgtaatggcgaatgtgagggcggctccccacaataaacaacttcagcaaagtagctgaatataaaattaactcgaacaaatcagtggcctttctctacacaaaggataaacaagctgagaaagaaattagggaaacaacacccttcacaatagtcacaaataatataaaataccttgatgtgactctaactaagcaagtaaaagatctatataataagaacgtcaagtcactgaagaaagaaatcaaagatctcagaagatggaaagatctcccacgctcatggattggcaggatcaatatagtaaaaatggccatttgccaaaagcaatctgcagattcaatgcaatccccatcaaaattccaactcaattcttcatagagttagaaagggcaatttgcaaattcatctggagtaacaaaaaagctaagatatcaaaaactattctcaacaataaaagaacttctgggggaatcaccatcctgaacctcaagctgtactacagaacaattgtgataaaaactgcatggtattggtgcagtgacacaggtagatcaatggaatagaattgaagacccagaaatgaacccacacacctatggtcacttgatctttgacaaagaagctaaaaccatccagtgggaaaaaaagacagcattttcaacaaatggtgctggcacaactggcagttagcatgtagaagaatgcaaattcatccattcttttctccttgtacaaagctcaagtccaagtggatcaaggacctccacataaaaccagatgtactgaaactaatagaaaagtaagtggggaagagcctcaaggacatgggcacaggggaaaactccctggacagaacaccaatagcttatgctccaagatcaagaattgacaaatgggacctcataaaattccaaagcaaaggacactgtcaataggacaaatggtaaccaacaaattgggaaaagatctttatcaatcctaaacacaatagagggctaatatccaatatatacaaagaactcaagaagttagactccagataaccaaataactctattaaaaagtgggctacagagataaagaattttcaactgaggaatactgaatggctgagaagcacctaaagaatttttcagcatctttagtcatcagggaaatgcaaatctaaacaaccctgaaattccacctcagatcagtcagaatggctaagatcaaaaattcacatgacagcagatggtggtgaagatgtggaaaagaggcacactcctccattgctgatgggattgcaagttagtacaaccactctggaaatcagtctggcagttcttcagaaaattggacatagtactacctgaggacccagaaataccactcctgggcatatttccagaagatgctccagcatgtaataaggacccatgctcaactctgttcatagcagccttatttataatagccagaagctagaaagaacccagatgtcattcaacagaggaatggatacagaaaatgtggtacatttacacaatggagtactactcagctattaaaaataatgaatttatgaaattcttaggcaaattaatggaactagtaaacatcatcctgagtgaagtaatccattcacaaaagaacacacatggtatgcactcactgataagtggatattagcccagaagctcagaatacccaagatacaattcacagagcacatgaagctcaaaaaggaaaaccaatttggtccttcttagaagggagaacaaaatacccatggaaggtgttatagagacaaagtatcgggcagagactaaaggaaaggtcatctagggactgccccacttggggatccatcccatatacagtcaccaaacccagacactattgtggatgccaacaagttct

SEQ ID NO: 123 - DNA, 11806 bp, Mus musculus
atgtctgacaaaatgtccagcttcctctacattggggacatcgtgtctctgtacgcggagggctcggtcaatggcttcatcagcaccctggggttggtggatgaccgttgtgtggtgcacccagaggcgggagaccttgccaacccacccaagaagttcagagactgcctgttcaaggtgtgccctatgaatcgatactctgcccagaagcaatactggaaagccaagcaggcgaaacaggggaaccatacagaggctgccctgctgaagaagctccagcatgcagcagagctggaacaaaaacagaatgagtcggagaacaggaaacttttgggagaaatcgtgaaatacagcaacgttatccaactgctgcacataaaaagcaacaagtacctgacggtgaacaagaggttacctgccttgctggagaagaatgccatgcgagtgtcactggatgctgcagggaacgaaggctcctggttctacatccatccgttctggaagctgagaagcgagggtgataatatcgtcgtaggagataaagtcgttctgatgcctgtaaatgctgggcagcccctgcatgccagcaacgtggagctcttggacaacccaggctgcaaagaggtgaatgctgttaattgtaacactagctggaaaatcactttattcatgaaattcagttcctatcgagaggatgtattaaaggggggtgatgttgtgagactctttcatgcggaacaagagaaatttctgacctgtgatgactatgagaaaaaacagcacattttccttcggacgaccttgcgtcaatcagcaacttcggccactagttctaaagcactctgggaaatagaggtggttcaccacgatccatgccgcggaggtgcgggacagtggaacagcctgttcaggtttaagcatcttgcaactgggaactacttagctgcagagcttaatcctgactatcgagatgctcaaaatgaaggaaaaaatgtgaaagacggggagattccaacaccaaagaaaaaacgccaggcaggggagaagatcatgtacaccctggtttcagtcccacacggaaatgacatcgcgtccctttttgaacttgatgccacaactctgcagagagccgactgcctggttccgaggaactcctacgtgcggttaaggcacttgtgcaccaacacctgggtaacaagcaccaccatccccatagacacagaggaagagaggcctgtcatgttgaaaattgggacctgccagaccaaggaagacaaagaagcctttgccattgtgtgcgtcccgctgtctgaggtccgtgacttggactttgccaacgatgccaacaaagtgctggccaccacggtgaagaagctggagaatggcagcatcacacagaacgagaggaggtttgtgactaagttgttggaagacctcattttctttgtggctgatgtgaccaacaatgggcaggacgttctggatgtggtcatcaccaagccaaaccgggaacggcagaaactaatgagggaacagaatatactggcacaggtgtttgggatccttaaagcacctttcaaggagaaggctggagaaggttcgatgctgaggctggaggacctgggcgaccagcgctacgccccgtacaagtatgtgctgcgtctctgctaccgtgtgctgcggcattcgcagcaggactacaggaagaaccaggagtacattgctaagaacttctgcgttatgcagtcccagatcggctatgatatcttggcagaagatacgattacagccttgttacacaacaaccgcaaactactggagaaacacatcacagccaaagaaattgagactttcgtcagcctgctcaggaggaaccgggagccgaggtttctggactatttgtctgacctctgtgtgtccaatagcacggccatccccgtcactcaggaactcatctgcaaattcatgctgagccctggcaatgcggacatcctcattcagacaaagctggtgtccatgcaagtggagaaccccatggagagctccatccttcctgatgacattgacgatgaggaggtctggctttactggattgacagcaacaaggagcctcacggcaaggccatcaggcaccttgcccaggaagccagggaaggcaccaaagctgacctggaagttctgacctattacaggtaccagctaaacctctttgcaaggatgtgcttggaccgccagtatctggccatcaaccagatttcaacacagttgtccgtagacctgatcctgcggtgtgtgtctgacgagagtctgccctttgacctcagagcatctttctgccgactcatgctccacatgcacgttgaccgcgacccccaggagtctgtagtgcctgttcgctatgcccgcctctggaccgaaatccccacaaagatcacgattcatgagtatgactccattacagactcttccagaaatgacatgaagaggaagtttgccctgacgatggaatttgtcgaagaatatttgaaagaagttgtaaatcaaccatttccttttggagacaaagagaaaaataaactgacatttgaggtggttcacctagcccggaacctcatctatttcggattctacagcttcagcgagttactgcggctgacgagaactctgctggcgatcctagacatcgtccaggcccccatgtcctcatatttcgaaagattaagcaagttccaagatggaagcaacaatgtcatgaggaccatccacggagtgggagagatgatgacacagatggtgctcagcagaggctccatcttcccagtgagtgtgcccgacgcacagcccatcgtccaccccagcaagcaggcgagccccggcgagcaggaggatgtgacagtgatggacaccaagctgaaggttatcgagattttacagttcatcctgagcgtcaggctggactaccggatctcttacatgctgtccatatacaagaaggaatttggagacaacaacgacaatggtgacccctctgccagcggcaccccagacacactgctaccatcagctcttgtccctgacatcgacgagattgcggctcaggcagaaacaatgttcgctggaagaaaagaaaaaactccagttcagcttgatgatgaaggaggcaggacgttcttacgcgtcctcatccacctgatcatgcacgactatgctccgctgctgtccggagccctgcagctgctcttcaagcatttcagccagagagcagaagtgcttcaggcctttaaacaggtgcagttactagtgtcgaaccaagatgttgataactacaagcaaatcaaggcagacctcgaccaacttcggctgacggtggagaaatctgagctgtgggtagaaaagagcggcagctatgagaatggagatgtgggtgagggccaggccaaaggaggcgaagaggcaaatgaggaatccaacctcttgagcccggtgcaggatggcgcgaagacacctcagatcgacagcaacaagggcaacaactaccggatcgtcaaggagatcttgattaggctgagtaagctctgtgtgcagaacaagaaatgccgtaatcaacaccagcggctgctgaaaaacatgggggctcactccgtggtgctggaccttctgcagatcccctatgagaagaccgacgagaagatgaacgaggtgatggacttagcccacaccttcctgcagaacttctgccgtgggaatccgcagaaccaagttctccttcacaagcatctcaatctgttcctaactcctggcctcctggaggcagaaaccatgcggcacatcttcatgaacaattatcacctgtgcaacgagatcagcgagagggtggtccagcacttcgtgcactgcattgagacacatggccgccatgtggagtacctgaggttcctgcagacgatcgtgaaagcagatggcaaatacgtgaagaaatgccaggacatggtgatgacggagttgatcaatgggggcgaggatgtgttgatattctacaatgacagagcttcatttcccatcctcctcaacatgatgtgctctgagagagcccgtggggacgagagcggccccctcgcctaccacatcacccttgtggagttgctggcagcgtgcaccgaaggcaaaaatgtctacacagaaatcaagtgcaattctctcttgcctctggacgacatagtgagagtggtgacccacgatgactgcattcctgaggtcaaaatcgcgtacgtgaactttgtcaaccattgctacgttgacactgaagtggagatgaaggagatctacacaagtaaccacatttggaagttatttgagaatttcttggtggatatggcgagggtctgtaacaccaccacagacaggaaacacgcagacacctttctggagaggtgtgtgacagagtcagtcatgaacattgtgagcggcttcttcaactcgccattttccgacaacagtaccagcctccagacccaccagccagtctttatccagctgctgcagtctgccttcagaatttacaactgtacctggcccaacccagcccagaaagcctccgtagaatcctgtatcagagccctggctgaagtggccaaaaaccgtgggattgcgatcccagtcgatttggacagccaggtcaacacgctcttcatgaagaaccactcaagtacggtgcagagggcagccatgggctggagactctcagctcgctctggacctcgcttcaaggaagctcttggaggaccagcctgggattacagaaatattattgaaaagttacaggatgtcgtggcctccctggaacagcagttcagccccatgatgcaggccgagttctctgtgcttgtggatgtgctgtacagcccggagctactgttcccagagggaagcgacgccaggatccgatgtggtgccttcatgtccaagctgattaatcacacaaagaaactgatggagaaagaagaaaagctgtgcattaaaatcctccagactttacgggagatgctggagaagaaagacagcttcatggaagagggtagcacattacggcgaatcctcctgaatcggtacttcaagggtgatcatagcattagtgtgaacggacctctgtcaggagcctatgccaagacagcacaagtgggaggaagcttctctggacaggattcagataagaagggcatttcaatgtccgatatccagtgtttgctggacaaagaaggagcatccgaacttgtcatcgatgtcattgtgaacaccaaaaacgacaggatcttttccgaaggaattttgcttggcattgccttgctggaaggaggaaacacacagacccagtattctttctaccagcagttgcatgaacaaaaaaagtcagagaaatttttcaaagtcctttatgatcggatgaaggctgctcagaaagagatcagatccacggtgaccgtcaacaccatagacttagggagcaagaagagagaagaggacagtgacgtcatggccctgggccctcggatgagagtgagagactcatcactacatttgagagaaggaatgaaagggcagttaacagaagcgtcttcagccacatccaaagcatactgtgtgtacagaagagagatggacccggaaatagacacaatgtgcccgggacaggaagcaggaagtgcggaggaaaagtctgcggaggaagttaccatgagcccggccatcaccatcatgcgtcccatcctcaggttcctgcagttactgtgtgagaatcataaccgggagcttcagaacttcttgaggaaccagaacaacaaaacaaactacaaccttgtctgtgaaacgcttcagttcctggactgtatctgcggaagtaccacagggggtctaggcctgctggggctctacatcaatgagaggaatgtagctctggtcaaccagactctggagagcttgaccgagtactgccaaggcccgtgccacgagaaccagacctgtatcgccactcacgaatccaatgggattgatatcatcatcgccttgattctgaatgacatcaaccccctgggcaagtacagaatggacttggtgttgcagctgaagaacaacgcctccaagcttctgctggccattatggagagcagacatgacagtgagaatgcagagagaattcttttcaacatgagacccagggaactggtggatgtcatgaagaatgcctataaccaaggcctggaatgtgaccatggggacgaggagggaggggatgatggtgtttctccaaaagacgttggacacaacatctacattctggcccatcagttggcccgccacaacaaactgctgcagcagatgctcaagccgggatctgacccagaggaaggggatgaagctttgaagtattacgccaaccacaccgcgcagatcgagattgtgcggcatgaccggactatggagcagattgttttcccggtccccaacatctgtgaattcctcactcgggaatccaagtaccgagtgttcaacacaacggagagggatgagcaaggaagcaaggtgaacgacttcttccagcaaacggaagatctctacaacgagatgaaatggcaaaagaagatcagaaacaaccccgccctgttctggttctccaggcacatctcactctgggggagcatctccttcaacctggctgtgttcatcaacctggctgtggctctcttctacccattcggggatgacggtgatgaaggcacactctccccgatgttctcagtcctcctttgggtagcagtggcgatctgcacatctatgctgttcttcttctccaagcccgtgggcatccggccattcctcgtgtctgtcatgctcagatcgatatacaccatcggtctggggccaacgctaatactacttggtgctgccaatctatgtaataaaatcgtgttcctggtgagttttgtgggaaaccgaggcacattcaccagaggctaccgagcagtcattctggacatggcctttctttaccacgtggcctatgtcctggtttgcatgcttggcctctttgtccacgagttcttctacagcttcctgctttttgatttggtatatagagaagagaccctgctgaatgtcatcaaaagcgtcacacggaacggccgctccatcatcctgaccgcggtcttggctcttatcttggtctacctgttctccatcatcggcttccttttcttaaaggacgacttcaccatggaggtggacagactgaaaaacagaactccagtcacaggtaatcacggggttcccactatgaccttatcttccatgatggaaacctgccagaaggaaaactgctcacccacgatcccctcttccaacacagccggcgaggaaggtgaggatggcatagaaaggacatgtgataccctgctcatgtgcattgtcaccgtgctgaaccagggcctcaggaatggcggcggagttggggatgtgctgagacgaccctcgaaagatgagcccttgtttgctgcccgggtagtctacgacctcctgttcttcttcatcgtcatcatcatcgttctcaacctgatctttggagtgatcattgacacgtttgctgacctcagaagtgagaagcagaagaaagaagaaatcctcaagacaacctgcttcatctgtggcctggagagagacaagtttgataacaagacagtgtcctttgaggagcacatcaagtcagagcacaacatgtggcattacctgtacttcatcgtcctggtgaaggtgaaggacccgacagaatacacagggcctgagagctacgtggctcagatgatcacggagaagaatttggactggtttcctcggatgcgagccatgtcacttgtcagcaacgaaggtgacagtgagcaaaatgagatccggaacctgcaggagaagctggagtctacgatgagtctggtgaagcagctgtcagggcagctggcagagctgaaggagcagatgacagaacaaaggaaaaacaagcaaaggctgggctttcttggatcaaacacaccccatgtgaaccatcacatgccaccgcactgacaccatgggggcacgccgtgaccagcctttcatcggatgcctgcctcatcacagagggatggagatggaggggagcgaacagtggctattgttgaaaagctaaaaacaaccaagtgccaagatgctgagccatttagctcccagaacaatccgtaactgtgtttgcacgcttgagaagattcaagcttagagaaaaaaagaaaaaaagaaaaaagaaaaaaaaaaacgcatagggcacagactctctcggtggggcaggaagtagccagcctgaggggctgttgggggtgggagagtctggtgtggagcagcagacctccccctgcttgatcgataggccttggatttgtctcacacgctgactgcagcctccgtcatggctggttggaatttgttcgaattgtggcactcaggtcatcgagacaggaagccacactctgctggctaagtctgactaagaaaaaaaaaatttaaaagattaaaaaggagaattgaaaagatgtcattaaacttctgaaccttacgtgttagctggacattttcttcttggcacgagacacaatgggctcagagcactgcccctcagtgcttcagagttcataccccacacactgaaaaacataactggatcagggtggctgtctccaggactctgtgcgggcctgtgcaatgagaagctttcttagaactggctaagagtgtgcttaaagtcacgtgcgtgctaagatgttaaagacctggagaagggaagcttaaccataaggcccaggaagtaatgttttgagtgcctatgctactaaaatatataggcattgaaaggaaatctcgggggtgacgcaaacactccgatggccttgccttttaaaagcaggttggcttatatctgtggtgcctgaggacctgaatgcagtccctgcagctgtgggagagaagtctaagaattgtattgactacataaaaatacacaacaacatttcaatggcctatttaagactattagagtaacagcttttcaagacgtaggcagctcataattccttcccccaaactgttttcacgttgagtcatacaaccagaacttgtcaaggggaaaaaatagcctggaaggagggatttctcttggagactcttcgaggtgtcagaggcagacaaataatgaaagtgtgaggtggtcttgtggtgaggggccaccagccaagacaccacatgctgaaccagagaccctctggtctctagatcctttaagctctcagccaccaagggccaggtagggcttgttacaacaacttttaaagctttatggcatttcaatacagttttagctgttagctcctaaaaagtaaaagcaaaaataaattaaacactggatgtatatgaaccccactgtacaggcaggaacctgaatggcttaccttctaatttcataggtgtagccttggaaccactgagacacacttttgtaactaaatttactgggactcaacctccacaaggaccacccgaagttaccaagtgctcccagccaggcaatgctcctcctagcctgaagtggaaaggtgctaagatgtcagtgtaccattgacctttgacccttgtcagagacctgtctgcagttacctttaattctttgctacaacttaaagggtatcacccaaactaggctaagacagccatgtttaaagcccagggccaggaacgctgcaacagtacaatccgctgggcaatcagaagggcaggtgctgcttcggtctgctgtggcctgaccgcccagctgtgtgccagcaactcagagttcagcactgtggtttcccctgtgggaaatatccaaaagatttcagctggtgagaccctcactttgtcaaaattaaaaccttttcagctgcactttttcttcccctgcacaagatgaaagattataaagcaaaatgttaaaaacatcaaacaaagaaagggcactttcaaggacactgaattaataaagatgttaaaaatgagggaatttgatgtcaggtgagagtttatatttgttatgcatgtttgttaatgcagctggagtagttggcagacgttgggtatagtcggtattctcatatgtatgtagtgatagtaaaaatacagtcacccctgacttctaagccagggagggcttttttaaatattcagattattaaaacccatactggttaaaagtcacagttcccgctgaatgatatttttaattttacagaagggtttgctcccaggtgtgctccattctgcatctcaagagcttaatcgaatacatttcctaaattaaaatgattgagattagagatcgtgcactgtctagagatataacatgcaaagataccatttctacccctttgtcacaaaggacttagtttcacaagtctgccattttctctcctcccccctcccccccatggataaagatcaccgtttttggtagattgttgataatttcaggaagctagttcatttgaatcagaactgatattgtgttaatcctcatattccccacttctaaaagttgtttaattagaaactgtaaagtgctgtggccccatccctgggactaagtgtgggagttgatgaagaagactaaggacttcgcttcccaagatgctatttaatgggaagggagggccaagtgcccatccctgggacccagtagatcagagtattcctgccagagtagtaatgacctcacagctcagaacccgtaagcatgcagacagacgtgccgtgtggaagagtaactgtgacagctgttttaaagctatattgcaatagttattgtaatcttctggcctggagaccccttccaaatgactgtgagatgagacacagttagcccagacggggcgggcatcttaaatccagactggatgtctgcagagccaggtgaagaactaagctgcttgcagctctgaggccctgccctgggcaggggcgggaaggctgtgtaagccatgctaagctcgctgttttcaaagtctgacagccaattccagaaaacactcaaggctacctgagggctcatactccctcaccctgctgctgcctctgaaataacacttgatagaactcctgtgtagaagacgcaatgccaaaatcaaatggaactaagtacgcatgagaaccgagagccccgaagaggactccaggtactcccctccctcggaactgactcgactaatgaatgaggtgactgtgccaggcaggactcacctcaccaaatggattctctgtcctctggcagtagagaatgtctatatcgtctttttaaaaggtgatttttaacatgctgtcaggactgggtaacttataagttaatattaataaaatgaatttgtgtcttgtgtgcacctcattcttctcttgccatgtttctgaataagatctccatgctgtgaaaggcatcatagtcagcactgttttacgcagcaaggctgagacacacaccaaaggccagtgagcccagggtctgttgggaactggccaaatctcctcacgcacactaatatatctacacttcagatccccagaagtggacacagatcctttgccatcttggaatctctgtttcttgatatctgctctccccaaaggtagtgcccccttcaaactgtgattctcaacctgtgagccatggcccatttgggggctaaatgaccctttcacggggtccacacaagac

SEQ ID NO: 124 - protein, 2677 aa, Mus musculus
MSDKMSSFLYIGDIVSLYAEGSVNGFISTLGLVDDRCVVHPEAGDLANPPKKFRDCLFKVCPMNRYSAQKQYWKAKQAKQGNHTEAALLKKLQHAAELEQKQNESENRKLLGEIVKYSNVIQLLHIKSNKYLTVNKRLPALLEKNAMRVSLDAAGNEGSWFYIHPFWKLRSEGDNIVVGDKVVLMPVNAGQPLHNVELLDNPGCKEVNAVNCNTSWKITLFMKFSSYREDVLKGGDVVRLFHAEQEKFLTCDDYEKKQHIFLRTTLRQSATSATSSKALWEIEVVHHDPCRGGAGQWNSLFRFKHLATGNYLAAELNPDYRDAQNEGKNVKDGEIPTPKKKRQAGEKIMYTLVSVPHGNDIASLFELDATTLQRADCLVPRNSYVRLRHLCTNTWVTSTTIPIDTEEERPVMLKIGTCQTKEDKEAFAIVCVPLSEVRDLDFANDANKVLATTVKKLENGSITQNERRFVTKLLEDLIFFVADVTNNGQDVLDVVITKPNRERQKLMREQNILAQVFGILKAPFKEKAGEGSMLRLEDLGDQRYAPYKYVLRLCYRVLRHSQQDYRKNQEYIAKNFCVMQSQIGYDILAEDTITALLHNNRKLLEKHITAKEIETFVSLLRRNREPRFLDYLSDLCVSNSTAIPVTQELICKFMLSPGNADILIQTKLVSMQVENPMESSILPDDIDDEEVWLYWIDSNKEPHGKAIRHLAQEAREGTKADLEVLTYYRYQLNLFARMCLDRQYLAINQISTQLSVDLILRCVSDESLPFDLRASFCRLMLHMHVDRDPQESVVPVRYARLWTEIPTKITIHEYDSITDSSRNDMKRKFALTMEFVEEYLKEVVNQPFPFGDKEKNKLTFEVVHLARNLIYFGFYSFSELLRLTRTLLAILDIVQAPMSSYFERLSKFQDGSNNVMRTIHGVGEMMTQMVLSRGSIFPVSVPDAQPIVHPSKQDGEQEDVTVMDTKLKVIEILQFILSVRLDYRISYMLSIYKKEFGDNNDNGDPSASGTPDTLLPSALVPDIDEIAAQAETMFAGRKEKTPVQLDDEGGRTFLRVLIHLIMHDYAPLLSGALQLLFKHFSQRAEVLQAFKQVQLLVSNQDVDNYKQIKADLDQLRLTVEKSELWVEKSGSYENGDVGEGQAKGGEEANEESNLLSPVQDGAKTPQIDSNKGNNYRIVKEILIRLSKLCVQNKKCRNQHQRLLKNMGAHSVVLDLLQIPYEKTDEKMNEVMDLAHTFLQNFCRGNPQNQVLLHKHLNLFLTPGLLEAETMRHIFMNNYHLCNEISVVQHFVHCIETHGRHVEYLRFLQTIVKADGKYVKKCQDMVMTELINGGEDVLIFYNDRASFPILLNMMCSRDESGPLAYHITLVELLAACTEGKNVYTEIKCNSLLPLDDIVRVVTHDDCIPEVKIAYVNFVNHCYVDTEVEMKEIYTSNHIWKLFENFLVDMARVCNTTTDRKHADTFLERCVTESVMNIVSGFFNSPFSDNSTSLQTHQPVFIQLLQSAFRIYNCTWPNPAQKASVESCIRAEVAKNRGIAIPVDLDSQVNTLFMKNHSSTVQRAAMGWRLSARSGPRFKEALGGPAWDYRNIIEKLQDVVASLEQQFSPMMQAEFSVLVDVKPELLFPEGSDARIRCGAFMSKLINHTKKLMEKEEKLCIKILQTLREMLEKKDSFMEEGSTLRRILLNRYFKGDHSISVNGPLSGAYAKTAQVGGSFSGQDSDKKGISMSDIQCLLDKEGASELVIDVIVNTKNDRIFSEGILLGIALLEGGNTQTQYSFYQQLHEQKKSEKFFKVLYDRMKAAQKEIRSTVTVNTIDLGSKKREEDSDVMALGPRMRVRDSSLHLREGMKGQLTEASSATSKAYCVYRREMDPEIDTMCPGQEAGSAEEKSAEEVTMSPAITIMRPILRFLQLLCENHNRELQNFLRNQNNKTNYNLVCETLQFLDCICGSTTGGLGLLGINERNVVNQTLESLTEYCQGPCHENQTCIATHESNGIDIIIALILNDINPLGKYRMDLVLQLKNNASKLLLAIMESRHDSENAERILFNMRPRELVDVMKNAYNQGLECDHGDEEGGDDGVSPKDVGHNIYILAHQLARHNKLLQQMLKPGSDPEEGDEALKYYANHTAQIEIVRHDRTMEQIVFPVPNICEFLTRESKYRVFNTTERDEQGSKVNDFFQQTEDLYNEMKWQKKIRNNPALFWFSRHLWGSISFNLAVFINLAVFYPFGDDGDEGTLSPMFSVLLWVAVAICTSMLFFFSKPVGIRPFLVSVMLRSIYTIGLGPTLILLGAANLCNKIVFLVSFVGNRGTFTRGYRAVILDMAFLYHVAYVLVCMLGLFVHEFFYSFLLFDLVYREETLLNVIKSVTRNGRSIILTAVLALILVYLFSIIGFLFLKDDFTMEVDRLKNRTPVTGNHGVPTMTLSSMMCQKENCSPTIPSSNTAGEEGEDGIERTCDTLLMCIVTVLNQGLRNGGGVGDVLRRPSKDEPLFAARVVYDLLFFFIVIIIVLNLIFGVIIDTFADLRSEKQKKEEILKTTCFICGLERDKFDNKTVSFEEHIKSEHNMWHYLYFIVLVKVKDPTEYTGPESYVAQMITEKNLDWFPRMRAMSLVSNEGDSEQNEIRNLQEKLESTMSLVKQLSGQLAELKEQMTEQRKNKQRLGFLGSNTPHVNHHMPPH

SEQ ID NO: 125 - DNA, 518360 bp, Homo sapiens
  misc_feature (1)...(518360): n = A,T,C or G
tgacaattgtgggtggttttatagcaccaggctggaaatttagccattttgtttcttttgtctcaaaatttgcttttccctgatgtctgaaacgtgtctgttaaaaaaattgatttctttctcttacacatattttttaaaaaattcaaattccttgaaaaagaaaaatttaataattatcaagaattttgccctggctcagtgtggctcatgcttgtaatcccagaactttgggaggcagaggcgggtagatcacttgaggccaggagtgcaagaccagcctgaccaacatgcaatacctggtctctactaaaaatacaaaaaatagctgggtatggtggtgggggcctgtaatcccagctattccagaggctgaggcaggagaatcactttaacctgggaggcggaggttgcagtgagctgagatggcaccactaccctccagcctaggcgacagagcaagactcatcttaaaacaaaaaacaaaaaacaaaaacaaaaaacaacaaaaaaagaattcgctacagttgatggaagggattgatctgtaaatggcagagctggtggcccagaggctctggagacagctctggtgtgggctcagtcactggcatgtcttattgcatagacagaaacacctctgatgcttggttttcttatgacatttcatgctgcttttctcacagataatcataatcataataatagctaatatttattgaagttggatgtggtggtttatgccttgtagtcctagctccttgagaggctgaagccaaaggattgcttgaccctggaattctgggatgcagtgagctatgactgcaccactgcacttcagcctggatgacagagtgagatcctctctctaaaaaacagcaaaacaaaacaaaaaacatgaaaggttattaagcactttatgccaggcaccacatcaagccccttaaatgtaacttctaatttaaacctcacaaagaccacatgagatagataccattattgtcctcattttacagataagtaaaacgaggccccagaggttatgtatttgcataaagcctggtagagagtaaattgtgaattagtaactcatcccaggtctatgcaatacttgtgtccttaactattgtggcatacaggtatgggattcatttaagtgcctgataaatgctttctgacatctacatgggaacattaaattgtatttggggaagaatcactgcaaattgaagtaggcaagattttagatatgcatacttttttttgagacagggtcttactctgccgtccagtctggagcacagaggcgtgattttggctcactgcaatctctgtctcccgggttcacgcctcagcctcctgagtagctgggactataggcatgcaccaccacgcctggctaatttttgtatttttggtggagatggggtttcgccatgcagcccaggttggtctcctgggctcaagcaatccgcctactttggcctcccagagaactggaattacaggtgtgaaccacagtgactggctcatttttttcttaaaactccccattcttttctgttatagagactgggccattttctcttttcttcaatattttgatgattctcagctctaattgatcatggttcttagaaccaaatggtatcagttgtatcagttcttcataaaatacttctaattacaacacctctcctctttttcatttccaagcccttacagaattatgacattagggtcagatcaagccataagcgattcagcagcaagtagtgtaaatacttctaagaactgtgaccctcaaataatatatatatataatattcaccatatgattatggtgaatatatataatattcagaagaatattttaatgggatgtgaagttgggagtttcagtggaggcatcgaaataccatcagtaagaccaagatgcaaattttgaaaggaaatatttgaccacaagggatacaatgcttaaaaatctttctcccagaccaaggatatgaaacagttgggctgttggagatgtgagtgttttggaatgagctactgctctgttgcgtctcacgccgtacatacccagtgcaggagagaagaacgtgtgcatgcatgtgtgtgtgcgtgtgtgtgtgtgtcagtcatggggagggaagtctttgactctcagatctaatctagtgagaagaacttcaaaggcaccacatggaaagcttatatttgtctcctgcaggtagggaaacacagtagattgatgtcaaactctggctttggaaacagagaggttaagggtcaaaagatgtgatagacaatatttttgagatgaatgtcagactttttgttgcctggagattggcctgcatttccagagttttcccaggctaagattgtttcttctgggccacatcttcaaaacagatctggtttgggattattcttaaattcctgtccactagacaacactctgagagtgatcaaaactgacactgtcaacaaagagcagatatagctatacatcgtgtgcctaaggttagggtgccctgggaagaacacaaaatcacttttgtagtattctggctagaaatgcttcatcaaatctaagtgtgaaatacaagacaaatccaattatggaacagcctataagtaaatgacttgtattcttttttctgttttttttttctgttttttttttttttttttgagacagagtcttgcactgtcatccaggctgagtgcagtggcgcgatctcagctcactgcaacctccacctcctgggttcaagcaattctcctgcctcagtctcttcagtagctgggactacaggtgcctgccaccacgcccagctaatttttgtatttttagtagagacggggattcaccatgttggccaggatgatctcaaactcctgacctccagtgacctgcccgcctcgacttcccaaagtgctgggattacaggcgtgagtcactgtgcctggccagatggcttgtattcttaaaaaatgtcaatgtcactgaagccaaagtgtggctaaggaattgttatagattaaaagagacaaaaaaaacatgaaaactgaatgctatatgtaattctaaataggattctgtcctggaagaaaaaaatgatgtaaaagacactattgagacagtggtatatcagagttaaatttcctgaactcgatggttgttctgtggctatatctttgttcttaggtatacatgaagtattaaaaggcaatagggcatgatgtatgcaacctacactcaaatggttctgaaaataaattgcatgcgtacgtgtgtaaaggcagtgataaaacaaatgtggcaaattataaaaattactgaatttaggtcacaggtattcttataacttttctgtaaattggagattatttctgtaagtttgaggttatttcaaaataaaaattaaaaacagatcattttctgagccactagccaaggtttgtttcaacctcttctccccaacccctaccgacatacaatcacccccttcaggaatgttagtaagtccccaccaagacaagctaaatcagaatctcaggagctaaggcccaaggatttgtgttttaacaagttctccaggcggttcttatgtgtactaaagcttgagaaacactggtttagcctagttaagaaccatgcttggagttgggggtggggttaaccccattgggctgttacactatgggggaaaggtggctggggataggggaaatggccacaggatctgtctcacatgactgttaagatgatagtggctgagatggttacattctcccctatcccgcccacctttttccttttagctttgacccagaggccttaaggacacatttttagtccaacatttcacaacaggaggtatacgtgactaatgtatatttattagagagcaaattcacaaaactctccacactgaatacaaattgattatggtgaattagcagagttgttcatttttggcctagtgaggagtagcagagatttttccttgggcatggtgggctgcaggtcccaagccctgccccacagggaggcagctgaggcccggtgagaattcgagcacagagctggcaggctggcactgctgggggacccggcgcaccctccgcagctgctggcccaggtgctaagaccctcattgcccggggccggagctggccggctgctccgggtgcgggtccgcccagcccatgcccactcggaactcgagctggcccacaagtgcactgcagccgcggttgccgcccgcgcctctccctccacaccccacagcaagcagagggagctggctccggcctcggccagcccagagaggggctcccacagtgcagcggctggctgaagggctcctcaagcgcagccagagtgggcgctgagagcgagctagggctgccagcacactgtcacctctcacctacaagagcctggccttggatgttctaattggaagtgatttggtatgtcagatttgttgatctgtctgagtagggaaaaaggaattggagattgatagaaacattgatggaatgagggggatcagtggagccgtttacatgcccagtctttggcatggtaaggatgcctgtatccagaactacctacataaattttcatggctcagtgaaaaataaaattgtggggcctcttgttaaaaaataatcaagaatttcaggatagcaccaacaaaacatcaaaccaatcatggggccctgtgctattgcacaggttgcaacaccatgaagcagaccctgcctaaatctcatgtggtcaaaaggaggccagacttgctagaacccacccaagaggtttgttggcctgtggataatagtgtcaggggtggagctgaaggggttgggaagaagtcaggctggggcaagctctcccacttcgaagaactgtgcactgcgaggtctttcagagcttttaaaatcttcatccacatgcccagcatagaactgctatttgacaaccacctgacaagaaggcctctgcaaccagtcagagtttactagatgagcagtggagtcgtgaggactgaaattgcaaacccaggtcagaatgatatgtttgctcatttcatcctgatcctgcattcccttcccaacacccaagaagctaaaatgtgaagatgtaagggaaggagtaaaagagaagaccacatccctccctgatgctggcctattgatctaaggaagtctggaatgtgtgtgtgtgtgtgtgtgtgtgtgtgtgtgtgtgtgtgttttgagacagagtctcgctctgtcactcaggctggagtgcagtggcatgatctcggctcactgcgacctccacctcgtgggttaaagtgattctcgtgcctcagcctccagagtagctgggattacaggcatgcaccaccaggccccgctaatttttgtatttttagaagagatggggtttcaccatgttggccaggctggtctcgaactccctacctcaggtgatctgcccgccttggcctcccaaattgctgggattacaggcgtgagccaccgcacccggtcatgtgtgtgtatttttaataaccaaaaatgacaatgactctaaatctaagagctctccttgaaatattattaaaagacagaacatgtagatttgatagaacatttccctttgttgaaagggaatgatttaaaaccccatattttatttgcacctcatgaagcagactgctcaataaaccagttactattaaaaattatatttaggccaggcgcagtggctcatgtctgtaatcccagcactttgggaggctgaggtgggcaaatcacctgaggtcaggagttcgagaccagcctggccaacatgatgaaaccccatctctactaaaaatacaaaaattagccaggcgtggtggcaggtgcctgtaatcccagctactcaggaggctgaggtaggagaattgcttgaacccaggaggcagaggttgcagtgagccgagatcgtgccactgcactccagcctcggtaacaaagagcaaaactccatctcaaaaaaagattatatttattacaaggcagggaataagaaaagggattcacaaaacactcagttgacagataatagattgcaaaccctttcacttctagtgttgatctgaggatatccaagtgaacactgaatgtaaattaccctgaaaacatctccgctagaagaacttgttactgaaaccttatttttaatataggcaatcctttgggagtaaacatttcaaatattacatcctgctctatttattatctctccctatgggttttttagggcatgataacttgggcttttgctgaagtgactcatagtctcagcacaggagactttttgaatatcatttggtggactgttctcatcatccaaagtaataaacatatttaagcattcaaaaattctaaattatttattatttcatttatctaccaaatatttattgaagtcataaatgggtactgctagtccccatgaggggtaaaacatgaattagacactgttctcattttcaggatgtttctagtttggtaagactcaagatgtacagatataacaagaaggcaaggtggaaagtgttgagaggtaccttaaaaggtatgtgcccttagaccaggcaactgagtccctgacctgggctctgagttttacaggatcttctggattaaggggacacgctcaccagaagcctgaacttcctcctctagcttctaaactgtgtcctgagtgtccaagatcccagaatctcatacataaattcatttccccaagtatagagacagaagctggaaacgtgggccaactctctctacactacaccaccttttacagtttattagttaattagcaacctttaatatttagactacgtaataagggcctctgatactctcggcatggaaacccacaaatgttagggggcaagttggcctggctatgggaattcaggaggaggcagaactttgccttggcagtatataggaagttccactggggaaggagaacttgggcatgcagaggtgggagaagggagaagaggaacttctggaagagggaacatcacactcaaagacatgagactaaaagtgccaggttacatgtgaaaagtctggctttcctggataccaggaatggaagggcagaaactcaggttgtaaaaggagaaggagaccagatcatggatggtgtggaatacaggacatggtgagtgagggtttggcaaactgtctcatattcttagtataggagagtctatttagagtgactgacgttcacatctaacactcacatcagcaggtaggccttactgtagacaataagctgtcattggaggtttgagcagttttgatgagatcaactttgtaagtataaagctctggcttgctatgggatagcaagtgggagagactggaagggtggaaacaggcaactgtgtagaagagggcaatgatataggagaaggtgaaaaagagacatatttgagataatagaaaggaagaactaggtagagaaacaaataaaaagtgatcccaagactttgtatgaatcccttggccaccccttaggccacctctctgtggccagctaaccatctttgccatgccaacacagaagagtgaccagctccagtccccagactatattggatacctctgtgggtgttgagtggtgggtggtagggacagggtgaagaggaaggaagacattggatttgggtacatggtttgaagtttgcacctgttcattagcataaacaaccactacttattttgtgtgtgttgtccgcagatagtttgtgacttgaaacaaagattattcacaattttgatcaataatttgggtacacggtttgaagtttgcacctgttcattagcataaacaaccactactcattttgttttgtttttcgagatggagtttcgctcttgttgcccaggctggaatgcaatggcgcgatctcggctcactgcaacttccacctcccagaatcaagcaattctcctgcctcagcctcccaagtagctgggattacaggcacccaccaccacacccagctaacgtttttgtatttttagtagagacggggtttcaccatgttggccaggctggtctcaaactcctgagctcaggtgatccccccacctctgcctcccaaagtgcttggattacaggcgtgagccaccgtgcctggccaaccactactcattttgtatgtgttggccacagatagtttgtgacttaaaacaaagatcattcatgactttgatcaataattgagcatccactggatgtatagcacagtagtgccgtgcaatatggggaacaatacaatgtaatgcacagatctcttggataaacagaaacttccatttccagggtcactatgttgttctgtctcagctttttaataactcctatgcccaatgtcttggtggcccccaacagtgatataatgtgtgtagacagagaagggctggattatgtaacaggcatttctaagttgtcaagtaactttttacaaagaaggacacataaaaggagatctgtcagctgcatgctattacaatgactgggtccagtttatctcaacacacacaggctttgcactggtgtttcctggattcagtgtctattcccttctatctagcaggctttttaaacacaaacttttgtttttttgagacggagtcttgctctgtcgcccaggttggagtgcagtggcgccatctctgctcactgcaacctctgcctcccagcttcaagcaattctcctgcctcagcctccagagtagctgggattataggcctgtgccaccacgtccggctaatttttgtatttttagtagagatggggtttcgccatgttggccaagctggtcttgaactcctgaccccaagtgatcctcccgcctcagtctctcaaagtgctgggattacaggcgtgagtcgctgcgcctggccttttgaattctgggctaattctttcattttctattatgtgattataagtctcaatctaaaccatctttgaactgtaagacatgtaagacatctgactgtaagttacattttggtcagttgcacaatttgacacaacatgcttctgcacaccccaagttcctctgcctttctacaaactttgctctgtggggattacttatgtagcacttttaaattaggtggctggtatcaaaaccgccatacagtttgcctccactgtgtcttctagaagggaagagcaaaaggcttttaaaatcatgttctaagaagagggctacagaagcaacagagaaggcgtggaaaagtgtctagctgcgttttgcttataacggctggagctttaagagtcagcagctttaaacgtaaacaagccagggttgtcttgagccggggaccttgggctgatgggggtggaaggttaacctcggcttggagttaacgaagcgcaggaggcgcggcctcggaggcttaaagctcagctccactgagccctcaccgctgaaggttggctacaaaaactggcttggccaagtgacgtttacctccttggaggctcgcgtccacctggacatcagcggacgggtcgagtttcattaacgccgcgtacttgagaaaagaagaggaaaaagaccacccaaactacataacgaaatcgagatcatcctccttccctcactctcttccttcctctcttctactttcttcatcatgcatttattttttatttgtatttttttcctttacttcaacgcctacctcttccttggccagcaaattacccaccccgctggggctccaccttttcatctccagcagttcgggggctctctccattgtgctcgggtcctacagtgcgctcgcccggccgccacctctcaccctccctgcccccatcaagcttcttcgagttcccaggcagcgactgtcgcgccccaggtccggcctctccagggcggccgcacgcgcccgctcccccgccggggtcccccgccgcccctccagcgccgcccagcgtcgcgtccccgcgcgggccggtgcggcggcagcagaggcttcccgggtggcccggcctcccgagggtcgccccgccccggcccagctccgcccccggccgctgctccctgattggccgcccccccacctctccagggctcctctcctcctcctcgcccaatgggcaccggcacctggtccaaaaattcccctgaggggaccgagggggctcggccacttccagctcccgccgggcggctgtgacggccgcagcgggtcgcagagcagggagtggacacggagtggggagcggagagggaaggaggaggaggaggagcaaaggtgttggagagaaaacttcagaaaggaacaggaaacctgccggggaggcggcggcggctgcggcttctctgggcgcctgggctgcgctcttcgcggggtgtccgcagctgcggcttggccccggtctggcttccccggcgcgcacgcacggctgagccgcgacgctcagtggctcgggccgtgccctccgccgcggctcttggccgctgtagtcccgcgatccgatccgcttctgccgcggcggctccctggagagagggcggcgagggcgcagggaagaagagggacgtccactgtggaacatgaagcagcatgactgagaaaatgtccagcttcctctacataggggacatcgtgtccctgtacgcggagggctcggtcaacggcttcatcagcaccttggggtaagcgggagacgagggctgggcagcgctcgcgctccgggtcctgggaaccagtccctgtccctcctccgccgcccggtcctcccgctgccgcgcgtggtggcccggccgggcagggtcggcgcccgcggacagcgccgtgcgctccgctctctcgctcgcccgctcgcaggaagctgccctgagaggcaagactttctcagcaacttcgtaatctcaagctcagagacacatcagaaaggaggaagtgattcagaagcccggagacgggcccggcgaagaggtcttcgctggcttctccctgggttgttttgattaaaatgtgtgcttgttttccctggaaggtaaaacaaaacaccccccttttccaccgtttctcgctaccgtcctcagcccctggtctctcagtgccgggtttgaaagagcagtcgataaaagtccgtggccttggacatgaaactcaagcgatgtggtgagccaaagtgtggcgttgtcctgcgggaggagctcaccgtcccctcttcgctggagcagtttccttttggccttgccgaaccaggactcgccccactggcctgggcagccctaggggcatctgcagcgctgtggcccttggacgtctctgagggcttcctgggttctagaactcagacctgctatctctccttcccaggccttggcccactgaaatgctgagcctctcttggaatttagccaagtgaagagttcttgagattcgagttgaatggggggaaaaatatatatatatatacacatatatgtatatatgtttatgaatgagggaaatatatattaatatatttatatattttatgtataatatatatttatatattttatgtataatatatatttatatattttatgtataatatatatttatatattttatgtagaatatatatttatatattttatgtagaatatatatttatatattttatgtagaatatatatttatatattttatgtagaatatatatatatatttatatataaaacagtgtgccaaatggttaaataggacttccttgttttctctgttctgattgggaatagcagtgtgcagtttaattgcacgctgcagtatattttgatgcacaggaaattttttgttacctcgttgtttcaacacttaggtccccccgccctacatttcaggctgtggaactggtgtttccactcctgtctggctactgttttcagctgttaggctttggggcagatgacttaacctgcaacgacccgggacagtgacttcgagctgtgttataacggactgctgcctaccaagcactgggacgtggaagtcaccagtacttccacagttcctgttacttgtgcattccccctaatgagtgaaagaagggaggtagatttaattcaatcccttttccatcagtgttactttcttatgcaactaaagcgtggtaggaaaaacacgttagtgccaagcgcttctgctgggtttgtgaatcatgagctaccactgtttttgagatcattcatgatacaagttcagtttctgggcctccagcaacattttgcaggtggactctgctgctcttcaccctccgtagactctccaggtgtgtgtgtgtgatgtagtagttaagcagagggggttccatggacagaatacttggggtttgaattctggcgcttccacttgtaaaccttatgaccttgggaaagttacataaactctgtgcccctgtctcctcagttctacaaatgggaataggcatggtttctacctcatagggttgtggtgaggaagaagagattaatatatgtaaagtgagtagcatggtacctggcacagtataagcactgatgtgttagctattgtagtaattatcattgccttggtgacggtgagccatagttatatttgtggacaaaataataacaaggactaggaatagagtataaaacctagacaaagaaaagaacttttttttagtgtctaattcagcaaatgtatgcttatggataacttataaaacaaataccagaaggactatatagatggcatatcaggaagctacaagtttgacagttgtggagtcgaccctgatcattttagagattaggaattgaggttaagagaaatgaagtgactaacccaggaaacagagggcattaatgccaaaacctggaacctaatcctgtctccagattcccagccaagagtgcttttctttggttatacataataatctttaaaccttgagaaaaataagctagactaacctttaatgtacaatatacatttgtgtaaatatctctgatttgtattcaacttttttgttggtgttttgaaggttgagcttccttagtatgcatttgtgcaatatattgtttttctattaatgaactgagtcttgttgaagttaatatgacaaagccttcgtgctgctagattctaaggtgaagaagggtctttagaaatgctgccattgggctgggcacagtggctcatgcctgtaatcccagcactttgggaggccaaggcgggcagatcacttgaggtcagcagtttgagaccagcctggccaacatggggaaaccccatctctattaaaaatacaaaaattagctgggcgtggtggcggacgcctgtagtcccagctactcgggaggctgaggcaggagaatcacttgaacctgggaggcggaggttgcagtgagctgagattgcgccactgcactccagcctgggggacagagcgagactctgcctcaaaaaaaacaaacaaaacaaaacaaaaagaaatgctgctattggtgaaacctggtgctttgattggatattctttttctgagatagactgctcagagtttcagataactttgtagtacttcagaagtcagaggttggatatgaccatgcctccctcctggtacttgcttctgaacatcttttcaaaggacagttgtagtaaaagtcattgctgatgtgccctggtgcagtttcctggccttcactggaatagtgtccaaaggatactcaagggaagcatggtgagcctaggacttaaatgggtcctgggtgaagtgaatctctttatagaataagacaaactgtaaaattaagaatgccgtgatccagcctgggcaacagacggagaccctgtctgtacaaaaaatataaaaaattagccaggtgtggtggtgcacgcctgtggtcccagctggtctcagccacttgggaggctgaggtgggatggtcacttgagcttgggaggtcaaggctgcagggagcaacagtcacaccattgcactccagcctgggtgacagagagagcccctgtctaaaaaaaaaaggtgctatgaaatctcatttgacaaatgtgcatcaaatttttatgatgcataaaaatatagcagttttctactttgaaaacagggcagtgcagaaagcgttaattttttttataataaaaaattgggaatatcaaaaaattaaacctgaaatcattatcttattaatgaacatttccaaattctgctgtatgtgggatatgcaaataatgttgcaaacacttgaaagttgctttcagaaagcatctggcacgtcattgaaaaaggctcatttaatttctaaagaaaccatgctgttcatttgctattcttctaagaattacatttaaaattcatataagagagaagaggaaacttaggaagaaagaagtgaatttattttcctgaccataggtcttccatctcaacaaaactatgtggctcttgtgcccagggctgtaggtttgcccacggctccttgcggtcctctactctgtacctccagccatcagagtatgtatttctgtggcagttgttagataagatgctaaaactgacttttggctttgataagtaaaccaagctactttatcctaatttaaactgatgtattttgcactcatctcatcgatttttattaacatgtgggtggttttcaaggttgggaatccataaataaaataatttcctaaaattcggggtgaaaaagtttcagctattgagaaataatcccatttaatttcataatggcttaattaaggccatggaatataacatctgatgcttttatcctgagaagtcagactgattcatgattttgttccctctgctttctgtctgtgacattgcagttttttaatggtccgtcatgcttggttttagtactttcttaaggctgtggaatcacattgggctcagatttttaggaattataaaactcatgggaacatatgtctgtgccacgtgaaatcttatctaggtacatgtaggggtagcactccctattttttacctcggagtacaattggtagatattttattttgcaagttggttttagggctatgaaaccaaagcagagtggtagttgtgatttctcattgtcttgttgtggggtcattatttgtacactttctgcttcaaagacagagtgcatctctctagttgaattttctttctcttctgttagttggaggtctgttgctccaggtctgctgctaattagccatatggccttgttcctatcgtttattcttttttcatgtcagtatgtcttcctgaaaactaagaaggagagaagatgctgtggcccatccccctgggggtattataaaaacaagtgatagagacagaaagaaaagatttcttttttagaaaattgctaggaaaatctacattatgcttatatttttgcatgtcaaattgcacattttcttcaaaggcgtacgaattgttaaagtgaatcagattggagacattgacactgtatatatttagtgacaatttattccactgtcatattaaaaacgcaacgggggagctaaaaattagactaaaagtttttgatttccattttagctcttcagccatgcatgatggctagtagcatgatgttttttcaaagtcagcttagcaaggtgtttaatgagaactgagtttacacagtatttcaagataatgaatagacatttatttgcaaataaatcttgtttgatttcaatgtttagcatgtaaataagttttggatgatatacattgttattgtgtagttgctgggaatttctgccataaggtaatgaatttttcagctggaaaagtcatggagtttcactatatttgagtttaccggacctctcttggaggcccctctgactggagatgtgggaggattttcttaggcttagtggcccagcttctcaggttgatttatcagtctgtttgtgcaaaatttgaatgccctagttgcaaagattggcatttctcctttttttccccattatcctttacctgtatttactagatgtttctgaatcttgaattgttgcaagccgagttacagttattgttcttttctccgagtttattgttcttttctccgtgtaagtgcaaaggggcctgctttgtatttcctaatttaaattttcatctaaagaatcaatttaagaaatacttgtattgacttatggacaattgctttaaatcctattggacgaagatggtgaatctattttaaataaactatttttattttctactggcatgtcttaaggttatagtttttgtgtctcttttaaaggtgaaggagggagtcttgggatgtgctgtccactttcaaatgtagtgttgattgtccctttctcctccttccattttttctatactaggatttgtctttcttgttgctgccacatctgatgacaacagatattcacatttctgtgtacgtcaacttgaccaatggtcaggtaccacagagtagggactgagcatagcagaattcttgggatagtgggatagtagaatcagtgtaaggtgcatcggtccttccttggctgttctcggcatggttgaggggttcgtaaatgaaaagtgtgtatatgtgtgtgtgtgtgtacatctgtatatgtatgtttaagtgatagccacctttgccttgaggtttcttctcaggatcgcctcagaaccaacacctagaagttaaggtctcagtaactatcaggtgactaccaattgatgcgctgacttcaaagcatcataagcatcatcatcatagtctcttagtcagagtgacagaggattggagcccttatttttacttcctgcttgattttggccaatgcaattaacttttccattcctttgtttccatgttcagggatggatgtctggtagggtgatagggagggggtcacacagtttataattctgacttaattccttagaagaatgagactgtgtaactgtttacattttactattcccaattatagtccctcaaatttctcttcctgatcttttttcctgctaaacattttgatgtttaaatagttgtagatttgatttatcttatttaattatgctgttcttattacagttttaaaaatattttcctcaataggactttttttttttttcttgaggcttgaccacagctcactgcaaccctgaactcctgggctcaagcgatccctccacctcagcctcccaaagttctaggattacaggtgtgagccatgacacccagcctcaataggactttttgatcagtggggagtttgtacatgaagcttggaatggttatagttaacttttatttttgtataagatgtttagtatcttccaaacagaactcttccaaatgatggctgttgtttcctgccataaccaggcatataagcttagctttgttttggctaaggcatatgataatgtgataaatatatctaaaagtccattggacatttgcatgtgtgttcactgtggaggaagaagatgacagaagcttgaatactgagttgttttggaaagtctaagtgttagaagtgtgatgttgtggaacttgaaattaagtacaaagagagtttctgaagtggtgaacataaagtatattttaagctgaaagggtgactatttcttaaacctaaaagtcattctataaataccataacagcttttcagccccctctggcaatgagagctcagtcaagtaaacaaccacccctcctcaagagccctgatggcttggctttgatagaagtcagaggtaactgcttggctttattctaggtggaacagagccattttctttgtgcacaggtagcgcttttcacaatgacacttttttttttgtaactgttctcatgcagatagtgtgtagataacttagagaatatagacagaatactatagactcaaactttaaaacttaaattccaggcagagggtcttcatatataaatataaaagaattaacagtggacttttatgaccgatttatgctataataacagtgaattttatggtttttaaaatatcagaacttggtaatagatcactgcgttataaccagacatgaaattttaatgatcgttcatttgttcattcacttatttttattttttaattttcttcagagacagggtcttgctctatcgtccaggttggagtgcagtggcgtgatcttggctcactgcaacctctgcctcctgggttcaagccattcctgtgcctcaattttcggagtagctgggactgcaggtgtgcgccaccacattcggctaatttattgtatttttagtagagatagggtgttgccatgttggccaggctggtctcaaactcctaacctcaggtgatctacctgccttggcttcccaaagtgttgggattacaggtgtgagccactgcgcccagcccattcacttatttaatgaataaaactgtgccttttgaatgtattgatggcattttttggtgtcatgtttctactcccatgatgactttgatgggaatgtttaaaaatatatagctttagaaaaccacaattttaataaaaaatattcaaaacaatatatatggaaaatagaacagcatattagcagtggttgaccctttatggtgagtatgtagatgattttaatttcaatttttatttcttctgtatttcccagttttatgtatggttttaaattaaacatctattacttttatagccaggaaagttaactaaaatggtttttaaggactcttcaatttcttattactgttaatcaacaatatttacattaaaaagcataaataaattattttcctagttatggtcagtggaggaaaaccacaaactgagaaactgttattactgaaatagacagtcatataattaccatgaaattttttttcctggttattattgatattttaaggtgtattgtggaaaaaatgtttgtctgaccagtaatgctgagcaattaagttggttgatttaactcatgtagtaaatgtatacagatgataaccaatttacaatggtttgatggtttgatttacaatttttcaacttgatgatggtgcaaaagtaatactcattcagtagaaaccatattagagtactcaaataaccattctgttttcaactttcagtatagtattcaataaattacatgagatattcaacacttttattacaaaataggctttgtatttgcccagtgtaggctaacgtaagtgttctgagaacacgtaaagaaggttaggctaagctatgttgtttggtaggttaggtgtattaaatgaatttttgactaagaatattttcaacttacaatgggtttattgggatgttaccccattgtaagttgaagagtattggtagtcttttaatttagaagtctattgacacatgttaagaagtatgcattttagcatggctgacttgttcattttagtaatcttagtactcactatgaaacttttattgcttgagtcaacttctatagtgttagtttttgaggagatttgtgtgtgtgtgtgtaattgaaatttaatcaactgtttttattgactatctttgaaatagatggattagctctctcaaaattcaaatcaataatgggttaccatagtttataccaacctatccaaagatttccaaccttgaattaagaataagttaaaatatcaggttctttagacaaaactttaatcatacaattgaaaatgtgtccatattaagacacatgtgactatcctggagatgtggtttatgctgaagcatgcttcagaatgactcattaattcatttagtagatatttcttgagccctttctgtgtgccgggcaatatgtgtaaagagatgccagatattaagctgtttttaattattatctcaatggattaattgttactttaattgttatctgaaaaacttaatcttcctttgcgaatttgtagtatgactcttggctaggatctgtgggagacatcaaggcatttgacactttttttgctctcagtgttgcaaatgttgcaaggtcaggaatggatactgtcttcttaatcctgtatgctcagcacctgacaaaattgctggtatatagtaggtgtttaataaatatttgtgcaattattgtagtaattttttagcaatggaggtaacactggcattgagtaactgcaatgtcaggcaatttttgtttttttccaagtgcccaaaagatgattaaaacagtaccacagaaagtcagaagagtcagattctttctctcctgattgggatgacctggcgggagcttcaaggaggaggtggcattttcgctgaacttggaaggatcattagaatatttgtctcaaatctatgcccatgattgattatgtattcttggtacttttttctttcatttaaaaaaattggtaaaattttactgtccattttaatagctccaaaaaactaaagcaaacaattcaatattgttgagatatgcaaagacagaagaaataatctgagaacctattttatgcttattttccataaggtttaagcttggttcatatcctctgagaataagatggcattccatccttgtcacatgcggtgaatttactgagacctgagataatgaggctagtactataaagcccagtcaggaagaaacttggcagttgcttgggagaaatttatgcgaagtacccagtgcctttggctattatatttttacctcctttccctgtatttgtttccatccctagtatttcatagtagtttttcttcatgaatcatgaacttaattagaattttataaatgcctggaaacattggcaatatggacaacttttcatcagatattaagaactattaagaactattttaatgaactattaagaactattttaatagttcttaatatagcacacacatacacgagtctcccacttggtatagagtacccttctggtatatatggagtccatcacgctctcttttccttttggtgttttaacatgttaaaaaagccatagatagattcccatgaatgcagggaagactaaaggaagtgaacaatgcataatctgaattcttagaattcaactatgtgttaatgaggttctatctatcactgagatgtttgagtcactgtacaaatatcatcataaaaatttctttgtgcagattacaaaatgctggacttttattatatattgattatcccagagatttcctcgacagagtcctagagaaaacttagatttttagtgaagtaatgtctagttctctagctctctgagatcctgtaatgactaattatgaaataatcactaaggaaaagaggattcttcacattatgtaggaaacttacatggatcatcagaactaaagatgagagctcaaatgaccagataagcaaacaaaacctgacaaaaacccaaaacaaaactggtttaaaagttgttaattttctaatggcaaatcaaagtgtattatttgtaaaaatttcagagaatagagtactcaccaactcaagttgcagctcacatttaattaaattatttgcaaaccttgtagtgaattgccctggaactcttgaaaataatttataggcatcccttgctatcctcattcttactatttgatctcaaaagctctaaagatttggaaagcaggggatacttggatatcactttgcccacatggatgaagtttaagaattgaaaaactgtgttagaagtaacgttctttgttggtgaggaacagaaaccatctctgaccagcttacggaaagaaggaaatttactgtgagaatactggaggagctccaagaaataaaatgatgagctcaacaactgagcatcaggagaggcaggaacctagggctgctttgggaatctcaatagcaggacctactctttgggtcccatcatttacatgacttgaatggagcaatttctgtattcagtgtccctcttgttaaacttcagattatgaggtgatggaatttggcccccttggatcaggattaatcatttatatccatgacggcaagtggcaatgcccagatctggctaccggggaaatcactgtgagcagggctccaatttctgcctgctgctggggcagtgtggtatgggagaaagagaacaaagatgctgggtgtgagctggatttcactgcttagtaggcatcttaatagtcagattttagtgccttttaaagtaaattgcgataaaatatacataaaatttatcattttgaccgtttaaaaagatataattcagtgatattaaggacattcacaatgttgagcaaccatcactgctctgcatttccagaacttttttttactatcccagacagaaactctgtatcctttagaaaataaattcccattctctccttaccccagcccctggtaacctctagtctactttctgtctctatgaatttgcctattctaggtaccatgtataagtgaaaacatgcaatattcatctgtccttttgtgtgtctggcttgttttacttaatgttttcaaggttcatccatgttgcagcacatgttagtacttcattcctgtttattgagaatactattccattgtagacatatgatccattgtgtttatccattcatcagttgataggcatttggattgtttccactttttggctattatgaataatgcagctgtgaatatttatgtacaagattttgtatagatatatatttttaaaaattcttttaggtatatacttagcaatggaatttctgggtcatatggtaatgctatgtttagcatttcaccttggtctttcctatgtgctttaccctgtgttacttttccttcctccatataatcttattacatacaatataatttattatctattgtatccattgtgtatcatctgtctaccccgatagactgtaagttctttgaaggcagggatctttttgttttgccactgaatatctcaaagcgcttggctccataaatattaataaatatttgttgcattaccatatacgtatttaattttaaaatctctaagtagctgttaacatcagttcctctctggaaaaaagtcaatataatgtctcatatttcttaaataccttgagatccatgggcaattcttttaaaatggatgggagttgtcactgggtttatggtgtcattaaatcttgccatcatcagtcttttaataatctgttgtgtcatctctctctacacactcagatcaatatgtggtaaagcttacactctgaaaaagtaatgtacatggccttttcttttttttgagactgagtctcactctgctgtcacccaggctggagtgcagtggcatgatcttgactcactgcaacctctgcctcctgggttcaagcaattctcctgcctcagcctctggagtagctgcgactacaggctcgtgccaccatgcccagctaatttttttgggtatttttagtagagatggggttttgccatgttgtccaggcaggtctcaacctactggcctcaagtgatccgcctgcctcggcctcccaaagtgctgggattacaggcgtgagctaccacacctgacttacatggccttttttttttaatgatttgcatgctatagccacattaaagaaaggttaatatttctgtaaattcagtttgtttttacgtgttcaaagagtgaatttgtaagcattttgtgaagccatttcttaatttaggtgggccttttctcttagtgggtagtacattatacatccagggagacattttatactttaactgctattgacagaaaaatttatttaaaaagaatttgctgataaaaatgcagcgagtagttggggaatttatagtactttagaaagatagaatagggcatatgacaccttgtaattttctttttaaaattcaagaataagtgtttggaaaatgataagcatttaaacacagattaaggagaacaaatgggcagaattttgttcctcgttaatttatatcatatctattgactaagtctgttgtaatgagctttgccttaagccaattccaaaagatacaatatccagccaatttcttcaagaatttgaaattctccagtgttattattgacttatgctaggaatcttcattggtagcagtgttacaaatgaggacttgtttgagagttatttgcatataggacagagaaataaagtgagaaatatagatatgtacaaattacaaaataacttgaaaaataaaacacatattttgatttcttctggttctaacatcctataatgctctttgctagatatttaaaaatgtaatatctttagaaaagcaattttgaggtgaagataccaagtattatcagagttttgtttcatttctataacatccaaactaatccagtttaagtatatcataccaataaagatagtgacttaaaacaaaattctattacccaaatcaccaaacacagttacattaggaatccaaagtaagttaatgatttaaggaacagttactgtgtttggctaaagtgttcaaggtcattgctaatatcggggacataactacttaaacatttgcatttcgggtagatctttgacttcaaccatattttcaaagatgatgatttcagttctggttctttacattagtagggaaggtaaaaaaaaaaaggaattttgttgtactcagagtcctatacttgtggctaggaatgataaatattaagtgaccttttaagtcaaatcaagattcactgtcagtgaaaatgttattaaaaacctgactacactaatccatgtgcaggaatattaataaatgagaaaaggacttttatttacctttcttcctttatttacctgacaggtcatgatttaatagctgagttccaatttaaaacccatgcgaagaatgagcctcctttcctggtcagtacaacgaagtcattgttatctgttaggggagaaaccaaatggatcctttcaaaaagtctcagtggctaaagaatctctcagaaggtcttttaaagtattatcacattgcaaatgtaaaagcactttcttaagaattggagaatctgaatgaagaactgtttgggtaagttgtcgcataggagttctgagaggcagtaatttctttggcaatggatacccatgaagtgattctataaacatttctaaagattagatcaatatttgtattacacatttttttcaaaatggaagttataattaatccaataaattctaaacaataaccacattatttagttttaaacatatttaattgaacaaaatgcatgctaatttcagtttttgtatcatagactactagtgatttctccaaattcatttttcccttcttccatactaatagaagtaattgagtttgtgggtacccagaataaagaccacattttctagcctcctttgtagccaggtgtgaccacaggctatactttgcagtcaggtattttaaggaaggatttactgcctcccccaccctccctctgcccctaccccattcaactgtttgaaatatggacatgggaaaatggcatcttggaccatacagatgaggtcagtcactagggataatagagcatcaagaaatgaaacagttctccagatgtcctcaaatgctggctctactgtatatggtctaaaaagatgaaactaggtgggtagacaagagccagattatgtattccctattaggtaatgggaagctattgaaggattttgaagcaggagaatgaaataatcagactttgctctagaaaaatcagtcagtggtaaaaaggaggaatagaaaaaggctgaaaatggcaggcagaggaggaattgatacacagcagcctgcaccaaacagctgtagtggggctgaaaagcagcttgtcagcagaagcactgaagggacagtatctttgtttagtgtttcactttaggcctagaaaagatgtatgaattaagatagtcaccactgctattgaggctttattagttttgaaactgagcatacagatttgaagtttctcttttgtttgctcacatttgaataacatgtcattacacccagcattatcgcaggcttttcaggtttctgagatacaaacgtcatcttgtgtcgtttctccttcctctagctctgtgctttgttcgtactgcccttttttttttttttttttttttgaaagagactctcggtctgtcgcccaggctggagtgcagtggcgtgatctcggctcactgcaacctctgcctcccgggttcaagtgattctcctgcctcagcttccccagtagctgggactacaggtgcatgccaccatgcccggctaatttttttgtattttttagtagagatggggtttcaccgtgttagccaggatggtcttgatctcctgacctcgtgatccgcccaccttggcctcccaaagtgacctttttcacctttatagttacacagacattctgagttccctttcgccaccgagcctttttatgtgcttttccctctgtctggtcaatttcccatcttacctgcacacctctcacctgtttattatgtggatttccagctttctgactcatctatagtgaactgttcctgatctcccagactatgtgaggcccctttactatatactcagatagcaccatattcttttccttcacaaaacttaccgcaattatagttttaattttgcttctatttttgtgaatattggattatgtttgtttcacccactatactttaaactctgtaagggctgtgactatgtctggctttgctaataatcatgtcctcaggtctttcacgatgtctgtcacatagtagatactcaagaagtatgttgagggaatgaaaaatgctttagcatatagttaacatgggcttttggttccgacaaacctggttttatatgatgactccactctctcatggtgtgatcttcagaagttatttaatactgaacacctcagtttccttatctgtaaagcaggattattgtccagtttatagtatcaccatgacgttaatggcaactaacatatgtaaaacacttagtaagtgtcaggctcatagcatcagatacctaaagtattaaatacatggaagctattattatttatattattagtagtatatctgaaaaatcagcatgagtttctttttggaagcttggctaagttaatattacattgatgttaaaaagttctgctgtattatgtttatatcattttgcagtacacctttttttttttttttttttttttgagacggagtcttgctctgtcacccaggctggagtgcagtggcgcgatctcagctcactgcaagctctgcctcctgggttcacaccattctcctgcctcagcctcccgagtagctgggactacaggcgtgtgccaccacgcccggctaattttttgtatttttagtggaggtggggtttcaccgtgttagccaggatggtctcgatctcctgacctcgtgatccacctgcctcagcctcccaaagtgctgggtttacagatgtaagccaccgcgccggccacagtacacctgtttttaagctgttatttgtttagtaggctgttcaaaggcatattgccttatctattatttattttggttttggactttttttttctcccttactttgataatgcacgctactcaattgcaggtagttatatttatcttttgttactggtttgatgcatgctatccttttgatgtaatgcaaacacctgaactacatcaacattaataataaccttagaattgcttagcatatatttacaatatcttccttgactagaattttcaactttttaaatgttttaaaaccaacatgttattttagttgctaatatttcatcccgattagaacatagtaatagaaagaaacaatttagttttattttttgagattaaaaacaagtgtttgttttggaaccattagaatatcttttgcatgttttcattggacagctggtgctactatcccttctctgagatttcctttttttttgagactgagtcttaccgtgtcacccaggctagagtgcagtggcacaatcttggcttactgaaacttctgcctcccaggttcaagtgattctcctgcctcagcctcctgagtagctggggactagaggcgtgcaccatcatgcctggctaatttttggtggagatgaggtttcaccatgttggccaggatggtctcaaactcctgacctcaactgattcacccgtctcggcctcccagagtgctgggattacaggcatgagctactgtgcttagagtcccattctattggctaagaattctgattaaacttctgtgactgttagaggaattggcaaaaacacttatctagtttggataattaaccattttacagataaacaaatttgtttaggaaaatcttgtcaaattttaaatagtaactaatcaaattatcatgcttctcttgtaagtattaatgatttttacacaagtcattgggattgaaaaggtataaagagtgtattttatttctgcttcttagatttacctaatgaataaaaattattcaggccctacccttcttttaattgtgccataaaaggagattttactgtttattggaaacttagtatatacgtgtatacaaattattggaaaaccttttaaaaaattaaagcattaaaaaacactttgaagaataaaccactttataaactcttatttgaaaatttctctgtgagaaaatatttctttttagctaacataaattcttgatggtgaagtctgagctagtttgctatttctagggattctggagtacctggtggtggagaagagcttgcaaagtgccacactcctggatgtgataaagaactggtgtatctattttgtaatttttaatttatttttatttttaattttgaaattcattccttcaacagaactggtgtaactgaagacactagttttatttctaagtttattacacttagttttattagttagggtgctttttggttgcaaaagtgagaaaacccaacccaagcaattttcaccccaaaagagaaccttgtgattaaggtaactgagaaatcttggcataatctcctgggttccttcattctgcggcgtcatcagcattagtcctgcccttgcgcaggtgttttgtttatggcatggctgctatctgccgcagccttacctctgtcctcttacaccagagctgaaaagagtgcctcattcccctaaactccagaaaaaaacactatggttattactgttgcaatggctggctcgatgatggtccagctgctctgatggcaaaggtgacgtcatcacgagtaggagaagagcagttctccattcttcatgtagggctctgttgccagaggaaggacagtggatgatggataggcggagacaacacatgtacactgtggccaaataaaatcacccctttaccttcacgaagccacatttcctaagtccttacaagcaggatataaaaattggaagcctttaatgattttggtatttatactattcttatttccagttcattgttctggggctttattttaggactctttcaggtggcgtacacttcctgatggaaaggagaattatccgagtccttttacatgccacaaagcctcaaagctctggtctggtctaaacttcaccttgacatcagctaatgaaaaaaaggattctaaggaaatcaaggatgggggtaatggtgaggggtcaaagaggaaaggcagcagtttggtgtggctaaattatacctcagtaatgctgctacgagatttaaaaagggaggggagtttctgaaacaaacttcccaaataagcacattattcagaatcacagaactttgataaatgaatctcattcatgaaagcatatgtttatgaatatttctcacagtaaatttgtgaatattcccacttttagcttagatgcaagtagcttatcttgtgtctatgaataattgtggctctttatgtgtacacaacaagcatgaattaataattattgtgatagagatgaacacaaagcaaggtgttatataagcagggtttaaaattttcaaaatttaaaatgtaaaatttaaaagtaaggaattgttaatttagatctcagaaattagaaaatcttactgctaaaatgctttttattaaaaattccccagtaaaacaaatataatttattttatgctacaactaaatatgaattataattaataattaacataatatttgaaatgtgatctttatgtaacttttttgaaaagtcaaagtaagctttttgcattcttaaaagtcagtatcttcaaccatttttgtttcttctgttttaagtatttaaaactcaggtccatgttgtactattgaagacgttggttggttatgacatgactatctagaaaatcaaatttaatttcaaagttaaagtcaaatcattgaataaatagatgtttgatagtggctttttaaaggcagtgttgtttgcagagagagctgctcaagcccttgggtctgaattctgttctgtcctgaagaaattctgagaaattgaaaacatcatttaacgtctgaattaaattcttcatctttatattgggagtactgataacacttctcttgtgttcctcagtggtcctttggagttaagaaatgacattatacctgtttgagtatctggaaagctgtaagctgtaagctgtactggtacagctagacatttaaaaattagtattaggttttttttttgagacggagtctcgctctgtcgcccaggctggagtgcagtggtgcaatctcagctcactgcaagctccgcctcacgggttcacgccattctcctgcctcagcctcccgagtagctgggagtacaggcgcctgccaccacgcccggctaatttgtttgtatttttagtagagatgaggtttcactgtgttagccaggatggtctcgatctcttgtcctcgtgatctgcccacctcggcctcccagagtgcttgggattacaggcatgagccaccgcatccggccgtattaggttttttttaaaatggtaaaatcataaggttacctaaacctatttattagcaggaattgaatcatatgacacattttagtgccaacggattatttttctatatttctttactttttttttttttttgagatggagtcttgctctgttgcccaggctagagtgcagtgggatgagctcggctcactgcaacctccgcctcccgggatgaagtgattctcctgcctcagcctcccgagtagcagggactacaggtgtgtgccaccatgcccagctaattttttgtatttttagtagagatggggattcgccatgttggccaggctggtcttgaactcctggcctcaagtgatctgccccttggcctcccaaagtgctgggattacaggtttgagccaccacgcccggccctagatttctttttttttttttttttttcagacggagtcttgctgtgtcgcccaggctggagtgcagtggtgcgatctcggctcactgcaagctccgcctccggggttcgcgccattctcctgcctcagcctcctgagcagctgggactacaggtacccgccaccacgcccggctaattttttttttttttttttttgagacagagtctcgctgtcccccaggctggagtgcagtggcgtcatctcggctcactgcaggctctgccccccgggttcatgccattctcctgcctcaccctcccgagtagctgggagtacaggcgcccgccagggtggtctcgatctcctgacctcgtgatccgcccgcctcggcctcccaaagtgctgggattacaggcgtgagccaccgcgcccaaccaattttttgtattttttagtagagatggggtttcaccgcgttagccaggatggtctcgatctcctgacctcgtgatccgcctgcctcagcctcccaaagtgctgggattacaggcatgagccaccaggccctaggtttctatactttgaaaagcagaacaacgtttcctcttcagcagtgatgcaaataggaagaaaatgttgaattagtttcatatccgggtattttcttgattttattttgtgtttattaatgaagaaacatatttggaaaatagaaataagttctatacaaaattaaacatcttgttttaggcagtcattttaaaactacactccaaatatctgactacaattcagcaggtctgtcatgatatttggagtgtcattagagtatctttctgtttttttttttttttttttttttgtaacttaaaacacaagagaggagatgagacatggatttaaacttcattgtttgtttaaaaaaacagaacagaccaggtgtggtggctcatgcctgtaatgccagcattttgggaggctgaggcaggaggattgcttgcgcccaggagtttgagaccagcctgggaagcatagtgagatcctgtctataaaaataaataaataaatgaaaccaaacaaaaaatgaaactggtctagctgtttcttcaaactccagcagcattcagggaagttaaagggtgaaatactaaacacagttatgtgtctaagtcaagatgtccatacatgaaaggaatgtaacattaagggagagaaaataaaacagttcctatcacatcctttttgttcctgtttttaaatcccaagtcctttaaagaaaacttctgctgcttagcaagtctttaggcaacgcttggaatgctcatgcagagactggcccagcgacagccctggactgccaagttcttggaatcgagtcagtcagggaagaggcttttgattggtgtgtgaaaggaagggaggctgaatgtctgagccgggctgtgctgagcagaagggaagtaggaaaaaggttgggcacagggataatagtgagtccccactttatggctttttttacatttcaaacattgaataaagcaggtaactgatgagatgtcatttcactgatttaacactgaaatataggacactatgaaaaaaaagctataaggatttgaggcaaccattcactgtaggaactatccacaaaattactttataagaaaactaaaaaaggaatggggtagttctactggcaatactaaatctccttccagagtgaacctttcagtcatgtgcccatcacagaccttcttcagactagacaaaagcaagggcaaagtgagattgcgaaagttattttattcttttatgatttaggataagtcttacttcccctggcaggagatgccatcatcttgcgtggatgtggcctttcagtgacaaagcccttagtgtacaatccagaaacaacacacagttgaagaattgtttgtcttctaatggatgtatttttccatgtaatttataattatgaatggcattatgacttaatgtgcaaagctaagaaaactgaaaaaagaaaagctgaaatctgtattggagtgtgggaaagagggagtctattattaaatctacgctcgttatttatagcatgcccaacaggatgaggtaactatggaggtttgtctctttcatgattaggtttggttggaaatcatcagattagcaaggccatcaagccgtaagaacagctgctaaactactcccccaacccccgccaagcccctgaaaaccagttgaaaatattttgggtaagttttactcaaaatatctttaaaacctgacattataaaagagagtgagaaaggcagatatggatagaaggtcatacacacttggggagaattggtaaaatcttaccaaaatgtcaaatgagattgcctgttcctagggagatatttcatagggaagagtgaggtagtgggtacctggagaatatggatcagtgaattatttgggcaggttaaaaaaattcattgtgtacatttgattacataaccttcagtttcattccacagaatagctgaaggttgagaaataagttgttttgcattgaaaaggaatctacttttgggagtctataagtaggaacagccagaccataagccactgagtcacattcttaggggacgtttagggacaaaataattataatgaaattagctgctgtttagacatctctggaaggcattttttgaataaggaaaagcagcatccctggttcctgtttttccttttaaccagagaggaatctgatcagtatcagtttagaagaaaactattttgcagatgagaggagatgcctttccttttgggtccaggaagtgcagggatgaaacatatgcttcaaaaggaatcagaaagtagagactgagatgttcaccacccactcaaatgaagggcagaatacaggtggttaagactccagttgttagctgttagttttgttttcataggaaaaaggattattaaaggagttaacctcataacgtattgtaaaggcgtgtagtatttctgtgaaatgcctgttgaatagagtgtgttctctttgaacacacctctgtgttagagttaagagatcagaatttccataatcattttgagacatattgatgccaagttatgcttatgctttaagagtttttcttaatgttttctggggtcataggtgcctttaagagtctgagaaaattttttgtgcagctttccattactatgcctaaccgcaagattttacatatatttgagggtcttcaagattccttgaaggctatcccttggacccaagcttggacccaagcttgggagtacttgtgctaacatgcaataatggctctaacattaaaatttaagctgtagatttggtctgtcatgtacactgctttatccccagtgcctagaacagtgcgtggttcataatcaacactcaataaatatttgttgaatgaataaatcaatgacaaaatgaacattttattttttagtatgtggcaggtatggatttttttggttacttgtactttattagttctttactagctgtgtgaccttcatggctacatttacttctactgaaaggaacagaaacccaaataagcaaaatagaagctggatggtttgcattgctgggaagttcaagagagggatctggctttaggtacaactggaaccaagggctccattgatgacaccaggattttgcctctctttcttggcttctctccttcttgtaggctttgttctctggcagattttttcccagccatggtggtgaagaatggtttctaggcctacacttttcctcatgatgcttgattttagaaggaagtagaacctgtgtggcatatgtgcctttgtaaaagcactttggccctgcttgggttaagtacttgttctttggatcaagaactgtgtctgggggtaatgggagagaaagaagccagcttagttaggtctcatacctttccttgggtggtggaggacttcctttggttcttcatgccatgtttaagagttgtacttgggaaagagaaatctctaaaagggaaagaaaaagactaaactgtaactgatatccatggcacctttcgtgaatagtttaatttggggttgatattatggtcttaagatgtcagcaggtccattgaatgtcccttaccaagcaactggttttctgggtggtatcaccaaatgcacttacattctgaaagtaaagactatctttcttgcagaatttttaataattaggagaataaataccaacatatgtacaaaaaagacaacaactaggagagcattataggaatcttgtgaaacctgctgtaaatcacggagagctgctgtcttcagactgcagaggcagtgatttggattccccacatatgacattgtgttccagctttgacttctcacctaccctctgatgcctgcagcaggacattggcatggactgaacacattgtgcttggctgggttcataagtagaatcagtgcaggttgattctgggtgggaaaggaaatactttgcaatgtatgggtattgttgaaatcctttcctatgtgttttgttttattacagtggaacatagaatcaatgactaagatttcaaatgactacaatttcaattattattttttgacatatatttcatttaacatggattttcgaacaatgaatatatatatatcttcttttttgttttttttgagacagagtcttgctctgttacccaggccggagtgcagtggtgtaatctcggctcactgcaacctccacctcccaggttcaagtgattctcaggccttagcctcctgagtagctaagattacaggtgtgcaccaccatgcctggctaatttttgtatttttagtagagatgaggtttcaccgtgttggccaggctggtctaatagtgcatatatatatatttcttaaagagaagagggatattttctttgtataatatttgtgaaattttgagaataacacccttagggtgattcaaatgcatttaaatctttcacatgtattttgataaattaagatggttgcaatgggctgggcatggtggctcatacctgtaatcccagcactttgggagcccgaggcaagaggattgcttgagcaaacgtgcttgagaccagagtgggaaacgtggcgaaaccctgtctctacaaaaagacaaaaattacccaggcatggtggcaagtgcctgtagtcccagctactaccactcagtagttccagatccttatcctgaaattcttttcatgtttagtaacgaaatgtgaacttacccagaatattcccacacatttattcttctctttccccttaagacgtagtgaagggattcaactagaaggtaatgtggtacttgacacacagtgggtggtcagttatacttgtttaaaaaaggatgagtgaatataaattaatgtgtaacaaacagtgtactgtaagagtagagggtaaccacagtctcttgtttttttttcaaggctttttctatgtcttattttttcctattaaaaatcatgtttggataacattttccaccaagaagttgagtacattcatatttactgaactcagtaagtgaatattcagtgtttactccgtgccaggcagggtctagttttcgggctctgaagtacttaactgcactatatttatggtcattactatattgccatatataattccactccaaaatcaatataacagctctcaaaaaagagcaactgtttgtatctcctctgaaatttcctgctgtgctccctagttgggagattgatagcttttgagaaacatatttatggaccctcacttttcttacctggattgctgtgctagtttccaaagtggtcttcccacttctgtctctctcttccccaccagtctatctattctcaacccagcagccagagggatctttttagaaataaaccagatcacgttgagctacctgtgctcccaatgctcccatctcactcagaatggaaaccagagtgtttcctatgacttgggaggccctgcaggtctggccttccattccttaatggttcagatgtccttgccaatcacttacctccttcctggctcctgccagccatattagcttccttgcaggtcttggaacatagtgaacacggtcccactgtagagccgtgttttatgtttccttttttctatagtgtttatcccttagcgtgctatgtaatttatggatttactatgcttattgcttgtgatttgtctcctccccattccctcctggaagagtattagttttgtttgctcttagatcaagcctggcacaaagtagctggtcagtaaatatttgtggaatgaatacatttctttgtgaagatatttaaattcatttttttctgaagtgactatcttactggtgaacttctttcaacaattaagcagtaataaataatgatgatgaaaatggcgatagccaatcattactgagtatgtacttggtgtcaggtgttgaataaataacattaataatgatgataatgatggctaacctttattgcatataactttgtactgagcattttgctttattaaatcagttaattttaaaataaaccctatgaggttagtactattattatctcaattttgtagttaggccagagaaacgactttcccaacatcacagatttagtatggaaaagatacaattgtgatattagactcttaaatagaaaaatatattgttaaatttatattttcccattttagtcctattaggttacaaaccagtatgtctctttacgaatttttatttgtggtcatgatcactgtctgaaggattagggattagaattagggatctctggcctggtgcggtggttcacgcctgcattcccagcactttgggaggctgaggtgggtggatctcttgagcccaggagttcaagaccagcctaggcaacatggcaaaaccccgtctctactaaaaatacaaaaattagccaggtgtggtggtgcacgcctgtagtctcaactgatagggaggctgaagtgggatgattgcttgaacagggaggtcaaggttgtagtgagccaggattgcagcactgcattccagcctgggtgacagagagagaccttgtctcaaaataaataaataaataaaaataaaataaataggagtctgttttatttagagataaattcattatctattattaattataaattctactttaagagtactactatttctgcctccaggggttggaaaaaatatccagcctataagcgagggaaatgatttaatttaatgcatacagatgtagctcttttcagccatcagacttttctgcttgtttttatttccttttgattttacccttggtttgctcagctttcagaggtcatgtgggttgcttcattattttcgggtaaggacttactcactccctcccagaaagagaggtctctgcactttaattaaaattctccagaagaaggtatatctgtcattctagccacaattagtcccttgccagtaacctaaataaatctgagaatattttctttgtgcacagaaatgtcttaaaagagggattgtatgcccattgattccatccataccaattaaaagtgtgaatttggaatgacaactgtattttttttctaaaacccatgtttattcacatttagccaatgttaaacgttggaagctctgtctgaaggaattacctgggaatgggaagttgttttgttttttagctcttcccttttctggtagttctcagaaagattctatttactagttgactcagaaacaacagtcatctgcttggaaatttcacaaggtaacttaaaattatttctttattttttatttatatataatagttgcacatattttgggagtacatgtgatattttgttacctgtatataatgtgtaatgatcagatttacagcctccaagtttctggtagtatgagtctagtttctcatgctgtaatgattgtgggaattggtctacagttgcccgaggtttttctggccagggaagttctcttgccaactatttcctcctaggaatgtttctcttttatgtctgatcagtcaggaagtggtagttggttctcatgttcatctctttttgaagaaggaggcataaaggaacagggaagaggcaggtccttaggctacagaacgaatcactgactgcattgtagtgtgaagatttcaaaggaaaaaaatgttttggctaactgatgttctgttctgtctaggagctcttactaactggattattttcagaggtctcctctagccatccacttgtagaatatgtaattaaatgttactttatggtttgctgagggtatgagccaaggacaaacagctatatcattattacatacttgctccatctttcctacctataatctttctttctgctatatcatcacttacctcattttgtcttctgcagtttgttttctttacctttaaaatatcaatggattcatttaacattttttttttttgcacttactatatgccagtcactgtgctgggtattgaggagataaagattaaaaatatactgtactgtccccaaggagctcattgtttattggagacatgtagttagaggtatcatacaataagataacagcttgaagtataatacaatacaataatagcatgtcaaatatggtgggatcataggagaccctaagcctctggaggatgggtgagtgtggggtttttagttaaacataagttcagtgtaagccaagataataatagttttttaaaagccaaaactgtaaatttaggctatattttagaaacagaatggggatatgaaaaccatataatctgaaaacagttgaggaaactggtatgttaatattccatatatgctcaaaaagaatatattttctattttatgtatgtctattagatcaggcttgttgattacaggtttcaaaacttatatccttacaaattttgtcagtttgccctttcagtaattaagcagtgtgttgaaatctcccactaagatagtgtattgttaatttctccctgtagttttgtaaattatgtttattttgaggctgttacatatacatttagaatttgtatatcttaaagcagtgaaacacttctcatgatgtaatggctctctttattctgaataaagcttttttctctttttttgatttttctgatatgtatatatagatatctatctatatctatctgtatatctatatctatatctatatctatatatagatatatatatatctcctctgcagtttgttgagaaacattcctaggaggaaatagttggatatgtatattaatttaaagagacagagtctcactatgtggcccaggctggtcttgaactcctgagctcaaatgctcctcctgcctcggcctcgcaaagtgctagcattacaggcatgagccaacatacctgccctatttgtctgatattatcactgctactatacttttcttttttaaaaattatttttattttttttttagagacagggtcttgttctgttgcccaggctggagtgcagtgacatgatcatagctgcttatagcctccacttcccaggctcaactgatcctccctcctcagcctttgagtagctgggaccacaggtgcatgcaatatgccaggctaatttttaaattttttgtagagacagggtcttgcaatgttgcccaaggctgatctttaactccttgcctcaagtgatcctctcacctcaccttcccaaagcactgggattacaggcataagctactacccctggcccataccttcctttggctagtattttcctgctttgttttgttctgtccttatattctaggtatgactcttgtaaatagcctatggctggattttttaatccaactacaaaatctagctttttttttttttaacatgaagtatttttattttgttaaatccttacagcagtttcattttgcagatgagaatgctgaggcccagagtttaaacaatttgtccaaagttatacagtgagtaactggcaaagaactggcatctgcagtctgacttttggcacatgtacaaccaataccagagtttattatctctattgtccagaggaaaaaactaggggtatcttaaaatctcttgacatctctagttagcgcctgatgactgagagagaggtcagggcctgagaaccaatgatacaaagacccagagggatctattttaattcttcttcatttgagtagagagagacaggcatcctccaaagcaaacccaaccctagggtgacatcaaggaaggtagcagtaggtggtatggtcagcatcttggttccaggcataatgccaatcatatcatatctatcatcatccttatggaggaaccgaagcccagagagatgaaatgatgagggcagtcctgatgcaaattttccttctggatcctgttgtttcaaggtgtgtatctcccatgctgaaggttaaatggggatcatttgccaacaaattttgggggttggttctctctgccatgtttccagccagtcccaggttggaatgttctgggcataaaatatcccttcagtggccatccctgatgcaatgtccacgtccatgccttggtcagtggctactttgcccagctgcatggcaatggggacctggggcaggacctcctgggccagtgcttgtgcccagtggtaggtgacatcaccctcctcgttttaggccacagcatgattcaccaaccccagtgcccactcagtcgtcagcctgtgaagatgagctccttcaccagggccacccccaggcagtgtggcagcctctgagtacctcctgtccctgggaggagccctcgagtggtctctcaatcagttccatgactttcgaggaagctgccacttggaggtcgcaggccagggcaagctccaggcctccacccaaggcgaacccatccatagccacaatggctatggatgctaactatatatgcatggtaaccttctcatccagccctttatataccttaaccttcttttgtatcttctctatccttgttgtcctctgcttcattccaagaaattattaaaacctttcttctaagatattaattagctgtgtctgatttactgtcttcagtccacttacttattcaataattatttttcattcctaggaattctttactaaatctatctggccatattttttaaaatgatagggtcttgctatgttgcccaggctcaactcagactcctgggctcaagaaatccccctgcctcagcctcccaagtagctgggactacaggggtgtaccaccatgccaagctatctgaccatttttgatgtgttcttcctccttgccctgtttataaaatttatcttccatttctttaaacatttcataatagttattttatattttttagttgataattacaatatttgttgttgtttttggtgactcatgcatagtaacttgtttccttgtgttattagtaatttttaaaatatttgagttcatatttctttgaatttaatctgtagtatatcaagtataaaactttttttggtctttttttttgaatggaaagttttttcttgatcacaactgtaaattctggacaaaatataaaaaacagctatgtgtagccactggagagtgaccaaaagcagacagaaacctggggtgggggaggtgtctgtacttggaagaagagagtgagactaggtgggtttctgatttgtatggccttttttcctgagagcacctgcaaattggtgtcaaccaggtggtgaaaactcagataggaatgacagtgtgatggtggtaaagatctggacctgaacttgtctagtgagtcacttttactagcaccaatgattttctggctctttgcaggtgattgagaactggtagtagttaaggtcagctcagccaccactaaataattgatctcaactggtagagatgcctgtttatattctgagaaaagtactttgcagatgctttgactttcatgagaactgtaatggacaagctcagacaaaatgcttcacaaactgacttgcaataacactgggttcaaagaggttgaggaggcagggtcaagaggatcaagaaaaggaagttattttagatggagaaagagaagcccagaagaaaaagtcacgatgatttttctttggctggattaggactgtaagctttcaaaatatacgggcaaatcctctctgaaatcattgtcagatagatgtgtttctctttgaaaggctatgtgtaactcttttagttgtttttccccttagtttcaccagtactgatactctgaagataatcgcttcacaagatgatggcttcttgcagtgctttatgaaaagattaatatgttggaaatagcattctccttgtagtcatgtgatacccatattttaaaaaggtagttaatagttaaattaaatcatttggtcagggtgatagcattcatcaaaacattttaaatgtatggattcatccagtatttttagtagtacttcaaagtttagtgtttatactgtaatttatgtgtgggtataggttaattatgtctttcatggaaaaataagtgggaatattttgaatacctaagagcaagcacaattctaactctgagtgaaaccagttttagaaatattggcagcaacaaacctatgcttgattgaaaacttatatatggaattaaacatacttttaatatttaaaccaaaatatatgtttgtcaacattattgaaattagacatgtctaaaaataggagataatgctaaatttatttgtttaaatttaaaaatcaataaaaccacacatttcaaatggcaaacaaaggtgcacttaactcctcttgtcatcatagacaggcaaaatatgagtgtagccatgaatgaatgtggcatgttgcatctgttttgcatttataagttagaaaacattttggcagaaagttttgcaatgaaattacttccttctttgaatgatttgaattatttatggccttgtacaggagtggccataggacctgtcagatataaggtggaaaactggacatttgtagaaacttctatttctgtttaagttattctggattatgagaaaaattaattaccatacaaacatgaattaacatccttgggatctacttcttatttgggcaacttgagtgttggctaagttaaaaaatgtgcatattactaaatagcaagatattacattttaaaaataatgtgttctaagactacggtgaatgaatggaacaaaaccacttagtgctggtatttagcttgtaatgataaaataatttgtaagcttcaaaaaaatagatgctaaacacttaaactttcaaactacagtgtataaattatgatacatgtcagagggcgctagtgaaggatgacaagccaactctagtcacaaaacaggagcagagaaacaagaaaccacagaaatacgaggaacgtgtgggaacacagctgccccatttcaaaaatgcggcacagtgaagttcagtaactagcataaacacagctggtcaaggatgagaagtcaggtttttttcttctcttctactgctgcttctaagtgcaggtgaaagagggagttgaatgacgtgccagggttgtgggggcctgtgatagattgatggggtggagggacagtttaggtgagaagccagaagattgcagctgagggagaaattcatgtagtcaagcagagtgaaaatcccagcgttgggggatcaagttatttgtgataaagttctgaaagttcttttaaagacaattctgctgggcgcagtggctcacacctgtaatcccagcactttgggaggccgaggtgggcggatcaccagaggtcaggagtttgagaccagcctgaccaacgagatgaaaccccatctctactaaaaatacaaaaattagccgggtgtggtagtgtgcacctgtaatcccagctactcgggaggctgagacaggagagtcatgtgaatctgggaggcaggggttgcagtgagccaagattgcaccattgcactccagcctgggcaacaagaacaaaactccatctcaaaaaaaaaaaaaaaaaaaaaaaaaagacaattccatgatgcttatgaatctatccaccatcttaaccccctctctagtaaaagcttttagtaatgtcaattgtggatgccccaccttctctctttccccaaattcattttatttaaatgcatttcagagccattttgttagaaatgaactatatcacttagtggtaaatgaatcagatatatgtggtaaacaaacatcaggaaaataatatgctgattttataatatattccagatggaaatagcatttatggcttcatcagagaaaagatacaactaatattttatcagttatgtggcattttctttgtagttgttggaataatgagggactggagacaaaggaattatttgctttcttttagaaatctatttaaaaatctgatagccacatattttatacattaattttttataccccatgtgtattcctaaaatatatgctgtttagtgtagcctatatatgcatctatataatggaattatataacatttgttgtttttggattcgctttttttaaagctcaactttatgtttttgagatttttagtgttgttgcatgcagtacaatttattcatttttttggtagttttctactgtatgaaattattcatttagtcataccttttgatttttttttgagacagagtctcattctgtcgcccggactagagggcagtggcgtgatatcagctcactgcaacctccacctccttggttcaagcaattcccctgcctcagcctcccgagtagctgggattacaggtgcgtaccaccatgcccagctgattgtttttgtatttttagtagagacgggggtggtttcaccatgttggccagactggtctcgaactcctgacctcaggcaatccacccgcctcagcctcccaaagtgctgggattacaggtgtgagctgccacgcctggcctagtcataacttctttatccatgttactgttaatgaaaattttgttttttttcagttgttgctatcataaacagttttgccgtgaacactcttgttcgtacatgtcttcagatgcaagtttgtaagatttctgtagagcatatatgtgtctagaaatagaaatggtgaatggaagggcatgcccgtgttcaacttttaaatgtcacattttttccaaattgcttgttctaatttctactctctatagcagtgaatgaaaatttgcattcattcaaaaccttactaacatttcaatttttttcttaccttactttttaccaatttgttggatatgtagtaagattttcatttgacttaaatttttttctgattacaaatgaagttgaacattttatcggacttctaaaagatattagtggttcctcaggcttattcctgggttattttgcatttttctgtttggttgtctttttcttattgattcatagacattccttataaatttctgatactaagcctttgtagcaaatatattctagtttgtaacttgtgtgttaagggatgccattagtatttatggcttctttgtatgaatgagaaaaaaggcctctgttggctgcacaggctgttctcttgtgcaaacataccattatttctgggcaggtgcagcttgtgccactgtatatggcttcaacagtggaacatagaccacatttcagaactgattttgtgtgttgccccccccccctttttttttgtttttggaaacagagtctcgctctgttgcgcaagctggggtgcagtggcgtgatctgggctcactgcaacctctgcctcctgggtttaagcgattctcccgcctcagtctccagagtagctgggattacaggtcgtgccaccacgccctgctaatttttgtatttttttgtagcgatagggttttgctatattgaccatgctggtcttgaactcctgacctcggatgatctgcccacctcagcctcccaaagtgctgggattgcaggcctgaaccaccatgcctggatgctaccaccctttttataatatgcttctacaaatgcacaagcatagcagtggccttgtgactcttctgtctctttatattgtccttgggtggatggaagtcctacttttaatgtagacaaacttatcggtcttttacgttttgtcctttatattgtctatattgtccttaggtggatggaagtcttacttttaatgtagacaaacttatcggtcttttacgttttgtcctttatattgtctatattgtccttaggtggatggaagtcttacttttaatgtagacaaacttatcggtcttttatgttttgtcctttttgtttagtctggcttaaataattttttctactctccgattcataaatatcatcatccatgtattctacacgttttatagttttacttatcacatttgaggctttaattcatgtggtattaacttcttatgtgaagaagggattatgtcatttttccccaaatagacaactaattatcctaacatcatttaatagttcatcctttccttaccttaatgtgttttggtgttgagtttctagatatggcacaaatcaggaaggcattatgcaaattaatgatgtttataaaatacttcagtatacaattgtgctttctaattttagatactataaaaatggaattatagaattatgagatgctaaagctggaatagacatcgacaaaagtcagttagcatttcagtaaaaaatattggagtgtctactacatctccattattttaccatgcatgtatacttggaaagcagagtatgtggatatgtaagagaatacaagttcagcctggtagaacagaaggagggagccaagtctttggtcttgtagatctgggtccaaatcttggctttgctcttgagctgtcatctccaccatatcatttgatctctctaatctgcaagagaaaaatattttgcaaaattgtttggaaattagtaattatgtttataaacatatagagcagtatgtggcatgcaatcagtgattgatagattatagttgtcatttggttgggaagataagactaatgtgtatgtcatacttatatcttgtaaactagaagatacttaaaattgctctgggaattcacagaagagtatctcatcacggggaatatagcttcagtgaagaaatgaaacttgaagatgtgttcaaaggatggatttcagttaatttctatagattgaagccaggttggatggatggatttcatttatatttctggacatggacagcaataaagtgtcttaaacaataaaaacgtagaaaatagataagaaaacgatgcattttctcttgactgttggcatttgtgaaaataattaatagtatactttatttttgacaaagtatcagtggacttgaatttaatgcataaacgtaactttttcatgtagatattacacttctcacagaatttttaagactcttgttatgtccagttaaaattccattcacatttacaaaattcatacttatgtataaaatcaaagtagctattaaattttccttatactttcgaagatctaattgttgagtgatttttttcttgtaagtaaatttgaacaaataatttacagttatgaccttatgaagagaagataggtaggaaaaacaacaggttttatgttagatgagttttagtaaaaaaattgagaattttaggctattgctataattgcctgtttggcttactcactagttagttctaagaaaaataaatgtagcccattaagatgtgcactgatgaattggattgaaaggtgctacctgagatattgttttttagggcaggctctcttggcctttttcaggatatgatatttttgataattttctgggacatacctacatagggaatatttccaaatctctctttcgtctcctattagttgactgtttattgcttctagttattttattgtttatgttaactaccaaaaatagcatcactgattttaaatgtcactttaatcattcatcaattaattatttagcaccatctatattttaagcataatgcttaaagatggccctataatggtgagtaagacagaaatggactgactctcttggagcttataatgatgttgcatatatatatacatgaaattataaaattatactgggctgtgatacagtctattggtagaggatagcctagagtattgtgggagtgcagagcagatcctcctactcaatttaaagagggttagaaagctttttaaaacacacagtcctcgtccccagaaagttttattctaataggtctggacaaaggaaggtttttttttggttatccttattatttttaactccccaaatgattcagccaaatttggggaacactgatcatgagtggttaaaatgggcaaaattatgacatggtctaaatgagttaactagggatggaatagatcaatgtttttcagatgattttcttctcatagaccaaaggtcaatctttgtatttatccctatttggttgtaaattctggtccttagcttataaaagttaactgccctactggtgggtgggagaacctggcttatcagtggtacacatgaaaaggatctggaattattgtttactataaacccaatgaaagtcagaggggaaccttaactgccacaggagctactaaaattgtaggttgcatttctgtaagtttagtatcagaaagaaggaggtaatagtcctctgtactctgccctcgttggggcacatctagactcatgtggatagtctctaggatcacaggtgagaggatgctggcacttggggtgtatgaaggatgttgaactcctggtaaatatccacatggagaagcactggagagaaatcagcttgcccatctcagaaaaagaaaacttagtctatatagtcccagaagaaagaactgggaacaaagagggagagttaattgggaagccaacatcatttattcactgactcatttatttatttaacaaatatttatttagtatctattgcacctcattctagtagatgccaaggatataatggtaaacaagatggattcaatctctgacttcatggagcttaaaatttattggaagactcaagacaattaggcaagtagatagaagaaaatgtagtaagtactattttacctccatataaaacacatttctaatattagggctgtcagaatgatggtaaatggtagatgagttggccttggaagtattcaagaagaggttgttggggatattgtagaagttgttccaggattttggcattaaaagtcaaacaggattccaattaccattaaaatcctgtttgacttttaatgccagtgatcatatatgtcttgtaacagattcagactccttgcttcttcttgtcgtttccttccttccattatcttcaaattcagttccaattctttaagtcttcaggatgaaatgactgccttagtgattttcacagatgtttttgtgtaaggaataggacaaatttttagaactgaagtcactcttaattattatgtttttatctgggctatcagataattgaggatagatattagtgttcacataaatacactgtcatctgatttatagcttcagttctcattcctcttgatggctggtccacacaggcggggactcagtgacattcataaaagtctgtatttttgtgggaatgcacaggtacaaggaatgaatagaatgtcagtgtcatttgtaatttttacattatgtaatttttatgtgctgtaaataagactatgattttttgaccattgtatttgaattcttaacatgtcttaaccaattagaaaagctgacctttccctcacagcacttttatttacatcttacgttgtaatattatcacaactattggagcctttcagattcaatgttacaggctgaagttggacattgtggaagtttgggtttgctttctcttgacccaatgtgacttcctgtttctaataaatcagtttctagagactcttaaaaggaatttcttgcatgcctggcagctcttgtaaaaccacattttagtaaaccagtgtgaatgaagggtatattaaaaaaatcaaggaactgtatttcttgaccaaatcagcattttgttttgtggaaattggattccacagaaaaatctgttgatttaggaagtgtctgcttccagtaactagataaactaggaaccaaaagtttcattttgattaagtcagtcatcctagttcaactcctgtgctggagttgatgcatgctagtgagtctggttaatacttcctcttcttcttttttttttttaaaccacaaggttgcaatttgggcatctccctttaaatgaattcatatacatgtaattaattaacatgcattctcacaatattctggaaaaaaacctgggtattcacaccacgtaaccaatggagaaatgaatgttagtgagtctggtattaagagatctttctctttgaacaggggattcatgtctcctggctctcggttcagagattcagcttctctgtcttgaaattgtcctacaaattgtcttctcataaatattttaatagagattaaacatgttgttgtagctacaaaggcagtttattcattttacttatatttgttgagcacttgtagtgtgtcaggcactcttctagaagcagagaatatgtgaagacacaagattcttgattttatttgtccattaaatggaaactgccagaagttgtactaggtactttaaaaatactaagtcatttaatctttctaacaatactgtgaggtagatatttttatccttattgtttaggtataaagaaggaggcctgaagtcacctagctaggaagtggccaagccagagattgaatgcaggccaggaaggcataaccacctactctatgggcactccagaagcctgatctcataagcttacacattccctgtaaaacatacatacacaccgggaaaaataaaagacaggaaaataaaaactatgggtaatctgaccactcttaatgttttgctgtgttccattccttatatatgtatgtgtagaagtgtgtgtgtgtgtgtgtgtgtgtgtgtgtgtaagcatatatgtatcttattgattggttaccactacattcactacatactgtaaacattttgcaggccagtgcattttgtttaatgtagttttaaacagctccgcagtgttccatgtcatgagttatctaactagtttcctacctcttaacaatgtttccaatgtttcaatttcataaaccaggctttaattaacatctctacaaccaaatctttttacagacccatgattgttaaaaagttacttagtgaagaaaggtattaaaacttttggtaaatatttatgcaatatccatgtgcagtctgtggtttatgaatatgacaaggatgttaacaatgtaaacatgcttttccttctaggttagtggatgacagatgtgtggtgcacccagaggccggggaccttgccaaccctcccaagaagttcagaggtaagaaatacatatatttttttaattgtgtgagctaagagggaggattatttttatgtctcaaagtaagtaatgttaaaactttattcaatgtgaaactttcagatataaatatgttcactgaaaattctttcaacaatttttccattgtttttcttttacatattgagggatttacaatgaaagaatagttttgatttttgttttgccagacaatggtctatctgttaaaaggaaatcttggtaattaactgtgaaaggctacttgtcaagccagtaaatgcagctgaacagtatttatttatatacttctctgacagttataaatgttatagtgttgcattgttagatttttaatttatctttgtaaactctccaggagtgtggcaatgatgtgttagcttactttttaaaatagcaatttgatggtgtgtaataactgacaattgtcttagaactcctaagtataatttttgaaatagcttgataatttcctcaaatgagaaattgatcctagtaagagattgattataactcaactcttacaaaagaaggattaatggaatctatagagaatcacagaaagctaaaactagtcattaaaagcttgcccaaatcaatttcataattggtacataattataataataaaaataattttaaaatggcatttattttgaacaatgtataaccattcattctcataatggtgaaaaacggccttaataaaggattaaaagctggagagagacggagggattctcagagcaccagcccaagtgaagattgctgcttactgcaatggaaaagggagacagttagcattgggttaatatttaccatgttttactctctgggataggcattttatttacaatatctcttatgggaatgttttatttatttcattttctctagactgagatccttgcagagaaactgacatgcacaaaaaaatgtcctttgagttaaattggtcactttataagagatccagatttctccccaagtagagaaatttgcgcagaatgtggaagacaaactacccattggaaacacatgcaaaatcactcagtagggatactctcctaaccctgggcaagtgaggtcttcttgcagtaaatagtttccactgaggatggacttagaatgaagctaccttgaggggacacgtaggctactagtattcaggaacaacctgccagagacaatgcaggaagtgtgtgtgaaatgacccaaaagataagagggtagagaaaccctaatggaaggacagatagtgtgaataaaggtagattctgaaaagaatgagctagcacattgtgtaaagatgaggagagaattagggctctggaggagagatctgaggaaaccacccagaatatagcacagagagatacaaagaagaagaatttggatgagtcatgaaaagcttggaggacaggctgagaaggtcccgcagtgtctaactgaattctagaaggaaaggctagggagactggaatagaggccatatgtggaggaatgtgggtgagaacttgctaaactgaggaaaaacactcttccccaggtggaagaggcacactgagttcagagtagtgatggtaaataacaaccacatccaccactagacactctttggtgaactatagggtattaaagacaaagagaaaaattctaaaagcagactgggacaacaaatctgtatttgtagcaggaaaaagcatgaggttcaggttttgactgtactgcttgctgcctgtgtcatcttaagtaggtcacctacctgcttcgagcctcagaggacatctgtcattggctaatgggagtagaagtggctaataacaagaacaatgactaccacacgaggttttgtgagccctgaaatatttccagagaataaatgtaaaagcattttaagtcattaaacaaatgggccgggcatggtggctcacacctgtaatcccagcactttgggaggccaaggcgggtggatcacctgaggtcgggagttcgagaccagtctgaccaacatggagaaaccctgtctctactaaaaatgcaaaattagccgggcatggtggctcatgcctgtaatcccagccactcaggaggctgaggcaggagaatcacctgaatgggaggcagaggttgcagtgagccgagatcgcgccattgcactccaacctgggcaacaaaagcgaaacttcatctcaaaaaaaaaaaaaaaaaaaggatagtcaccttatgatagaaaggcataatgcatttctattaaacatatttgactcaacccttacatcattgcctcttcaagagcaggattttattttcttctttttgtgttttccaggcatagtgctctgcccatagtctcatagtctgtatcccccaaaatagccattaggtgcttttggatgagacactcaaactttttctgggatcatgtgataaaacttggtttccaggggtgcccacgtttcacaggcatgagcctgggcagccttactcctctgttggtcaggaagaattaatctttcaaagataaacatttacgcttcatgggtgcctttcctctttccctctttcaatccacagtgaagtaaattgttttaaatttgcaaagattattttagagtatctaagggaacctggggtaacagctctgtacccactaggtaattatatgctgatacttggtctcatattattcactgggcactggttcagagcatgaatcactttttcagacactccatccttctggtgaaaggctggcttttcctgtaatccagtcattgaggtcattatccttgctggtttactctcattttctacctccagttttagattaaatcatttatcttactacaatcatcactggaaaaggagggttctttcctattgggaactcagggttctgtcttatcttaaagctccagcctttctcccatgatgcattgtttatgcagctggagtcccagagaattccctgagctgggcttgcctctgccctggccttcttaacagccaggagcagacagtgcctgaccaagtgcctcatccttttgcatagcttgtctttacggctcttgccttaggccattctctgcatgaatatatttcccccatttttttttggctttaaaagccattgctgtttcgtagatttgcctcccagaatcaccatcccagcatttccagactgccctgccaagtttccagagcaccctcccttattgttactttttagataaggtgaagaaacaatagcatatcaacagttcagctgcacctcagttcctcttgcctcagccagacaaatgatattctcaaattaattttaaaagatttttgtttttcatactcatggtatgatttgttcaagtgaatcataacattttagagcgggtaggcaattaaaagtaaatctagtacaactcctccaatgtttttgactgtggcaaccaagttccacagtgaaatgttcttttgactgtgtctcattacctcacttgtgaacagaggaaactaagttttaccaaataaacaatttccaaagggttatttcaaacctgatggacagccatttttcgatagaaaccatacaatagattgatattaacagaaacatagtagctttttcttatgcgaataaaatttctttaatgatcaaatattctccatttttttttttttttttttttattgatcattcttgggtgtttctcgcagagggggatttggcagggtcataggacaatagtggagggaaggtcagcagataaacaagtgaacaaaggtctctggttttcctaggcagaggaccctgcggccttccgcagtgtttgtgtccctgggtacttaagattagggagtggtgatgactcttaaggagcacgctgccttcaagcatctgtttaacaaagcacatcttgcaccgcacttaatccatttaaccctgagtggacacagcacatgtttcagagagcacagggttggggataaggtcacagatcaacaggatcccaaggcagaagaatttttcttagtacagaacaaaatgaaaagtctcccatgtctacttctatccacacagacccggcaaccatccgatttctcaattttttccccacccttcccgcctttctattccacaaaaccgccattgtcatcatggcccatccccaatgagccgctgggcacacctcccagacggggtcctggccgggcagaggggctcctcacttcccagtaggggcggccgggcagaggcgcccctcacctcctggatagggcggctggccgggcggggggctgacccccccacctccctcccggacggggcggctggccgggcagaggggtcctcacttcccagtaggggcggccgggcagaggcgcccctcacctcccggacggggcggctggccaggcgggggactgatccccccacctccctcccggacggggcggctggccgggcggggggctgacccccccacctccctcccggacggggcggctggctgggcagggggctgacccccccacctccctcccggacggggcggctggccgggcggggggctgaccccccccacctccctcctggacggggcggctggccgggcagaggggtcctcacttcccagtaggggcggccgggcagaggcgcccctcacctcccggacggggcggccggccgggcagggggctgacccccccacctccctcctggacggggcggctggccgggcagaggggctcctcacttcccagtaggggcggccgggcagaggcgcccctcacctcccggacggggcggctggccgggcggggggctgacccccaccacctccctctcggacggggcggctggccgggcagaggggctcctcacttcccagtaggggcggccgggcagaggagcccctcacctcccggacggggcggctggccgggcggggggctgacccccccccacctccctcccggacggggtggctgccgggcggagacgctcctcacttcccagacggggtggctgccggacggaggggctcctcacttctcagacggggcggttgccaggcagagggtttcctcacttctcagacggggcggccgggcagagacgctcctcacctcccagacagggttgcggcccagcagaggcgctcctcacatcccagacagggcggcggggcagagacgctcctcacttcctagatgggatggcggcggggaagaggtgctcctcgcttcctagatgggatggcggccgggcagagacgctcctcaccttccagactgggcagccaggcagagaggctccccgtatcccagacgatggggggccaggcagagacgctccccacttcccagacggggtggtggctgggcagaggctgcaatctcggcactttggggggccaaggcaggcggttgggaggtggaggctgtagcgagccgagatcacgccactgcactccagcctgggcaccattgagcaccgagtgaacaagactccgtctgcaatcccggcacctcgggaggccgaggctggcggatcactcgcggttaggagctggagaccagcccggccaacacagcaaaaccccgtctccaccaaaaaaaaaccgaaaaccagtcaggcgtggcggcgtgcgcaggcacccggcaggctgaggcaggagaatcaggcagggaggctgcagcgagccgagatggcagcagcaccgtccagccttggctcggcatcagagggagaccgtggaaggagaccgtggagggagagggagagggagagggagagggagagggagagggagaggcagagggagagggagagggagagggagagggagagggagagggagagggagagggagagggagattctccatttttaaaagagaaactgtaaacattggaataaatgtagctgtactgaagagttgtgaaaacgtacatagaattctcttccactctgtttcccctgttatttgcatctcactggggacattagtttaaactaagaatttaccatttgtacattactactgactgcattccagacttcagtcatatttcaccagcttttccactaaagtccttttgactgcattccagacttcagtcatatttcaccagcttttccactaaagtccttttcctgttcctgaacccatccatgatcctgagttgcatctagtcattgtgtctccttagtttgctctattctgtgacccggtcttagtcttccctggcttttcatgatcttgatacttttgaagagtactagctaggtattttatagaatatgccttgtgtgtctgtctgatgcttttgtcatggttggactggagttaaaattttgagactaccacagacgttatgtactcatataatacctcataatgagggtattatgccctcatatgataccaacagagttcatcatgggtcttatttttttgtgtacaatttaatcgtcttccctttaataaaggcagttattttaattgattttatattcttttgctttttcctgttcctttccacccttctcccccttctctagaaaactcttcttagtatcatttttctaaaagtctgcatattgatatatgtgccatttctattaggagaagtccacttaaatcaacttaaagagaggtttatgtccttctcttaccatcagggtgataaaacacggaagtaatggagaacccagggaccatttcctggagggtggagggaagagaagacagccacttctcttggttgattaggtatttcccagtgttgggccatttggtcttgaaggttccagttctgagattctctgaacatttgtcacttgactatttcataatgtaccatgcctaccatggggccacttctggcaagcaacaatcagttgttttgaagtaataagtcagaatgcttcaggaattggaactaatatagagaatttcattgctgtgcaatgaacactaaagcaggtagtaattagggacttgggggaaaatggagaaaatctcttctttaactcagttccttttcttcaagtaattcagggaagtccttttgaaagctgggcctaaccttttgcctctgctcatggaggttacacactcatgtgtataaatgaaagtgtgttcttgctaggcagttgctttgactttttatggagtcgaacatgtcaagcttgtctaacagtgattctgcactctcagcccatgatgaatacttgctccacccgcttaacaattgctatattgaatttcttcaggtttggtgttagaatactttcagttgttgttgttgaagactgaaactatttcagatttgaaatcaactaagatttattgaacatgtaatacatgctacactgtacttgaggcttcctgtgcattattatttggtcatcacatgaagtagaaattattgctatcctgattttgcagtggagaaagtaagtataagaagttatgcaaccatcttaaagttgctgagctccttagtgttaagactgggacttaaaccaagttctatgactctagagctgtttgtttttaaccactgtgccatactatctattgaattagtcccacctataaattctacctgttagtcgtataaagccacattgattgaatctaatccttttcctacacaatagccctttaagtatttgtttagaatgaccatattcctgtggatcttttcttctagtcttacttttttttttttagttcttttaactgttgccaggtacaaattctttagggatttttctgtcttcattatactactttgtttgttttatggttaggctcctgtttgtcaatttaattctgagctgtgtataaagaactgaacatagtgcatttgagttttgtctaatgagaactcctctcatttttggatgccacacttgcaacctctgttagtcagcgttctctaatagggacagaactaatacaatatagttctgtataataggataataggatgtaaaggagagtttatgttatatacatgagtttattaagaactaataggatctctctcgctctctctctctctctctctctctctctctctctctatacatatatatatatatatatatatatatatatatatatatatacaggggagtttattaagtagtattaactcacatgatcacaaggtcccacaataggccatctgagtcccaaagctgaagaactttgagggcaggaagcatccggcacagaagaaagatgtaggctgggaggctaagccagtctagccttttcacatttttctgctgctttatattctggccgtgctggcagctgattagatggtgcccacccagattaagggtaggtcagcctttcccagcccactgactcagatgttaatctcctttggcaacaccctcacagacacatccaggatcaatactttgcaatcaagttgatcactttaatccaatcaagttgacactcagtattaaccatcacaagtccaccccttgtcaacttgaacccataaacatctcctgagctcatacataatcttcaaataaagacaataataaggtcataattatgcctaacatgatacaactgtcctttgtacaaccggaaatgtaccaatccccagcccaaatactattacataaagttaagaatacttaaatgctgatatgaggtcaataaatcttatgtcacataataaaggaaaaagagaataaaatgaaaatattttcttagtacaagtttatgcatatatgtacatgctaaaatatgtttttagcaaaaggaggaggaaataatcatgacacagtcctcgtttttgcaactgatcatctggtcatagctggtactaatgactaccttcttctactacccattctatattccttctgccttcagcaaacacctcagcatgtcgtgatgttttccctggtggagtaacccaaaccttcattcctgaagggtctgggccatttgtagtcctgccgggattgggctgttttagtttctcattgaccttaatcacaaggcatggtaatactaagagatgccccaaggatctcctgtatttcatgcatactcttacttacttccattgtggagtcatagactgatttcatcttgatagtctgggtcagtcaccccagccaacactgtaactcccttcttagcctgttgacttaaaggtaggaggaacccaaagtgtccaggtggcaatcttaacttccagtttaatgtaattgtgcctcctggtggcagcattccttcctctggaactaagacctctaggccagcagaacataatgttcgaatgaactgaaagcaaaaattttgttagtggatcactaggggtgatggtgagtggtgccacttccatttccaccccttgattcctggacccgtgaatcctggctatgggaggaacagtgccatatattggatgctgattcagaacatacacagctttctggataactttgccccaaccctgcaaagtatcgtcacctagttggcattgtaattgtgacttcaaaaggccattccactgttctgtcaatccagctgcttcaggatgatggggaacatggtaagtccagtaaattccatgagcatgagcccactgctgcacttctttagctataaagtgagtgccttggtcagtggcaatgttgtgtggaataccatgatggtagataaggccttctgtgagtccacagatggtagtcttggcagaagcattgcgtgcaggataggcaaacccatatctggagtaagtgtctatttcagtgaggacaaaaacctctgccctttctatgatgaaagagttccagtataatcaacctgccaccagggagctggccgatcaccccaaggaatggtgccatatcgaaggctcagtgttggtctctgctgctgtcaagttgggcactcagcagtggctgtagccaggtcagccttggcgagtggaagtccatattactgagcccatgagtaacctctatccctgccaccatagccactttgttcatgggcccattggtgatgacagcggtggctggggaaagaggctgagtggtgtccacagaatgggtcatcctatccacttgattattaaaatcctcctctgctgaggtcacctgttggtgagcactcacatgggatacaaacgtcttcacagtttttgaccactcagagaggcccgtctacatacctcttccccaaattcctttgtcaccaattttccaatcatgcttcttccaagcccctgaccatccagccaaaccattggctacagcccatgaatcagtgtataatcgcacatctggccatttctccttccatgcaaagtgcacaaccaagtgcactgcttgaagttctgccccctgggaagatttcccttcactgctctccttcatggatgtcctagaaaggggctgtagtgctacagctgtccacttttgggtgatgcctgcatattgggcataactatctgcgaaccaggccctagtcttctcttcctttgtcagctgatcatagggaactcctcatgaggccatcgatgcaggctgggagagagaaggcctggtggcaggagtagagactatgggcatttgagccactttctcatgtaactgacttgtgccttcaggacctgctagagcccagtcacatttatactacttccattcgatgatagaatgctgctatgcatgacccactttatggctagatgggtcagaaagcacccagttcatgatagggagttcaggtcacatggtgacttgatgacccatagttaaatgttcagtttccaccaaagcccagtaccagaccaagagctgtctctccaaaggagagtagttatctgcagaagatggcagggccttgctccaaaatcctagaggcctccactgtgattcacctatggaggcctgccaaaggctccaaacagcatccctatctgtcactgacaccccaggcatcattggatctgttgggtcacatggcccaagtggcagagcagcttgcacagcaggctggacctgttgcagagctttctgctgttctggaccccctcaaaactggcagcttttcgggtcactcaataaatgagttggagtaacacacccaaatgacgaatgtgttgcctccaaaatccaaataggcccactagatgttgtgcctctttctgggttgtaggaggggccaaatgcagcaatttacccttcacattagaaggagtatcttgacaggccccacaccactggacctctagaaattttactgaggtagaaggtccctgaactgtaattggatgtatttctcattctctggcacgcaaatgtctcacaaataagtccagtgtgtttgctacttcttgctcactggatccagtcaacatagtgtcatcaatgtaatggaccagtgtgatatcttgtggaagcaaaaagcaatcaaggtctctctgaataagattatggaacaaagtggagagttgatatacccctgtagtaggacagtgaaggtatattgctggccttgccagccgaaggcaaattgcttctggtgggccttatggacaggaatggagaaaaaggcatttgccaagtcaatggctgcatgctaggtaccaggagatgtgttaatttgctgaagaagtgaaaccacatctggtacagcagctgcaattggagtcacaacttcgttaagcttatgataatccactgtcattctctaagatccatctgtcttctgcacaggccagataggggagttgaacggggatgtgatgtgaatcatcacccctgtgtctttcaagtcctcgatggtggcactaatctccgcaatccctccagggttgcaatattgtttttgatttactatttttctaggtagaagtagcttcagtggcttccatttggcctttcccaccacagtagtcctcactctaccagtcagggagccaatgtgggggttctgccagctgctaagtatgtctatggcaattatgcattctggcagtgggaaaatgaccataggatgactcctgggactcactggacccactgtaagttgaacctgagctaaaactccactaattgcctgacctccataagcccttactttgactggaggactgcctgacattttgggtcccctggaatcaatgtcagctcagagccagtgtccagcagtccctaaaatatctgatcatttccctttctccagtgcacagttacccaggtaaaaggccaaaggtctccttggggaaggatgggagaaagattaacagtataaattgtcagtagtgtagtggggtccttcatcaaggggaaggacctccccttcattcaagtggttctaggtctgtaaactggctcaagtctgaaaattgattgaagggccatgaatctctgttttataattcaaattagtcttttgtccattcgacctggaagttttctgcttctataaattaagtaggaatgcatttatcaattttacttctgggaataccgtgattaattagccaatgtcagagctctacacgagtcagactattctgatggttgctttgcctctgctttccattatggtagttacacccaccgtgcctctgacagttgaatgttaccacttggcccctaccaccttgggatccaattattcccattgtatttaaattttgtagttgagtgactgttgttcctactattagatctgacatacagagaagagcagttacagacctcttcaaagatgcaggtgctgccctcacaaatctgtttcacaaagcattggtcaagggtagatcttctggaccctcccagctgggatgagtaaagtgactaatccactctaggatcccaatctccctaagcctttgaattccttcctccacattaaaccaagggagatcaggcatttcccgcttgctcacagtgggccatcttttaacttatatttcagctaaccaagtaaataaactatttgaacctttttttaactctctgagctgcaacattaaatgcagagtccctatttagtgggcccaaatcaataaattcagcctgatccaactctgtgttccttccaccattattccatacccttaatatctattcccatgtctgtttttcagatttctgctaatataaattagaaaactcaagcaattcttttttagtgtagtgcacctcctcatgggtcacactgtgaacctcacctctggggcctgctaggactttagtctagttataggtctagaagcaaacaggggtgttgaggatggctcctgaggagaatcaacattatcttgcctggcaactgcctaaggggtccttccctgttgcttcaggcagtgcagggtttatctactcagacaaaggtggaaaggttgatggcaacatgagttggggaagggatgttgccactactggggatggggaagatgtttcttctggcaaaaatggttcatcagagtttacaagctcagtgtccccagcttcatcagggtcctcccatacatccccattcctagttgcagggtcccattcttttccaatcaatgccctcactttagcagtagacatctggcaaggctgtgcatgcactttttgttgcaggtcagccacttgcataagagcttgtgtctatttttctacaatttcagctctttctctacaggagataagactctcactcagggcagtcttagcagatttgaggctccgtagctgcttctgaagccaggagttagaatccctgagttcctcattttctttcatcactttgtccagtgaacttaggagcaaccaaccaacttcattaggttccttggttctccacatataatcaaaggtattatatatagagtcactaaattccttgcctctcatgagtggtgagtcaggagtgtcaaatgcgtttattttgcgtaactctttaaacagctcatgctaaggactatcagtgttctccatactgttagaagtagagtccttagcatttttgggtctaatcatattaagcagccagctccagaaatcccaaaaccaaagaaagaactccatccttaatattctgttcctctagaaccactcctggtaccaaaatctgtattagtcagggttctttagagagacagaactaataggatatacatatacatatatatatatatgtaaaggggagtttattaagtggtattgactgacacgatcacaaggttctgcaataggccatcagcaagctgaggagcaaggaagccagtccgagtcccatagctgaagaacttagagtccaatgttcaatggcaggaagcatccagcacaggagaaagatgtaagctggaaggctaatccagtgtagccttttcaagtttttctacttgctttatattctagctgtgctggcagctgagtagatggtgcctgcccagattaagggtggatctacttttcccagcccactgactcaaatgttaatctcctttggcaacaccctcacagatacacccaagatcaatacttcaatccaatcaagttgacacttaatattaaccataacacagcccaataatcttgggccagagtccctgactctcctcctgcttttagtcaatggaaactcctgatgctttttcatttgcatctctggattctgtttcgtccttcctgtgctgtgtaactggttctttggaatcaagtggagaacctgttactttttaccttgttgcattggctcattgttctaggtttgttttagcctaataaacttgtgttttgttctttttcttttttttttaaatcttaactctcattcaaattatttattctaattcccaacctcatgacatcttgaaatttgtaaagttaataaaaggtatgtattgtgataatctcatttcatgttattctgttgttattgaatatatctgaggagcaatagattaggatagtataagttggggtacctgtggatcagaccctggaagacttggtagaggtaatctatttgggaggtgatcccaggaaacacagatgaggacttgggggaaaatggggtgaaaggaagaaaaggcaggacagcgtgcattagtgaagctcaatcctggtggaagcaactgaagctcagtcctgccagggccactgggaaaccatgcagaacatgccttggaacctcctacgaaggacaggaaggctggggccaacttccatccactaagggtttttgtttgcaccagacggtgttgtcatttcgttccacaatacacttctgcactgttcctgctgtttctccatgtggcagggagagctctcatgcagagaaaaagagagatccaggaagttgaggtgggaagctgttcgcatgttggaaattgtctactgcacttgttggtgaacttgggcctgaggacacatgttcacattcttgtggatcgtcagaattttatctgtttctttaattgaaagacctgtgattagactataaactgtatgagggtcaggactgtgttagccttgcgctctgctcagtcaccaagatcaaacacagtgtttagcatattgttggtgctgacttaatttttgttgaattaatgaatacatctctagaaaagaattatttaattaacttttctataaaaacaaggtttcactatgttgaccaggctggtttcgaactcctggcctcaaatgatcctcttacctcagccttccaaagtgctggaattagaggcatgagccaccacacccaggctaagaaccataatttttaaaggcaatatagtttcagttctgtctccagatgctttttcagtgtcttaccactaccgagcatgtaacatagttgtttgattagttgttttatgttaaagcaacctgtagacctattagtttgttatagtcttaaattctacacctttaaatttaagttcacaggtgtcagtatggattctaacaaatctttagtttaaataacagaagacaaaaacttctccatgtattaagtgaagatgtttttagtagtttgtaattcgctgctactcaaagaagttcagaaaattgcagtggatttccaagtcaggagttacatgctttatactaaaaaaaaaaaaaaaaaaaaaaaaaaaaattctccagttgaatgttgtttctatgtttatcctgtgtgtttgtggtgagtcatcctgtttataacccttactgctaatgccatattattaacctcttaagtggcagtggaaattggataataagtttactctcctccatgaggtttcagagaagggccaaaggatgaaatgagaacaccacattgctttgcctctttgcctctcctgtcaaagctagtcaggattgtaaaagtgcttatactttaaaatacttgagcctctgtattgggaagagggaagttgctgtggttctgagtgataaagtaggactgttttggaagtctcatgaaccactgtttaaggcagcactcacacaattaattgtgtctctgagttatgaacagtgtgtgaattttgagtgattcgtggctttggttgtgagattcaattgtctcccttcagaataggaaccaatgggcagaaaaggaacaatcgtggtgcatgtggtatagtggggtaagaacagctctccagctccctcacttacccatcctgtgttctggggttaattttcatgagctgcaggctcatgtgtaaaaatcttccttcccatggtgtatatgaagtgagttgtgtgtctaaattcttagtgagtgctgaataaatatgtattttttctgtattttaacagccaagactatttaagaatagaaagtcctaaatattaaaattcttaattttgagtgcttataacggcctttctccatgttagcctacttaatcctgaatagccttgttttacaaatgtggaaaccacactttagagaagcagcatgctcaaatcacatagatggtaggtgggaaggtaggcttgtttttcaacactgtaagatcttgggcagccataaaaaagaatgagttcatgtcctttgcagggacatggctgaagctggaagctatcattctaagcaaactaatacaggaagagaaaaccaaacaccacatgttctcactcataagtgggagttgaacaatgagaacacatggacacacggaggggaaaatcacatactggggcctctcgatgggtggaggacaaggggaagaagactattaggacaaatacctaatgcatgcggggcttaaaatgtagatgatgggtcaataggcgcagcaaaccaccatgacacatgtacacctatataacaaacctgcatgttctgctcgtgtatcccagaagttaaagtaaaaaaagaaaaagaaaaaaaaagatattggatacatttagcagatttatcgaatatacaccatgtgcacatacggtaccatgtgcaattcagtgtatgaagtagttgctacagttcagaccagtcagaaatgaatgctgctctcaaggaatttataatctaatgaagaagataagatacatatatatatataatacatgtattatatatataatacatgtattatatataataatgtattatatataatacatgtattatatgtattatatatattatatataatacatgtattatatatataatatatataatacatgtattatatataatatatataaatgtgtatattatatatatataatataacacaaggtagaaagtgataagggctaaatcaaaagatatggtgacatgttgtgggaggatgaagattttaatttcctgtttcgagtgatgaggaaagcttcttaattgagatggcatttggcctgagagatttgtgcctgtagggaaggacatgtagacttgttgggcccaatatgcacctttatgataaattagttcctaggataatgtttgatgtgtcaagttcagttgcatttcttctttaaacagtaatggaatgtttagtattctttcgagtataatactgagatgaaagtgccaagcctttaccccaatccgttcggtcttctgcagctgttacacggtaaatcaatgacaactaaatgtgacaagagtaccactgctgtaaataactaatatttatttagttcttactatatgtcaggtaatgttccaactgctttatattctattaatgcatttaatattttacagcaatatgaggtatatattattattaaatattattgtccccatatattagataaagtgctgtgacataaatccccccaaagcccaaaaaacaaacaaacaggccaggcacggtggcttatgcctgtaatcccagcactttgggaggccaagatgggcggatcacgagatcaggagatcaagaccatcctgctaacacagtgaaaccctgtctctacaaaaaatacaaaaaattagccaggcgtggtgttgggcacctgtagtcccagctgctcaggaggctgaggcaggagaatggtgtgaacccgggaggcagagcttgcagtgagccgagatcgcaccgctgcactccagcctgggcgacagagggagactccgtttcaaaaaaacaaaacaaaaacaataataataacaacaacaaaaaacaaacaacccacaatgacttctatatatagtagaaatgtatttctctttcacctaatagtccctaggtgagtggtccgggaccatcttggcagctctgtcattcgcagcacgtggcttccaaggttgttccagtagtcagcatttcctagttggtagaaagggggtaaaaggaatacaaggaaagtagattcttccttcaggagggctcctggaattttataaattagtctcactcatatctcatagtcatatagcttattgaatcaaatggtggccctgcaaactacatgtccaagtctttatgtataatgtctttttatataacgtctgggcactataagtgtgacattattaggaaaaatggtctatgcaaattaaattaaggatcttgagatgagatcgccttggattacccaggtgggtcctaaatcttatatatccttgtacaagacatacgaatagaaggcgcacacagaagaccacataaagacacagtcagaaaatggacttttgctgccataagccgaggaggactttgagccaccagaagctggaagaggcaaaagattttctcctagagctttcagagggaacatggctctacccacaccttgactttggacttttggcctccagaactatgagagtgtaaattgctgttgttttaagccaccaattttgtgttgatttgttgtagcagtcacaggaaactaataaacttgactccatgttgctgcaaggagcctgaggaacatggtggttagtgggctggccatgcgccaacctaaaactacctaaaggaagaaaagaatggatatgggatgggggaggagtaacattctctatcatatctcattttatagatgaggaagttgaggcacagagaagttaagtaacttgctccttgtcatacatctaggaggaagcaagcaaagctgtgattgaaatctagacccttagctaccaactatactgcctttaaactcaagagactgtagaagcacagagaagagaattgtgattggctttggaatgcagaggaagaatggccagttgttaaccaggcagagaggaggggatgatggagaaagaggcatttctggctgaggcacagaggtatgaaatagcatgaccagtttgtgggggtagttagaagctcagtcgacccagaaatactctcttgacttcactgaaaaaagaataagcctccccagtctacagttctgtgacttttttcacctctaaggctgcctgtgtgggaagatggagaaagaccttatttattcaatcctttgcctctctcaacccatataggaaggtccttggtgaagtcttcagatatttatatgatacagatctacttttggagaaaaggatgatccttataacagtacaacagagtacattttaatcatttttataggatgttgctctcctaaatgatgtggaggttatagggttagagtatttctatctatgctatattcattattaagtttgtattctttaggaagttattcccaatcatgttacaccagtagaatttcccttggaaaatgcattcttttgataatgtatttctaggaacgtgatgtggtaagaaacatggactgtttgtggaaatgaaactttggctcagtcaaaatactttccatgaattaaatatagctgtttttaagtaagccactccccccatccggtcttctcttgtgtcatgtattaggcatattaatatatcaaatcagttccctttttacctattctctagtataaagtgtctccactgagaaggagggtattatataaatatttattattttatgtggaaatatgtgtgcattaatattgtgcttctatggtttatggtaggtgagtcttacttgtttttctctcttctgagtattaaacagattaacaaaagttatattttgtttatggaagtctctgtgttgctccataagcttaataatcattaacttattcaagctaccaccaagagttttagataaaagattgatttgtacactgtgtattcaagccgaagtcaactgcctttccttcccaggtgttgatttagtgagtgagcagtttgaagatcttctctgaacaggtgccctgtttacagtttgtggttttcaaggtaaatacagcaatttcagaataaagcaaacattgctggtgggtggcaatgtttgttttacaaatgcttggaagtggtttagaaattgtcttttaaagaataaggtggataataacccaatagagcagcccacatgaatggagatccagtctcagttggcaaggcaccattgactcacccttgttctcctggaaccttgcttgccctttagctggaacccctgcaaagagagacttatgcctgaaaatgaaagtgatggctccccaggaacccactgagtcctggtgcttctgtaatgttttactatgtggctgagattggtgtgtgtgtgtgtgtgtgtgtgtgtgtgtgtgtgtgtgtgtgtgttctactggatgacttggaggtggtcaaacttacagagactctgaagggccatgaagaactggaggataacatgcttatctagagagtgtcctatcttggaagtaccctaaaaatggtttttactagcatttttgaaagggcagaagcttcagctctgtttagaaatagggctgtggacatttgtccttctggttctatttagacaggctgcatgaaacacaagtgcagttacaaattgttgtaggaagcctcacagttatgcaacttgaactctgattatatctgcataattaaggacccagatgtgggtccttaataatttttaagagtgtgaaggggtcctgtgaccaaaaagtttgagaaatgcttgctagaggaacagtcaggaaacaggaggttttttttttttgttttttgtttttttttatatatttgtattcatccatttgacattctcttactttactaactaatacctttagatctgaatttcaattttctttttttttttttgagttgcacaaaatttttatttttttattttttattttttattttttatttttttttaatttttttttattatactttaagttttagggtacatgtgcacattgtgcaggttagttacatatgtatacatgtgccatgctggtgcgctgcacccaccaacgtgtcatctatcattaggtatatctcccactgctatccctcccccttcccccgaccccaccaccgtccccagagtgtgatattccccttcctgtgtcctgggatacatgtgcataatatgcaggtttgttacataggtatgtgccatgtaacatgtgccatgctggtttgctgcacacatcaacctgtcatctacattaggtatccataagcttagttcagctatggggaaaaagcacatgttaaaagcagtagataggcaaggattaggtaagaatcatggtcagggaaagtaattagaaatcaggaagtcagcgggtataccaaggaggcggcatgaaataagggagcaagagaaagcctattttctgtgagctttctgaggacccacattgtatctctaccacagcttataaagcaggatgtttgtcaatgatcgaattgataagtataaataatgttgaatcaaacatatgttgagaaacagatgagatgtttatcgcaggattatttataatggaagaaacaaatatataaaaagaagaaaaagatttaatacatcgtaatttattctaggagggaattaatgttttcaggtaatatttaatgacattacaaaatgtgaaatggaaaagagacttcatgtgaaactgtgtatataatacgtttctggttatctaaaatatatatgcatgtacaagtgtacactttggcaaatttgtctgtctctctaaagatacataacaaaatgataatcatgtctaactctgggacatgaaaagaggtgtgatattttctttatagtcttttgattttccaaaatgttttcagtggtgacacatcaattttacagttagaaaaaagtccaagtttttcacacatacatacatgctttttctaagccactagagaaaggttcaggtcaagtttcatattgaaagagcttcctgccctaggctcagaactttatttatttgctgcctgtgtgaagctgctctgaacctctggagggagcagaggcaggtgagagctccaggcagaggtgggcattggcagccagatattgcctacactagaggaaagacacaagtacaagaagttgctttaatttgaactgcagtacttgatgctccatgtgaagaactttaacaaactccaggctcagaaggaggccggcctgctgcagggccatcaaggaaagcacaagaaagcttgtagcagtaagaacaacaaaggaaagaaggaatgactgggggactggcagccttgttttccctttgccatttggaaggaaaaaaacctaggcttattataggaggaaaaaataataattaaaagtatgtatgatgtattatatatatacgcacacatgcacctgcatatatacatcgtactagctaatgttttcagtggtttccattttctagtgctgtagaacacaaattgtcctatattgcctcaattttaccttttttcttctctctttagaatataggaaatctgtgacatttaaaagtgaaaggaccctacaaaaaattaactcaaagtggatcatagacctcagcgtaagaactaaaactatataacaattagaagcaaacacaggagtaaatctgtatgaccttgggttaggcagtgatttcttagatacaacaccaaaccataggtgacaaaagaaaaaaatggataaactggacttcataaaaattaaaaactcttgtgcttcaaaggacaccatcaagaaagtgaaaatgcagtccaaagaaagggagaagatatttccaaataatttatctggtaagggacttgaatctagaatatataaggaactcttataaatcgataataaaaagacaacccaattgaaaaatggacagaggatctgaatagatatttctcaaaaaaatacgtaaaaatggttagtaaacgcatggaaagatgttgtcattaaacatcaggaaaaatgcaaataaaaaccacaatgagatatcacttgaaacctggaattatagttacaaaaaaaaaacagataataaaaagtattatccaggatgtggagatattgagaccctcataaactgctggtgggaatttaaaatggtgtaggaccttgaaaaacaatctggaagttcctcagaaagctataataaaattaccatttggtccagcaattttacccctagttgaaaatgtatgtccacacaaaaatttgtacccaaatgttcatagcagcattgttcataatagctcgaagtggaaacaacccaaatgcttagcagctggtgaatggacaaacacaatacgatatatccctacagtggaacattatttagccataagatgtaatgaactactgatacatgctacaacatagatcagccttggaaatattatgctaagtgaaataatccagttataaaatgctacatattgcatgattccatttatatggaatgtcaagaataggcaaatctgtagagacagaaattagattaatgattgccgagggctggtggaagaggaggtaaagagaggcagtaagtacaagatttccttttgaattgataaaaatgttctaaaattagttgagatgtttgcacaactcaactgtgaatatagtaaaaatcattgaaattacacactttaaataagtgagcttaatggtatgtaacttatatattaataaagctgttaaaaaaccaaaaggtatgtagccaacatagataaaatgttaaaactcacaaataataaattacaagtttaaacaactgttgtatgttattacatccatccaatcagcagaaatatgtaaaaattacagtctttaagagaaggtaagggcaataggcactgtcacattgaaggaaagagtatacattggtacactttctagagagctgtcagatgaaccagacatatttataaggccttggctcagaaaggaaaatataaactaaccagcaagcaaagaattctgatcttaaacaataaataacaaaattgtatctccatttactcatgagtacacacattcaatgatacactttcttgcttgtaaaatttataattaacataggttgttgagtcaacatgggatgggcaaaattcaaggcaaataagagtatcattagttgttttgatgcatgtcccatagaaaatacgggctattttgttgacttttcatacaaaattctgtgggtattgttcaagttctacttatacaaaatatgttgtaggttatgccacttagagcttccttgttgtctgacaacagatttagatggaagggcctgataatcttatcagttaatgtcttcattccagttgagttttagggtagcccaaatgtgggtaaaaaatttgcagaaatattgtttttcattagctgtgttccttagctaaagaagagaaaacaataacaatattcaacaatttaggaatggttaagtaaaatatgaaatataagtgtcattaaaaagaaatgtgggcttttccagtatacattctcaatatctttttatttgttcatttgttttattggtttatttgccatctatataatttctctggtaaggtgtctgttcaggtcttttgtacagttttttttgttgttgttgtttatgggctttatttagaaatccacattagtgattctgatagttaggatattaacccaataattccttttctttgtggtttatttatttattatactttaagttctgggatacatgtgcagaacatgcaggtttgttacataagtatacttgttgcacagtttttaattaggttgtttattttcttgttgttgagcgttaaagtttctttgtatattttggataataatatacaaagacatagcctttatcaggtatgtcttttgcatatatttttcccagttggtgccttatcttgtcattctattgacactgtcttttgcagaacagaagtttttaaatttcatgaagtccagcttatcatttgattctttcacggattgtgcctttggtattgtatctaaaaagtcattgccacacttgaggtcatctagatttttttcctatgttattttctaggagttttatggttttgcacttcacatttaggtctatgatccatttttagttaatttttgtgaagggtgaaaagtctttgtctagatttagtttcttgcatgtggatgtccagttgttctagcataatttgttcaaagactacctttacttaattttattgcctttgttccttagtcaaagatctgttgatatttttatgtaagtctatttctgggctatctgttctgttcctttgatctgtttgtctgttctttcacaaacatgacagtgtcttgattactgtagctttatagcaggttttgaagttaaatagacctgttcgtttcactaaagaaaggttgaggaggagggtagggaagatggataccaaatttccaccttttatgtaatagaggctagatgtaaagatctggctttaggtattttggccaagtgggtgtgccaattctgaacctgtaattttacccagtcttagcattcaggtaatcatataagtcccttcacttctttagggctgtgcaagtaaaagaatggagaaatgccacagtttcactctccaaattcccattaccagaaggaaacaatggaagtggggaagaaattccccactaatagaacttctaaaagaaataaaaattacacaagtgcctctcatttagcttaagaaagagcacttgcaagtaacttagaagcccccgtttcaccacaaagataactactatcctgagttttgtgttaaccatcccctttattttctttagttttatcatttatcacatgtgtatgtatccctaaattaaatatacatctcatcgttttttggattcataaacttcgatgggaaaaaaagtcatacctttattttcactagcttgttttcacaattttcattattttcactatttcattgcctttgattacatttatttatttatttatttattgaactggtaggtttaattttttcctccagctttattaaactataattggcaaagaaaaaatgtatatatttatggtgtataacatgaagagttaatatatgtatacattatgaattgattaaatgaagcatatatgccccagaacacgcatccatcaccacacaaatgtatttattgtagtgagaacatttaagatatactctcttagatattttaaagtataaaatgcatttcattaattatagtcataatgtacaatagatctctagaatctattcatcctgtctaactgaaactttgtgctctgtaacctaaaatgtcttgtagttataacagtttattttaagctgatagcagtgtgacttcaactgcatacaaaaactctacactaacttctcctcccaggataagttaaagtgtagagttctacatcgcttctaattttgttgaacttctaattttgtataattgtttttataataattttatgttattgatgccacaatttatatatatttatatattgtatatccattaacaagttattatagctacacttatttttaatgcttttgtcttttaacttttatactagaattaaaagcgatttatccatcaccattacagtagatgattctgaatttgactataatcttacctttaaagtgaattttatacttctacatgttttcatgttgttaattagtgtcctttcacttcaactttaggaaatgccttcagcatttcttgttaggcaggtctcatggtgataaactcccctagcttttatttttctgggaaagtccttatcgttccctcatttctgagtgtaatagtcttggttggcagtcctttctttcaccactttgaatatgtcatcccactgtctcctggcctgcaaggtttctgctgagaaatctgctgatagtcttatgtaagttttcttgtttgtgatgagttgcttctctgttgctgctttcaaaattcactttgacttttgagaatgatttaatgtgtttcagtgatgatctctttatagttaatctatttagtgttatttggaattcatgaatctggatgttcatttcctgtccaaattagggaagtattctgttattatttctttaaataactgttatgcccctttttctttctctattccttctgggaccccgtaattcctatatcagttctcttgatgatatcctatactcatgtaggcttttttcagtctttttaaattctttttttctcatgtttctttgactgagtagtttcaaatgacctgcctttgagctcaccttctatagtttgatcaaatctgctgttaaagccctttatggaatttttcagttaagacattgtattctttagctccagaatttctgtttagttctttttatggtttctgtctctttgttgaacttctaattttgtgtaattgttttcctggtttttgtttggtggtcaatctgagatctcttgtagtttactgaacttcttttttagagacaggatctcgctctgtcgcccaggctgaagtgtgttggcatgatcatagttcagtacagccttgaatccccggactaaagtgatcctcctgcctcagtctcctgagtagctggaactacaggcatgtgccactatgcctggctaatttttaaaaagttttttgtagaaatgtgttctcactatgttgcccaggctggtctcaaacttgtggcctcaagcgattctctcacctccacttccaaagtgttgggaattacaggcacaaggcaccatgcccacctcactgaactttttaaagatgattattttgacctctttatcagaaaatgtatagatctccatttctttagggccagtcactgttgctttgttttgttctttgttggtggttttgtgtttccctgattatttgtgatttttgtgaccttgtgttggtgtctgcacattttaagaattaggcatctagtctagtcttaactaacttcagcaaggaaagtccttcaccaatcagcccgtccagagattcttgatgggctgtctggtggatttctcaggcaggattgctgatacagtccttgagcaggctggcctggtgcctgggtcagtaggtatatgagtctggtacctgaatctatggggttgggcctgaagccttggtccactgggcttgcttggcacttaggtccatgggggcggacttgaaacctgtaaccatgggcctggcctgaagcctggctctacagaacttggccaggtgctggggtggcccttaagcctgaacctatgggagccaggttagaacctgggtccacaggggtgttcctgaaggctgggtctgtggatgccagcctggtgcctgggaccatggaggctagcttattgccttcaattatgaatgtagattataaatcattgttctgggaaaggttccatgagctttaccagactaccatggcacattcctaatagagtattttcctaggagtagctttgctggatcatctcagggaatgtgttttcacactattaataggaaactatcatactctccattctagtctttctcgccaggattcctcatctaccacagaacacagataataatatgcataactgttttcttagttttccaaaggatgatatataaccatccttttcattttagatgggtaggagagaagttcatttgttatagacaagggatttgttagggcattagggcttacttctctccagaatcacacacagttttggcattaagttctttgttggtgctatgaaacttctctttcctgccttggggtataatagagtcaaactgatttgtacttagaccatggcactgccacttactgggagtatgactttgagtggttatttaaacctatttcattttcagtgtacatactgtaaaatgatggtgatgtagacatcttgggtttatttagaaattaaataaaataatttttgtaaagtaactagcacatttattggcacaaaatagaatggtactcccattctctgtaagaaatcagagatgtgtatgttaatatatacagtagtatccataggttctacatctatgaattcagccaactgcagattgaaaatatttgaaaaaaattctgccaagttccagaaagcaaaacttgaatttgctgcaccctgagtactacattgaatctacatgaataaagtgatggatagggagtattaggtattataagtaatctagagatggtttaaagtgtacagaagaatgtgcataggctatatgcaaatactatagcattttatatcagggacttgagcttctgtagattttggtatctgcagagggtcctggaatccattccccagcagatacctagggatgactaattacattttccatctctttctttcttccttgaaatgctgagagttgtttttaattttatctttgttactccagtgaaatcatatttgattctggcttccatattgctgttagtttttttagttcagactttgcttgggcttagccgaagagttgtcactaatcactagaagctttagaaaagatgatgtggaggtcataaggagcccttgttgtcgggcttgtcaaaagctgctatttcagtgtcattattgcaccctgctttagttgtgctctgcacctctaattgctctttagtctttgaagtaattcttgtcactttgccttagtaagattgtgtgttccagctcttagtataagtaactctgtatttaatttggctagatttacttggtatttgccaaattagtgcaatttccttaggtaagatataatttacaacaggatgacacctcataatttaaatagcagctgttgaggggaggcaaacagttacgaattactctttctcttcctttgaaaaagagctgtgctatggtgctgtgaggaaatgaacaaagtgttttaggacattcttggtcatatgttgtttgatttacatggacaaaggaaaaaaaacctactcatttgaatttgctttgaaatgttaacataatttagattcctgtaagataattttgaaagaacaactctcttgttactaaaagaaattcttcctgtttgctagttcatgtaatgggtaatggcccagttcacctacatctggggagggggtgtttcttttttgaaacggtgagaatttatgtgcatgtatcattcatttatttctgaagtatttactgaacactttttatgtgttaggtactgtgatagacactggagatataattgtaggcaatatgggtactgtttctgctttcctggtgcaaatggaccatgatgtccagaaggtttaagtttggtctcttgatctcagtcatggaagagactgtatgcaggaggatgtgatccatagaggatcaataacctgttgtttgaaaaactataagttttttatatatttccatttatatttcctttggcaattaagaacatttaaaagaaagtgctggtggatttcatttgagctaagtagaatgtaggaaattcttctgccatccatatacctcgttctatgtaggcagccacagaccaatgagggaagagtatgtaagttgcagcaagtaaaacagccttgctggagatggacacttattaagacaatctggctgctgggtcagatgccctgtcctacctggagcttctcattccagtgcctaatctgtgaagacttgaacatcctgtgttctaataagaggccttatatactagacatgcaacttttaacagtaacattataaagttggaatttttggggaccattatggctagaaagaccatggaatggagaaaggctagcgttaagatggggaatcctgttttctccccattaatcctgccattgatcctgacaaaattaatcaagggccaattgtaaggcaaaaatatacaacaaataaactaaatggggaaatgagtgaacattaacacacatctattatgtactaggtagtattttgttatttctaaattttcatattcaactaatcttttataacttagaaaaggagacatcaatgtatattaaatgaatacttaaaatatgcttttatgtatactatctctaaggaagtaagaaggttagaaatggggggatggagagtgagaaaggtaagagaaaaggggatggggatgacactgactctggtgagattgagagatagagacaggagaagctacatggagggaatagaaagcaggtggagaggttctcacctcgattagtaatttggacagttacttcagaatcaaattttagtaactactactattccttagaattcaaattaatgcttaagcaattactttttaatgctctagaaataatcaaacaggagagtcacagcagccctttccacccttactttcccatcttccacatccccaagaggatattttgctaaggactctgcctaaagcactatcacagtatgggatatttcctgagagtccaataaaattaaacagagatggacttggatcagagagagaaagaataacggttgaattaagtattttcatgtatttcaaaagtcatgcaaagtgtgagaaccaaccacagttgtcccttgaattacaatggggacatgtcctgataaacctatcacaaattgaaaatatcgtaagtcaagctgttacaggaaaagggtcccaatccagaccccaagagagggttcttggacttcaagcatgaaagaattcagggtgagcccatagagtaaagtgaaagcaaatttattaagaaattaaatgaataagaccgggtgtggtggctcatgcctgtaatcctagcactttgggaggccaaggagggcggatcccctgaggtcgggagttcgagaccagcctgagcaacatggcaaagccctgtctgtcctaaaaatacaaaaattagccaggcatggtggtgggcacctataatcccagctactcgggaggctgaggcaggagaatcacttaaacccaggaggcggaggttgcagtgagctaagattgcaccattgcactctagcctaggtgacagagtgagactccatctcaaaaaaaaaaaaaagaaagtaaaggaatagaagaatggctaccccatagacagagcagccctgtgggctgttgcttgcccatttttatggttatttcttgataatatgctaaacaagaggtggatcattcatgcctcccctttttagaccatatagggtaattcctgacattgccatggcatttgtaaactgtcacggcactggtggaaatgtagcagtgaggatgaccagagttcactcttgtggctatcttggtaaaggcttctttattacaacttgttttatcaacaagatctttatgacctgtatcttctgctgacctcctatctcatcctgtgatttagaatgcctgaaccatctgggtatgcagcccaataggtctcagcctcatttaacccagctcctattcaagatggagttgctctggtttaaacacctctgacatttcccccctcccttctataagagaacctttaatcctaagggttgcagagggataaatatccatcttctgtaacttcttcaggctgaaaggggtgatggtatttctgcctattagcatctcttgtgttcagggtagggaggagctcagtcagaaagcatcagtatggtgagggctatccgtgactcttgagttccgacaagaggcaatatctggaagattaataagtgtttagtttaagaaaacattcagaaagcttgtcctgcatttctacaaaaagactacaacagcaatacattacacaacagtaaagcaacataagtaaaaatatctcaagaaaaccaagtaagaaggctttccatgaactgggcaactgttggaaccaagctgatatgggtttgctagccaattccaatatatgcacagaattagaatactgatccagatttttacattacccatccattttgttttttttctgagcagcagtcagagattactggttggttcacaggaataagcagcgttagcctaagttacagaaacaaacttaaaaacaactgatgagactataatctaataacagatgtaccatagttcttgaaatataatttttctctctcccgtttcccatttttactaaagacaaatcatggtaagactgatttgctttattatacttggcctgtttatttgtataagtgcagcaagaataattataataattatttttcacataagctctttcaaattggctttgatggaactctgttccatagaaggattcttagataagacttttttagagctgagccctgctgtgggtttgtactctctaatacctatgaattgggtaaattcctttccttttgaggtcccaagataacttggggttcctggacttgttagaaagtcacattctttacttactacaggtcagaaactctgtatagggactgtcatagacaaggtctaaggctagttcctcaagcggcttttattggctttacaagtcaagtttgagtccttaaaggaaagcacaccattccagtcaaagcctcggtaaaataaccggtttcttcaattgtgtcttagtattgcaaaagaaaacagatttgtattgcacttatgcaagtaactatattgccataaattaagaatacttacaactactttccaaattctggagaaatcaggtagagagaaacaaatatgctccaaattttgttcacaggagtttgttcaattgttacaagccttaaataactcaaaagaaaagttttcttgactctgaaaaacaaaggatcagcaacattttaagcaaagttaaaaagattactttagacttctattggttcagtcaattcagttaattcgttttgcttgatattcatgaacatttcagctctccatgagtcctgaaagtttttccctttttttctgatgtcacaatctccaaagttatcagaaacctgcattcaagaacacctgctagaattttatagttaattataaatcaacttctaaagaggaccaaaacaagataacagttgtttgtggatgacaaaatatcttgggacaaccacagtcaaaaaacacgattgataaagaaatttggttagctttgtggcatacaatgattttatgtaacaattattaaaaacatacactaagtcatattagaattataggagtttcccataattttggaacatataccaaaaacacatttatgcaaatacagcccaaaggaaaccaaacaccattttatatttgacaatgcttcctgtaggattttaatatcaagtaagccagatatcactgttgcattagtgcactactgatgttaaacccaatttttaatgaaaccttacagacaaatgtattcaatcttaatcagtttgatcataaggtaaaattttaataaaccttttataaccctgtacaatttttgttaaagagcagatcataagcaggtttttgctctaagaaaaacctattgtgcttttattccaatgtttaatttacagaaaaactgaataatacccctttaactttagccaatatgttcacagacagaatttgttttacaagattaatttttcacaaactttccacaacttgcttaaaacttcagcttttcctatcttacttaaaacaatcctgtagctctctaaacttaggcaaaaaaaatccacattcccatggcttcttataatcttttaccaaaaacacatttcactttctttatacacctcgcatgtaaaactgttccttcagtagtctcaattacatgtaacaatgttaactcttagcaacttttacttttgatgaaaaccttggtaagttcgggattttaattatgtaccatgcgtggagcctaggacagcagacagaagtgcagataagagctgactttttccagcatagttagggggtgtggctaactccacatgtccccagctgtatctagaatctaatgctccaaaatcaattgaacagttttcaaaagtcaaagaagcagtttattaccctaaagcatttagcaaacttaatatctgaccagcataatttagactaaatgtttacatttctgaagatattttattttaccaataatcctttacaattacctttatttcccaaagattatttaaatcacgtgaactaaataaaaggcattataccttttacttttctcacaaaatatttgatttaacctcttattattaaaccaattaatcaaagctctttcatatataaacatcacacacacaatacatataaatacacagacagaagaagataaaggacttatcccctaagcttggaatcaaaccctgaacctaggctgccattgtgacaagagaaagcatggccacacggttacaaggtcaagctcccaaggacatacaagacaagagggaaacctcatccatttttttcagggacctgcagcaaagtttgtaactggccagtttgctgggtcgtcttgaacagcaggcttataggtgtccaaagcctgtgttttgtcctaatgtacctctcttgatgacagaacaatacagaaagacatgcaaagcagaccggatttgttacagcttaagactagcctcacaaatcctttttcccatgaatcaaaactttacagaagataaacagtgatttttaccattcattcaaccagtttgcacagaatgagcgagagagaggaaagcattgcctgaagcagggtggggaaggcgagtcacttagagaggccagggaaagatccacacactgcagtgacactgaaaagttcaggtgaccgcttgtcggtaatgaagggatcttttccagcagtcccatcagctctcaagtttccccttttagggtgaaaaaagctccccatgtcccacgatcctgtacatgcctaattctgtcacccatagcggtcagcaaagagtacaaggcagattattccaaacagaatagcagttaacatcccatagtgtcaaatccgttcttaggcaaaagggactttaccaagagggactttactgagagaggcctttaaccccctaagtcttagaagggactctaaccatcctaagttaggcctttaacccaaggtcagtcaagtgtccttgccttttattaagtggggcctctaatccactctgtcttaggagagactctaattcccctaagttgggcctctaacccaatcccattcgttacccagctaccccaccaccacttacccagagttattgaatcagtgctgcagtctatttcctttgggtggggggtcacctcagtatcatccattctgtggttcgccagaaagatgttactggaccccaccacttacccaaagttagcttttgggttgggggtttctgcactatagttgcttccgtggtcaccagaaagatgttataggacaccaccacttaccctaaagttagcttttgggtcaggggtttcctcactctagtcccttggtggtctccagaatgatgttacaggaaaggggtcctgatccagaccccaagagagggttcttggatcttgtgcatgaaagaattcagggcgagtccgtaaagtgaaagcaagtttataaagaaagtaaaggcataaaacaatggctaccccatagacagagcagccccaagtgcagcagcttgcccttttttatggttatttcttgatcatatgctaaacaacgagtggattattcatgcctcccctttttagaccatatagggtaattcctgacgttgccatggcatttgtaaactaccatggcactggtggaagtatagcagtgaggatgaccagaggtcactcttgtggctatcttggttttggtgggttttagccagcttctttactgcaacttgttttatcagcaaggtctttacgacctgtatcttctgttgatctcctctctcatcctgtgacttagaatgccttaaccatcttggaatgcagcccagtaggtctcagcctcattttacccagctccttttcaagatggagttgctctggtttaaatgcctctgacaaaaccattgtaagtcagggactgtgtgtatagtcattatctgaactgagaatgcaataggagaaacaaactcaagtaagtattctgaggaacttagcatagacaataagaacttaattactaacaaagagggctgttaaaattaaggtgggtttttagatgtctaatgtgaaaatttaacaaatttttggaaaaggagactgtttacccatgaaaattaattgttaattttgtatatgcattgacccactcaagactatagacatatctctataattctgggattatgcatgtggtaaaaatttgtgtctgggttcgaaatgatgtggttttacagtgtgggttttagggcctgtaaaactgtttttttttttttttagatagagtcttgctctgtcgcccaggctggagtgcagtggcaccatcttggctcattgcaacctctgcctcccaggttcaagcgattctcctgcctcagcctcccaagtagctgggactacaggcgcccaccaccacgcctggctaatttttgtatttttagttgagacggggtttcaccatattgctaggctggtctcgaacttctgaccttgtgatccgccccctcagcctcccaaagtgctgggattacaggcatcagccactgcacctggcctgtaaaactttttatataagatgattttttgatatttcaagcacagatgatttgagttgatgggagttcattgtcagaatatatagagtaataaaaagaatatgaattgatctcgttccccctgacctgggcctcaaggctacaacgctggttctagtagtttgagattagtcctgtttatgccacagtaactgtaaaagtagttctgaactctaggacaatgacctttcaactttttttttaacatttattttaggttcgtgggtacatgtgtaggtttgttattaggtaaactcactgtgacatgatctttcaactttttggatcatatgtcccatcagaaaaaaagtaagcataatcgatacacacttatttataagttacatatatgtattactatagtactgagttgcccacattattgaacataagcagaagaaagttctaaaataggggataaataaaagtaaatctgatttctggaattttcctccacatcctagtagattgtttgggtactcccctgaaatgtgcacaccctttttgaaccccctgccctggtcttttgccagtgtggtgactcagccgttttcgttgcttgggcggtgttaactagctgcgtgatcttgagcagatatctttatttaactgatttgtaaaatgacggtaattgtacatatctcattggattgctttggagattaaatgccacctgatctctaaagtttttagcacagtgtatgaaacattagctattttttccctttggtgagtttctctttattttcctctatttcacgacttctgttcattcatatacctacttccttttcttctgcgtcaggactttgcttagagccttctgtctgtgtgtttcttctggtttcctttctaagtctcatgtacagagaggggatctgtttggcctaattggttatagccatatgacccattttgcctggagcaatactggtttccacctgttgtcccagtacaactatggtggttcttttaccttttccaggtgtcctgagttggaaataaagcacagggtgaacttcttaacaagtcaccatcaagtatagacgacctgtttggggggcagatgtcttctatgaaggatgactccttgtcattgcacagcttagagatggctctctggctatcttcagatgatgtgttaaccagaagaggagggtcccatctataaggacatgatggggtggcatggtgagtgtgacatgacctcagagagatgtctagtacaagaggtcactattaatccacagaacaatagatgactttaggagagggctggacagttggagtctataaccatggtggctgtctacccacattgcaacaatgaaaatccagaatttactgggcattgaacttggaaatccgaacctgcaatctgaggctcagcatcatggtgaatattttctaagttgagaaaatgttcttttgatttggaataaaatgtgctactcttatgcaaggttacactcacactcatagcaggagttagaaataggtcttcttgttctgcaccaggtgctctagaaagagcagtatagtttcttgttcccctaatgtttactaaaaacttgttgctacttgtcttgtgggtttttcaattctggcttcatgttttaaccctactagacactcagcaaatatgaattagcaattgtgaagtttattctaacagtgtcagcaaaaaaaagaaaaagaaacccatacatgattactgaataatgcacattttcttcactttcaagtaatttctataactgtgttcttgaggcatagtacttaaaattactactttacttaggaagtcatagataggggacacatgccactatgaagaaaatggaatattaaggtgttttgatttttaatcctatttcatgacctttattggaaatggtaacataagaaactaatggataagttaacttttatatttcctgaggtctgtaggcttggatttttaaagcgaacataatcctgtgatcatcaccctgaaattttacaaccctgacacaatactcgaaaacaatgttatttatttcctctcttagaatcaggagctggtggtgaatgtattggaccacatcagtatttcattgtttcttcaggagaaaaaaaatagtgattgaaaccttatgattactagagttaaaaaaatcagttatgacttaaaagataactgcagctcagacttttccactaatgcttgacattttacattatagaataagcagtaacttttcttccagaaatgtatgagtcatatgtccgagtggttgttgctttggatcagagttcatatttaattacctggcttggacatttaaaagtcagtcctaactaatcataaccatgagttcaatttcttcctctagtttccatcttgaactttcaaactgcagagtagagataataacccacaaatggttaatagggaaatcaagctaatacctttgaagaaagactgcaggtatttgagtatacctgatatcacgtagtcaaatctgagtaatgaatctcacttcgtttagtcatttaacacatacataaaaggtatgatttccccaggttttgcccatttccttcacgctctttagactttcatttttaaatgttatctatttctgtggcttaaattactaaaaacttgttgctacttgtcttgtgggtttttcaattctggcttcatgttttaaccctgctagacatctttgtactgatgggctgcaaaatttacattttaagttccttctaactctcccagtctctccagtgactcatcacccatgggtttcctgaaggaaatggtattttagaatcccacctactgtttcacagtttaaaaaataacttaagcaagtatcaaggataaccatcataattctcactaagactaaaatgcaagtctgtctcacatgaaaaatgagacacccagtggatatgttctgcagacaatttagaagtcattgtagtgaagctcttgtgagaaggtgatttaaagatacatatctgaaattcagataggagcaatcgtcaaaactattaggttggtgcaaacataattgtagtttttactattacttttaacggcaaaaattgcaattacatttgcaccaacctaatattagaaagaatgatttcttggtaatagtataggattaagtgtaataaaattaattaggaaagcctcggctgggtgctgtggctcacacctgtaacctcagcactttgggaggctgaggtgggtggatcatctgaggtcaggagtttgagaccagcctggccaacacgatgaaaccctgtctctactaaacatataaaagttagtcgagtgtggtggcaggttcctgtaatcccagttacttgggaggctgaggcaggagaatcacttgaacccaggaggcggaggtggcagtgagccgagatcacaccattgcactccagcctgggtgacagagtgagactccatctcaaaaaaacaaaacaaacaaacaaaaagctcttaggaaagccttcctggaaaaatgatttcttcagggttttgaagttagaagggacttgcattggtggaagttgatagactgaattattcggacactggagtagcacacagaagtcccttaggaaggaataacaagctattgagttggggcagcgaattttgtctcaaatagaaatctgttggagaataatgaaaaaaggttaatgaaataatgacgtgagactggtgacatgttgtaggatgctcaagaagagaaacatttgcatttgatatggaagaattcttgaacagggaaataaaagcattgttggaagaacctgaaccattggtctcaagattgtattggaaggggagagtcaagcaaggacatattctcagttcttctgctgagaggtgatgagccatgagcttcagtgatgtttaggaagtggagaagtgtagcagtaaaaacagaacaagagacatataggaaagaccttatggatttgattagataaagttttataacatttgcatgagtaacatgaagaggcgtcgaagatgttgataaacctacattagggttgacctatatgaagttaccagtatttgactttttaaacctacaaaagtggtagttttaaatagttctttgtaatagacacctggcttgggttggagatgactactcttcaaaatggacaatggcatcagtgaagaaccaagaattgcaaagatactgcaattctgccagttaagtgaggacaaaagccttaagtgattaccggcattttcagagctcttagctggtagcatagtgaattgtagtattgagaacaaagggaaggaaggaaggaaagaaggagaaagcaaggaagcaaatttcatgaatactttttctttgaaattttaaacgtgtctgtttttatgtacaatggaaagtctcagataaaagaatagaggctttgactaagtggcgtttaaccagtgtagagaaattttgggagattgattacttcatcagaaagtttggccttgatctggtcaattgctcaatttggagttacttgaatatttagcaagagaaaaagtatttttgtgaatttgaaaaggaagcatgtttttgcttacttttctagtcacttttaggtagccactaagaggatcagacccaagttagttaagaaagtaaacaaaataacactccctaacatgcttacacacacacacacacacacacacacacatgcatgcacccctgataagagaacacttgtgctctttggaaagaaaggtaggtacatgcaacacacattgttttaagatacctagtttggctgcattaccttgaaaattctctccactgcttcatgcagatctgattggtgagcataaattagtcacaaatggcacatgtgtgcatcagtaataaggaagataacagcactactacactaagtttgtgatgctctcaacaagccaggggtggtatgaatctacagatgaaatctcccacagattcctttgagaaagacatgagtcatgagatcagatcgctaagaggcaggacacactcagttaggaccaagctgcagctaaagaaagtttacatgttttagagtggcaaattgtcaggttgtttctgctcattttctattcaaactcacgtccagggcttcctgagtaccgcagcaaacactagctctgtcttctctaagctcagtgaatgtgggacatggggcaaaacagaatgggctcattctccaggttccctccatttgcatgcatattttattaggtcttcgtctaagaagcagctcatgaagaggcatgcaggaacatttgtgtgtgtgtatgtgtgtgtgtgtgtgtgtgtgttgtaggaatacacagctatttgtgctcacttgggatgaatggggtgatatgtttcatatttatcctactctgtgcctccaacccctattcttctgggtaatttagaagaaatttaatgtgtagtctttgaatttgagggattcacagtctaggtggggagatgaggatctatacaaaaaataattaaagaacaacaagaacagtttataatcattgttggatagtaagtattataggagtctgagaagtgggtttcttgtgagctgatataatcagggaagacttcttggaaaaatgaggtttcaattttaaatctcattaaatttcaattaaattggcatttattgaatatctattatgccagtgtgctcaatcatgggactaaaatttgagttatgagtgagaaaccattctggtgtaatcctctttgtattaggtggagccatgtaaatgctttttgataattgtgttccacaaaaaacacgttataactacctttctgtctctctgtctctctgaaaccaagtattttctaatttttgcttggttaaattgtaattcccctatagacttatatgcctttggtaagtgaggaatttgttagggaatttcttctcctttcttgaggctgtgattctgaggaaggagttcaagcgtgcttcttcaaacaatgaaagtcagctgtcttggtagcaattgtcctcacaagcagatagttcaactttgcagtttgggctatagaaaaataatcctgtaatcggattgttagaatattcagaacttatgcctcaaataaacttttatgtctgtggtgcaaagggttgcttttgtcttttgcctggattcagtcccacagagtgggaacatcaccatgtgcaatcattagaagtgcaatagaaactcagcatcagttgaaccagctcatatttagtgaggtcacatctgctgtatgtctgtgtttgttcaaggataaaaggaaagaagcaccagggcttctttatgttctcatgttttcatctagcgggcaaggagcacaggaggtctgttgttcgtcattcctggataacatcaaagcccgttctggcaaagccgttgctaatctgtgggcaggatgaccctgagaacacttataatgctgctacctgggaaatagttctcatttttgcaaaacattttatctgaaaaaggttgcacctaccatcgtttgcctaacttttaacagaaaacttctgacaatctgtacgtgcataacagtttgcctgcaaaattgttgtcctccatactcacattttccttttaaaatctcatagtagcctctttctttataaggctatgtatttgatgaggcaaacaagaaaagagagtatatttccttttgctttatgggtttttgttgttctttataggcagatcatgaatagaatccagtgaaattacaggctgctatgactgtgttctctacttcctgtttgcgatccaaaataatccacatttgtgataaaaattcaaattgtaccaaaggttatgggatttcattccatattcaggaattaatataactaatgttttttttattcgtatgttcatgtctgtgttcattgattcaggaaacattcattgagcacctactaagtgctaggcatttatcagatggtgacatgctatgtagagaaataaagcaaggtgaccaagagtgctagcttgggaagggttgctgtgtttgcagtgccagggcaggcctcactgatacttgagcggaggcctgagtcggggcagagttacctgtgcagaaatcttggggaacaggcagaggtggagagagcatccagggcaaagtccctgaagtggaagtgtcctagataagttgcagtaatggcaagtaggatggtgtggctggggtggagccagtgagtggccaggtagtggtggggaggtcgggctggtcactaggagtggcagaaccagagagcagctcatatagggccttgtgggccacagggaggcctttggcttttgctttgagtaaggtggaggcattgaagggttttgagcagaggctgttgggccctgacttctgtttaacaggcttacagtgcttgctgcatgaagaatccacagtcgggcatgggcagaagcagagacttgttagtagactgttgctgcagccaggagagaaattatggtgatttagattaggatgatgagttggtaagaaatcggttgctagatctattttaaaggtagaacctatagaggtgtcattgttttggacatgaggttttgttttgttttgtttttttgagatggagttttgctcttgttgcccaggctggagtgcaatggcacaatctcggctcacctcaacctccgcctcccgggttcaagtgattctcctgcctcagcctcccgagtagctgggactacaggcatgtgccaccatgcccagctaattttgtatttttagtagagacggggtttctccatgttggtaggctggttttgaactcctgacctcaggtgatccccccgcctcggcctcccaaagtgctgggattacaggcatgagccactgcacctggcctggacatgaggtttttaatgtaggcaactggtagggtaaaattgcttcactgaacatattatatgttctaaacttggttctagggatttacatctaataatgcattgatccttatcacaatgctatggaaaaaatatttttttctaaaatatctgctgaaatacattcaacaaaacacataaatcttaagtgcgagctcaaatgtattaaatgtaagcttgataaatttttatatgtgtgtatgtatatataaacatatataaataaatgtaaatataaatatttatgtaagcagcacctagatcatgatataaaacatttacagccctgcagaggttcctctgccaaaggtaaccactgtttttaccctcacaccatagattgtttttgtctgttttcaaacttcatataaatgaaaccatactatacctattatttctttaactggtttttattgacatgatttatacatcataaaattcatcttttaaagtgtacaattcagtagttttagtgtattcacaagtttgtgcaaccattgtcactttctattctagaaccttttcatcacctccaaaagatacagccattagcagtcactcccaatttccccctcctcccagccctggcgaagctcctttccatctgtatacatttgcctattctgaacatttcatgtaaatggaaccataccttatgtggccttttgtgactggcttctttcatttagataatgttttcaaagtttgtccatgttttagcatgaatcagtacatcattcctttttttttttttcccaagacagagtcttgttctgtcacccaggctggagtgcggtggtatgatctcggctcactgcaacctctgcttccgggttcaagggattctcctgactcagcctcctgagtagctgggattacaggcacccgccaccactcccggctaatttttgtatttttagtaagacagggtttcaccatgttggccaggctggtctcaaactcctgacctcaggcgatccatctgcctcagcctcccaaagtgctgggattacaggtatgagccactgcacctggccacatcattcctttttaaggctggataatattccaagatgtggatatatcatattttgtttgtccatctatcagttaatggacatttaggtttttctcttttttgactattatgaataatgctgctcctaacattaggttttgtgtggacatggacaggttttccgtcatactctgttgtggctgtttctttgttcaacatgacatctatgtaattcattaatgttattgcatgcagcagttcattctttcttgttactttttacaattccattctgtgaccataccactatttatttatcgcttatccaatcaatgggctgtgatgaatcctgtgacatgctttgtgtgtcttttggtgggcaaaagcactcatttctctttggtaaatacctggccatggaattgctggctcattcatctttttctttatctgtcctctcagagcattctgtcatgcttgttcttgttggtgtgggcactcccttgcagaggaaatgtgcttcctgtagacctggtccagggatctcccttccctgcctgggcccacatttaggactgacttatcttctttctacttctctaaagcatcttttaggaaccctctccttcccaatgtatttcctcttccattgtttaacaaagcagagtttagctcatgcctgcttgcaactgactgtgttcgtttagttactggcttgagagcctaagatgatttataatggtacactccctttcaggagtgattactatgggtttctgaggggactagagccctctcagaatttcataacagctatgtgtcctcccatagagaaatgaatctgtgaatgcacacacacacacgcacacacagacacacatgcaggttttcttacacgttcaggggatttgtcgacctccatgaatcccatccgctgtaggctcgtggttcccacattaagaatccttcttttctactttgtaatgccttgacttttttttttcaaacaaaacttcccctgtgtcaactgacatggtaaaatggaaggactatatttccagagatgtgtataaaacatgtttataaaacatgtgtataaaactggctaaaacagaggtcctgacttgtacccagctggcaaaggaggtaagaattatcagcacttagaaaagtaattttaattgttatggaatcctcattcttttcaattctgctagcagttgagaacgtttctaattatatcctttgctactcctgttaaacttcttaactagagattaaaatgaaggcactgccattgagctgggccctcccaggcctggaaggcgccacctctgccgcagggacagctggcatcagagtgggatgtgctcaccccaagctctccccctcaatgggagcctcctctcctcagcctgagtttcctgtctcacatgtttaatggatgaataattgggtgccactcaattgcagagttcctcggaaaagagcaggtgtggactaaatgaagtagaaaattaaatagatcttttctaaatgatttttaaaataatttgatgacagtggtagcagaagtggaatcatggtggcccattctcattctctggtccatttctccaaagacagaaagagaaacagcaacattagagtaagcttttcttatttacatcttttgaaacttttatttgatacttttccctctaagaacaaatttgggcttcatccagtaggcagtgcagcatcattacaaggctttaacatatagtccataataaattagacttttttcccctgggaagacaaaaaagttttgtctagaaatttgttgctttaaaatttttaccgaagtaataaaacatacaaagtgaaaatcttttttcctcctccacaacatccatttccgtatctcaggggtaaccacagtaaatagtttatcttccttgagtttttattgaagtctataaaagcattgtatagatttgttgaattttataacattgggatcaccttatacggcggaatgaagcttactctttctactgtgtgacgtatcgcagatgtccttcagtgtttatgttgatctgccttcctcttttcttgcttttatagcgtatttccctttatcttccagtttttagaataatgagttggtactctgacctccaaagatgactaatatgtgttttcaaaaataattatgagctcacggattttaacatatttggtgtgtttcaatccaatgtggccattcatctcaatgctcagtagtctcaattttgttcgttgggaccctcaagtatttttggcatgactcaatagtctcttcctcactttcaggtatgacaggatattccaggctattcttttcttcaaattgaaattaaattgtggattaaatcttaattttattgtgtgctgtgttaagaaaaatttatctcactagatttaattagatgtacctgctgtacccctgggtgtgccttatcagtcaatcaccaaatgattttgagagctgccgtgtgcggggaagtcaagctagatcctgtgatttagcaaacaagtcaacccagtgttcctcttcccacatgccaagcaaaccaaaccacaacaactattaataaaacaaatccttattatgtctttaaagtttatcttttttcttaaaaatatttatgagaaacaattgatccatagaaaagtgaacaattgaggactatatacaactgtagtaattttattttcaacttgattgaatagtaacttatataccataaaatttactccttttaaatattcagcttaatgagttttgttaaatatatacagttgtgcagccaatacttaaatcacttacatcatctcaaaaagttcttttttgtccttttgcagtcaatccttgcttccaccccacttccaggtaacccttgaccttcttttggatgctatagttttgccttttctagaattcatataaatggcctcatgtggtgtgtagtcttttgtgtctggcttctttcacttagtaagatgtgtttgagattcatccatgttcaggatcagtactgcatgtgtcagtatttgttcttttgtttttggtagtagtattctattgtatggatataccactacatttggagttggacatttggtttgttttcccccatttttgggaaactgtgaataatgtaggtggacatttgcatacaatgctttgtgtggacatatgttctaattctcttgggtagacatcttggaatgggattactggatcatataataagtatcttttaacttttcaagaaactaccaaaatgttctccaaagtagggaaccatttgtgttcataccatcagtgtatgagcattccagttgctccacatcctcataacacatgacattgtcattctttttaattgtagccattctagtggttttgtagtggtatctaattatggtcatagtttgcatttctctaatgaccagtggtattgagtgtatttttatgtacttgttagccttcccttttttgtgaaacatctgtttaaatcttattggattgtatgtcttcttttattgagttgtaaaagcactttctgtattctggatccaagtcctctgttagaaatgtgcttgcttttgcaacttactttcaggttgagttttgataagaaaatgttcaactcatctaaatttttatttgaaatagaaaagacctaatcttatccaaaggacatgatacatttttaaagaataattttataatcatgtaaggaagagaaagaaaagaaaaagtttggagaattgataaaggaaatattggagagagagtgaaataagagactgtaaaaggaagaaaataattagggaaagagaaggagataaaactacaaagagacccaagctcattcttgttggtaaaaagaaaaaacaaaaacaacccccttctcaaaaaccgacaaaaagagatgtaatgagagagagaagctaaaaaatagaggaagagaacaacaaacaaatttacagttatggagaataaaagaataggtaggaaaggaggagacaaaaaaatgccaagagaagaacacaccaccaccattgctttcatttcccatggcctgtccaccatgttgtctcctctctactctgttacctcatctctctgttccccacttctcatgtccactttctggaagtcctacctttcctcccacatcccaattctttaatattttactgttctactttccaaacatacaaaatagctgggttatgtcctttctatctttagtgtataaaagaacagactctgaagttagttgtttgggtttgaatcctacctctgtgaccctgggcagaacctaacctttaaaatttccagtttcatgatctgtaacatgggaacaatagtaatactggtctcaaagttttctacagagattaaagaatctgtgtaaagcttctatcattgtacttggcatagagtgctcagtcattaagtattatagctgctatttgtgtagtgtatgtgtgtgcgtgtgtgtgtgtgttgtggggaaagcgtgtttctttgttattattccttctacctttgactctctgttaatcttattttaatctgggagtatcttaccaaactaaaaacttaagtgacaaaataccacagcgagcatcatgcttccgatactgcaaaatataaacacaactgtatttgttcatgtggaatgtaaagttggaagtaataataatacatatttacatagtgctttaactttgagcattttgatgtagcactgacagatatttagtagtagaagacttatggggtccgggtgctgaaatttccggtttctgtaataccgagatgccaaaccaaccacagtttgataaatacagctgaagcaggtgaggtgtctgagctttttatgtaaatgcacaacatgaactccttccctttttgccagtcacctccaccacagtttccattgaaaaatagaaggtaggccaggtgcggtggcttatgcctgtaatcccagaactttaggaggccgaggtgggcagatcacgaggtcaggagtttgagaccagcctgtccaacatggtgaaacccatctctactaaaaatacaaaaattagctgggcgtcgtagggcgtgcctgtaatcccagctactcaggaggctgagacaggagaatcgcttgaacctggaaggtggaggttgcagtgagctgagatagcgccgttctccagcctgggtgacagagcgaggctccgtattaaaaaaaagaaagaaagaaagaaacgaaaaggaaaaaaaaaagaaaaatagaaggtagtatttgggaaagacctccccaaggcaagattcctgctgcactgcatctgcctctgcctcaacatgatgagtacaagtttacttgcctctgagtaatttgtattttttggattttttccaattgctggcgagtttccccttgcatggaactgaaattttctttgatcctggatcaatatagggaaaaactttcctccctcgtttacatgtagaagtttagctacacaaagtgggattatgccaactctttgttttctctctgttaggcaacatttcccagtttgaactatcgttgctcaaataacaagacttgtgtattttgcttgctttcccccttgctgaactttggatactggctaatttgttaggatgctgcttaaaatgtgccatctatagaactggacccaacatggatgtgttccttcttcctctgtttgaggaatcagtctaatatgaatcagcctaaaatggcggcatcagcttttccgccggttcagcacagtattcacttatttatatttggagtgataatatacttatcacccaaaccaggacattcttgagagtgaaagggggacgtggctaataattaagctcaggcaacaggcataaaccagaattgtcctgggcacacagggctatagggcattctaattatgttaagttgaactcaagcctaaggtctaggcaattttcagtttttaaaatactaattgctaatagccttggtgctcctctctatcatgtaccaaagtagttgacttttttctgaccttatatttatgtttgtataaagttaattgcattgatgtttggatttaaaaaaaatctagattttaatctgcctaattagctactcctcttcactctgcatcatctgcaaatttgatcaacaactttcctgtgtatttttcccagtcgttggtaagctaaaaggtgcctttcccagatgctcagtaccaatcacttcaccctcatggacctctcaggcagcaggagtcaactgagaaccaagatcttagggtattcccttctcaggtgtttgtattttgataggagacctccccccaccccgcaaaaaagatggtaaaacccttcagagcagaaagaatagatatctaatgattgtttctcaggtaacttggcaggaactttcttttgcaaacagattttgagcatcttccttatagtagctaataggggctgaatatagagttacatgtaaacatgttatctaataggaagcactatctgatagatgggtgctatagtaaaggtagaggccaaccagcgtggggctaaaaagaggaagacatttttaaaagggcatcttcccattccattgtaatggtctatatacaaatttgacagggcagttaatttaaaaatatagtttttatgtatttcagaagtcattcatagagcaaaggaaagtttcctggtctcagtttcctttcctcttgaccacaggatatgtttatataaatttgaagttcatttaaccctaacctgtacacatgtgcagacttccagaagtatggcttttgaatacttttagttgcaactctcagtaagaaatacattatacattgtaatcccacatgtgcatatgtgtgtgtgcacatgcacaaacccacacatgaccagaaacagaagtttcttgaaagaatacttgctactttgcaatgtcctcttcttccctcctcttcttctcccttccccctctccctctcctctcttctccttccctgtcctcttccctacccttccccttcccttactcttttccttcccattttgtttcccttgtccttcccttctctttccctttccctttctcttcctgttccattcaattcaatttcattccattcagaaggctggttgagaccaaataatttgatttcaagcctggctaggccaggcacagtacctcacgtctgtaatcccagcactttgggaggccaaggcaggcagataacctgaggtcaggagttcgagaccagcctggctaacatggtgaaaccccgtttctactaaagatacaaaaaattagctgggtgtggtgatgcatgcctgtaatcccagcttctcaggaggctgagacaggagaatcgtttgaacccaggaggcggaggttgtggtgagccgagatcgtgccattgcactctggcttggtcaacaagagcgaaactccatctcaaaaaaaaaaaaaaaaaaaaagactggcttgcacaattacacaattacagtttgttaaactttgctctggagttgtccattgactcctaaattatctgtagatgctttttggtagtaataataatcaaaagaaagctagtcttattggagtataaatatgtaataataatgatgaataagactccatgatctttttgttattatgaataaatctctgcttacggaggaactagcataacaaactgattttgttttaggtcacccatatgagaacagcaattaattcagtaccaggacaatgaacagcaagcagttctttactctaaatattgctattacataactgtgacttggcataaaataccctgtgttagacttttttttttttttaatttaggacaggagttgttacagtcatgctcaaattggtttaaaaaggcaagcttacctctataaagttaatttacctgtattaatagtttaattgttcacctattagaaaattattgctttctgagtggagggcttgaagccgtgaacttctctggcttgctactgtgctcttctgtcgtattgatagttacaggtgtttggattgtctcttttaacacatttttgggcccttgtaggataatttcagcaaggaatctgggaatttgaaaccagagaacgtggactgtcacattatgtgttttaatttcagtgaatgtacctcaatgtatttgttaaagttttaatttcatgaatatagagcatcttctattgaattatgaagatgggctttggaggcaggttgatctggactaaatttaaaaacaatttttgaaattttaggttagagctctaaaacattctgagtttctctttcctcatttatagaactaatacttcaaagcatttgtgaaagaattaaatgagataatgtatgtgacaagacctgatgtaaaaggagacgctatggaagtacatactcatatgtaaatatacataaaatatattatgcatctatacatattatatatgtgtgtatcttgtctgcatgtatgtgtgtagaaacataaatatatgtaaaaaatcacttcctttttcaaatctgacacttatgtaatgaaatttggaggcttgcattttgatttctaaatcagtcagcttattacattttttttattatcagtgttaacatggcacattgagaatgggaaaaatgattgaaaaattatacattatgatttttctggtagcagatttcacttacatctagtgtagtggcttgctcaatcaatgctgaaattcaaaccttgacaagaatacaaattagcattaatgcatttgaattttacttttcctccccactccaaattaggcaaaggataaagcttcatttgttcttgagtgtttacctattagtgtatgaatcaggcaattaatctctttgagactaagatttcataatatttttatttatgttttagcatttaattatatatacacatagtatatttcccattgaaaaccactcattagtttctttttaagtattataactgtggcacatatgtatatgtatcttgataatatttttctagaggttgtgttgtgttgcaagactgtggtagggatgagaactgaggcatatgcatatttcactttctggccagtggttttcttttttcttttcttttcttttcttttttttttttttttgagatggagtcttgctctgtcacctaggctggagtgcagtggcatgatcttggctcactgcaacctctgcttcctggtttcaaacgattctgctgcctcagcctcttgagtggctgggattacaggcacacgccactgcgcctggctaatttttgtatttttagtagagatggggttttgccatgttggccaggctggtcttgaactcctgaccccagcctcccaaagtgctgggattacaggcatgagccaccgtgcctggcctggccagtggttttcttaccatctgtatttgctaaatacattaatagatgctttaacaattcagtctttaattgactaaaatcacatctattatgggaaagaggcagttagtatttggtaataaaaatgataactttttgaggagatcttgccacgatgatcaaatcaaagttggggtggagaagtcagaaggatgctgtctgaggatatttagggctgttaagtagaagccagattagatttgttctaaatggccttgaggtacatgtagaattacgaacagcatttaaacagagacagattatgcctcaacatgacaacctgctcccagtggcatctctgcatggctacagtacactacgtagggttcagaggatcttggttcatatttcatctcaattcctcatgaagaaaagtctcagtttccttctctgtaacatggagaaaataaccctggctaactcttgagagtcttgtgaagatccagtgatctttattatcaatgtgtagtgctgtttatagtttacaaagcgctccatggtagtaaactgtattgaacaaaccaagtgtggcattggtgtccctaccactaagaggtcaggcagtcacttgtcagggcattcaagcatcctatgtgtggttgaacttcttcatatttataatattctaatctggaaatactatcctgaaggatctagggaattcactttttgagtttttgcttctttgcttcaaggaagggaaagattggattttatctgaggcttctttgagtgctaacattttatcagtctacaagcctgtaatgacaaaatgctatttctcttcctctttcgtagtataataattgactttcagctagaggaagttacattgcgatctttgtggttgctaacccatgtgttgtgattaattttcatgtttgctaacacatgcaatacatttccctgagccttcatagcattctagaggacactttccctcttagatcctctctttacagttgccttaggcaaggcaggtggggggatagatgtttggtttgaaatttgtgttcttaaaacacattcctttttaaaacttctaaaaataaagagttttatacaaacactgtatttcaggatgcatttcttagggaaactgaaaaacgaaaacaacctagagttgtattttcagctaatgaatgcattcctctccctgcatcaactctgaattctattatatttaattttttaaaatttgtattttgtaagagacaaggtcttgctttgtcctccaggctggagtgcagtggtgtgatcatagctcattgcagccttgaactcctaggctcaagtgatcctcttgtctcagcctcctgagtagctcggacttgtagtccactgcccccagctgattttttaaaaaaattttttcgtagagacagggtctcaatttgttgcccaggctggccttgaactcttggcttcaagcaatccccctttatcagcctcccagagtgctgggattataggcatgagccactgtgtctgacctgaattctaatttctagtggctaatggccccttgtctgcctgccccttatcctaaggagagtttcttttttaaccactttccattttatcattgggaaggttctagcttgctcttctgtttcagagaccattgtcttcattgaactcttctggatccactttgtgtcataaagagagaaacaaaagtccccgaggctttccctccccacctttctccacgtagggagaataaagcccttggtaaccatgttccctatggttatgaggtgttttttacacgctaccgtgaaagagccatttgttgaatgcctgccttgtgacaggcacttgcctcatttaaatcttaagacatctttaggaggaaggagaaattaaaaaccaatttttttttccaccattgccaaaggatactgctggccaagacatagcttgaactttacatatgatagccctaaatagagtcctaaagtcagtttctggggttcaggagtggcctcctgatacaaatattgtagaaagtacctccacaggttcaaagcaaaacatttcaaaactatttatacagctattgtaagtggaggtttagactgatttcctgccagatttccatggactcatgtgcgaaggttggctctttgacttacagtgttaacgtgctgtgggttacgtgctccataccatttgagtggctttcgtatttcttccctctgctagcatttgtaagtaagcaggctaaaatgccaccaatgctatcagtttaaaatgaacacttctgagtggcttaatttccttccataactgttcaaaaaataaataaataaaagttgtaattctaagccattgttcttataatattgtctgactgaacatatgtctggttggattactaacatttcctgaacttctgtaattctgcaaattgttggcttcaggtcttaaggttaagcttttaaaaaaattaaacaaaaataacttccttttatttgtgctgttgatgctcgctctatgagataaacctttcctttttttattccttgagtcttgaaatgttgaagagattgttgttagaattaaaaaatgacgctgagtcaatttctgattgaactccataaaacatttttcttaacagtattacacctctacagatcaaggaatactagagagtttagaagcaggatgaggagggcaggtgagaccgggttgctctgaaatagctgtaatcctgcacactgaaaaaaagtaggcttgtcaaaggttttgcccttactgatgttagtgatggcgtctgcatttctaaaaagatattacatggtaatgaagatctaatcctcttcttactgtcattttgttccaaggaatttgagaagtgtatacaaagacacatcgtggcatcttaaaccaaaggggtggacaccttgtcattaactgggcactcttggtgtgtcttcaggtttcatctgagaacttttcttttctttttctttctttttttggtttatttcagcttcccagttgcatgcctaacttctctctctcccctttttaaaaaacttttattttaacttcagggttacaagtgcagttttgttccataggtaaacttgtgtcatgggggtttgttgtacagattatttcatcacccaagtttaagccttgtactcattagttatttttcttgatcctctccctcctctcatcctccatcctccaaaaggctccagtgtgtgttgttcccctctatgtgtccatgtgttctcatcttttagctcccacttataagtgggagctaaatataacttatttgattttctgttcctgcactagcttgctagggataatggcctccagctccattcatgtccttgcaaaagacatgatctcattcttttatggctgcatagtattccatggtgtatatgtaccatgttttctttatccagtctatgattgatgggcatttaggttgattccatgtctttgctattgtgaatggtgctgcagtgaatgtatgtgtgcatgtgtcttcataacagaatgatttatattcctttgggcatatacccagtaatgaaattgctgggtctgatggtatttctgtcttttggcctttgagaaattgtcttccacaatgactggactattttacactcccaccaacagtgtagaagtgttaatttttcttcataacctcactagcatctgttatttttgactctttagtagtagccattctgactgatgtgagatagtatctcattgtggttttgatttgcatttctctaatgatcagtgatgctgagcttttttttcatgtgattgttggccgcatgtatgttttcttttgaaaagtgtctgttcatgtcctttgcccactttttaatggggttgtttattttttacttgtaaatttgtttaagttccaaaagcaattgcaacaaaagcaaaaattgacaactgggatctaattaaactgaagagcttctgcacagcaaaagaagctgtcaacaaagtaaacagacaacctacagaatgggagaaaatttttgcaaactatgcatccaacaaaggtctaatatccagcatgtgtaaggaacttaaactacttttcattactctttgctgagagctctgtaaggatttagtcatctcttcatcttagtgaggctattgctgaaagaatgaagcaatatcaataataatgccttacattcataataggactttaaagttcacaaagaactttcacacagattttctttttgctcatctcagcaaccctgtgaattaggtgtggcaggtattagcacttttattatgcagtaaatttagaatccgacaaaatgtgtgaccagcccaagaacagtagatttttaaaaatgtgttctaaaggaggcagagagagaattaagcatgcacacaccctactgccaccaatgaaagctttttaacagaagtctgtgtgtgccccaccttctctcctattatccagaacagtcctgcaagattagttcccatgcagaaacagatcaattatttactgtaatataaaatgagatgtcccctgtgggaggctgctgaaagggactgtaaaactaaggccctgaaatggaaagggcttttgaaacccaagactttgtacttcagatagagtgggtggaagcttgttcatttggctattttcacttacccctccttgaccttttcccgcccccacatctagtcgattattaagcctctggtttggctgctttattttacatctacggctacccaaaactaccgtagggccccagttccatccctactgtcttttcacaacagcagcgggtttcggggatggccttcctgccccttgctcatgccatctttcacatgccctaagagcttaaaagtctgtaagagttcagcgttttccatggggtatagtccatcctccttagcctagaacataacactgtagatcttgacctcagcctaccattccatttttatcttgccgcttcagtggtggttttcctgaatggttaggggtcccttagcattcttcgctgccttcataccagccagtggctctgtttggaacgcccctccccttagcatgggagccctcttgcccctgtgctgaatgagtattggttctttaaaatttggctgtgttttctcctttcttctccgtggggaagtcttttctgacctccgttgcctgtgaaattggccacgtgcatcgttgtggctcttagcatctcctccagagctcccttgtgaagcttcaagtagaccgtgagctttctgaggacagggtctgaggcttaacccctgttcgtgcagggcatgaccccctgtagggggattacagtaaacacagtttggctgaaagtttggcttcacttcacagtgacctcagccaccactcaggagcatttggcctgacagccagtttgctgactccccaaagatatcgctaattaggagtgctgttgaggtggtctgggatttacaaaaatattttttctgttaaaggatcatttccaattgaccttaattaggaatctgtaataatgaagagaaacacaattttttctctttcctttttatacatgaagaaagtcagaagcataaattccagattatggagttcagttccccttgatcatggatttgtgcttttgctgagtgcagacagtatagagttttgccacttgcctaatataggatagtcaaaagagtctgctgtattaaattgggagcactcttatggaaatatctgtaaacaacttgtggatttgtgcttcaagaaatttgtaaaattctctttgtagttgctaagatacaggaaataacttttagggctagtatgatacactgccaaggaaaacattttccaggctgtccgtctttggtcacacacgtgctaggtgttgattcctgtatcatactgtaattgtggtggcctctaagcctacttttagcagtttgaaggtatctgttttctactacctatgagatatttacttatccatatcagtaccctttaaactagaaattaagattagtttactattaccttgtctgtatatggggggtggggcaatcacatggggaatatgtgttcttatagaaaaaaatcatcattgtcttgtttttcctacattccttacaaattttacagccatatttcttgatcatttatgccattagaaccatgaaaaagtgatatttgaaaaggtatcatctttttaaatacaattaattttaaggaaaatagtggaacaagcatattatataatgtagtcaataatgtggctaaagtggatatttgagttgactgaattttatttttgtgatagttatttgtcgaatgagaatgactctaaatatcaacacatcagtcaaaataaagtaaatttgttatgttgaactcacagttttttatgagaaaaatgaaaataaggtttgaattttctgtattactactcttttatgatagaatactgagaatttacctttattctagattgtaatctattccacaagcatacaaaatcattagcatgtggcgaaactgttgagttcttccattctcctcattgaaaataaaacgtatattttgcttcttgacttagagatatcacaactataatattcctctatgattttctatcttgatgtttagcaatagagtcaggactgtaatcttggtttaggtgttttgttttgctttatgtttccatcatatcatattgtctttcagattttcacatcatattcacccaggtatttggaaacttggggagtggatgactctaatggtcagctgggatctacttcctggatcactttggctgtcaaatatacacagcaccaatgtgtattaattgtgcaaagtcagataaggcagtgaaagtcactaatctcattctatttgctttctaagaccaggtgccccattataattaatccatgccttataataccacaattacatgggtttgatttctttatacactggctatcgtagtctttaaaaaacttaaattaatgaagaagtggatattttaactgagtctagataattatttgaaaaggatgttatagagtgaatggagagttggctggaggacggactatatgacttttaactgttctgtataatcagggattccaagattcaaaagctgagctataagggaaatctaagaaatgctagtagccttagttacagtgtttttgtatgttggtttgtcacagactgccttttcaaggtgtgccctatgaacagatattctgcccagaagcaatattggaaagcaaagcaagccaaacaagggaaccacaccgaggcagccttgctgaagaaactacaggtaaggaccaggattccaattgtctggcttaggctaaccaagtacagcaataataaaaatgtatttagagctttctagctttgtcctttcacccaaaacacagagatttagaatacatatagcaacacattgaaagtagaagggcttttcaagtaatagggtgtgaccatctatttcctggcatgtaggtagcacattactgctgctgttttttagggtgtgccagactaattcaaagcttcccatcaaaatgaaaaccaattcagaatctctgtaagaatattaaatccagttatattttacttgacataatccttgatatttttcctgaaagaaactatggagaaaaataattgaaagaccattgtttatggtttgtctgagtgtaaattcgatagaacttaattttgcctcattaaaattcctggtactttcagaattaagaacttttatttttgagactttggaaattctactattatcctggttggtttttctagcaatataccttcttaaagtaattttaaaagaacaaagagcctagtacttttctgaaatgtccaacataaaagtggcccaagacatgttggagggcatttcagcatacattgacaaatcatcacactatattataatcatttatttaattactgctccctttggggagtcatccactccccaagtttccaaatacttggatgaatatgacgtgaaaatctgaaagacaatatgatatgatggaaacataaagcaaaacaaaacacctaaactaagattacagtcctgactctactactagcctattttattcctggctatagtcttgttcctaaaaaaaatttctttgtcagttattacactctgtttactatatttctacactgaatatttgataatcatcttatagcacgctgcagaactggaacaaaaacaaaatgaatcggagaataagaaactgttgggagaaattgtaaaatacagtaatgttatacaagtaagtattttctcttaaacgaggtgagtattttatgtggagtttgtcagtaagttggcaggaaagccaaactgcgttaaaattttgagatacaggaagtttgttctttgatgggaattatcgatgttgtgacgtattgtgatgtattcatttgatatgtgctgcactattctgtatgtttaagaataaatctgattttacacataaagaagtgatcttatctggatgtatacacaagttattacatcaaaaagaagagggtcaggaaacaatttctaaaggcctgttctgaaatagtcctttagattaatgggactgtgtttaacatacggagcttagcttttcattttgtgaagagagaaaagttttcactttcagttggaagtcatccttgaattgttattagaaggtcttctatttctattagtatgcacacactgttttatctcagctgcattcctttcctgtgtttcacttagatctttttagcttcttacttggttatttgttaatatatgccccacctttttcaaaaaagaatgtaaggcactttccaaaatacagagctacatagtgagataaaatacaaataaataaagcaattggtcacagggaaaatcatggttggatgaataaattgaaatcggggtaaggcatgtttataaaaaccatgttgtaaagtctggtaaattttgacttgaaggctttttcttgccctcttagccatagggaagcatagtctgttacatcgttggctaggagatccgcagcacagagccaaatcagaggtctagaagcacaactgttcccaggaataggaccagggaagtgtttctcctatgtgtgctcataaagaggacactgtgtaatatagtaaacaatagccttgacagcttccttacagtaaatgctacaatgaggcatttcatagagctgtcttttaaaataatatccctgatattttgttactggccaatggcaaaatgccagaacacagggcagtcaaagcagtgcactgttgggataagatgagagaagctgggtcggcagctccctgaatgtatgacttaatcgaatgatggataatgtgaaacctgcaacctgagtgggctggatgtccctggggcaatccttcataaatagagtttctcttaaccaagtttcggttaaatgtcagcaagtggaacttatgtttcttgtcaagtacccgaagcgcaggtgttagcttggtcagtgaggggctgagccatgttcttgaacatggtggatcccaaagtccagcccatgagggtttccattgctttgtggtaacataaggacccaagagtatgataatgagcattttaaaatgctgattttttttcaattaaagaaccgtactttattttgagataatttcttacttatattgtgagtactaaaatgaccattgttttttgaaatgattgtaataatagatggaaaggttattttgttttggttttgctactcagtagaatcatgtttttgtaagattttgttcacaaagtccaaaaaaatctgagaagtgatgcttttacactcatctgggagggggtagggtcagcatcccctggcagaaggtgtagaagcctatttaggatgagcagctgcctccttacagaggaagaatcagggctgactgtgggcagggctggttaataatagtaagtgggttggtgcattatttgagtttcttggcctttctttagtatattctgtttttgtggctatgcaggcattgagaaaggatgtggttttggggaaactcaaggtctcctttggaaaacctagttttagccattatttatcagtagatgaaaatcactcggaggggtcccctgtttttttttccctattatgccgacttcattatgaagcagaattggggtgaaggggaggaagaacccaaagaaagtcaagtaggaaagatggtgagtgtggaggctgaaaatactcctttgtttaattttcatctcaagccatgttagatgaatatatgatacatgtataaaacatatgaatgtaattaacagaggagaacaaagaataaaggtggtaatctatgtcttttccctatagctactgcatataaaaagcaacaaatatcttactgtcaacaagagattacctgctttactggagaagaatgccatgcgtgtgtccttggatgctgcaggaaatgaagggtcttggttttatattcatccgttctggaaactgagaagcgagggtgacaatgtatgtaatatacaattaagagggaaatagtgggttcataaagaaaatgattcctaataagtaagataatccagaaagtacaaaaaagaaaatatagtttttactcaatacctgatttttatgttagtatctactaggttaaacatgtttatttatagtacaaattgtgctcagaagtcataagacaaagttcagattaatttaaaatcttccagctagaatttgtatgaaagaacttaagcaaccttaatattggctgagacttttaaaagagaaggagaatttacttttttgcctaattaggaggaagcttggtcataaggaaaaagagctgtgtttaggaaatagtgtgtgccctttgaattaatggagtgacaccgtgattcatgacaggattccatttactggctgtatgccagctgctgacagtctataagtcttaatagagatggagtagaggagctgaaggttggcatctgctcattgatgacaactatgtttacaatatgttgtggactagttggggcactgaggcaggagaatcacttgagcccacgggttcaagaccagcctgggcaacatagcaagaccttgtttctaaaaaaaaaatttttttaatgttgtggaatatgtgtgtattgcacataaattttagtagttgctgaaatattttctgctactttataaaatagagaataaattatgagaaatagtcaataggatctagagtgtgatatttttgcatgtaataaataaaatactgcgtgatagtccttagcacatggacgatgctcaggaaatgctgctagacactgagcgctgaataagtttcataaatacctgcaagtattgcatcaggggatcaatagttaagatttaaaaaaattaacatgaattcgaagcaatataaaagtataattattctgagagagttttttcagttgaaactttgattacattttaaatgtgttttggatatttcttgtcttaggaatgtctttatcgtgaatctaatttttccagtgaattttgaaatacaaattcaattccacaggatgcaagcttctggatttaatttggttaataaattatctggtgatatcttcctttggtaaggtttggtagaagcatggcatgcaggaatgtgatgcactttaagtcttgtgttggttggatttcttaaaaaaaaaaccctacttttttttcttttgacatcaggtgatgtgtgctgtgagcatgatacacattttagtttcattaaatagttcattacaatcaactctcaattgttcagggactgattatgtagtttatgaacaacctgtgcctttgaggctctttcttgcaatgcttgttcccatccccagccctccactgaatagtatccctgtctacaggaggtccatgaaaattaaatatgaaaacaaacaaaacctgagctcaagctcggaaggaatgtgatgaaataattgaatgaattggagtttttaaattagccgtggattatattaattcatcctatctgcttatttattcattttatctattcttttccttgctgcctttacacagtcaacagagagttgaatgtaatgaactatttcaaataattagttgtactggaaaaccaaaacaaaacaaaacctaccacccaaacactcaatcttggtgaaaatggacaatgtaattgttaagtgcaatacaggagttcttatctggatgtgcttcagaaagcatggctgaaacaactttccacactgctttttgctgaaacagctcaccgtttttgtttgccactgtgtagcttttgtgtgtaattaaggttgctgaaagcataagcacacccacaaccctatattggtcacataaataattgtattgtaatactcgtttttttccctaaaataggtagcgtatttctaaaatataaaccgactgtgtggaaggcaattggaaatacggtcacttcataaccagtggttcaactactactgattttctttaaaaacacattaaattagaaaaaggaaattgcaatgtttagaggacttttaaaatgatattttactatttaacaatagatgaggttttaagatgatattttaagatgaggttttaacatccaacaagatgttctgttacccaaatgaaatgcaataaataggctgacgatagtctgggagaaaggaaaccctatcttcaaaaggtaatagttcctattacttaagggcaactttatgatatagcttatggaattgtgggatggatggttttggggaagaaatagactcatggatccctgtactttcagctgtatacaaagcccttggttgcagttgaactgcaaagtcactagggacagctatgagcagagaacataaatatttcatttttctttccttatttttttatctttatgtatcttcccatggttgaatagttaatttttcattttcaattttgatctaagaaaacttgggttctttacttttatggtagattttaaaagggaataaaggtcagatattctttaaatgaagagaaaattttaactcttgaaaaaagaaactcttcaaacagcaagtagactttgcgttttagaaaaagtgtgtgcccaccagggactgttgtggggtggggagagcggggagggatagcattaggagatatacctaatgctaaatgacgagttaatgggtgcagcacaccaacatgacacatgtatacatatgtaacaaacctgcacgttgtgcacatgtaccctaaaacttaaagtgtaataaaaaaaagtgttgaatttctagctgcggtggaactagaaccctggcgtttagattcctattgtgatgttcttttcaccataccaggtgccacttcaaaagaagggtagctgctagtgatgttatatccctctttattttcagcgaaatctcagcttgaatcttacatggctcttacatagaatcaacagaagtgcttttggaattgcaatttataaaaaacatgtttgtgtactagagtgaatgtgatggcttatcctaggatgtggcagaaaatgacttcaccctcaagttctatattaaatacatagcttctcagaaagcacctgaccccatctgtgaatcacgtcctgagcttcactattttgaaaatattaccatatttcatatttgctaagttatctaattaggtatgaattctgtgagaatagggactatttcttagacctttttgttttctccctggaacttcttaatattctttttatttcacatgattggtagtttatccatttcacttgcaagttttattcagcttggttaggcaaggtaatcattgtcaagaataagaatgaggatctgaaaattactgaattaatgttagattctacttatgaataccattttttaatgaaccactggaagctgtttcacagataccaaggaacattttggctatatgattggtctcttaatatatacaatgttaggctgggcacagtggttcacgcctatgtaatcctttgggaggctgaggcaggtgaatcacctgaggttaggagttcgaaaccagcctgaccaacgtagtgaaaccccgtatctactaaaaatacaaaaattagctgggtgtgatggtgcacacacgtgtgatcccagctacttgggaggctgaggcaagagaatcgcttgaacctgggaagcagaggttgcagtgagttgagattgtgccactgtactccagcctgggtgacagagcgagaccccatctcaaaaaacagaaaaaactatatatatatacacacacacatatatatatactatatatatgcacatatttgtatatattatatatttaagtctatatatatatttaaaaccttatatatatatacagttttatgggtggtattttgaagtaaatatacggattgacccaaagcttacagacaactatagtaaaatagcaagacttagagcagcgaatgtaggtgcaaccaaaagtattcttgaattggaaggacatagttaaaatatgtcattatatttagtaacttattggctaggatttatatggcacagatgagaatcaaatagtaaaccaaatccagttgttctttaagaaattggaagttgagaacacatggacacagagaggggaacaacacacaccagagcctgtcagggggtggggggtgaggggagggaacttagaggacgggtcaataggtgcagtaagccatcagggcacatgtatacctatgtaacaaacctgcacgttctgcacatgtattctgttttgtttttttgtttttgtttttgttttttagaagaaataaagaaaaaaatgtaattggaagaacagatgcagcactggcaaaatgtggcatcaagctcccagtactttagagtatggatgatgactcaggcctctacatggctctgtgacttggagctgccttgctgtcatgtgcaacagcacgtgttttcctagggagaatggggattgggaatatgcttatgtcatgttgactttcatttgtttttgctcataatttaatttttaaaagggataccaattcatggttcaaagatagaaaacaatgtaaagatatattgtgaaaaatctctcttctactctttttattccatctgtccgatttctactcttcttcttcctcaggtatgcactggagagatttatttatgcagatcctcctattccctccctcacatttgtacacgaatgatagcatactacatgccttgctctgcctattcatcttttcacttaatactgctccttaatgatctttccttaactgtatatagagagcttctatgatgaatctttgtgagttacagcatctgacttcttatggacgtgatgagtagagaccagtcctgtaaacagcaggagttgtttccacaaaccaaagcacaacctttctttgtttggttggtgagcttgaggcttctctattatatttcaatcgccagatatagtttgtgacaacagtaccatatgtgagcatggactcctccgtatcatccatatgaggatatctgatattgaaaatatgaaattatgttttttaaagtttgggcttagattaagatacactacatggagaagttctgtttattcatatcgactgaatcctgatttgttttatcatttatctatcaaactaatttattctaatatttacttggtataaaatatacaaagggagggttttggttttcatttttgagacagtgatcaattctttaagtgagattttatttactataataatatgtcttctaaataaattcagcaatgtaagtaactttaataatggaaattaaactgttcattgttatcatgaagaaaggataactttgattccccacaatttgagttatgaataaaaatacttaaagagaaggtggatattgctacaataacatacattaaaaaatcaattagagttacttctgtagagcacttttccaagaatcaattttagtttttatttaaaaatgaacatcaggtttaaggagcaatattagtttaatatatttaagatatgagtgaatcggatgcccaaggctcaaacacaaaacatatttctacaaggtcatacctaattctgcatttcctgaatcgagctgacattagaatttttaatacacttctgagactatgggaagatcaaatttactcatctcttataaaagataatacaagtgtataacattttctgcttgcttttgcagtggttctaatatttggatagattacttttttgtggtgacagatgcatttactctttctgttgtgcttatggcataagacctcgtggggagggataatggcctatttattgactttaaggaagctctaactgaaatgggagatgaatatgaaaaagatccacactagctttatgaatccagactgataggcactatgggacatggttatatgatcatttattagaagatattttacctcaaagagaaaaaggattgtatgaaaatttgtgtgaaggataaaaggaccagatgtcagatcaataatggggactcctgtgcagttatttctagcttcgaatatagcaccaaagatccatgcagtgtctcaattgtgatttatttctgcttcctagattgttgtaggagataaagttgttttgatgcctgtgaatgcagggcagccactacatgccagcaacatagagcttcttgataacccagggtgtaaagaggtaagttcaagtggaaaaggaatgaatgtgttcatttttctcatgagacagagggagaaaaaagtaatatagtttctttcattgttttcatgagcataatcccagttattctaattaatatccctaaggtacatatagctgtgattagttattgctatttttggatggtctctcaaagatacttgtattgagctatatacttcattatccaaaattgtctttaatttccttttactagttgaactaataatttctggtagagaatggaatctgtagtcttataactttgaacgtttcttcattaataggtgaatgctgtcaattgcaacaccagctggaaaatcactttattcatgaaatatagttcctatcgagaggatgtattaaaaggagtaagtatgtgctacacaggacatttgctgggagaaatgatggtagtcttactgaaattctagatgcaaaacctatgtattcactggtgttcataatttagaatgtgactacacatgttaatacttactctaagtgttttactgaatttcccccccacatttttaaatgtttaaataagcattaaataaatttaaataagctttaaaagtcaaatagctagtagaagggcccagagtagcaaaaccagaaagagacacctgcttctcacatctgtttgttcagatgtctcttgacctttttgctagggggacgttgttagattatttcatgcggaacaagagaagtttttgacttgtgatgaatatgagaaaaaacagcacattttccttcgtacgaccttgcgccaatcagctacttctgctactagttctaaagcactctgggaaatagaggtatgtaaatgttttttggcacttaataaatatttagatcaaaaagagaagattcactgggcttgttgttttattgttataggcatcatttatgatagaatcataaaatagaataatttttgtgaaccaacttgtgcctattcattgctgtgaccaatttgaaaggaaactgtttcctaagcctgtcttctctgtggtagctctcattttctctctctccttctctgtcaagtgcacacacacacacacatttacaaaaggtacattacgatcttacttttaacaaatcaattgtgaaatgtcaagactagttagactgaagaccatgtgactcaaatggcactggagtcaagatggagtaggatgcctcactttgaggaaggttgaggccagaactactcagtccctgaggagaacaatgtttatttcttctgtagatgccatttctattggaatcaggagacccatagttaagaattcattcatctttttaaaagtatcacttaaatgtggaacatggtagagtaattaaggaaatgtaatctatggatttttccttaaaggatctttttatatgtggaggagataagatctacagaattgcctatgaacaagagatttactaaacatctaaaccactagcggtgattctcaaccatttcaaattcttcacctgcccccaattttaaaacatatattttgtgacactccctttaatattctaaaatgaaatttataggtaatattatttatatactaataggtagaattagtataatgctcaaattctaacataaagaataaataaaaggaaaatactttataataaaataatatgtatttcaacatgagaatgactatctaaaagatacaatatttatgcccatcttggatggatatgtttggatttgagagaagtggttaaagaagtggatcagaagacagcccatacaagtacaggaaaatgaaaaagcaaaggtaaatgtgggcccttgaatgataaccagtgttaggagacgtaataacggaacaaactgaaaaacggagagataaccataatcaaagtagggataatactttaggcaaattaccgacgagatgcagaaaatgaggaagtaagatgcctctgcaaatgagctgagccttatttataaatatgacactaaaaaagaactaagtttatgacatggtttagaatcgagatgaaatagtacaaaagaacttatcttctatcttgaaactccacaacatattgaggaataatttcagtcgctagcatgcagatggactttggagaccacaaccatcaacaggtgatggaactgagaagctctggggaaaacagctatgactaaagctaataatacacgaggctgcatgaaacacctcccagaagtctacctcattcataagagcaaaactgaaaaataacaggcaatcctaaaataaatacataattaaagcatgcattttcacaccataaagttcttaatattttgctgtttttaaaaattaaaaaaatatagaggtagcaataagatgagatattatttaaaactctgttaatgaaatacagtgagttacctgcatttgatgtgtctctgcttatttaatattggttctgagtctgttaaaaggagttttgaaaattctctcatatttttgcttttagttttatagcttttgctgtaactgtactactgcagtgaaccctttccatcaaaatgcatagttggaaatgctgtgacacattgaccagaatagggagcgaataaattgtttaataattttgagatgtctttacttcatttaaacgtccctcaccgtaatgaatttcatataacttgatgtaaaatgtttttatctgctgatgtactaaagtattgccagtttatatcggtggtaggcttatttctatttgagatttgagggacttttctctattgtgtgctgtcacagttgggctttgtgaggaagcctgaggactgtgcttacccagcatgggcatcaggtgtttcaaggaagagggaaattacgttcaacatgattggaagggctggggaggaaatgtggagtgggggacatgggcttatctgaatgcagataagcaatgcaatgactgctcctcctctgagcctgcaggcctctgctcacatgctgaggggtccttacccacgcaccttgtaggagcgggcactagtcagctgctcccactgttactgcagcccaaagaggagtctctcttctactgtcctctgctttccattctaacgggaatgtcctcagagccccgctgggtgaggctttcagcccctgtgatgcaggggagcacttagcagggtggggctggtcctgagggccacacacagtgttgatcacattctggaattccctgtaaattgcagcatagataatatcttggtcactgcatattaaatgccaatagcatccctccaaaatcattgtgataaacaaaaacaccctcccttccaaatctctagaatatcccctctagggagccgtactgcccttgccagacccactgatgtataggagagtagttcttagtctgggatcttcagatcatttgttaaccttagcatttatatacaaaccacaaaattgtgtgtgtgtgtgtgtgtgtgtgtgtgtgtgtgtgtgtatttgagacaaacattagattttatcacattctcgcagatatctctgcctccctcaaaggtttaagagttcaaacactgacaagatcacagtggccagtgtgattagcaaaggatttgtggaagaaatgtgatgtgagaatttgaaggataggtgggcttttggccacagagggagtgttttgtaagacctcaaggactttgaagtattttcataattattatcttatctgagttatgagagtatgggaagacagttgctggagtctagcaaaaggcattagcaagtgaagtatgttaacacacagaattcgtggttgcagcaggagccaaagggtggtcagtactagcaaaaagaacgtaatgtgctgagggagagtcatgaaagttatcctagcattgtgatatgccttatgatatttcatcttcacaacaatcctgtgaatcaacccattttgtacacgaagaaataaggctcaaagatgttaaattcctttctgtggtcataccccagtaattggtggacctgagactcacatgcctgaattggagtgtaaaacccgagcttttctgctgcccatcccgcctgtcataaccaggtgtgtcagagcttctactgcattcattcccagtgagcctaggggctcagcatctgggcaaggtcaattcagagacaggtatcaaaagacatgctgtcaataaaaagcatgcatggaaagggctaagaattaagtagtttagaccttaggccttgacgtttgtgattctctcttccaatctacgtggctgtctttctcatcctccaggtttcagctcacatgacatctcaaagtggcccatactcatgatggtcatatctaaagttgccttccctagttactcaatcatgtacttcccctgtgttgtttctggcacttgtcaaatcttacttatttctttgttcgctggctctctcttttccattagaatggaagctctagctttatccactgctgtgtttctcttctcttgaaggtacttggcacatagtgggctcttaatgcaagctgccaagtaaatgtttgaaaaacaaagggaagaaaatctcagtatttccactttggtcttggaaacatgtctttctgagtaaagctgtgtttgcagatgtaaggcacaagtgtcatgcatgcacgagttaacaactgttataacatttctcttgctcatttatggggaattttgtttttctgccacattatgctctcatggaaacatatattaggtttgacagatcagtattaacaggagggcaggcatgtaaactgttggtgtttgcttgccaggaacataaatattgttttgccattactatcgttgctctctttgtaggtggttcatcatgacccatgccgtgggggtgcaggacagtggaacagcttgttcagatttaagcatcttgcaactggaaactatttagctgcagaggtaagactaatggataaagtggtattaagtttctgactctgaattagtgaaagaggcagttgggttcgccacaagacatcgtatttgcaggaacagtcattacacaaatttgattgttgcctctagtattctggattggcatataaattatttttaaaatgtaaatgttagtcaaagtattacaaattaagacaacaacgataataacaacaaaaactctgcagttgttttactggaaggccaactggaatggggcatctgatttgcatatgtatgtgatgtggcctaaaattttctatttagcttcaccctttcagaatgtccgcatcatagatatgatcagttcattgcccgtgtcatatagcctagctagctttgggttcatctgcagtggcctctttcactgtgggtggcttttattattcaaatcattgggaaggaaaatgttttcttcgtaaaactgtcaataaaatggtaaaaacgtacaaaagctttttctttatccactaaaagtatgttgacagacagatatgaaggatgtcagaagatatgaaggataggtagaaataacatcatggaagttttacaaatgttttaattaaagtttggttatctaattgaaaaataattttgaagctagtcttttccagatgtatgaaaatttccattcatggaactgtgctgggcacttagcatttgatgactattttgtgaatggatagaggatggggagaaggagatttcaggctttgtatatgagacgcatttggagacatattgggcaaattaatcacactacactccaatttcttcttctggaaaatggggataatcaaatatatttctaattctcttaacttattagaattaaattaggcaaagtgcttgcagaagttgtggtttatggtaagcacagggtaagtgatgctggcatgactaatttttgtttttgagacagattcttgccctgttgcccaggctggagtgccgtgatgcactcaacctatgcctcccaggttcaagcaatcctcttgcttcagcctcctgagtagctgggactacaggttcacaccaccatgcctggctatgttttatattttcagtagagaaggggttttgccatgttggccaggctggtctcagactcctggactcaagcgcctgcctcggcctcccaaagccctgggattataggcatgagccactgtgccctgcctaattttatgtgataaacagggattatttttacttttttaagtatctaacacattatttagtgctcaactagatgaaatacagctttgcaatttacagtctgtttatagcgtaaatgttttaaagtaacccttttgaaaagcaactcattgaagcaaaaatcattagtaaggtagagaatcttgtctaaaataaaaattacaaaagcctaactagatatcctataaaagataagaaattaggattaaaattctcttatgttagtggctcttttcccctgttcacttttcaagcaaatctactgatgtgctgtagaaaactgacatgatgtacatgtatattactagttttctttgttaatttctataattaaaacatgtaccatttgatgcattcaaatgattagatttttaagaattaaattgttcattaaccttagtgaggatccaagacttcaatatatacacgaattaattaaaaatggagaagtagaaagcaaatcattccttgaaaagatttgaaagactctctttcatcctgtctctagagaatgcagctttaaatgccaggtgccgtctcatccattaaagagtctggtgtatttagaggaccttttctttgacctttaatactttagataacatcttttttatggtctagtgggaggaggaaaattaagtattaagcacatatctgaaaactgaaagttacgaatttattttctactgattttaactagtgtaacagaatgggtgctctgtgtagtgttctaatatcaaaatagcaatcatagcctcaaaatcctggcatccatacattggtgttttgtattttctatgtcagttgggacaaaatcctggtgtgctcatgtctcaggatgcttgtccttactggtgtgaaagtgtctagaggtgtggccaaatcacaatgatttctagtccaggaacagctggtaactagcctctgacagcagttgagaagcaatgattacacgtttatcattttgctttctaaaaatgcccaggtctttatttctttcttaaactttttaatttttatggacacatagtatacgtatacacttatggggcacgtgtgatgtcttgatgcaggcatacaatgtgtaataatcacatagggtatttgggatattggtcacctcaggcatttatcatttctttgtattaggaacattccaattctactcttttagttattttaaaatatacaataaattgttgttaactgtgtattaccctgttgggctatcaaattctagatcttactccttctatcgaactatatttttgtacccattaatcacctccaccttttctctccctccctgtcacccttcctagcctctggtaactatccttctactccctagcttcataagttcaattgttttaatttttagctcccacatatgagtgagaacatgtgaaatttgtcattctgtgcctggcttatttcacttaacataatgtcctccagttttatccatattgttgcaaatgacaggatctcgttcttttttatggctgaataatattccactgtgaacaggtactacattttctttatccattcatctgttgatgtatacttaggttgattccaaatcttggctattgtgtgtagtgctgtaataaacatgggaatgcaggtacctcttccatatactgatttccttccttttgggtgtatacctagcagtaggattgccggatcatatggtagctctatttttagttttttgaggaaccgccatactgttctctatagtggctgcactaatttacattcctaccaaccatgtgagggttcccctttctccacatcttcatcagcatttgttattgcctttcttttggataatagtcattttaaacggggtgagatgatatcttattgtagttttggttggcatttctctgatgattaatgatgttaagcatttttttatatatttgtttgccatttgtatgtcttcttttgagaaatttgtattcagatcttttactcatttttaaatcagattattaatttttttttttgtctgttgagttgttttagctccttatatattctggttattaatctcttgtcaaaaaatgcccaggttggccaggcgcggtggctcacatctgtattcccggcactttaggaggctgaggcgggtggatcacctgaggtcaggagttcaagactagcctggccaacatggtgccctgtctctacaaaaatacaataattagccaggcatgatggcgggtgcctgtaatcccagctacttgggaggcagaggtgggagagaattgcttgaacctgggaggtggaggttgcagtgagccaagatcgtgccattgcacttcagcgtgggcaaaagaacaagactctgtctcaaaaaataaaataaaataaaatagcccaggttttttatttcaaagcattagtcatgtcgttcaagtaggacgggggttctctatattttgagtgacaacctcctagaattatttgttttattaccctgtacccttattcttaggcgatagaggctccatggcacagatttattttacttgttcagttttctctttaatatctagatattatttttaaaaagacacatattgggatgtggggaatgcaagaattgggaatgattatttttggaattcataaaattgcaaacatagtctttaagatttcatgcaaccttcaatatatgtttcttcagtgcctggtaaatgcacagcatggtagaatgctgcaggtacggcaaaggaagctgaggactcagtctttgccttcaaagaatggagcttctagttcggaagacagcgcggcacaatcagggagggctaattatatgtgcaggtagaattgggtcatattccagtgagagaatctggtgtgaggttagttgaagattcttgcttggggcaaactggttctcaaagaaaataatagacatggactgttagagaaataaaagggcggtcctgtgtaagttgctaagaaggcgcatcagagatacagaatgtccaaatcatacatagacaatattaaaactgaggcccagcccaaggaaggtgttgtgaaaggaatgactgacaggtctccttgctttaagattttgaatgaagggtttgacttttatccagtttgtaataggaatgaagtttgaggaagtttaacttggtagctacctcgaggctgggactgatcagctattagcaggcctttggtagagatcagtgatgtcattaaaaaaatcccagtacagtgtgatacatttatgatagcaatatgaatagtggcccacacttttctcagggggtctcaaggatgtgcaagaaatggtcagggggtcagagaggttgctgcttaatgaatgagtaaggcacatggggaagagggagaaagggcgttcagacagtgagggcagcttgtacacaaggaaggaggtgtgtggcaccatacaaactcgtttcatatgtaggacttgtgagttaggaagtaatgttagaaggtgagagggaagcgatggggccagaagtgtagtgcagctgatcagttcaggccatatatatcaaggagaatgggttttatctttaaagtacagaggagtataataaatagatttgtgattaaagaagaccactccagagttgtactgtgtaatatagtagtttctagccacatgttggctattaaattaaaattaatattatcaaaataaaattaaaaagtcagtttctcattcacaacagccacatttcaagttgctcaacagccacgccacacgaaataatgcacatttccaaagagacagttgtggtgggcagcactgctctggagccttggtgaagtgactagaagaaattgaatctagaggcagtgaggccagataagagtctgaatgatctgctttctacattttctttctttgccatctggtggaagttttgcctatctacaaacaaataaggtagttgtctttaaaagggctatattacaatctttaacaaagaaaattattttgcattacttgacctatattgctttggaaaggtcatcaacagtttttgctttagtaattttgagcacttgaaccaagggagaggcttcagtaatggtgaggaagggaagggttgaaggcattcttgggagacagaactgatgcagtggtaagccgtcaggtgttaagggttaaggaataggattctggctttggagaactagcgatgtcattcaccaaattagggaaaatgagaagaggtgccaaattgatgagggaaataatccattcaaatttgattatgcttataaaatgtctggatgaaattgtccactagggaagatttcaaaacgtctggaagtttggggattgaccagtgttagatttgggttttcagagcgcaggtaagatcattagggagtagaaagagagtgggagggtgtttgaaggtagaatcatgaggaaattatctttaaaggatgagggagagactgggagcctgagaagccagaagcacctggaaaatcaaatgggctgaattacaaataccaagcaaggaaggagagaacttcgcaaaggaggaagtgctactaaacaggccagaaacaaatctgcttacatcagctggcaagaatgcaatcatttgttactttatggggaaaatttttagtggaaaccagaatgcaggagtggaggaatgaccaggaagccaggaagcagaagtgggtgcagactgagttttcatagcactgctgtgaaaaggggaagcagagttgcaggccagggaaaattaagagccctattagatgatttttataaaatgtatttttaaaaatgaggtggttgaggatgctgctgtttttgcattaaagggaagtacctagcagtgcggctagatattgcagagtattaaccttttttcccatgacctttccaactttaacagacatatttataatttaaaatattactttcatgtgctgtaggcattcctggtaaattggattatgtaattcttgaattgcctttgagtttatggtgtttatattggccagtgtgacagagcctagcatagtgggaaaaaaatcccatgcatactgtttacaatctgtctgactttaagcaaatatttaacccctctggacctgagttcctttgtgtgtaaaaaaagttaagaatgtatattatatagtattattctggaattaaagaagataggggatgtacagcaccttgtacatgagaggtatgcaataaatattaagtctgtttgctttcttggggaggaaacagagagaaaatgcagagtagtgttttattattatcattattaataactagcatgtcttagataagttaaggagggtaagtatataggggcaaagtttagttatttaatatgtttatctggaaaagattactacaatgctttgacataggaaacactgcctcatggagccactgaaaatccttccaataatatctcatgatctgttgtgcagttcctatgtcaggtataacacacagccagccagtcacttccgtgatttataaatagacattttgggtgacattactcttaatcaactgggcaaagtatgctgagtgcttatctaggagaacagctgaaaagactatccatgacctggattattagaatattttaacatatattgcttttatttctctgaattctttagataaatttttctaaagcagaaatgaagtttcttttgaataacttgaaatagtttttttatggtctatacatttgagtttaactcacgctattgtgtagcaacttaaattgtggtcttttaaataatatagcgcagttagagttcattgagcattttagaattttaaaagcctttgattctggataatgccacagttactctccataaacctgttgagatatttcagaaatcccccacttagggaggaaatgtttatagcatttctttgggcttatcacagttcacagttagctatgcatttgtttgttacctgttgtatgtattgtgtatatctattcaatggctattttgttccctgcaatgaaaggcctgtatctgttttgctcattgctggatgccttgtgcctagaagagtgcctgacacttaatttgccttcagtaactgttggatgattgaatgaatgaatcacagggactatgactgttgttataaatccaataattttagtttacagaaaaagaaatccaggctcacagaggtgatttattttgttaaaatcaaaaaaccgatataatgaaagtattaggaatgaatgctttcaactgagggtaacgatggcaatgtctagagacatttttattttcacagttggggaatgggagctgctatttattgtcacagttagggaatgggatgtagctaaacatcctactatacacaggacagcccctcccaacaaagaattatcgggttcaagataccagtaatgctaagggttgagaaactctgatctgtattatactgaaagtatacatttattgaatgcctactaggtagaagtactactttgacattgtgaagaaaacagagatgattaacacatggtccttgtcctctaagagtttgcaatttagattaactcaatctctgggacattgagatctcttttgccattgtttccactatacatgcacatctgagagaaatggttctatgtaatgtctaattgttaacatctgtaggtgaccatgctaagtctcacagtaagtttaaaggactgcaaccttaaatctaagcacaaattagataagaagatctaaaatttacttatagatacagtgcccaagtatgatactctattttaaccagcacttaactggattgtttaggtattcagaaaaatgtaataagcctaattatttatgtggaagtgaagggggcactatccaaaggaaatcagaccatttgatatgctggaaattccgtagttgaatcacatagagaaaacacatatgttgcaagctatttaagaatagcatcttttttttggtgaattgcggaaaacacctaggaactaggataatgatacaagatttaacacggtttaagttttatcctgcaagatagtaaagctaaccaagggttagaaatggtcccttattcaatgtaaagatatccaacaggatagtttagggattcggattaattttaaagaaataactcagtgctagactgtaatcccagcactttgggaggccaaggtgggcagatcacttgaggtcaggagttcaagactagcctggccaatatggtgaaacccccctctctactaaaaatacaaaaataaaccgggcatggtggcacacgcctgtagccccagctactcaggaggctgaggcaggagaatcacttgaacccaggaggtggaggttgcagtgagccgagatcgcaccactgcactacagcctgggcgacagagtgagagtctgtctcaaaataaaaggagaaaaaaaaaaaagaaaaaaaaaacaccaaccccccacccccgcccccaaaaaccaaaccaaaccaaaaacctcaatgctagaaacctatggataaaatgtggaacaaagtaattatgaacaagataaagatttttgatctcatgaagtaatacagagcatattattagaccctttctcttgcaatgttggtttctgtggggcatatatgtagttaggtggcatgaggggaaggtaaatatacactgatatttttgacacagctgtccacacactcatcgacactttgtcatagatattttacttgtattattattgtagtggttcaggtaagttcacaactatgtctgtgagggagaaagtaattttaccatattttgcataggaaaatatggggacctcagtaaatgggtcttccacagttgtgggaagaattataaatcagccttcacagtttatgatctgatgctttctgcattttctttctttggatcttactaaagcaaaaacttttgatgatctttccaaagcaatatagatcaagtactgcataataatgtcatttattcaagattggaataaaagcccttttaaagatcactagcttatttgtttgtagataggcaaaacttccaccagatggcagtaaacacttatttcctgactattcaatagcctgtggatttaattaattagctaaaaacccagtactcaagaaactctataatagcataggattttatgactattggggctgtagttttaaatgtctctatgtttagttctctctcaaatgtatcagccatagtatgtgaaaagggcctggtttgtatgcatgtatatgtatacataaatacagcagactaacatacagaccagaccctatacataagaataaaatgttacatatcaaaatatagaaattgtacctgacacacatatacacccagtaaaggttattttctctcctttcttttctaggcttatcaatcagaataatagatttgtcctgaaatgccagtcgttggaaagagaaacatataaatataatcatttaaaaatacacacatgatgtttatgatttcagtgttatatataataaaaattgatcaaaacacatttcattgtaaaaaaaagtaaagcttctcttttaagaaaataagtaggtattatggacttaaaaacttacggtctgcttcttgctattgtgttagatggaggggtgcagttgttttttaattgattgcggtacaagcatgactttcactgcccaggtatttatgatgtttctctctctctatcattttgcaccatacctgacttctttatattcttctttggccagttaattgaagactgtcttcaaagattagtaatgggtctctgtattctctctctgttactcactgccatggctgcagtggaccctgcctttgatcttggatatgccattgccatacaaaatcaataaatttatctaaaatttaattgtttccttgcaaaatagtgatttttcttagttcatagttaaagacttgagagtcatgataaacggttttctctctcagtttacacattcagattctactgattctgtctctgcaaaatctttcacatccactttgtcctttttattccagcattattatcttcatttgggtccacccacctcttccttggaccactgcccttagttactttccctttttcatcctctgtccccttgcatcatctgaatatggatgcaaactctctagcctgcggtttaaaggcctggatgatctgggctgaccctccttcccagcttgcatcacaccactctgctttatggaggcaggagggaagcagcgtgctacaggaactgaaagacgtggctctggagccctcagacctgtgcttgcccaccctgccactccccagcggtgtgactttgcataaagcacttcagttgatgtactccaagtgccttgtctgtaaactgtgttaagaatcttgtcttatagtataattgtaaggttaaatgaattaacctgtaaaagcatataaaaaagtatttcgtaagtgacactggtgggtcttctttaaagaagtctcatttttctcacccatgtggcagtggcccctccagccttgctgccttcttcactccctggttcctgccctgccagttaaaattctacccatccttcaaggcttatctcaaatgctaccttctccatgaataatttgtgaataaatttgcccaccacagatccctccttcctctgacctatattatttataaattattcattcctgtcttatgtcccttgtcacattttattttgtatttcagctgactgtatttatgtcttattttccctcctaggttgtaatgtcttatggtcagggaccatattctctttgtctttgctaaaataccatatgccgcaatgctttgcccattatagatgctctattaatatttattgaataaatgattgaatggcatattagctctccaatgccagatttataatttatttttttaacataaagacattaagtcctaaaagacctccatatgaccatgtctttttcctccttctttaaaaaataatttttttctattcatttttactctcttactttaagaattactgctattattcaatttagagatgggaaacagcagtataatttaaagcatatatttatttggcctttaatagttaacgttggtaaatttatatggccctggatttatttgggtggctttttgtccttctttcccttctcctcttccttttcttccacatcattattgttattattatactttattgagtttactgaggtaatctctctatgttaattatttaaaaaatcatattgcagcctgagagacacagatgaggcaaaatctaactgattggcaccatctgtagttttgctgccaaagatatgaatatgtaaaatttattgacatagagtcatggtttagtcatagtctttttctcattttgcagatgaggacactgagttccatgggcattaggccacctttcctaaagatgctggtgtttccttatagagcagagactggaatccacttccccagacagccagtcagggacgggtaatcctaagcaggggaaatacgtaaagactgattgtagaaggtaacattgtctttggggtagaatatatgatctaagtttcagagggcataaattattttattttgtgtttgacttaggtacattaattcctgtttttgtgcatgttttagtgggggatatgtcatggtttccagcattgaatttcaagtgtctgtaataaccattctaatgtgtattgagtgaaaacttgggccataaggtacatccttggtcgaacatgttgcatatcatttggatataatttagctaaaattttaggatggattttttttaatttaaaagaaaagttgaaatttttcaagcagaagacaaataaatttttaaaaaagctatggtgaaacttgactaaaatagatgaataaatttcttctggacaccgtgctagaattttctttactaacaagtgaaaatgtgtttctttaatcagaagaaaggaggccagttaactcactctttgctctctacctttcactcttggattctaaaagcaggattaaatcccgttttgaaactaattctgttactcataattcaagggaacttaaggaatctgagggaaagtctgggtctctgtagacagaggccagcctcaagtcccctcagtggctgtcccagcattaacaggtgacctgtatcttcttaccctccttgtgtgtcagttctgaaaactgaaagactgctgtcatgaaactcttggtctgggtaatgctttccatccatactcccttccctcacactcctactcattttctgatttgtttcaccataatgtagttttgtttgttcgtttatttcatttaaatggaatcatgcagtacattgtgttttgtgtgtgccttcatccacttaatgtctttgagattcattcttggttgtcgcttgcatgagaagctcgtcatgttcattgccgagtagtactccattgtttgaatatgccacatttagtttatcattcttctcttacatgacatgcttttaaaatcttagcctaatttctggctctgttttacacccctaccactgttttctctgccttttccccttatcatcttcaaatgaatgtgtcaatcttttgtggttgatttcaatggatagagtaacctctgcatacacaattctttcttcagctgaggaaaattttatcttctattatctttgattattgcttgtgttccacttattctctcttccatttgagagctctggtccctcattagttggttgtctcttctctggttgtctgtgaccattttctttttctaattatcatttctggataccttccttctgtatggagggatagctgctaagctgctcatcctctgcattgctgattttctgtaactgtgctgttggtgctaatgtggactttaattttgtatttatgttttcatgtatattgaaatatgaagaaattccataacttctcttatattgtattatttatattgttattttagtatttatatattattattattataattattttgagacagagtctcacttcgtcatccaggctggagtgcagtcactgcaacctctgcctcctgggttcaagcaagtctcatgctcagcttcccaagtagctggaattacaagtgcgtgccaccatgcccagctaatttttgaatttttagtagagacggggtcttaccatgttggccaggatgatctcgaactcctgatcttaggtgatccacccaccttggcctcccaaagtgctgggattaaatgcatgagccaccacacccggccacatattgtttctatactatcattttagctctttatgttatttcgttgcctttatgtagaggtcatgtttacttgtactttcctgagaatgccaaaccatttcctgaaaattcattttgcatcatatcataggaaatgttgagaaagactctgagaaggaatctcccttgttctaactcagtgttccatcagtcctattttcttttttccttcctttgttctttccttgttatcctcagatgagtgagctctgtgcagaaccagagggttgagtggattgtccttttgttcaatttttaaattctctagtatgaaaattcagtcctctttctaaatgttcagctgcagggctggctgatgggtgcatttgcagcgcagttcccagatttgagcagacatcgactctatggattctatggactctacacacctgggtttaactaaggcagttgcttctgtgtcctacccctttgctatttctgcatcatcatgcaatgtcattccagcatacggcattccttttctctcttcacaccatgcttctcagaaaggccttggccatcatcttttccctccactttctgcccacttgttttctgagcatctgtttggtcatgtaaagtcagagacaggtagcagactagggaagcagttttctgcgtaatttcatggcagcttgccagtgatagagaaactcttctctataggtttttggtcggtaaattctctgggtttctacgtcagcgttcaaactgactcactatcttcttatctttgtttacgtggccactagcttaaagagacgttgaagtttgccacatgataaaaactgggtcattacctgcctgtccccaagaactatctactttataattagcatcagttcattgaagatttggaatttaggttgttttttcagccttagttcttaatgagattgggattttttttgctttcattttgctttgcttttgtttttttcagaaccctcattggtatttagtgatgagttggaaggggcaattctcagagctgctagataagtggtattatgagaaagactcctaaccttacattttaaatgataactttactgggattgtgcattgtatacaccagttgattcacattaaaatgattaaattcaattggacaacttgatgtttcaagaaacacaccttatacatctattgctttacgagtgatcaactatttcagaacaactaagaatcgctttgagactgtaaggacaagtgggagtgaggagtcatggatttcaaccagccagatgatgcaagggtctgtactcagcacatccagaactcatctttgtcatcagattggccccaaaatgccactctccaagcccgaagacatgtgtttgtttgtttcagtagtcctcatgtatttgctcacatatcttatatgtagctccttttttgctctgttttgtttttcttttccttgtgtacataacatgtaaaacatgatctcaaatcatcaatgtcccactggttttttttgtttaatttgtgtctgagttattggtaaatggcagtttttgcagagggtaaaatggtgaactctattgaatatttttccagaggaggtgatattgtcaattcttacttcttcaaagatgtcaacagttctgatataaaccaaggcaatgaacttggcatgtcagcttttgtctcctgcaactagggtttgatggtagtattttaaattgtcatatttactaatagtttctttcttagcatctttttatattaaacttagttgaggatagaatattaattgaattgaagatcaatggtcttgttagtgtgcttttcatagcaatgaaaaactaaattttcctttgtttttctagcttaatcctgattatcgagatgcccaaaatgaaggaaaaaatgtggtgagtagaactggcttttctccaacaaatctcagcatattgttattattttatatggatagattggaattttaatagcaaatttgaagactaggggctcagagagattttctgagtagagcctatgggtcacaggtaaaagatgatatggcttagattatgagaagatgttcaattatgggtgcttgggaagagttctgcaacttggaggccattgttggtggagtgctaaaggcagctggcatctgagagatatggtgggtctaggtttagttttatttacccttttttcttctgtaaagaagaaagcttcatggtgacaacatggcttctttattcaatcaaaaattcagaaattcaggacaatttgatgtgatgcagacaaaatctctggatgttgggctagatttttaaaaagttttaaagagcaatttaactagatattttggcgtaatctagatacggtctgtaattcaattttcttaggagtttagcaattccttttgaaattggtaggtattattactccatcattcaaaattttaccctttgacagaaagaattggaatgtttaattaacatggccagtatctttgcattgatacatagctttaggatttgtgaggatattgacatgggggaggtgaaaccaatcagaatttatgtacctcattcaaccctgtttgacccccttctctgtctgactgccaggcttacgatagaaataaagctgtgaagtatcaggtaattggcccaatgaaacctttaacatatcaaaatgtctctaaacgtagaggtaggtttattcgattaattggatctcctatttataattcaattttagcgcactgggtgggctcttctcttgttggttttcacatggctgccccaggattgttgggttcttacttttgtatgatttaggaaaatgctgtcagtaaccaggtttaaaaagcaaagtgtgaatcatggcttctttggttcttactataagcttgtcaatggcctccacccaaagaccatcaggaacacatgggtagttgaacaagttgggtttattacttatgcagtgagaaaggaacatgccatgaggagctgtggggcatctcagagcatgttagaaagaacttactagaggatttgtgtttgtgtaaggtgatttggggaggatttaaggaagtgaggctttgctgtggagagaatgttgtcaggaagaggaattctataattggtatcttaataaattttacctatagggaggacaggcttctaaggaagcaacagtcactcatattagttgggggagagggatatttagtcatttttgtggcttggacaatattcatattttgtctgtgtttagacatgattagggaatggtcttgttttgtcttgatccatcacagtcacagagtggccttgtctgatgacattctgtgaaattgttcaacagagaacagtatggccttgctaagaggaccagaccacctattggatgtcaggggctgctgcttttctctttcacaaggtttatttttgtaatattctgtgtgacttcttcagcatcgtgtagggccaagagagtcttgttctagcaccaccattaacttgtgtggccttggacaagtgagatagctttcttgagactcagtttccccacctgtgtaatgggatgaagatgttcgtcttatgtacttcacctgcatgccatgaggataaaataagatcagacagatggaaactctttgaatttgtaagttgtttctagtaaaagagcatcatatcaaaatttcaaattgtacaaattaattaaatctctgtgcgcatctcctttctactacataatattcggtgatacagctgatgattttggcctgagcagagtgggagaatacagtcttcctccctatccagtggttttgcatctgtgtattcaaacatccacagatcaaaaacaccaaaatataataatacaaattaaaaaacaatacagtataacaagtatttacctggcacttagattgtattagatattatgactaatctacaggtaatttaaagtatataggaggatatgtataggttatatgcaaatactatgcaattttatatgagaaacttgagcagatttttgtatttgcagggggtcctggaaccaatcctctgcagataccgagggttgactacatagggtatggaggttctatggaacagcacaaactgtataaatgatcatatatccatggtgaagttcactctttctgttaatcaagcttttagttagacttgatagcttttcttctttttattcgaaaaaacaacttcttcattgacctctaaaggtgagaaagagtgctcttctgtttaagccgttgttactggcaatactttaattgcattcaacacagatgggtctgcttttgctgtagatgtttatgactgagtctcatctgtcatctcagggagacatccaactgcagacagttgatttaattttttttcctctccagaatacctagcttgagagcaaagaaaattgagaatgtggagccataaagctaacaatatggcttcctattttatagaacatttgccacagagcaataattatttttctgtctaaagaagaaaacaaaggagctgttagagtttatctccagcctgtgaaatatgcaatcagtttcccaaaacagaatactgtttcacctcagatctgggttccagtaacactgactttattatgaccatgctaattttttctttcctagttttcctgacgttgtctatgtaatgcccagttaatattttttttttgtaatttagaaacatttatcaaaatgttgccttccgtatttgaagtttcaaaggttcatgcatggtgccactgaaatgaggcggtgtgtgtcagagctcccattaagacacaaattgctgtatttattctacaaaggagtctattatttccaatattacaaatgtacagcatccacagggaccctgtaaacattggaaccgtgtcaagcccagctgggaacctgacagtcattagtttcttctccttgaaaagctgcatcttttcagatggctctttgaaggggaattttttggaattaacgctacccatcttaacattaccatatttatgtggaatatgatctgatttttcttgggaatgtctgttttagatattggaatttctggccatattgggccagataattctctgttgtggtgcaatggcttttgcctgtaggatgtttagcagcatccacaccctctactcaccaggtgccaatagcaggtccccgattgtggcaactaacaatgtgcccagaaattgccaatgccccctgggggcaaatatcattccctgttgagaaccaccggtctatgtgcatttatatacatcaacagaaatgttccaggaaccagggaactttgtggaaatataactgaaaatcctgtgtccatagaatttggcgggggggcggtgtaccagcttctgacagaccctcaaattttcctgagtaccagattctgacccccgaatttccttgttttactatatattcatcagtgacaaggtgataaggaaaacacagaaacaaaggttctatcagaaattaattggagagtagcagtttgttaaggaacctcggcaagagaagtatttgcagctgtaaatggcagtgttgtgtgcggttacataaagtcagtagtgagagccctggaggatgtgaacaaaaacacacgtgcatgcacatcgttatgctgctgtggccgctcacaggtctgaaccaactctgcaaatgcagacgtttcttacagaatgtctctggctcccaacaacagaattgcaacgtgatgtctgtgctaaaaatttgatgactcacaaatgagtcagcagagaaggtgttctaggggctgactgctgtgcggatgcctgcaggccccaggacggcaggagaagcaaggagagccattagttgagttgactcagctggcttttcgtaggggcattttctccatgtacaacttgagaggctatgtggctttctttctgagtgaaaaatgctcgtttgattaagagctcagtagaccaggttaacattccaaggccctgtgttaccctaaattgagaatgttttggagagctagctgaggttaaatttaatacctgtttaagttctgtcgtaccttaatgtattttcatgctgaagagagagggcgttgcgcttctgtgattcggtgtggggaactagtgtttctgtgtcttttttcttaaaaaaatcaatgtgagtttataaacaaaagccacaaggacacaattttaaactgaattgtcttcatgttataaagatatattgacttttttctatattgaggcttgaatcatacattaaaaattgtatacttatcacacgttattcagatgtcattagaggctggcttgaggggcacattccaaggagtgggcttgaagtttactgtcagactgtctaccaagagagtttattaagcaaattaacagagtgcaaaagagtgaaagcagaatgcttaaggctacagcactgttttaaaaaacttctaaacatgtttgaagctcttattcacacataagcaattgttatatgctctttataaatggagattttcttttcattaaagctattttccaagaacctaagtgaactatttaagggtggaatagcgtattctacttatcctatgtaattaaaataaaaccacaggtcttaaacagtatgagtaattcagagtgacctcttttaattaaccctaactggtgagttttttctgtgtttggaagacagtctaattgttgcagtgtgagaatgtcaaaatagagaggtccctgactactcttgttgggcctttacagggagacattaccaaggagtgtagggtaggagggcattctgtaggaacctgggtctgatcttttcttataagtctagaaaatttatttcattagcattttaaaagagggataaatgcaggaggattaactccttctaaataaactcacaaaagactgatgaataaaccacaatgccaactttcaattgccaaatagacctaaatatttggctcaattggtgcattttccttgaaggagaatatgtatcaaaggctaaattagaatattggggtgcaggagactcaggaaattagatgacacatactccttttaaggatatgctatttttccaagaagactggcaagccatttattgcttctacactaggcaatggtgagagaaactgttttattctccatttatttgggttacatgctgatcttctgttaataagcctttattcaaacatggttcaatatgactgataacattttatcttccttagttaatattatgttttatttgtgccttcccaatattccacttaagccacttgtgcccaaatcccattgccgtaatagtcacaaaaatcctttaggttatttgtataactgactgatcttgttcataacttctgtgtccttatattccgaggcagtcttctctcacatgtatttacaacactcagtgtgcttgtggctctttcttttggctacaatagggttccaaaatccaggaaaaaaagctcttttccaatatttctttgtgactataattctcctggtctatttctccccaagttttcatgttactggggatatcattaaaaacaaacatcctttgttttcttttagaattatcacatcctcttctaaacctcctccttccttccttttgtatgccgtgttcttcataatcattgtcctcttcagtatcagatgtcactacagtttttaaccttgacaaggaattcctacttgcacatggtcttctactgggccctgtaaaagaggattgcatagaccttgttcaggccttcttgcgtcagctgtttgcagttggacagcagtgtggctttagtgtcaccatcagatttcagagccttcagggaaaactgcgtctttgccatccatatcttattataacacctagattttcatgttgaggtacatgatgtagatcaatgaaccaacacacttttgagtttgcccttccctccatccttccctccctcccttccttccctttctttcccacctgcctccctccctctctttttttcttttttcttttctcctttttatctttttgagacagttttgctctgtcacccaggctggagtgcagtgatgcaatcttggctcactgtggcctcgacctccgggctcaggtgatcctcccactacaggctcctgagtagctgagaccataggcgtgtgccatcatgcctaactaattattgtattttttgtagagatggggtttcgccatgttgcccaggctggtcttgaactcctgagctcaggtgatccacctgccttggcctcccaaagtgctaggattataggcatgagccactgtgcctggcctctttttcattttaaaactgtatatagttaaggtatataacatgatgttttgatacacatatgtatagtaaaatgttactctagtcaagcaaattaacgtatccatcatgtcacatagttaacttttatttttgtgataaaaatacctaaaattgactctcttagcaaatttccagtatacagttattcatgtatattattgagttatttaaagacatttagactttcttcttgagggatgagagggtggttttccccctcatatattttgtcttcaattcttaggcttcctcatccttcatgcaaatcaccgtgaaagtgggtcccaagacccaagataactttttcagaagacttgggggagggtcttagccatgagtttttatttactcttagaggagtgactcatacagtatttaagggcctcaggcctggcctctggcttgggttggcttggattcaggccctggtcagttgaatttggggctgagcattcattaccaccatctactgctcccctcttgttctctattctttctccccacctcctctccttccttctttccctcttttcccttctccttcttcttcctctgcttctccttcttcctcccctttctttttccccttccctcatctttcatcttttttaggtaactgcactcatctctttgctcaatggaaattataatgcttacctttctctctcttaaattttttgttgtgggattaatgagaacaaccaaaggaatggctttggtattgtgagaagctttgtataaattcagaaatatcagccaggtgcagtggcccacgcctgtaatcccagcctttgggaggccaagcagggaggatcgcttgagctcaagagttcgagaccagcctcagcaacatactgaggtccagttagtacaacaattataaaaattgttgatgtggtgtgtggtggcacacgtctgtagtcgcagctacccaggaggccgaggtgggaggatctcttgagccctggagagcgagactatagtgagccttgattgtgccactgcactccagcctgggcaacagagtgagaccttgtcttaaaaaaaaaattcagaagtattatttgctaactgtttctgcattttcttccttcctacatgcccatactcccttatgatgtatagtatgctaagtatgcccttttctagtcaataaacagagtttatatttacaaataagaaattactgttatgagggtcaccctttgtggagagtttgctgaacccctgctttcatttaactctgaattttggtctctgtggaagacacagaagtcaaagatgacgggagctacctggtgctgtgaggctgtgagggctttagcagataacaatcctgctcctgtttaggaacgctggcagttccctctgcccattcccatttcaacggtgctaccatttgtgcaccatttacagaagaggccaaaaagcaaggctttttgatccaagtaaaatgatattaacaatctctgggagggggtagggactccaagtgaatgttctgggatgatcaggggtaatatcttgttgtcgcagcagccattgaagaaacgcttgtccatggatataggctgcttgcatttgccttttgagcatcccttccttccctcagtttcattcaccttcctgtgatagtgcagtgacagtgtttctgtctgtctttcttccactctcattttcagatttcacctgttttaataaatatgtgtaagtcactatttttatctactaactaccaagcttatattgcatcccttgttttggtttctcgtgcaaccagttcttccatggggtactgggacttggggaagttctagtaaaaacacatactcattaatctcttgttggtttctgcttaaaatggtagggtgtgctggaagcattgaccaagttccacatcactatgaaggcttctgtgtgtggagatctccttttattttatttcttatgcaattatagtatgttcttgaatctaggggagcaagcaggtggtgaaagggaatgttgctgttgattctgctcctctccaagtattattatgcctggggagttaggtatgaactcctgcacactgccatgcttactttaacttcagaaatctagatgattcaacacacgggctcttctctgtgtttgttttaactgtggaatggtcaaaattactactttgtaaataggtttaagagaacgagggaagggtccataactattggtaccgttagtgccttaatgatgtgggcagatcaagccaccccgccctaggagtgtgggactcatcactgttgacagtaattacctcaatggctgtcgggctagagctagtgtttctggatgatgtgaaatagacacctcttcaatccaaggaagaaataacatgcacatttaaaccttatcacctgattaattggagagtttagcaagaaacgtgataaaagtaaataaacttgtacttcctcaacagagagatggagtccctccaacttcaaagaaaaaacgccaggcaggggagaagatcatgtatactttggtttcagtcccgcatggcaatgacattgcatccctttttgaactagatgccacaactcttcagagagctgactgcctggttccaaggtaaaaaaaattatggttaaaagatgtttctttgaataattataccagtaggtgaggaatgaaaataataatattaatatatttttatgatatcaagggagcaaacataaatgaagaaaaatgtgtaaaacattgtatctcttctgtgaggaggttaacatagtttgttttattcttattaataattaaaatgtgcaggaccaaagaaactctgaaaaatttataagaatcatttattcttattacttgtatggcctttggttactaaaatgaaaaataatataaaagtatttctatttatatatttatcatttatttttattatgtcagatttcccatttcattcatccatttgttcatttatgtagtcaatcagtcaagaaatatctattgaacatccattacattccaggcattgcccttggcattgggaagacaacagtgaacaaactggttatattctcacattcaaatgggggagacaggcagtaaacaaaacaatagacataaaatattaatataaggtcaggtaataaaagtgctttgaagaaaaaatggagggtatggagagttctattaggtaggagtgttcaactgtggcctctctgagttagtacatttgaataacgatctgaatgaattaaggaatcaagtcctctcttcctaggaggaacatttcaagcagcaggaacacgaaatgaaaaatgttgaaatttactgggtgtttttaaggaccagtgagaaggcagagtaattagacataaatgagggaggggttgtgggattggaaatgagattgccagaacttaaggtaagacaatatcttacattcttttgcttgaatttgaccattttattttacttttcatttatttatcttttttgagacaggatctcactctgttgtccagggtgtagtgcagaggcacaatcatggctcactgcatcctctacctctggtactcaggtgatcctcccacctcagtctcctgagtagctgggactataggcatgcaccaccatgctctgctaatttttgtatatttttgtagagatggtattttgccatattgcgcaggctggtcttgaactcctgggctcgagggatccacccacctcagcttctcaaaatgccgagattacaggcatgagccaccacgcccaggctgaatttgactagtttagttaagcttttttgtctacaactgtccatctttcaaccataaggctatgatgcactctctagatgcatcgaggagtcttgcccatattattagggttagtgggatggctctaaattggccttgatggagcagtattgtgcttggccttggcagatggcagtggtgaagctgaaggcacctatgcagaaaggcaggcattgtgtgggtttcctccagggagggtaaaaagttactataataacactattgagaaacattgctggtagagcttcccagggtgttttatggctattctcattcatgagaaatgttgctgaatttcataccttatatgagtccatctctcactcttttttttttccatcaatataagcctgtaaagagatcctctctggttttacctgacccaggtctctggctttctcctcccaggactgggaccttaatcaatccttactatgactttacttattttagatttaagtcagcaaaaagggagtccttcttgaactctaaccaagagaatttgcttaaggaaatgataaaagggtcttactagaaagtgtatagaaccacgatgagggccactgagcctcactttatatagaataattaatctattacttttcagaactgtggaagccctattcagtgtagtgcagaattttgtattaacatcgattcatctgtcattaattgtattcaagccaacattaattaatgcttaataactactattataatataactcttgaagcactttttatgtattaagtcctgtgtcaagttcttaataaatattgtcttattgcatactggcagtaactcttacagatcaggaactagagactgagttggaacagtggttctcaagctgactgtaaattagaaccacctgggtattgttgacacctcaccatgccctggccacactgagaccaatgaaatcagagtcttacaggtggggtgcaggctttactctttttgaagcatttattacccaagtgattccactgtggagtccagtgtttctcagactttatggtccaatgctgcttaaactttattctatactaaatcaccaggggacctgatgacaactgagtacaaattacatctcctgtgtaattcaatgcagaagatgccaagtgataaaacagaggcatttcagaatttctagttatttgaacaaagattggagaactgctattttagatatttgaagctcagtttgtattttatctacttttataaaggagcagaaccaggttgttgaatgaatctctttgcctgagtcccttggcattttatttggttttcttttcttggccctaatgctttttaccttatgttttaagacgtatttatgccttatctttacactgatctgtaagcaacttgaaggcagagtacttactgtgcttttcttttaatagacactatacacatatttgttaaagaaataacaaaagattataaaagatttactaaaaacggtaatacttgagtaggatgaagttctaggtgtcctttcttaggcattctctcacagttcatatctagtcaatctttaaaattcatggtacatggaattagcaaatactgaaccattgttcctaggggaaatatagagttaggttcctgtgagcttctggtcgcaacatttttgttgacgaatacatagccttgttctatgtgtgcttctgtttaaatacaccttatttaatgtacgttgctgattcattaacattgaacttgtggtcaacagcactataattcatgcatgaacgaagctcatctagcacaagtattttctttgtaaggcacatcacaaccttcttgtgctttaggaacactagatggcacttctacacctcatgtgggggccatcttattgtgaaatatgaaaaacatggcactaaatgggccacaaaaaggacacttgtttatagcatgagagctgagacaagaaggcagagcatcaccttgttccacttcagcttggaaatgtgcctactgggccacttaaatttttgccactctatgtatgttctggaatgaccacaaaagctccttgaatattgatttgggggctacaaataaattttaccgaacaggagaattcacaagtacagaagccacaaataatgaggattgattgtacattaatactttcacatgcagacaattaaactacacaaactacactactctctgccagcagtgttagctgagttggctatttgatcaatgttcttagtttagcatgcatcagaactgcctggagaacctattaaaccactcattgttgggccacacccccaaagtttctgattcagtcgatggggatgaagtttcagaatttgtatttctaacaagctcccaggcaatgctgatgccactggtctagggaccacactttgagaactactacctaggtaaaaatgctgcatgctttgaaatagtctataattccgaatttccccttaaagcagagggatcttgagtcaattactagttaatatgtatttatgttcatataatatatgaaactgttaaagatgttaatatgtaagtgtgctaattttttataatttgtttttttatattgttttgcttttaggaactcatatgttcggttaaggcatttatgcaccaacacatgggtaaccagtactagtatccccatagacacagatgaagagaggcctgttatgttaaaggtaaatgtcactgaagatggtttaattttcagccaaatgccatgagaataggattaggataggaatgctgtgtgacacatgttccttatactccatcttcaccaatattacagatcattgcaattaatttcatcaagcatgcatgtctgccagttgcttaggtagctgatctaaatgggttggaggcagcaaagctgtgattcagaaggatgctacagagacaccagaaagaatggtagcagcatatggatggaggagtagaatccaggagtgccttttctctactctgtcgaaactgaagcagagggcaagtgtgaaagggagaagtttccagtggggctttgggaacagggcaggaagtgggcacaggaaatctctgtgtccctgcagcctttcatagtggatgatgcatgtgggagttactgtgttcggatgatctattcttgtcttatatttcttaaacagtactagatgtgttagtcttcaaagaatattgtatagttgtttataaaactaagcttaatggaaaaacatttcagattggaacctgccaaaccaaagaagataaagaagcgttcgcaatcgtgtctgttccactgtctgaagttcgagacttagactttgccaatgatgccaataaagtactagcgaccacagttaaaaagctagaaaacggcacaataactcagaatgaaaggaggtgagtaactctttaaattggtcttaaataatcacgagtcagttgtcaattgttatagtaagcctgatatgaatgaatgactctaagggaatattcagaacattctcgatagcacacttgcttctgaatgagatgggaacttattcctcttgatcatagtgagtgagtgaaatttgtcagatttaaatctgttggaatatttacttgtcccattttagctttgcttgaaaatagttgttttaagttactttctggtcattcttttttaaatcctttgtgagagatttgcaataccttttgctgcgcatgatttgatatttggatttagagttctaaaggacctaaaggaaggtttgtgtttctctgatcttatttattcaagatgcatttctcagctctggtaccacaaaataaacagatatgtaaaaccagaaaaaaaaaatctgcagggtatagttctctgccctcataccttgttcagagaaactggaaccttgattcttcagctctggttttggaaataagtaagaaagagaatgatattgacagctaacgattattgcatgcctgctttgtgtcacttactaggttgggcactgtaaatatattttatgtaatccttcaaatagccttgaaataggtattcctgttttacataaaggaaaactgacgagggtaagcaaacaaggtaaagctgcatagttaatactaagggaggattcagtcatgtatggtttaaagtccatatgctttgcagtatgcctaagcacaagcatcctctgtatttcctctcttcatgatctactacatgccttttaatttaaacaagaaaaagctgtttgccaatttcccaggcattcagacattggagctctcatacacagctggtgagatgataattgatgtatgcaccttggaaaatagtttggcagtaactagcaaaattaaagaagcaaacaccccgtgactcaccaattccactcccaggctgaacattcttgaacatctgtccaaaagactctcctccacatgtgtaccaggacacatgttcaagaatgttcagctttgtttgaaataaccccaaatggaaaaccatccaaatgtccatcaccagttgaatagaggatgaaaattatgttattttcatacaacagaatacagttttgcgatgaaaataaatgaactacatctatgtgcaatggcgtggctaaatttaacaaatggattgggtgaaaactagacacaacattctctgataaatcaggtaacaaaatgtatttgattgatagaattttgaagtaaatgtgattttatctatcagtttctgagtaacaaagagcaccaagttttaatttaaataggggatttaacactagggatcagggagtttagttatgaagagttaaaaaaatttaaaaaacagtgtaagctgttgaaatggcaagtgaattattttaatgatgtaataaaatatttttaaattttgacatagtgatcatttaatgaaaaaactcaccaaaatgtctccatttgaattgtattgataatgtgggacatatgtgtaattcaatatatacatatacccatatgtatatacagaaaattatttttaatactttcctactgatatgaaatttaaaattggaaattttgtgagtgtttttcttgtccaatagagcctgtttcctttttttttggtgatttaacaatctcttgagggctgcacctttaaattcccagattgtcaatagacatgtatagtatatgggataaggtggacacaagtgcacatataaataaaatcttcttaagacttttaactattcatttacagtaggagagtatgtagaaatcatcatccacaagtcataattaggttgtgtgcctactgtagttttttccatttctgtattatataaacatttgcatattaaaatttgatttttcccagagacaagtattatatactgtatctatatttaaatcaaactgtggtaatatatttctcagaaaataatgttggggactatagcctgaacatttggacttgaagcgacatggaggaggaggttgatcccgttgtgtataagttaatatgtgataactattgaatcttgtacaaaaacaaaaattgaaaaagaaaaaagaaaagcaaaaatacagtttttattttgaaatacaaaaaaataaaaataaaaaagaaaactagacacaacaaagacattcactgtagtactatgtgtgacattcaaaaacaagcaaaaacaaactccatttctttgggggtgtttaagcaattagaagaaccataaagaaatgcaaggaagtcattgtgacaaaaaacaggatggtgtttcttcttagaggggagggaggaattatgctccctgaaggtttgaaaggctcctgcagggtcccatttcctgctcttggtgatggcttcatgggattcacttttcagtagtccttagctatatgttttaaaaccttttagatatacatcttacaatacaaaagaacaaaaaatccaagtttgcttccctccatccctgtcaattagaaaaaaatcctaaatatgcaaacaaatggaatagctgtttctcagcttcctctctattcttacctctatttttttccctggcaaacttacatttcaaaacaactattgtatattcagtcgcacctccaaccctgttaggggaaatgaataaaggccggaagcagaaacaactggcccacttttatgggctatagacaagtaaatatcagagctaaattatggcaggaaatggattctgatgtgcagataggaatttttatttgcctgttattgatctaacttttccttttgtgaatctatttctttgtttctaacactcttacatatgcacagcaatttacttggcttcacttaaaaagtctcccttgctaagcattaagatattccttgaagaaaaggacagataaaaattcagattatggtctctccaccattgctggctggaatcctgtgcgagtcactcttcttcagtcacagctggagattatcttaacctctcaagatgattctaaggaaggtggtggactaggactgactagagagcatgcatttttatttcctttgcttctttccctgctgttttggagtgaaaaacgttgtattaatagcaaagagaaggctttgcctaagaaatatgaaggtacaattattgatcttaatttagtaatttcagaaaagccacctcccatcaaaattcattcaaagctgcctgtcagtaaggtagagcttattggcagagttgaatgcatttatattattttctcagttttggaattgaatataaaattatttctgaaaataactgacaactctgacttttttccccctatggaaaatgaagtgattattatctgtctcaaaaagcctgtgttgttggaattttttttttctctctctctctctctgtcttccctttttacttatcccaggaatgaacatgaaccctggaagtacagttcctgtgttatgcttcaagaccctcaacattagatatttttcaatggaattttctaatcttattctacataattgcacccacaaaatagagaggactgggaacatattgtcagggatggaggagggaagatggaggggtgttaactgccatccagaacttgaggaagtgacacaggcagtccctgaccagcatttctgcactatgtttacctctgagggtacacaaaatactggggttactctcaaacagtgagagttcagagatgtgattaattcagtattactgaactcctggtatgtgccaggcacttggccatgcagcatggctatatgtagtgctaatgtggtggtgaaggccacagactatcccatgtctctgtgaaacttaccctctcgagggatggttctcattccccatgataggagcccaggatctagaataggggtcatccaccatgtgatcaccagatcagatgtcattctgatgttgcttctctgagcaacatcattttctcttaaattttatttgccaggtatgactatcctgacaccagcaatcttttgtttaatatttgaaatgcctgatgtctctttttccatatctttttaattcagatttcctggtcattttgttttagttgtgtctcttatgagcagcagaaggttgatttgaaacaatctaatctgatagtctattttatttatttttaaggttgattgtaacaatccaatctgatagtctattttatttatttttttttgagagagggtcttgctctgttgcccaggctggagtgcagtggtatgatcatggctcactgcagcttcaacctcctgtgctcaggtgatcctcccacctcagactcccgagtagctgggaacacaggcacgtgccaccacacccagctaattttttggatttttctagagacagggtttcgccgtgttgcccaggctaatctgaaactcctgagcttaagcaatctacctttgttggcctcccaaagtgctgagattacagacgtgagccaccgtgcctggctgatagtctattttcatttgcaagtttaatgactttgtatttgacaaatttatttgaatgcatttttatttttgttttctttctttagtgtagcttgttttcatttccttttacttctttcttgctttctgctagattaataaagtttatattcccctcccacccaatttactgttttctctactgatttagaagctttaggtcatattttcattcattagcaattacccttgaattcttatcgtacattttgaccatatattcttcctgataaacttgaagttactatttttttccccctcccatgaaagaaaagtgccgcggcatgctttggttttgctctgacattctccctcccttctttcttgtagtagttgtttagaaccttagttctgtgtttattctcttcatttgtaaaattttaatttgataaatacaaaagaataaatgtgtcaatataaatcatgatgcaccaccttttgtttttactgataaattttgttcctttttttaagacaaagaaacatcttttttttacttaaaacatttattttatttttttaatcttatttcactagtttttgaggagataaatttagtttctaaagtttttttagtgattaattatattttttaaacaattttacctcttcttctgcccctttctttacgtcttcctcctgcctttattacttgtatctcacttattctttctcttttcatcttgctgaaatttattctttagtccattcagtggagaggcctatgggttataatctttttaggttttatgtatatgaaaatatctttattttgcctttactcttttttttttttttttaaagacagagtctcactctgtcacccaggctggaatgcagtggcgtgatcttggctcactgcaacctccgcctcgcaggctcaagtgattcttttgcctcagcctcccgagtagttgggattataggcacctgccaccacatctggctaatttttgtatttttagtagatacagggtttcaccatgttagccaggatggtctcgaactcccgacctcaggtaatctgcctgccttagcctcccaaagtgctgggattacaggtatgagccaccatgcccagccagaatttactctcaacatatttcttttttatttttttgagatagagtcttgctctgtcgcccaggctggagtgcagtggcacgatcttggctcactgcaatctccacctcctgggttcaagcgattctcctgcctcagcctcctgagtagctgggattacaggtgtgtgccaccacacctagctaatttttgtatttttggtagagatggggtttcaccatgttggccaggctggtgttgaactcctgacctcaggtgatctgcccgcctctgcctcccaaagtgctgggattacaggcgtgagccactgcactcttgccattactcttaagtgatactttatagagatgttagattgataattactttctatctgtattttaaagctaaaatttaattattttctagcatctcttgttgctgttaagaaatctgctgtcaatagacttgttattcttcactggtaatttttcttgacttggtaattttttttttattattatactttaagttttagggtacatgtgcacaatgtgcaggttagttacatatgtatacatgtgccatgctggtgcgctgtacccactaactcgtcatctagcattaggtatatctcccaatgctatccctccccccttcccccaccccacaacagtccccagagtgtgatgttccccttcctgtgaacatatgttcttattgttcaattcccacctatgagtagaacatgtggtgtttggttttttgttcttgcgatagtttactgagaatgatgatttccaatttcatccatgtccctacaaaggacatgaactcatcattttttatggctacatagtattccatggtgtatatgtgccacattttcttaatccagtctatcattgttggacatttgggttggttccaagtctttgctattgtgaatagtgccgcaataaacatgcatgtgcatgtgtctttataacagcatgatttatagtcctttgggtatatacccagtaatgggatggctgggtcaaatggtatttgtagttctagatccctgaggaattgccacactgacttccacaatggttgaactagtttacagtcccaccaacagtgtaaaagtgttcctatttctccacatcctctccagcacctgttgtttcttgactttttaatgattgccattctaactggtgtgagatgatatctcattgtggttttgatttgcatttctctgatggccagtgatggtgagcattttttcatgtgttttttggctgcataaatgtcttcttttgagaagtgtctattcatgtcctttgcccactttttgatggggttgtttgtttttttcttgtaaatttgttggagttcattgtagattctggatattagccctttgtcagatgagtaggttgcgaaaattttctcccattttgtgggttgcctgttcactctgatggtagtttcttttgttgtgcagaagctctttagttgaattagatcccatttgtcagttttggcttttgttgccattgcttttggtgttttagacatgaagtccttgcccatgcctatgtcctgaatggtaatgcctaggttttcttctagggtttttatgattttaggtctaacgtttatgtctttaatccattttgaattgatttttatataaggtgtaaggaagggatccagtttcagctttctacatatggctagccagttttcccagcaccatttattaaatagggaatccttttcccattgcttgtttctctcaggtttgtcaaagatcagatagttgtagatatgcggtgttatttctgagggctctgttctgttccattggtctatatctctgttttggtaccagtaccatgctgttttggttactatagccttgtagtatagtttgaagtcaggtagcgtgatgcctccagctttgttcttttggcttaggattgacttggcgatgcaggctcttttttggttccatatgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtgtcctcttttatttcattgagcagtggtttgtagttctccttgaagaggtccttcacatcccttgtaaggtggattcctaggtattttattctctttgaagcaattgtgaatgggagttcactcatgatttggctctctgtttgtctgttattgttgtataagaatgcttgtgatttttgtacattgattttgtatcctgagactttgctgaagttgcttatcagcttaaggagattttgggctgagacaatggggttttctagatatacaatcatgtcatctgcaaacagggacaatttgacttcctcttttcctaattgaataccctttattttcttctcctgcctaattgccctggccagaacttccaacactatgttgaataggagtggtgagagagggcatccctgtcttgtgccagttttcaaagggaatgcttccagtttttgcccattcagtatgacattggctgtgggtttgtcatagatagctcttattattttgagatacgtcccatcaatacctaatttattgagagtttttagcatgaagggttgttgaattttgtcaaaggccttttctgcatctattgagatagtcatgtggtttttgtctttggttctgtttatatgctggattacatttagtgatttgcgtatattgaaccagccttgcatcccagggatgaagcccacttaatcatggtggataagctttttgatgtgctgctggatttggtttgccagtattttattgaggatttttgcatcaatgttcatcaaggatattggtctaaaattctcttttttggttgtgtctctgcccagctttggtatcaggatgatgctggcctcataaaatgagttagggaggattccctctttttctattgattggaatagtttcagaaggaatgataccagttcctccttgtatctctggtagaattcggctgtgaatccatctggtcctggactctttttggttggtaagctattgattattgccacaatttcagctcctgttattggtctattcagagcttcttcctggtttagtcttgggagagtgtatgtgtcaaggaatttatccatttcttctagattttctagtttatttgcatagaggtgtttgtagtaatctctgatggtagtttgtatttctgtgggatcggtggtgatatcccctttatcattttttattgcgtctatttgattcttctctctttttttctttattagtcttgctagcagtctatcaattttgttgatcctttcaaaaaaccagctcctggattcattgatttttttgaagggttttttgtgtctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcgttggtttcaaagaacatctttatttctgccttcatttcgttatgtacccagtagtcattcaggagcaggtttttcagtttccatgtagttgagtggttttgagtgagtttcttaatcctgagttctagttcgattgcactgtagtctgagagatagtttgttataatttctgctcttttacatttgctgaggagagctttacttccaactatgtggtcaattttggaataggtgtggtgtggtgctgaaaacaatgtatattctgttgatttggggtggagagttctgtagatgtctattaggtctgcttggtgcagagctgagttcaattcctgggtatccttgttaactttctgtgtcattgatctgtctaatgttgacagtggggtgttaacatctcccattattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctgttttgatctttgttggtttaaagtctgttttatcagagactaggattgcaacccctgccttttttcgttttccatttgcttggtagatcttcctccatccttttattttgagcctatgtgtgtctctgcacgtgagataggttgcctgaatacagcacactgatgagtcttgactctttatccaatttgccagtctgtgtcttttaattggagcatttagtccatttacatttaaagttaatattgttatgtgtgaatttgatcctgtcattatgatgttagctagttattttgctcgttagttgatgcagtttcttcctagtctcgatggtctttacattttgacatgattttgcagcggctggtaccagttgttcctttccatgtttagtgcttccttcaggacctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactgtcttctggcttgtagagtttctgctgagagatctgctgttagtctgatgggcttccctttgtgggtaacccaacctttctctctggctgcccttaacattttttccttcatttcaactttggtgaatctgataattatgtgtcttggagttgctcttcttgaggagtatctttgtggcgttctctgtatttcctgaatctgaatgttgtcctgctttgctagattggggaagttctcctggataatatcctgcagagtgttttccaacttggttccattctccccgtcactttcaggtacaccaatcagacgtagatttggtcttttcacatagtcccatatttcttggaggctttgttcatttctttttattcttttttctctaaacttcccttctcgcttcatttcattcatttcatcttccattgctgataccctttcttccagttgatcgcattggctcctgaggcttctgcattcttcaggtagttctcgagccttggctttcagctccatcgctcctttaagcacttctctgtattggttattctagttatacattcgtctaaatttttttcaaagtttttaacttctttgcctttggtttgaatttcctcctgtagctcggagtagtttgatcgtctgaagccttcttctctcaactcgtaaaagtcattatccgtccagctttgttccattgctggtgaggaactgcgttcctttggaggaggagaggtgctctgctttttagagtttccagtttttctgctctgttttttccccatctttgtggttttatctacttttggtctttgatgatggtgatgtacagatgggtttttggtgtggatgtcctttccgtttgttagttttccttctaacagacaggaccctcagctgcaggtctgttggagtttgctagaggtccactccagaccctgtttgcctgggtatcagcagcggtgtttgtataacagcagtttttcgtgaaccgtgagtgctgctgtctgatcgttcctctggaagttttgtctcagaggagtacccggccgtgtgaagtgtcagtctgcccctactggggggtgcctcccagttaggctgctcaggggtcaggggtcagggacccacttgaggaggcagtctgcccgttctcagatctccagctgcatgctgggagaaccaatgctctcttcaaagctgtcagacagggacatttaagtctgcagaggttactgctgtctttttgtttgtctgtgccctgcccccagaggtggagcctacagaggcaggcaggcctccttgagctgtggtgggcttcacccagttcgagcttcaggctgctttgtttacctaagcaagcctgggcaatggcgggcacccctcccccagcctcgctgccgccttgcagtttgatctcagactgctgcgttagcaatcagcgagaccccatgggcgtaggaccctcccagccaggtgtgggatgtaatctcctggtgcgccgttttttaagcccgtcggaaaagcgcagtactcgggtgggagtgacccgattttccaggtgctatctttcacctctttctttgactaggaaagggaactccctgaccccttgcgcttcctgagtgaggcaatgcctcgcactgcttcggctcgcgcatggtgcgctgcacccactgacctgcgcccactgtctggcactccctagtgagatgaacccggtacctcagatggaaatgcagaaatcaccggtcttctgcttcactcacgctgggagctgtagacccgagctgttcctattcggccatcttggctcctcccccgacttggtaattttatagattatttttctttgcttttgatgtcttaagtttcaccatgatgtgtttacaaaggagttttatttttgttttttctcatttgacacttaaggtatacttttaatctgaatacttatttctgccttcaattcttggaaattttcagccgttttcctgcaaatattgcttctttgtctttttcctcctttctgtcttttggaacttttatgagatatatgttggatcctcttaattcctcttctttctctcttaacttcccttttattatttgccttttaatagttctctttgctagtatctggatcaatttttgatactgccttatagattaataatatttttagaatgtatgtagaataattttccttcttcagttaaatttttatttaaataattataataataataattttttttttgagacaggatcttgccctgtcacccaagctggaatgcagtggtgcaatcacacagctcactgcagccttgacctcccaggtttcagcaattcctcttgcctcagctgcctgagtagctgggaccataggcgcatgccacctcaccaactaattttttaattgttttgtgcaaacgggtttcactatgttgccctggctgattttgaactcgggctcaagcaatccccctgcctcaacctcccaaaatgctgggattacaggcatgagccactgtgctcagcctataatttttatctctcagatttttttttttggtatatccacctatttttcatttatattggcctttttaaaatacgttgtctttttaatatattgctttgtttatctctttgaagactgaatacacactcatttaaaacttattttgaaactgttttgttactcggattttgttgatggtggagtagcctcctgatactgtatggtggctatcttcctcaatgtcagctttccttatgtgctttggacttttactatgcatgattttcttaggtgggagatttttgtttttcctttctctacattcacttgtcttctctatcagttttatgcttgcttctacctggcttccctcaactaggccagagccagatctgatatcgagagctgagagtccatgttctctggtaatttgagactttaatcatggagattgctggtggctgggtccagccctatccatgtgtatctgttgtttcctgctaccactgcacagccaaagcccaaataagggccactgaactttaagttttctttaagaggttagagaagccatatgtttgtctctgttttatatgtttagtttatttccctatcatgtgtttttggtccctcttaccttgcaagagttgaaatcatccctgttcctcactgtgtttttcttattttgttcattttccataaagcttaaaaagcaaatgcgtgagctagtaggagctacccactgcccagtatagaatcagagtttgatctaaactgaaaacaaaccagcttttttgttttgccacaaaggggatgcttgaggtgcaaggtcaaaaaaaggtttcagcagtttcagaggtcaaaagagaaggttgcttttcctggcttccatggccttgtcatgaagaggtgggctttacatgtagggttgacatgtcgtgatttgcaatcaagactgttaatgttcgtcgtcatcattccattaaccgtcaccaattttcagggcatttgaatgactttgaaacagagcgatctgtagttgctcacaaaattttactttcttagatatctaaatatttgattatagttattgaaacagcaagagaaaaggaatcttactaatttaaaaaataaaatacaaatatttatgctcaaactggacttgcattgggcatatagaaacttaagttcaactttttttcattttgctgaagtaacctccgctccaaatttgttttgttttgttttaagagcaacagaatgatttggaggacattaaatcacaatttcaaaagaagttcacaccacattttgatgcacatgaaacgggttttacgtttctgtggctgccttcagagattacacgtaactatgtcagtgaatcctgtcagttagacacaattttccaaaagaaacagactgggttacaatttaaaataggcataccaagaaaacatagaatcccaggaattttggaatggagtttatgatccctggaagtatactgaaatttctctgggtgactaaattatggattctaggtgtgtccacttggctgcaggaagtgcattctctttcaagacataaatcgggagataggatcaggatgttttcttaccaaaggtattgaaagagaagaaaagagatgttttccaactgaatacattctatactttcctggaattgttgaagctcttaaaatgtagttttcttatgaatgtattcatgattagcatcattgtattcacatgctaataacagtgaataaagatgctaacactatatggatgaagctaatttaactgtttattggtcagcttttgtctataccaaaaaaagtatgtgtttattgagtaattaagttgtactttaccattaatacaatttaaaaaatgccttgacccttccaatacggattcctcatctgtttacccatttttgcaatagcttgaacccctgccccctccctcaatcgactaacacaaatggaaaatgataaagagcaggcagaggaaggaggaggagaaaagtgaagagaggaaggctttcaagacacttcctgtactacatgccactgaagttcaagtaatagttgtaataataaccaaaatatagatttaaaagtgaacattggtgtatggttttagaatttcacgattttgataggtcatttaatacttccagtattttgagtgtcagattgcttactctgtctctattcataggtcatttaagtttttcctgttctgtacattgggcaagttgaaatgtggcgaggattaggaaatgtagtttaacagtaaaaaaagaaagaaaaaggattggaatttaggaatttagtatagctgttttcccttaagcagaagtatgctgctttgctagtcagttgtggaaaggcatctggtggtgtcatcctaccaactcgtgtgcagttgcgactcacatggctttatttgataatagtctgcaaacgcttgatgagaactggaggcgcaagtagagattggagatgctggagaaggaattttctttgtaaaggcttaggtaaacagtaactgccttagagattatcttttgtcaattaaatacttttttattataaaacaccttgttttcaagtgtttcagttcttattatttaataaaaagaaatttccatggatttgagttccactcctgaagaaaaagtaaaaaaaaaatctatctatctatctatctatctatcttctatctatctatctatctctacctacctacctatcatctatctatacattttccaaaattaagcacactgtaaagtaaaatttccttttcattttgtaataggtttgtaaccaaattattggaagatctcatattctttgttgctgatgtgcctaataatggacaagaagttctggatgtggttatcactaagccaaaccgagagcgtcaaaaattgatgagggaacaaaacatactggcacaggtgaattttttcatgtactaaatttgtatattttattttctgaattacagtatcaggaaaggccttgtattagttatctattactatgaagcaaatgatcccaaaacttagtggctgaaaacaagatacttcttgtctcacagtttctgtggagtagtgatctaggcgtggcttacatgggcagatctcactcagggtctctcaccaggctgcagtcaaggtgtttgctggggctgcaggcatctcaaggttcaactgagagaggacttgccttccagccctctcacataggcatctctcaggagtgcctcaagacaaggcagcttgctttcttagaactgagggatccaagagagaactagagaggacgctcaggtagaagctaccatctttgtagaacgtaatcttagaagtaacatcagttctactgtgttctattagttagaaatgggttaataaatctaacccgtagttaaggagagaggattcgatgaggctatgaatatcaggaggcaggaatatcagagaccattgtagagacagcctaccatggacctccaaaaaccctgcatagtcagactatctccagaaaatatgttggaaaaattcctaggtagaatttccaggtgaacttggaaagtgccatctccatctgcttcctacttctttccttctcttccctgggaaagtagggcagtctgttcatcagctcacgagtgctctgtacaatattctagttttcttccctgaaagtacagaactgctcctgtattacatcttcttgaaattgttcataacacgtcagtaaattgattcacttcctaatgatatgcacatatggacatgcctacgtttatgtattatttttattctattaattgctatttaaattaatgagtttcttcattaatgaagtatagactcaaggaagatacttaaaacataaaaatcatgttcttgatacacatattcttattgatttgggaaaggaaaatagtagacataatgttagttattatatgtagctgattgtctgaaaatacaaaatcaacttttttctcaaataaaataaaggttgcaaatctaataggacttttttcgagtaattattatataaaaaatttgatttcaaagacttttaggaccttggataattaattaataatattttaaccaacatatgtcaaatattttatttttgtttgataaatataaaattaaaggcttagtgaatacaaaattattaaagaaactttagttcatatcatatttcatgaattccaaagaataattcctttctattttgttttcatgtattaatgttcatgcccttgaccgctctttcatagacaatttcctcattctagcagctcatctccaggtgatccctcctgctgtcttgctgccgaaaagagttatattcctcaatgctttttaaatgcttcctaactgctaaccttcttacaagaatctggcttactgggagccaccagctgcccatgtggctcctaatttgtcacatttgaatgctgatatgttcatcgatttggccacatctttgtatacaaacaacagtaaattaactcttttataaagcagtttagaagcaatgtttggaagtcattttctgatgtcagttttaaagaaaagtaaatgttttctttatattattttgattttgaaaggttatagaaaataatagaagaaacttattataaagcccctagaaatcaagctacattttagttcatctgaatatgttcatgtaacttggtgaaattgaacatcttcatatttcttattttataaaatatgatttctaaacaaaattaagcattttatttaaagaatgtttttgtcactcaatgtaggtgacccttttggcagtacttttctgatccttgatatgttggtcctgtaacgtaaatccttttgtttttcccgtttactctaatactcaaatttatataagtgttttttgaatcaatgttcttatttgttaaaaaaaaaaggttgcaaaacattttattcatcagaataggtggctgtttttattcctgataggtatttggaattcttaaagcaccctttaaagagaaagcaggagaaggctcgatgctgagacttgaagatctgggggatcaaagatatgcaccctacaagtacatgctgcggctctgttaccgcgtcctgagacactcgcagcaggattaccggaaaaatcaggtcagagggtagcccccattttaaactgtttcatatgtaaagtatgggcaaggttctttggttataattctacagcatagaaagtaggaatgggaaatttcactttgaaatgaaatattttatgttgggcaatacataaaaatgatttgtaagtatttttgagttgtattgaacatggctttattcttccatatgaaattagaatcactgggggaggatgtcctgagtactaatatgtgcctgttattggttcctggtggccaggacatcctggatctattatgtaaggaggaatggaacatttttggcttgaggaacatgtgaggtacagcatcaccgtgtatggaccaaagaggttatagtttagtggaaaagatatgatgggagacaaagaaaagacacagagagaaaagatagagttatgggaattcaccagagggagagcccagtggtggctttgggaaccaaggaagaatacttggagaaggaagcctttgggtaggatgagaatcattttcataaattgtatgggaagaggtatttgtgaagagagatctatgaagtgagaatgatagatgctagaaaggacacgtttcccctaagatatttgcaactgctgaggtcagggaacccagatggatctaggggtacagctaacagttgccagttgcaagtgaaatttctcttaagtctcatttttatcttaaaaatacaaaccaggtggcgtggctcaagcctgtaatcccaacactttaggaggccaaggtggggggattactcaaggccaggagttctagaccagcctaggcaatatagcgaggcccccatctctacaaaaacgaaaaatacctgggtgtggtggtgtgtgtctgtagttccagctactaaggaggctaaggctggaggatcacttcagcctaggagttcgaggctgtagtgagttatgatcacactagtacactccagcctgagcaacagaatgagaccctgcctcataaaaaacaaaacaaaacacaagcttaatattttgcaatgtgttcaataatgtaaatgtctaacatacaattgtataaaattaattattgtttgataaattagggtttctcttaatccatttgagggcagagtgcatcactgtaagtttcattgatgagtttggtccatgaagaaggatggtgtgggagagggctggaagggcagggtgggctaagccactagggcctaggatgtcaatcctagaaggtggaggttatttgggaagagttagtagtatttattgtgtgcttactttgtaccaggctcagttgtaaatacttgtcatgaattaattcagttaacactgaattaagatgaaggatagaggcacagagaggttaagtaatttgtccaaggtgatagtttaagaatggaaccagtatgcaaacccaggctctgaatcatcacactattgcatcttggtagtttgaacatttttggggaagaaaaaaagatttgcttgaggaagactgtgttaaaatgttttggcttcacaattctgtttgaagagtaagaaaggtctgaaaagagtatataaaaacattagctagaagataaataatatggcaaggaataggagtaagagctaggggtgatataaacaaatccttaaatattgtctaatataatcctagttataaacacccttcttgctgatccaaatgctgtcactagaattatttttccggacttcattgggttcctttaagatggcaagatgaagtagatagtgttgttcatatttttttggaagaagaattaagtagcaggacattaaatggccttccttcaagcacttggaggcagtgttaggggatgctcccagtatcggaccctgagtttttagtggaggtctggagtggggaagggaaatgagaggctgctcaatgttttctccttgctctggtttttcttcttgggtttggagaaatacacttgtgagactggtcaccacttcacccgtacgagcagtgctgtattatagagattgacattaacagaaaaaatacctaacaggtctatagaggctacccagggccctcaggcccatcaggtcccatgatgtgcaccctccttgatggctgtcagcctttggaagggtacttggggccccttcccttttctatagccctgtgcttcgggatggcagggagccagctcactttggatttggttattctgctagtcagtagtaggttccctgggcgacatgtcttacctggtgtcagttctgtctctcaaggtctggcacacatggttctttctctctcccctctcagtcttggccagggatcagtgtgtgcgtacacacacacaaacacacacacgtgtgcgctcgtgcacgtgcccgttccctcccacccccccccccccacacacacacccctacctagtcatatcactcctttcaggtacatgtttatgcactttagggacctgccttctgggtttctttggagcatagagttagagcatagatgataaaggaataaagaatccccagcatttgttaagggttatattttatttttcttccctttctgttgtgtgttctaattgaatctcagtgatagctgggaaatgtttttctcatttctattgagttaagaatgcttggtagtaagcataaagcagctttctgattttttagaacattttaaaatgttctatattattattattatgtagtatatattatatagcattatggctataattactttgtttttctttatcttcacctatatgttgtagtcctaataggaagttcatttgtgacttaacactcacccatatatttaatattgaagatctatttattactatttataaaatttgataccacctctaatttcatttagttatttattaacatttttggatgtttgccttataccagagtatgactacagtagtcatgaaagtgtataaatcaatatgtatccttaaaatgatataataacagaagacatttactttacttaactggctccccaatacacaaagccatcattctgaagggccacaaaaatgctgcttagcatataattagatttgtgcaaccaatatcattttcaaggaataggtacattccagtaaattttacctaaggcaaaaccactttctaatctatcagttgtcttgtcagagaaacaaagacacatttccagggagaatcccaaggaatcaaagtaagaacctttcatggtggaagggggagaagctcaccagtcccatggcagtgtgagatgtgctgcttgtagatagaacgtgggagatgaacaatagtggtttgggatataggaaaattagtgtgatgaataaggagtagatcaaacaataacatgattgaacctccccagtggctttctcttacttttagcacaatctctttgccctttaccatggctcacaaggattcttttgacctacctctcaaacttcgactttgctttctgccccttaccactgcctagctacaatggccaccttctgttgatagaacataagcttggttctactacctcagggcctttgcactggctattcccactgcctagatggcttccctttaggtcttccaatggctgcctcgttctcttcattcccatcctagctcaaatgtcacttcttcagcataggccttcaagaaacatttattgggcaaatggatctaatcaataaagtgattaatcacattgccctgtttggtggctttttaaagataaaaagtatatgacattttaccattattttaaagaaaagatcttacagatcattccagcctattcacagaaaaggaatcaatccaagtccatctaggatcttcaggtaacaacccagatctcatgtctcatgaatgaaatatcaggcagtcattttcttttctataattatgcccaaatcattggctatgactttaagtaagagatagaagaaaagcctctgttagactgatgaaatccaaagttattgtgtcataaaagcttattttaattagatttatttttcccacttagcctctgttagactgatgaaatccaaagttattgtgtcataaaaacttactttaattagatttatttttcccactttggaaataggtatttccaaaatacctatactgataattatttctaggtgtataattttttagtagaagttcaaaaacgtatatgccagtatgttttcatgtctttcctcaaaaagctctatttattgaaaaatttacttgcttttcttttgagaaaatttttagtgaaccttctgttgtgaataaattaatcaatgttgttgaccctaatagaacctgttatttgtaagctgtttggcagtgcattctgacagcctttcttctttgcaggaatatattgctaagaatttctgtgtcatgcagtcccagattggctatgatattttggcagaagatactatcacagctttgttgcacaacaacagaaaactactagagaaacatatcacagcaaaagaaatagaaacatttgtcagtttactcaggagaaatcgggagccaaggtttgaaatgattcatgcggtattcttttctagtggagattgcggctttatgttttatttttagaacttttaaaagttagagttctttcacatcactaacttttatggacgaactatgttgggcttattgctataataattgtatataataaagagttattacctcataagagatcagagccctttatagacatacttaagtgtgattgattttcactctgaatcctcatgattttatagaactttatggtttctcaaaatacattcatatacattatctcatttagatccttgcacacttgtatgagatacactggttgtatattattatccccattttagagatgagaaaatagaagccgagtgagcaacttgcccaagcgtaccctgataggaatagaatacgaggtaaatcaagggcttctgactccacatcaagctctttttctgttgtaccatgctgccttatcttgaagaaatgagtgcagacaagtcaagccaattggcaatgtttccttagctaattagcacagcaaataaatgctagaaggtagaaatgggcctctgacttgaccaggtcatagtaattttcattaggtgtgtgctctatttctcttttgttcagtacagcattagctttgatctgcctttgttttgatattcagctctggggagactcactttaggggagatgaatgattttctaaacataagtcacggtgctgtgggtggaatatcataaaataaatagaagcaaacacatcctttttgaaacaagacttatattaaataaaaagaattgtatgtttaatttgtttctaatgatgcagtagataaacaacacattagacaaatgttgtgtggaaataatattaaaacatataataagtttattttattatattccaaattatgtctttattgtgatgcttttataaaatgctttgtcttcatattccatttaatttttttcttttgccaggtttttggattatttgtcagatctgtgtgtgtctaataccactgctatccctgtaactcaagaactcatctgtaaatttatgttgagtccaggcaatgcagacattctcattcaaactaagtaagcccagataatggatgcatcattttcctgttgattatttgtaagcactgtaattctttgtcatatttacaagtgtactttttagtagatttttgtatgtgctatttatttgaagggtggtctcaatgcaagcagacaaccccatggagagctccatcctttcagatgacattgatgatgaagaagtttggctctattggattgacagcaacaaggaacctcatggcaaagctatcaggcaccttgctcaagaggcaaaagaaggcaccaaagctgacttagaagttcttacctattacaggttaagtattatagacaatcttacaataattcccagtctcacatattaattgagaactggttctctgtagccactagttaggtatctatgaagaggcaattttaaaagtcatgtcagaactagggtagctgaaatatttagtattgtttaaaatattcaaaataaaagttaacatttatattttctgcatacaccacttgtaatttcctggtttctcactagcttggaattattgtgcagccaaaggctttgtcctcatattgagtagagtggaggcagatgagaggcatgttaggacctaggtgatggagttgagagggatatagacatggagctaaggaaattgatctggctacaagggtagctcagagcaagtaagccagtagtttagtatagagtggattatgaatatgtggtgacctagagcctaagagaaactggtgcctgtagttaacgaaagttcagccccggaatatggcagcggaagtactgaaggcagttcctggtggtcaatatattgggagcaagaacctagctggcatctttgagttgcaggtatagaaacccaaggcagaagccttggggccaagttgggcccaaatggcaagaatcagacaaagacagatgacgctttgtgctccctggtttctacagctatagcaaccaaatcaaaggctaattcttaatctcaaaactgggctgataagccaagtgactcatgccatttggactgatcacttttggtttgggaactgagtggggcaaaacctggagtgtagacactagagctagaagctgagtgaggctggcgaaggtggagagagatggtttcatgtgagctgttacccatagccttcagcctgagtgcagtatttgtcattctaggaaacccagaatggagtgcctagtgacactctccagcagacacattttgctgaaacaagtaagaggtattgtaactgaagggacatagagacagtttcatatatgtcttgtcatttgatcttaatggttaacatactacagtcaagagtttgactccaatatcatgaatgcttggaaatacaggtgtcttaaacatagatactgattggtactatgacgtttaaagatttccttgagataagacaataatgtaatatgtttaccatttttaaggtaccagctaaacctctttgcaaggatgtgcttggatcgccagtatctggccataaaccagatttctacacagctgtctgtagacctgatcctgcggtgtgtgtcggatgagagcctgccgttcgacctccgagcgtccttctgtcgcctcatgctccacatgcacgttgaccgggatccccaggagtccgtggtgcctgttcgctatgccaggctctggacagaaatccccacaaagatcacaattcatgagtatgtttggaaaaaggtcttgaggctttggaattcatcagatgaactccacgtcaaatgtctacagttttgaaatgaaacatgtggaaaggcatttgtgtatcctgtcttgggttgttaatcttctaaatgcaaataagatactcgttttgaagggtgaaatgataactctcagtggtaataaaggcactttctagaaaacagtaaataatattgatgtaatgagcaagaattgtaagtacttaatattgtggtagactgatataactgctttacacgtgctaactcatttcacaatagccccattttacagatgaggacccagcctctaggaaagctaactaatttatccaagattatgcacccaggaaactacgtgtgttttcctatttttaaatgattgcaatcagtttaacttgcgttatcttctttctctatttccagatatgattctataacagactcttccagaaatgatatgaagaggaaatttgccctgacaatggaatttgttgaagaatatttgaaagaagttgtaaaccagccctttccttttggggataaagaaaaaaataaactgacatttgaggtactttgtccctctaatatttaggatgttttggtaactgggtagtttagttcatgaaggtattattttctctgctttttttttttttttttttgagacagagtctcactcggtcgcccaggctggagtgcagtggcatgatctcggctcactgcaagctccgcctcccgggttcacgccattctcctgcctcagcctcccgagtagctgggactacaggcgcctgccaccacgcccggctaattttttgtatttttagtagagacggggtttcaccatgttagctgggatggtctcgatgtcctgacctcgtgatccacctgccccggcctcccaaagtgctgggattacaggtgtgagccaccacccccggccttctctgccatttttagaagatagatttggtgctttgatgtccagtacaaaacattttatttataattgtctattaattactatttcccttgattttttgtttcatttgtgtaagattttttgcatgtaataaagaaaggcagttttgcatattttgtaaaatgtttggatacttttttttatctctatggagatgtttttattttcaccaaactgaattgaaatactttcagtttggggatgtagtgacaaaactagagaaaggatgctgttacttgataactggtgtattagctacctactggtgtataacaaattactccaaaacttgcagcctgaagcaacaaacattatcatagcttctatgggtcaggaacctgggaatagcttagctgggtggttctggctcagggtctgtgatggggtagccagcaagctgttgactgggattgcagccatctagggctggacagtctgtttctaaggtcactggaggggttgttggtggccacacctccttgctggctgttggcacctcagcttcctgccatgtgggcctttctgtaggctgcctgggtgtcctcatgacatggtacctggcttcctcagagcaagccatctgagagagagagagagagagtacaagatggaagttgcagtcttctgtaatctaatcttggaagtgacatgtcatcacttctgttggttacttggaccaactctgatacagtgtggtagggggagactgtgcactggggccacatcttggaggtagactctcgcacttggaatgtcctgtgcgatccacaagaccacaaagcagcatagggaacatagatttctgggcaaatttcttggataatagccatttattaaggtaattaattgatgcaaccatttattaagtggcatcctgctgacttaaattacttaatgtttaattaggatgtaaataattctagtgtaaattttgttaagtaccttaaagcactctgagtcttgcttggatttagttctagacttgaataaatcaaagttcaagtggttgcttttgcaagtattttaattcctaggtgttaaagaattaggaagtttagaaattgctgtgctaatttagataataaaaaagccaatgtttatttcagtacccaatttttttttccactctttcaccctccccctccccgcttttttttttttattaaggtggtccacttggctcggaatcttatatactttggattttatagtttcagtgagttattaaggctaacaagaacacttctggctattttagacattgtacaggcccccatgtcatcatactttgaaagattaagcaaatttcaagatggaggtaagaattttgggaaatgtgataatatcattgttattacttggaagtaagataaaaaacaaaactacagagaaggggttgctattgtgtacctgctaatatatgtgtgcatatgaacacaattcctatgacagggctgagtgataataaggtggatttacaaacatgcatctctgtttataatgctaaagctttgaaagatgaattcataaggtcagattccatctttagcaactaacattatagccaagccacttgtgaaaatattctgtgttaaaaaatgaaaacatcttgatgtttgtggtcatgtggttcaagcaattctcctgcctcagcctcttttatttttacaaatacagatgaaattataaggtgtcaaagagagaatagatttgaaggctgtgctccacagcagagcttagacggatgcaaggaaggccaggcacggtggctcacgcctgtaatcctagcactttgggaggccaaggtgggcagatcatgaggtcaggagatcgagaccatcctggccaacatggtgaaaacccgtctctgctaaaaatgcaaaaattagctgggcatggtggcgtgtgcctgtaattccagctactcgggaggctgaggtagaattgcttgaaccagggagtcggatgttgcagtgagctgacatcgtgccactgtactccagcctgacgacagagtgagactccatctcaaaaaaaaaaaaaaaaaaaaaagaaagattcaaggaaagggctgccaaagtatcacgccagagaaggagtgaatgccacgccagtgtgggaacctgtggagtgaagtggataagagaatgggttttcaagttagagtatctgtattcaaatcctgccttgaccatttataaggtacttgtcttctctatgatttttcttttctcatctgagatatgaagatggtaataacaatatccttctcacagtttccttgcaagaattgagggaatgtatacaatatattcaatggactttcaacagtgcctgtctcataagtcaatacaaagtttttatgacgattgtcttgggttggataccctaaaaacaccctgatctagaggcttgtttgcagaaggtatatcgaagagtgcacttggatatgtacctgtaaggaagtgaggaaggtaggactgtgcaggcagagctcatctgcaatgcagttatgactgagacctcagctcatcctgtagggagttttggagctgggatgctctttggaattgtcacaaattaaggcaaagggggccaccctttgtgtctttgtatcagccagctattagctacttggcttcatcctggagggggctgtgtaacattgggtaagagtctggcctagtgagaggtacagctgtaaatagttagcaacaagaatgcccagcagctgggcccttaagggcctcagccttgaaaaggggacatgggtggagcacaatagtatccactacaacatccactacagtattaaaagggcaaaaccagaaacctaatttcagacataaagaagaaatacctagttaagaattataaatgagcaacttacagtaagctgaagtaattaattgctgctgcccaaatctcaattccttttatagctttcaaaaaactgtacaaatcaataagaagccaattgaaccacagaaatccctcaccttcagcataactagaagcgaggggacagtgcaaatgctagttactgtaagtagaaaaataaacattcatttttagtacagctgcctggtgagctcccattgcaagctttgaggatggtgagtggtttttggagaaactggggaagagaaaagggatcgtgtgcaaagggaatgaaatgaaattgtatgaaaatcacccttagaaagagaaagtttatctaggtgtgaaaatatggaaaaagtatccaggtagataagagcaccaacttaaaaggaagggacttgaaatagcacagggagcagctgtggaaaagcagtgcttctagggatgaacaaggttgcaggtaagggaagggcaccccttcgagtcttttggtgaaagaaaaagaggcaagatggggagatctagaataccacaagacaaaagaaacctgaaacatcgatggacataccactcctccaccgacctctaccaaaagccaaattttaaagaaactgcacttcatgactctgacaggagggggcgatgttgaacaagagatcctataaacccgctccttgtggatcctgtctgctgaatgtgtaaatgtcatcggtatcactatgtgaaaccactgtaagaccaaaacagaatggaaaaatctaaacacctcagtggatggaaattcctctctgaagagtaactgtgaagcagaagaatattgtaacatggtactctaaatggaattaagtagcttcaagcacagtggactatggaaaacagtttgattcataaattcaaaaactaagatcagaaatggaccaaaacccaagaagaaatgaaatgaaaattgattgaacttaggaaagaaatagaataaaatggttggctttatttattcatttattttttaccaatacagattaaattataaggtgtcaaagagagaatagatttgaaggaaaatcaaataggtgacactgaagaaaggcaggagaacaatgaagagaatgacaatgatccaaagaaacaagtgatgagggtgagagggaaagaggctgaaatggaagaaaggcaaagaagagccaccatatgaataactggagtccctgaagaagaaaaacaagaaaatggaacagaatgagtatttaaaattgcaatccaagagaacatttggaaataaaagacaacctgaatctacatggtgtaattatccagaatggtaatctctaagagcataataagatgattatatatagtatacattcagaaagagaataataagggtttcagagaggaaccacgaaagcaaatggagaaaaaaggaaagcgtatatgaatattctttactattattgcatctttaatgtaaattgaacattttataaaaataaatctatgagcaacatatgaatgagaaaaagcaaagaccaagaaccgtagttgttaatcaaagagcagggacatgcaggggtctatattaattccgctgcctgaatctcactagtgagactccttttaccactcccagagggtacataacacttgaaatgtccatactaaagctgcttgttatgcttttacaatcttcaatctaaactaaattattcttagaaagctagaagttgatcctgacttttgatctcactgcttacaatctgccttcagtgtttcaccatgaagagtattttattaaagacatttttttttagagcagttttaggttcatggcaacattaagaggaagatacagagattttttatttatcacctgccccccaacatgcatagcgtccccatatcaacatcctccactagaggggtacatttattacaactagtgaaccaacattgacatcattattcccaaagttcatcgttgacattggggttcactcttggtgttgcacattctatgtatttggacaaatgtataatgacacgtatctaacattatagtatcgtacagcatcttttcactgccctaaaaattctctgtgctctgcatattcaacccttctcccacctcctcaccatcccctggcaactgctgatctttttctctttccatagttttgcctaaggaaagtactttttttcttggaaaagttgttaccttgtttgctctctccaccgtcctgtttatatctgccctcaaagacacataaatttaatttctataattctcatattttttagtgaattccactgacttctagataccttaattattctttcagcaatctgataataatttattaatttatttaacaagaatgtattgaagaattactacatgccagacacagttctagtcactggtaataagtaatgaacaagataaacaaagttgttagccacagggaagacaattaataaataaatgggcaaaatttctcctttctcctattgggagaaatagtcagattatctatctgtctatctatctataataggagaaacagccaggttatctatctgtctgtctgtctatctatctatctatctatctatctatctatctatctatctatctatctagtctatctatcctgtaacatctgataatgctgtgaagaaaaataaagtaggtcaatgatatggagactgatggagtgagggagggtagaattttgttttaagtttggtgggcaatctctggagggatttgagaagggattgatatgatctgatcatgttgactgctgaatggagaatagagaatatctatgtgggcaaaaatgtcgaaggctgagaaactgtttcagattaaaggagattaaagagacatgacaactaaatgcaatatgcaattcagtactggatcctggattaggagaaatattatctatagaagatattattggcacaagtgatacaatttgaaaatggattgtagaaatatggattgcaggttatatttgaatattgattatgtcagttagatttcttgacttttgtaattgcactgtgcttagctaagctaatgtacttgtttttagcaaatacatgctgaagaattgaaagttgaaagggcatgatgtctagaaccaactttcaaatagagcaggaaagatgtgtgtgtgtgagtgtgtgtgtgtgtgtgtgtgtgggtgtgtgtggagacagatgcaaatgtggcaggatttgtgaatctaatcaatctgagcaaagtctatgtgggagttctttgtactattcttgcaactctttctataaatttgaaagttttttaaaacaaaaaagttaagaacttaaataattaatctggtaggaaaacgatttatgttatgcaaggtgacaattcaaacttcaagaatgatcttacaactctactaggagatgtgttattaatattatagctgggttctctcttagactataaattcctaacaaaagttctgttagactgtataaattcttaacagaagaagcaagaagaaacacttttctggaatctccaaatatggagataggattgtcaagcatgggaaaaattcctgtggtgcagggtgagacaaaggtcgatgccagagaggaaatcccagattgtggaaagtacctagagaaaaaaaaagaaatattattttaaagatcaactgttaggagtcatagcaatgttaccacattacaatactctgtatcatcatcttggctctttgatatctaaatgatttggattgtattttcttcttttttttttcatatggactcctctcatactgtaagtatttttctcttttaatgaaactttatcttcaatgggaagtcatttgcaaagtacaattaaaaaaaaaaaaaaaagaaagtggttttataaacattgttgctagatagaccagttcctttaagtaaatgatacagttctgtatgctcatatcatgtcaggaaaattttgtgtactagaactacatcttttttatccttacttcccacttactaatttttctccagcacagttggggttggacatgcagaaaaatgtgtttggcaggtcagacgcaggagagcagaagaggaggcatatctagaaggaaaaggctttacagttcctggagttccattttttgccagcctcagtggcgccaggcttaaataggatgtgcacgcacagcattcatttgttttttctgggaaatcctgtagctttagatgccagtgatgagtgtttgaggttgtagagatggctggcttggaaagtggcaattacagaagtttttttcttctgcatccttggtcacacagcagcccacctcagtgtcattgtaagttgtcctcatcctagatctggttgggggtctgcgtctagcttccaggctgtggctgctccctgtcacaatggcttatagttggcacgctcagcagaaattgctaggctcagaagcagctttttatctttgtaccctaaaggtggtccgttcagaaaatgattgaggcttgctcatatggagacacagggagctggcactgctgtggccttcactgtagtgaaatagaagatcagatcttcaggactatcaatccaatacctttcattggctatacatttacttaagaaatattgttttcaaacaaatgtacttgctcccaggaggctgtgtggttgagtcaatttgctttgcctaatacttacgatttgctctcagtgattttaaatgcacaggcaccattcagtgtaattgatcttttgagtagaaggattatggcaagccatgttcttctttgtcacttatagaagttaaaagcaaatgcacatacaagctgatgaactggatattttccatattctttgcaaacatttcacttttagaagcatacatctgttttatacttgctaaaggatatacaacccaaagctttctatttctactaataattaagagcccttttttcttttacaacagcatgggtatattttattctactggagagtcacttaaatagttgaggacaaatgtgaatcccacttacacatcttctgtggaacagcatgatatgtgtataactctgaatcattcgagtatcatctccatgtgaatatgcatgtggttagaatagaggagtggacacagtctggaaatggtttgggtctggtttgttatttagttatcctgttaatatccttctacctatctgtgcttgctgtttgaacgggactggggttcaactttggatctccaacatggaacaataaagtctacatcgttcagtgaactttgggcataattactgtgtctaggacaccactacaatttcttttcactgttgtcttcctgcccatccttgaactcaccataatttgaaaaggcagtagatcatagaaaactaccaaaagaccaaccaagagctaaatagtttcttcatagcttctctcattttgcttttgctcaatttcaaattcttgggagtttccatagctaagcactgaaatgtgggcctattcccagtcaggaaccagataatcctttttgttggtatatatgttatgatgtagaaaatgaggagtcacttaaaaaaaattcaatggagaattccatttatttgtaggatttctttttctttgaggattcagagttggaaatgaagtgcctttggccttagagaataagatacaggcaaccacaacagcctggaattatcctcctttcctaaaataattctgctgtcccgagtgacttacagccctgtggacccaacccagggtagggcggagacaggaggcagggtagtgagatgtgctttgaatctatctatgtccaggagtaccccttgccctaggagatttggggaacaaagtaagaggatgtcaactctccatctcctggcaaagagccacttgcttgtgcagtttaattttttgtttgtttgtttgcctttatagggactgcacattatctaccttgaagtgctttttctggcagcatagttactgttaaaaaggagaagggaaattgagatgagaggggcggggcagaaacatttttaaatattgctttatgggtgagaaaggaagaaaatatttgcagacaaaaaaaaaatctgccaggaaataatttcttcttttataaaactacgaggttagtctaaatatgatctttgcaatctcttttagttcaaaactgattatttgaagattagtatgtaatcttcctcgttcattgaatggcgttcttcttttatgtgtgttgcaaaacaacctttttagaaaatatctgtgaagcttatcttctgattaatagctatgattgttctttgtaagacaccagcttgaatgtcctgaaaccagaagccctagtccactggatatactcagagtatcttaccaaaaaaaaaaaaaaaaaaaaggaaagaaagaaagggagaaaaataaagacttaaccgagtgtgaggtgagaccatgaaaaagtgtgtatgtggaaatgggggatcagaaagaatagaaaagggtttagtataaggatcaaaaccaaagaacacatacgtacaagctagtgtcctattacagactcttcccagtgttcatctcttttgaatttttcacctgactgagctcttttcaggtctctgcaaagcagttaagtttgcagtagagttcacagtgctaagaagtgttagcaaagtttacatgcaaagggaaggcacaaccaattaccgtttatcacttgaaaaactcgatttctggacttagcacttcccagcaccatgctgcctctgggcattcaagcttattcttcttgagatggctcgattctgtctgtcctccctctgtccatgctctgctttcagtgaagtccctttgtttctgaaagaactatcttatctccattatgtaccatgttccccacacttacccatcttccatatgtggttcctttctccctacaccttctggccatccaaatcacacactcaagtcaagggaagctttagactctaagaaaaggcaggaacatgggtataatcccatccacagtggtaggtttccttcttgtccctttgtgtctgtgtgtattgtatcagatgagcatgtacttctcataacatcttgaaatccttgcactgatttttaaataacagcagcaatgaccacaattctcggcaactctagaattacgtattgccagttgtgttcctcaggaagcagactctgggagaggattagcatgaagaagacttattagggagagctcttaggatcaacaccagtagaatgggagggaaagcaagattgagaaagggagaagttgggttgtgatgcagtttagtggaggcttctgggaggttgaagttgggatgtcttcagggctgtctccattagggtgagggggctgagcctttatgtccccgtaggcagctctggaatgggtgagtgaccgtgcttgaagtacctgtcttcagactagttgtcttagtcggcctgggctactgtaacaaaaataccatagactgggtggcttgtaaacaacaagcaattatttctcacagttcaggaggctaggaggtccaagatcatggttgatatggtttggctgtgtcctcacctgaatctcctcttgaattgtagctcccataattcccacgtgtcatgggaggggcctggtgggagggaattgaatcatgggggcagtttcttcctgtgctgttcttgtgttagtgagtaagtctcatgagatctgatggttttataaaggggagttcccttgcacatgctctttgcctgctgccatgtaagatatgactttgcccctcctttgccttcagccatgattgtgaggcctccccagccatgtggaattgtgagtcaattaaacctctttcctttataagttaccgagtatcgggtgtgtctttattagcagtgtgagaatagactaatataatggtgccagcagattcagtgtctggtgagagcctgcttctggttgatagatggtgctttctattgcctgggccccacagctcaccagggcatcctttgaaatccaggtggaggcagcagctcctccccactcaactcccccacagctttgctggacacagtgcatgctgtaatggggtccactggagccatacctggggcagcctaggagcccagtcacagggtatgggaaagtgaagctcatgatgtgaggtggcaccccctcctttgaaatctttttggccgctagctccttatattctgggcctgtgatgggaggggcatccctgataatctcctaaatctgctggggtcattcttccattgttttggacagtaggtcctggcttctctttaggtggctaattcatctccccattgtcatgataaatagcatctggcttcccttgagatgcctgatccctagtaaactctttacgaatggtcacttggccacacttccaaacagactttttcatgtttttcaatatggataggctgaggattttccaaaaattcaagttccgtttcctttttaattagcaattccatctttaaggcatttctcttttcttatattttactgtaagcagtcaggaggaaccagacgttctgtcaacactttgcttacatatttttcacccaaatattcaatttcatctctggcaagttctaccttccataaatcagtagggcatgaatacaactcagccaagtttattgctactttatacaatgatggctcttctgtagtttccagtaagatgttcctcatttctatctgatacctcctctgaatgacctttaccatccatatttctaccaatgttctgtttgtgaccttctatgaagtctttaagaatactcttagagaattcaaaaagtattagagctacatgctttctctgtagctctcctcctctcctctgagacttcacagaatcatccttaaggatctgtttatggcaatgttggctttttcttggatgcacatgaaaactcttccagcctctacccactacccagtttcaaagcacttctacattttagatatttgttatagcagcatcccacttcttcgtaagacaattttctgtcttagactatttggactgctataacaacagcaacaaaaataccataaactaggtagcttcaaaacaacaaacatttatttctcacagttctggaggctgggaagtccaggattatggtgcctgcagatttggtgtccagtgggggtctgctttttggatcacagatggcaccttcttactgtgtcctgacttggggaaaggggcaaggggaatttttcttgggcatctttcgaaagagccctggtcccattcatgaggactcctcctccatgacctaatcacctcccaaaggttctacttctaacaccatcaccttgggagagagtatctcaatgcatgaatttcggggggacacaaacacaggggctggcagttgagtgctgtcttctgagtagcactccagcagcttggggagtagacctccacttctgaaagggaatctgggcaggagcatcacagcatccaccacaattatcttcctagaaaatgccctgattggaaacattttgggtcaagactaagatcttgtcttggtccattttgcacagcaggccttttttggaatgctgtttttcagatgctgaggaacatttctgtgccattgtcatgttctgagtctggttctcttgtcagctttgtgctatgctggctgcacctctaagtcctttctggattaatgagtaatatcttttgcagaatgcctgagactgggtaatgtataaggaacagaaatttattgctcacagctccggaggctgggaagccaagggttgagaggccagcatctggcaaagatctccttgctgtgtcgtctcttagtgggagggcaaagagaaagcaagagtgtgagagagcaagatagcgctaaacttattctttcacaaaaaacccactcctgggataatgccattaatccattcataagggtggtgctctcatgacttcaataccctttaaaggtcccacctcccaacttcacaacattggagatctagtttccaacatgtgagctttgggggacacattcaagtcatagcaggtgtcataggaaatagagattatggagaaaaataaaaataaattataacatttaaacatgtaataaaattctagacatgaaaacaatggctagaagcttcctatttccaggtgccccagaatcactggcatcagaaacctgctctaggcagcaagccttttgcaggatgctgttcctcaggagctgagaaagatttttctgtgccattttgaagtcctgaggctggttctctcaccagctttgtgctatgctggctgtgcctctaagccctttctggcttaatgtgtaatgtcttttacttttctgtttgtttgttttttccttctaagcttttataagttttataaaaagtatctgtatgactattggactttcttttagttgtcaacggtgcctaaaaggactctcctcattccacctcccagcttttctctgtgtcaagagggtgtcaaacacatgctctacactagatcatgttccttttaaaaatcaaatgcacatagtaaagtagggggagaataactatgtaacggatgccaggctacacatcaggcaagggatttctatgtaaaggtatctattacttatatagaatacctagcacacctctaggtcttttgcatatttttattgttaatccttattgcagtccagcgtgtcggatattatggtcctgattgtgtccaggaaataagcttttcaacagcttatatactttgcctaagatcatacagcttgtatgtagcttgctggaaattttgaattcaggtttctttttctttttctctcttctttaaaaaaaaaaacctacagctttacagttgatattctttctattattattttattgctttctttatacacagttgacttcctcatgtgcaaagactcttttctactttttccaagtttcccaagaaagttcagcacaacgtagtacatatctacgaaagagttttgatttggctggaagttatttttcaggtcatattaaagagagattttttttttttttaaacaaagaatcactcctttgtgaatggttgtttggcttgtctcagaaaagtttcaattgcaagtcttaaaagttttaccagctaaagatctcttgaagctaagtattcctcttcctttcctgaaataaatttgattgttctctctgactctgtgttttgactctttctccacattccaacgtaaggatctttctaaatcacatactctacttctttatttagctctcatcatctccagagaataataactcagctctttaaattggtgcccaagggtcttcataatctgagttagacatctccagctctgtctcctgctgtttccccagtaatactaagcaattgtatctccttcgacacctttctgtgagctactcatatgagtatctcagatatactttcatatctcactgttgttaggatgaatgtgtgtgacatgccttataaagcatttatgcatttgaagcacaaaaatatttagagaccctaatatttcaaatatatacttgtgtctttcttaattttatgattatttttcataaggttgtcttttccaatagacttatagaagactctatggttcttagagttactacatagatgattcaataacagagattcagatttattgactgagagtatcatactggggggaaaattatcaaaatagattctatttctggttctatgggggacttgtaccatgtctaatatattactatatacctaataggttttcaaaaatatttattgagtgaaatgaatttaatatatgtaaattatatgctttatacaaatatgtttgaatcaaaacaatattactagattgtaacattctaagtatatgtttttttttaattaaatttttttttaagttctgggataaatgtttaggacgtagcggtttgttacataggtaaacatgtgccatggtggtttgctgattgtttttctactcacattgcctaactgagttaatagggcaggatcaatccctaagaatgactttacaaataatgagaatgactgaagagggtcatgttgttctaagctgtctactacagttatttttctgtagttataaatattgcttgagcctcagcatctgatgtcttcaagtgttaatacacttgcataggctccccagttctcacaatctctggtgacctatgataaggcttattgttagaacccaacacaaacttatagaatgctggcatagacccatttgactcagcaatcccattactgggtatatacccaaaggattataaatcatgctgctttaaagacacatgcacatgtatgtttattgtggcactattcacagtagcaaagacttggaaccaacccaaatgtccaacaacgatagactggattaagaaaatgtggcacatatacaccatggaatactatgcagccataaaaaatgatgagttcatgtcctttgtagggacatggatgaagctggaaaccatcattctcagcaaactatcacaaggacaaaaaaccaaacactgcatattctcactcataggtgggaattgaacaatgagaacacatggacacaggaaggggaacatcacactctggggactgtcgtggggtggggggaggggggagggatagcatcaggagatatacctaatgttaaatgacgagttactgggtgcagcacaccaacatggcacatgtatacatatgtaactaaccagcacgttgtgcacatgtaccctaaaacttaaagtataatttaaaaaaaaaagaatgctggcatagaaaggaaccatataaattatctatataatatatgagcttcatatcttcatgcaacacccattacaaatggtcacataggatctccttgaacacctagagtgaccaagattttacttccgcaaagggtaggcctttcttatttttcatagctctaattattaggtcttttttgtttggttatcctatatgtagacttccctctcacttccagcaagcagccttacttctgttgcttgttgagctgcacagaaatacaacatcccttccacatgtcaggtctttctgtgcttgaaaatggctagcacatcacctgcgtcccccctcctctctgtatagtcctatgcaattcctgtagcagttcctcttatgactcaatctaatttatcactgatttgactggcacagaagcaaagatggctacattcgcctcattctgaacccttttataatgtagcctaggtgaaaatgagtgttttgttaacaatgacatagtattgattcctactaaacttgaactcaactaaaattctaatttgttttcttttacatcacattttcccacatcatgtacttgagttggttttctttggccctaagcatgtagcaccttttatattttgaatttaccatgttggatttaacctgttattttcttcctatttgtgtagttttggaatttggtagagtcattcactatattagccatcctcccttgtttcatgttatctttgcatttgagaaacatgctatctctgacttcacccaagtcaatgacgaaaatactgatctagtcaaggcaagaacaaagcagcaaagaactaaaggcccttctgtgctttaacattgatcagttacccagtattctttggcataatcacttaaccaaactcatacctatgaaactctacattagccaatacatgtgtctgtggtgtgagaaatcaagagcatcgttgcctttggtcgtggggctggggagaaatttggggggaattgactgtgaaagggcacaagagagctttctagggtgatggaaattttcagtaactggtttgcatgtggttcgtatggtatatgcctttatgagaactgctcaaacctttcatttatgatcagtgcatttcactgtaagtaaattacatttcacttatgaaaacagcatgtacattcatttattacttccattaccaactattaatcattgaagatcagttttgcaaattgaaatcttgagatttggaatattgaaatgactttgtcaatatttgacagtgatgaaatccaaaataagatgcagaacacagccactattttatatgaattgctttttcagttaatcctttgaataacacttctttagtgtgtgggatgtaaaacagttttcttctaagtagtctacttgatattcaataaaagatggataataacattactacactttggttacatgcttttggttggtttttgttttgttctatttctaagcccttgtaaatttggaatctgtaagcagtctattaatacactgtattcagtggtgttttatttagaatgaagaaaattaggtatcatattatctgcttcttccattaagtattctttattaaacactcttctgaaggacatctccatttagagtcaatattgtgtttcgatcatgccgtattataagacattatgaactataattatatgatgaaaccacatattcattagtaaggtggtgaccactataatggaacataattaaatggagaagagttgtttttcagaggtgtagcgaaagcatgcagatgtcctctacttttcatttttgaaataataccttacaattatatggtacttttttattgttcatggctttttttgcacatattatataattttattcttacaagaaggcccaacctattttataggattaagattttgaacataggatgatgacatgatttgacaaatatcacacttctgtaatctaaatctttcacttcgttcaaaacctcgttaaaaattgtatatcctttgtgaaactgtctttcactgccctcactctaagataatttcccagttaaaaaaaattcctaagcaattttgtgtgctgtccatgctatactactaccatcatatctgtcttgtacttgttcttaatttttttatgggcacattttatgttttcctgaccatattgtaaattcttcttcctttcttatatcttcccacctgagatgtccctggtatagagccagatgaacattaggtactttatgaatactttctgaacaagggctgcttctaaaattaaattgtataatataagcaaaataccactggtagtatgtggcacatgatatgtaataaaagctggttgggtaagatcacttcagaataatgtgagcaaatttatcatatgattaatggaaattctacattttcagtacacagttttaattggaatcttttcttctgtaattgcattagggctttctgaattctagtataaaaattttggaactttgtaaagtctgttagtgaaccaacctggtgtgggaaaacatgattcatgctgagatcagttgatgtgtacttgagactctgccacttcctagctatgtaaactggaattcgtctcccaacccccaccgtgctgtgaggatccaatgaggtgaagggtatatgtggcctgtggtctagcaaggtacacacaatatgataagcccctgataaagacaggtttcattattttcccttatctcattggtatctattttattaattttttccttttaataaatttttaagtaatgtgaaattatgtatgctttttgaaaaaagggagaagtataaaggaaagtaagcaaaaactcaacttgatgaaagatgaagtacctttaatgagacccaactttttatataaaccttattacaataagtcattctcatttttaatagttcattttgttatccaatctttgttattcatgcgttactttgacaaacatttattaaataagagttgggcatcggacactattccaggtgttagaaaaaggtagactccctgtcctcatggaactcgtgttttatgttgttggagagggggactgcaataaacacgcagacaaatatatgatatgatatgagacagtgttaatgccatgaccgaaatttaaagggggtgcatggattgagagtgatggaagttcttcagagagggtggccagaagaggtctacctatggaggtgacattgcaccacaaatcagaaaggagtgagggagcaagttgtgtgaccgtctggacacaagaacacaaggcaaagttatagcaagttccctgtaggttcggcacatggaataaaaaccatgcatgtatgtactacgtagaactagctatccagctttccaaaatactgtgatcttacttggaattgggactgctggttagataaaattgctttctctggctgtttaatcttgatcttccccttaacccaggttgctaccatattacctactgctctgtggttactagcttaattaaggctttgatcttatgctaatgtttttgttttctttgcatacagaaaagtccttttataacccagaccctcagccactgggaggaagtactgctccagggaatgtttgaaatagaaaactgctctagttctagaaagtaaagatattttccagcaagggcaggtttataaggagctgctaagctgggatgggaaataggaagacttccagaatcatgtcttcatggttgaacatcattcggtttcagatgagttattataacagcagatgcatttattcaaatccaactattaaaaatatgtttcagggaaaataatagtttttggattatccatttttggcctctattatgataaaacattgagctgattttagtagtcatagaacaattaaatgactgtgaacaattattcacaaaactcttagaatcaaatgtgtctgttatctcttataaatgctgagaatgtttcagaaatgtctgatatctaaacaacaagaaaattcaaattatcattttcttatgtgttcataagagaaaagcatttctaataaaaagagagaataaatataactttaaataaaataaataccagcagacttaagtaaatttcaatcaatattctgttaaatctcttacacctgctataaattcatgtagctgctagtggttgttgaacccaatagtgtgatcaccacagtaaaattatttctgaatagggcaaaattaaattatggtcagcacagctgtagtgttaggttggttaattccttattgcttttcactttcctgaaatgggcagtaggagcttggctcactggaacaatcaaagaacaaagcaatgtattccccaagcattcccagttactgctctcagtatgcatttgctatacctgtcttttagattttttttcttgagggaattaaggttactaaaaatatctatgtaatcatataatgaaagaacctgaaaagttgaccagtcattctttctaagcagtcccttcctttttttttttttttttttttttgagatgaagtcttgctctgttgcctgggctggagtgcggtggtgcagtctcaactcactagtacctctgccttccagcttcaagcaatactcctgcctcagcctcccgagtagctgaaattaccagtgcccacaagcacgcccggctagtttttgtatttttaacagagacagggtttcaccatgttgatcaggctggtctcatctcctggcctcaagtgatccacccgccttggcctcccaaagtgctaggattacaggcatgagccaccgtgcctggcgtttccttccttcttactttgtacttagcaaagatgacttccatattttcaaattatctcattacactttgtacacaaatgccaattctggctgctgggtttatataaaagacacagaaaagctgaatttgtaagcattaggttgttcagagaatttatattatagtaggctttttcactgaaaactttccagtcaatattaactaattatggttgagaagtagtacaatttctttttttgcaatgttgaggattaatcacctctgatttatctcaacagtttagaattagaagtttttctctggaggaatggatattagaagctttgcatggctgtgatttatgcagtgtctgacttcatgtttttcaagctgtaatggttcacaattttagcacttctcatcaccaccaagcaaatccagaaaatgtagcatttttaatttgaggcctctgagctggccatacatggaaatgtcaagtgaggtttgtggcgaccacgtgccacaggcatctgagaatgtggtatgactgagtgaaccctcccatttcattgacgacatgtgttacaaattactatggatctggcctctggattttaattccttggtgacaggatctatatttgggggaaagaattgtctgggctaactttctgtgtagtaatcatttggattaaaggattgttttccatgcaaatctaaataagatgcagacactgtgggtgccaaggatttgtgtgtgaatcaggggtaagaataacaaaggagcctgttctgtattagtagtgagaaagcatctcttggaggcaaacacgtatacatacttgaatcaagtctcagataaaggtagtggttaaatatcgatggctcaaaatcattgccaacaaccagatgtgcctccctgcagtccatgtagcaagcagggggagggatgttgaaatactcaattgctatgattgtttgagaaccacagacaatgaagcattctgcctcaaggctattctgatagaaaagaggggctggctcaaatccttttgcctcaattttgtccgaacttggaaattacacttatatatacattttgtcgtgttttttggcttatgcaagtagcagtgtaataaaaggtctcagaccttcaaaatgaaaacttctgcctggactatgccactttaggaaaaatgtaacttctttgtgtactctaagatgtattactgaagcactaccctcttacacttaaattgattccatatacagataagataatgaattttcaaaggcattttaccttttcacaatgtacagataatagtctttaccagtggcttaatggtaattgtggtctggaccattcagattctcttgtcatcttttacatattttctttttatttgtttgcctttcgatcctgtaggtattaccatggtttacattcttctcttagagctcagagttttttttttttaataaaaatctcatcccatcttatttccatttctctttctcttggtttacgccctgagacactgagggaaaggaaaattcttagccagattcttaggcctttgcttaaggcagagctccatgaacacccacgaagcaaagaccactgtttggaaaggaatggagacagccattcttttgcatccttattgcttcttgtgggaacttagaagtgagaagcagcattcaggctggagaacataaattgtcatagtgttaaggaggatccttggatacagctatttgtggtcagtgtaaggaacgtgtgcatgatacgaatgatgacattttatcagcaaataaaggagaagccaaattcagaaagagacggaaagagcgtgatccctccctcattgaaaatgatcatgtttgtcactagcttgtttccataatcacctcaaacattattgctttctgtggattttgagtaatggttttctattcaaattggatgaaggaatgggaagtgtattggctaatgcatatgtcttccccagatgagactattttttcttaaaataaaggtaacagtcctcctcacaagctctttttataagtgttatgaaaggaaagctaaaaaatccctggtttgaggatcagattatgatgctggaattcaatatctaaatgtttttaggcagtctttgtatccccacttgcaactcactttatcttggcgattagtaatcttcttttgcattattgtaaaagcaagggcctattggtatgacagttagtaggacatactgtgttacagaaggacctgatttggatgttagagcaacctgctcacctttgttacatgatttgaaagcattttctgaaaaaggaaaatttccatttttaaaagttgtcattttgaaacatgtctgcaatatcttaattttatctgtaaagaaagagcccaaacaatgcttatgctattctgtcttatcctgaatccttttcctggctgcttttcagtgtggttgtgactaactgagttttatagttacatgatctccaggggttgtgtgtgttgacttacggcattttctcatgccaggaaacaatgtgatgagaaccattcatggggtgggagagatgatgacccagatggtactcagtagaggctccatcttccccatgagcgtgccggatgtgccacccagcatccacccgagcaagcaagggagccccaccgagcatgaggatgtgactgtgatggacaccaagctgaagatcattgagattttgcaggtgtgttgcctaacagaagctaggtgacaaagatgtaattttgcttattgatttaacttcttaccctttttgttccaaatcactgtgtaaatattctgaaatgctatcaatataattttatttttttaagttaatgacaaacctggtaaaaaatatcacacagacgctatttaacatatgaatcacatttgtccattcccattaaatatactaatgatcatatctaacaattgtggggtgctttgaggttgataaactgctttcatgtgtattaaaaaaaattagtattgtccctgatggaactttaccttcatttgagaaggatttcagagcaagcaaagttattgattagtttccagctcttttcctatttttaattgaattgaacatgtgattccatatatctagatttattgttttagcaagaaagacaaataaaattttatttcttattaacaaaaattattaatcattggttttggtattttatatgtgacaatccctctctgtttttgtttctaaaggacaaaggaataactagaaaaaataacctagtctaatgcctaattttaagaatttaaaggagataaattattatttcatgcccattggtttagtgaatagacttcccattacgagagctataaattcttagcagtttttaagtttgaaaataccttttgtgataccttaattatagcatttattccagatttggagaatggagtttgaagttttcaagtacctattaggaatctaggtacagtttactgtgtctttcatcataatttaatatagactgagctaccagaagtgggttagtagtcctttaagggtctgtacattgttcatttaaagtaattagatttataatcataaaaggtttcacagttcctctaggaattccaaaggctgaatcctgagaaatattggcaggcctcccaatgctgtgttcatgaccctgaaaaatcgtttaaagttttcctgttcttaaactgagaaagatagcgatcacctgacccatggacctactgatccccagcttaccatcacctgactcatgggacaaactctaaaatacgtgacctcattttagcccacatttacagaaaaaaagcattagaaaaacaatctccaacagctaaaaaaggatgagatggagcttctacggctcagcagtccggggctgattcatttctgcagcgtctccttgaaccgctattcactctgattttctatccctgtgtctgggccggctccaccgtgcgtatgtgtctgagtactgtttctgaatgtgtctttcttggaatggctcttcaggaatttctttgtagccctactccttggtgctacaaggacttcaaggtcctgtgccttgtgccagctcctctcttccccctgggtcttcttttttttttacccccccatcactttgtgtatctctctcagcctctctcttttcatttctctctcattctctctctctcttcctggccctctcttaattctttttctctgcctttgtttttatccttccctttcctcctttctttctactttccacttgtttttcctgattaggcgtattagagaaatgaaagttttaattttgattgtatttatggaatacaatgctgcatgtaaacattgtcaactgaaagttagtttcatttgtttatgatttatcctttactttaaaaaataggattttaaacacccttccatgtgaagcatctgcagtccagctctgccccctgccttctgctcatggttaccaaatcccatgccctttctcagtcctcttttcccatgagctgtctcctgccctgcaaatccctttgctaccaagaatcagttcaatcaatatgtgttccagccctcaccacacgttcttaagagtctctggtgtttgttttcccctctagactgtaagttcttcaaaggcaggattgagatccttggcacctttttatgcccttagtgccttcctcaatgccttgtttaacgcatgtctggtgaattaaccagctgagtacagctgacatggaggatgtgtccataaaaagcataaaagtctagcaaaggctgggtgggtcgggggaggagagagagagagagagaaaaagagaaagagaaagagagagactgagacagacgaggacagagaaagggagggagggaggaaaggagggagattgattcagattgtgactggggaaccagtgaaagctgcgttaaaaaagaatttaaactggaacttggaggattttttttttttttgagacagggtcttgctgtgtcacccaggcagaaatgcagtggcacagtcttggctcactgcagccttgaggtcgtgggttcaaatgttctcccacctcagcatccatggtagctgggattacaggcacgcaccaccatgcctggctaatttgttgtgtttttgtagagatgggacttcgccatgttgcccaggctggtcttgaattcgtgaggtcaagcgatccctttgtctcagcctcccaaagtgctgggattacagccatgagccactgcccctgagagaggatatcttaaaatgtaattattatgaagtggaggagaatattcaaagtaaagtggacactgtgagcacctgtgcggaggcaagagcggaagtgcaggcactccagtgctgttagaaccggagagaggatgagagaaggggcgtaggaggagggagggatgggacacaggtggtatagatagagatgaagttagatgataccatgaaatgccaatcttcctaaaacttgggtgaccacattgtttactgtccaaatacgacacttttgagaatgtaggggcaccattaataattatgctgaaacaaaaggttaaacagggcctctctcaggcagacagggacagatggtacctatgtaaaaacctctcctttgatctgcagcacatcccagctttttcttctttgatttctgttgtatttagaccacatgatttagctctcaatagtttcctaattatgctaacagtgctatatttttttcccaactcgactattggctttttgagggcagtaggcttcacgtgtttgcattccctgtggcacctagcacagtctggagccttgctaggtacttagtttctgtccgtgcatccatgaatgagaacaatgacagcaacccaaactcaaggaaacacaaacaccagtgaggaaaatccatggtgtatagatgctgttacttaaactgtccttttagaacctggctttaggactgatcatggtatagtcacagtcatactattgtagctgaattattgccctactgtgtaagaatgagggtcacacctccaacagtctcctcccagagacaatggcactctgtaaaatgttcagtaaaatgacgtcatcattacctcttcatccagacccccacgatgcctctagctggaatattcagagagcaatcatagggagtcaaatgttctttccaaaaattgctttgggattttactgacattagctagtagaaatgaattcccttgcttagtcattgctgacaaacatgtggcaactggtgttaaaagcttctaactagttcctttgaaaggttggtacttccactgttattggtgtgttgtgaattgcatttttaaatactatgctaatgaaagaaatttatgttgttcttaatgtttcttatagtttatcctgagtgtcagactggattataggatctcatatatgctgtcaatatataagaaggagtttggagaggacaatgacaatgcggagacatctgccagtggatctccagacactttactaccatcaggtatctttttgtgacagtatttactctttttattttatttttctgagaacttgaaagtacctatcatattttaaaacataattatattttttgtgctttttaaatttttttattatactttaagttctgggatacatgtgcagaacgtgcagatttgttacataggtatacacgtgccatgttggtttgctgcacccatcaacccgtcatctacatttggtatttctcctaatgctgtcactcccctagcccgccacccaccgacaggccctggtgtgtgatgttcccctccctgtgtccatgtgttcttattgttgaactcccacttatgaatgagaacatgcagtgtttggttttctgttcctgtgttagtttgctgagaatgatggtttcctcatatttttacgagacaaaaatgtagatgtaatctccactaacgacatcaaagaactgagacagattgtgaaataactctcctagaatggtgtggagggtgtttgctgtcgtttgttgctaactcctatgaatgccttttcctttgtaatcttcaggactgggacatactgtttactgtgccattttacagaggagaaaaccaaggtcagaaaggttaagttacttgccaaaggtcctgaaagtagtggcacaaggattctctctgaggtctctccagctcgagagtccaaatcttttcagcatcatgatgttttggtgaaaatccaagagaagtttttctgcctggatcaaagagcagtgcgaaatgtagttatcagaaggataggtgttttgaagagaagccgttgcctgatccagaataaagacgtggcattccccaaagacttgaatgtggttgttggtctcattttgtgtgtgtggattttttttaaaaaaatttactttgtatagttataaactggaactatatttcaattttcatatttaaaaagtgtaaaaatgaagctaatttatctctgagcactggagcataacaaaagagcacagttatgattgtaaaaattttgtgactattgaaagaactttagaaaaactaagaaatattaaattaccatttttttttttggacaggtcaggccaagtcattataggctgaaaagtatgtcttattgaagatttagccggctaatggaattcttttcgtgagaataggatttgtacacagatgtgaaacttccttctaactgccaccactgtgacattaggaactctcccctcttcttcgtccatcaatcagttaggaatgattcagtgattacaagcatgtagttaaaatggatactagaccaactgtcctgctgtctgaatcattagtcccatcaaaaggcagcatgccgctgcagaaggacttgagcttgtctaagcaagacttctcttctggcacctttgcaatggtgttgtttttctgcttctcagaagtgtagaaccccaaagggctatttccaggaatgatatggcagaaccaggaagtcttgctggcggttgcattgacagtagcataaaaattattgactcccagaggcctggcttctggaaacatgagttttaagtgtcagtaaagtaccagagggaaagtctaggggcaccccagaaaaccctttctctctacctgatctctttcctttttttgtaccagtaagggatacctttctggggagaattatttttccacttttatatcttactgtgtttctttttacgctttggagatgagaaataagtggtgtattttatcatttaaacatgttaccttggccaggtatggtggctcacgcctgtaatcccaacactttgggaggccgaagggggcggattggttgagcccaggagtttgagaccagactgggcaacatggcgaaaccctgtctctacaaaaaaatacaaaaaaattagccagtagtggaggcgcgtgcctttggtcccagctactcaggaggctgaggcaggaggattgcttgagcctggaaggtcgacgctgcagtgagttgaagttgtgccactgcactccagcctgggcaacagaacaagaccctgtttcaataacaaacaaacacacaaaaagccccatgttatcttagtaaagttatcttcaaaatgttagtggtgtgggacagtaaggaatcatgattggttcacatagaaaaaaaaatgccctttcccacaagaaaaagggacggaattttagtaatagtaagcttaggtaaaaagaccatggtgtttggaaataaccatataataacaaggctaattgtatgtatattttgattctttaaagaattatcctcccatttatcactcatttaaattatatgtaagtatgtgcatatgtatgtatatatgatctatatatacacacacacttctctagataagaggcacctttgtaactggtgctttctgatcttttagacatatttttgattacagcaatacattagtttaaaacatagtttacattaaaaaattacattgatgtcttagtggaactatattgtgatttttttcaaactgttaattgacttaaatttttttaatttttaatttttgtgggtacatagttgatgtatatatttgtggggtatatggagtattttgatgcaggtatacaatgtgtaataatcatatcaggataaatgaggtatgcatcacctcaagcatttatcttttgtgttacaaataatccaattatagtcatttagttattaaaaaatgtacaacaaattattattgactatagtcactctgtatactagatcttactcattctgtcatactatatttttgtaaccattaatcatccccactccgcccaccccactacctttcccagcctctggtaactcttattctactgtctatcgccatgagttcaattgttttaatttttagcttccacaaatgagtgagaacatgagaagtttgtctttctgtgcctggctaatttcatttaacataatgacctccagttccatccatgttgttgcagatgacaggatctcattcttttttttaatggctgaatagtactccattgtgtctgtgtaccacacttctttatccatttgtctgttgatggacacttaggttgattccaaatcttagctattgtaaatagtgcctccataaaaatggaaatgcagatatctctttgacatacaaatttcctttctttttcatatacacccagaagtagaattactggatcatatggtagctcaatttttagttttttttttttttttgagaaacctcgaaactgttctccatagcagttgtactaatttacattcccaccaacagtgtatgagggttcccttgtctccaaattctcaccagcatttattattgcctgtttgttggataaaagtcattttaactggggtgagatgatatctcattgtagttttgatttgcatttctctgatgatcagtgatgttgagcaccttttcataaacctgtttgccatttgtatgttttcttttaagaaatgtctattcagatcttttgcccattttaaaatcagattattagtgttaattgacttttggtcgaataaagaaatgaagacaaagatattttcacatcaattgatattaatatgactattatggctcctaattaaaataggataaagaagagattttaccatttatctttgcagctattgttcctgatatagatgaaattgcagctcaggcagaaactatgtttgcgggaaggtatagtaacatttatatatctttatcttacttgtgaataacattttacttagaattctattgatactttgatattgttcactctatatctatttatttttagaccctctattgttgctaacataatttctgccagaaatgaagctgctaatttactctggaggagaaagcatagcttttctttaggtcaggtaaaaaaaaggacaagagagatgagatcagtgtattgaactttcctctgaattctttgcttttctttcctcaaataatgacagcccaagaatgccctttaactcccctggtataaatatcactgagtcttgtaaaacattgcttccctgaatcttagatatttgaggcaagaaagtaacttctttaatgttatcattaactttatatgtaagaaataaagccattttctgccaattggaaatacccatgattaaataaaacaagacacctttgacatgactagcctcctttgccatcaggaatcctgccgtttattgttttaatattgtttgttcttcagaaatgaagttaatagtgatcaaaaagaaaaattaaaatgtttaagctacaaattattaagcttctggtgctcatttatattacagacttgacatgagaccctaaaaacagtctgtacagtagtctttccttatctgctacggttacattccaagacccccagtggatgcctgaaaccacagctagtaccaaaccctgtatacactgtgttttttcctatatatacatgcgtatgataaaatttaatatataaattaggcatactaagagattaacaacataactaataataaaacaattataacaatatgccagcatcaccactcttgcactttggggccattattaagtaaagtaagggttacctgaacaagctctgtgaccctgcagcagtcacctgatgactgatacggctactaagtgactaatgatgggggaacacgtacagcgtggagatgctggcaaagggatgattcatgtcccaaatgggacaggcaggatgacacaaaatttagaactcgtgaattatttatttctgaagttttccatttcatattttaggaccatggttgaccatgggcaactgaaaccacaaaaagtaaaaccacagatagagttgggtagggtagtggggacgactacactaagcatcttattgcagtttttgttgttgtcattggaaagacaaacaagaatcaagaattaggggcacaaaaagaggatttttatctctagtgaacatttagtttagtttttatattatagtactagtttgtggtgttgtattttcctattgaagaatttcattattccctaggagaaatgaaccagtatatgatttcatcttgaaacagatggaccttttgttccagtggaacctcacccagagtcctcatacgccacacctgtggccactctggtgctggttcacgcacatgtgcgctggcctcccccactcctccccatctgtcatgtaggggtctgtagggccccaggggaaatcagtcatcggtgtacatccagcctagcacagctcctcccataaatgcttttggattgatgcagatgcccatcttttgtctatgccaaggtgaccaactcatcccagtttccctaggaacccctgagtcttggataaaccgggatgtttgatcacccctgctttcatggacagacacaagcttttctttatgattgtttcctcatcagttacatgaggaaaacaaagaaaatgttttcctgttcacttcctaatttggtaaaacaaatgatatacctctgagaatacgtatacaattctaatactgaagtgtagatgttatataaataggagtcactttagaaatgtttttggttttatagaaaagaaaaaaatccagttcaacttgacgatgaaggaggcaggacgtttttacgggtcctcattcatctgatcatgcacgactacccgcctttgctgtctggagccctgcagctgttgtttaagcacttcagccagagggcagaggttttacaggcatttaagcaggtaagattgaagagccctcaatgcatccacagcaaaagctctgaaagtgttaataacatccaacctgacttcatggctgcagaggtaatgacactgtgtggcttttcctggagacactttctatttttaaacagagacatggccttgtctatgccaggacgtgatctatttagaaggtattccccacaagtgattttttagttaatgtctttaaaacaaatgaaaggcaccaagatttgggaaggcactgggagataataacatgttaggaattttgttaccactgctattattttatccttaaattttactgatgaatttgggtaggagcaccaatagccctgaaataattattttatgattgaaaactgcataaatccaaaaaaacgaactgttatggatctaatctttttctttgtggtctttgaataagacatcaatcttgagattattaattagtaatacgtaagtgcttacatatgtttcactatttatttaacataatagggtattgatcatttaggcagttttacaggaatatgttaaaagaatatgaaataaaagggtagttatacatcaaatacgtatatgtatatgtcatataatacatgtaaattataagaaaataaaaacttgtatgatgaggtttagattgtatctattgatattttctcccagttgtttttgtttctgcctcttttcaaacagagtctcagaaaaattaacttcagcagtgaaattaaagttagggtatcttttaatcttaaatcactttgaaaagttttgctagggctcacttaaaaaaattataatgtgtgaaaatactggttaagtgttcacacttacttctaggtaggttttcatggtcaatatacatctaaaatattcataaatattctagaaatagtgaacttcaactaagattgaaattcttctgttttaggtgcaattactggtgtctaatcaagacgtagataactacaagcaaatcaaggcagatctagaccagcttcgactgacagtagaaaagtctgagctatgggtggagaagagcagcaactatgagaatggagaaataggggaaagtcaagtgaaaggtggtgaagagccaattgaggttcgtttcaagatctatttcgaaatactcccaatgatgtcttttaagtcagatatataaccacatgctctacaatcaaaattgttcataaagaaaaattctgttctgagcaacagagcacaaaattttcatttgctaagttgtcaattaactccgtaaactggcactttgtttagctcttatcaatttctaccacttcttacctcatctatctagtgtttcactctttgtcatttccacggtaaattctataattcagcaatcaagaaaataggaaggagtggaaggagaaaaaaggagtggaccctaaactgagacctgtagggagaggtgaatttttgtggacccttttgctgtggccatttttttgccaagcagtaattcattcctatcattatgcatatccttatataatatataaaagtatctaaatggaagaccaatatgctttattgccagtatgaaaataccaaaaatctaaagagtgactgtcatcttctgttgtattggcttttttagtgtgttaattagttgctgttttcacatttcactaagtacctataaccacttaaaaaatgttaaatactgctttagtagtcatgcttagataaagcacactagtaccaacatcataattgttaatacaaaaagttttgtaaatgcctgtctggtgttttatatagttgttttttaatctgcaggcatataagccgttttgatgggtttacctgccttagcttttgttatttgttggagtacccaaaatattgtgaagtgaaacgtgaaaacagagcaagagataattaatcaaaatgcttctgaaatgctttggaagtttgggacaaaatactggaacgtgggcttcattgcacactgacgtctactgggatttcctttgcggccctcgcagccacaagtagatgccctttatttcccttttggcttttaagttccacatgagtttatctcattggcagaagttgaattgaatttagaacttcagctataggggaatttgagaaaccagctctgtgatacagagggaccgtgaggggtgggaatgcttgctgaatgccaggtaataaagtgcatcataggaaggacaatgtgtaggttattagcatgggttttggaatcagacaccccagaatttgccacttggtatatgtgtgacttcgagcaacttattttcattctctaagttttatttttattgactatcaaatggacatcatcatggtacttagctcctggaattgctgtaaagattaaatgaggaaaccctatgcacgtggtaagtgtgtcagttaatatggcttcagtgggaaaatatgaacaacatgaaaatatatacaataaaatgacatattacttaccaacaagtcaagaagtaagactccagctttaattccttgcctcagtgttgtcatcatggatcagctggcttagttttgaaaccagtctttctcctgacggcatcatggcagtagcattctagatatcacatctgtgcacgacaacatcaagaaggagtatctatttctgggtctcctgtttaggggcaaggaaacctttcctagacatccctcaccttatttcatgtctctttggccagaacagggccagatgttaaaactctacaccagtggagtacaggattagtttagattaagtaaaagatgtcgcccaagctaggatacaccaccctgaattacctgggagaacgatagatggccgaacaaaactggattcttctagcagggaagaataagaaagaatgttggttagcaaccaacagtgtttttcaacattagcattcagtcagtgtttgttgtaattattgtttttatgtgtaacacactgtgttgtttactatggtggatatggaattatgaaattttagagttacaagataattgtagggataatcacctccagttccctatgtgatatatgtgttctctatctctaaatatctcacctgagtgacattatttctttaaacaaagcaaacttctgtagctggaaattcagtaccacctgaggtagcatattctgttgatattaaggtacagcttaagaaatagagtattgccagtaagaagttgatgtgctccctccctatataacagaggaaaccactatcatgaatttattttaacattttccttgcttagtagttttaccatgtgtctgtatttctaaaacataagaaatatatgaggtatatttatttagcctattttgtacatgttttcattgttcatccttgttgatgtataactgcaactcattcattttctctaacatatattattacatttatgcacatgtttatccagttagctgtggatggacatttgggctcttcccggttttggtgttttaaaagaaaatttgctactacaagcagtgctgctgtgaaagctgttgtatgtcacctggtgcacatgtttgggagattttttgggatatctacataggagtaacacatgcagtatgttcccctctaccagacaatgccagttgttttccctccactagtgtatgagtgttcttctagctccctatccttatgatgggtgtttttctcactttcccacttttgatgattgagtacacttgatatattatctccgctgtgattttcattttgctgaattagttatgaggttgagttttttaatgtttatttgccattttacttcctattccagtttagataaagctaaattctacacaggcaaatagttaagtcctaccgattcatgtgtacttactaataaggttaaaaatattcattcacttcaagtcaggtaatgctataagttcaaacttgaacatgatattttatttcttttttttcttgctttactgtgtttgtagtattttcaagtacaaggtaaaatagaagtggtaataatgggcatccctgtcttatttctgattttaaagggaatggttctaatatttcactattgaacataatgtttactgtacattcttttatagataccctttatggaggagcacattctcttcctagtttactttttaaaaactacaaatggttattgactttaattaaatgtaatttacacatctattaaggttatattattttttatttaatctgttcacctaaatgacataaatcttaaatagaacttctaccgtagtaactttgcattctagatttaaaatatcttggtgatttgtttttacattgctagattctgtttactaatactttctgtagaattttacatctctgttgccagtgaaattagcctgtaatttttccttccttccttccttccctccttcctttcctctttccttccctccttccttccctccctccctccttctgtccttccttccctccctccctcccttcctccttccctccttccttctctccttccttccctccttccttccctccttccttccctccctccgtccctcctttcttttcttttttctttccttttcttcttttctttcctcttttcttttctttctttctttcactgttcctatcaagcagtagtattgaggttacactagtcccataaaatgagctatagaatattcctttttctttgtgtaacattagaaggatctgttcataaatgtttggtaaaacctgtctgcaaaactgtctggacatgatatttacattggggaaagactttgactactgattcaattttttaatggttataaattcattcaaattttccattttgagttaatttgttgtgcatttttctagccatatattgaaatcttcgaatttattggcataaatttgttcatattcttttgctatcttttaaatttctgctgtattcatagctttgtatccctttttcattctttgtatgttttgctatggctctcttcttttctctagctctatccagctcaatctttccagagttttatgtacagtttacccttgaacagtgtttgggggatggtcaggggtgctaccctcccgcacagttgaaaatttgtttataacttctgactccctcaaaacttaagtactaatagcctactgttgactggaagccttactgataacacagacagtcaattaacatatattttctgtgttgtgtgaattatgtagtgtatttttacaataaaataagctagagaaaagaaaatgttaagaaaatcgtaaggaaaagaaaatatatttactctctattaaatggaattggatcatcataaaggtcttcatcctcatcatcttcatgttgagtagattcaggaggaggaggaagagggagggttggtcttgctgtctgaaggggggcagaggtaaaagaaaatctgtgtataagtggacctgcacagttcaaattcatgttgttcaaggtcacctgaattttactcatctcttaaatatagtctgttttgggtttgttgagattctggatttgtttgctattttattatacttatcctactatactctatcgttttatgttgacagacttttcgatttaaaaaaaattggtggtataattttcttcaaaggagctgcattccctgagttttgacaaatgatatttttattatttttcaatattagatactaaaaatttttccattgtgagttctttctcttagaattacttggaagtgagtttttaaatttccacatgcggccgggcacggtggctcatgcctgtaatccctgcactttgggaggctgaggtgggtggatcacaaggtcaggagatcgagaccatcctggctaacacagtgaaaccccatctctactaaaaatacaaaaaattagctgggtgtggtggtgggtgcctgtagtcccagctactcgggaggctgaggcaggagaatggcgtgaacccgggaggcggagcttgcagtgagccgagattgcaccactgcactccagcttgggcaacagagtgagactctgtctcaaataaaataaaataaaataaaataaaaataaataaataaatttccacatgcataggcaaaatttaccttttttgttaattgaattcttaattaacttgtgaccagataatttagttattatgatatcatttctccaaaattcattgaggtttgctttttgacctattgtacatccaggttttgtaattgtccattgtggcttgagaagaatgtgaatgggtgtaggattcttaatagatgactggcaaatcaagcttattaattctgtttaaatactatatttaataatatttttattttcttgacatatcaataagtgagagagatttgttgacattttccactacaatggtatgtttatcaatttccccttgcatttctattagtttttactccatgtgttttgagactatgtcattagatgcctgtaaatttgaaattattatatttttactgcagaacaaaagaatttattaactgtgaattatttcccctcacttctgattattttatcccatgtcttctggcttccattgctgctgttgagaagtttgctctgttaaatagtggtactttaactttgaaactccaattaagttcatgttaaactttattagtgaatatattactatatagtacatatctgttcatttcctttttacattttctctacctatgactttgtatggcatatggataatttttttagactcatctgagtctctcttcaagtctgtcttctttgcagttttctctaccaatttacttttaaacttcagccactatatttttttatacctgaaatttcatttttttcaaacctgaaatttgagttttttcaaatatatttggtcattttttatcatgctttgttgttttctaatttttgtgattccctatggctgttttatggtctgtatgtggtaactcggagatccgatgtacttgagattttcttgttattctcactcatgttgtgtttcattatatttttgatcatctttgattatgcgctcatatcttttttcaaattgacttcatttttagagcagttttaggtttagagaaaaattacacagaaagcatagagttcccatatagtccctcttctcctctctctttctccgattgttaacatctagaataagtgtggtacattcattataattgataagccaatattgacacagtatttttaaactaaaatccataatttattaaggttcattctttatgttgtttaactatgggttttgacaaatgcataatgtcatgtatccaccattgcagtgtcaaacagaatagcttcattgccctaaaaattctctgtgcttcacctatttgtctctccttctggacccctgagtccctgccaaccactgattttttttctctgtaggtttgccttctccagaatttcatataattggaattatataacatgtagcttttccagactggtttcttttacttagcagtatatgtttaagttcttccatgtccttttgcagtttaatgcctcattttttgttattgctgaataatagtcccttgtattgtttatccattcacctattgaaggacatcttggttgcttctaaattttggcaattatgaataaagctgctataaacatttgggtgcaggttttgagctcgtatcttttgaccttagtcctggggttgacatagggtatgttttcctgcttagagtatttgtgattgcctttgcctgttggcagggggcgctgctagcctgagaccacattactcccatcctatatacctattttaaggcaggagttttgggtttagctccccaaactagacacttgctcagagttcccttagtctttgggttgcagatctagtattgtcatttgccttcagggaaacttatcttgtgcccttgttgcttggagctctctggtcaggtttcaggttacatttttcccttagaagatggagggtggggtctctgggagttgtcctttcttttctatgggcccagaaatgtacttaaaataggtttatatctaagatctagttgttttgtaataggagggttctttgcagttttaagttggccattcttgccaaagtctttgggttgtatttacttcaggtgttccgtgattttttattgtcatgaacccacatgctttggaactttgtatgtggaatttctctgaggtctgtagttaaggccttattgagattttatttgcctctgtgaagcactgtgggacactacattctgtaaccatattgaacataccttttggcttgggtcttttgggacccctttagattggacattctggtccccagtcttgagtgaaagtgagcttgtcttgtatatgggagcctcaagagaattttttcccctcttttgcttttgatgagcaccaaggccaagataggtgcccttttgctcttctgtgggccatgtctttccctggtttatcattgtgggtatcacccttaggtattcctgactctatgccagggtctctgatcagaccttccatcttgcatgggatctggattttgtttcctttttgccgtgtgtgtgtgtgtgtgtgtgtgtgtctgtgtatgatatagcaaaactcagaatccagcttattaggtatggactgatgccgtcagagccaacaatgagtctagtgcttgattattgctctgaaaattttatgtattttcagggtttctggccttgctactataaagagatgttttaaatattttatcaatcatttttagattttatacaggagggatttctctgcactttgtcattttctgtttgaccattcttaacaagagacagctctttgttttgagcctgtgtatttgtctcaataatacctgttcaaacctatgctgggtttggggcaacatgaatggtcacacttaatgaactgtcatgtttctccagagtaaaatctttctttcaaatgctgtgtaaagtgtacatttcagtcccgttgttttcatgctaacttgcctttgtgcacacttgaatttctcctttccgttcttaaagttagatatctggactcaaatctcatattctacttgccctcaacgaacgaacacacttcatgaacacccaaaaaatagggtgacaaagtagttgattaaatactgaactatgtagtacagaaaaaggagaggccagcgtgggcctgatgactgaaagaaggcctcactccagattctgcgcataggcctattctgaaggactgggaggagttagcatgtattcaagaataataagagaagtaaagttcaagaataagcgatttgtatttgcaatgactggaaactgggagcctgtgaagattcttgggtagagaggtgagcatactattttggaaaatttagtctgacagaatccggaatgcttcagaagagcaagaggctgggttgggacacccgttaagaggctgttgtacgaattcaggtgtgagcttctgaaagcatggactagtgaggtagcagtagaaatgtatgcaaatgggtgtattgggaagctgggagaatggtacctatataatgaattaatataaggggaacaaaaatgagaaactgtgaagttactaatttatatacagccaaataatctgtattatgcaataacccagcagccaaagatagtggcaatgtattgtaaacaggatgaaatatatcacagtatcaatggaaacagccagtagcaggcagcacacacactagcaggccaatacgaacaatactcctttgttgtttagtaaatcttacaaaggctgtaaacacagcaccatcagcattgttctaaaacagctcataatggtctaactttgtgcctgcttagatatcagaagaccagataactttaatgtgattcttcattttgagaataaaaaatatctccaataacataaaagcgtgaggggaaaaaaagttttttccctcagtggtaaatttggtatactctgttgacaataaatgtgaattgatggtctgtctgctaacactaacaaatctcagtttataatccaaaattataccattaccatacttgatctcttataaataaggagaaggggatggatttggttgtctattaagcccattgcgtccctcgagcctagcagctttattatctattgtatattatagtgtttccctttattaaacctatcgtccccagcattaaaagactgtaccatcatttctgaaagcttaaaggctaaaatataacaagttgacaatatcagtagcattaggagcaattactaattcatcactttcaaatatgcattgccttctaaatataggaaggagagattaactcaggaaaccgtatccgagtaggttaagtcaggattaccctttacgttcatccaccgctttatttagggttgagatgcaggtcacgtgggcattgcagtgcttcagaggaaagttcctcatgttgtttattttgattgttaatttttcttacagtgattttgtttctctatttgtgtgtatacctatatttatctctatatctatctactcacctatatatggttgccagcttctttttctttacttttttttagagatgggtctcgctctgtcacccagctggagtacggtggccctttttaaaaatttgacttagactctcactgatgtaaagtctcatgcttaaactgtctatctagtttttacttcaaggactatatagttcattttcaggttatttaattggttctttttcatatccatctattctagattcatatctgcctgtttttacttcataattatttttgttcttttaatggatgtgtgatgtaaggaacagaattaactaaaaaatgtccctaggggctcactctgggttgtctggacaacgaggtggctgggactgtttttgcagatgaggagtccctttcttccaaggggctgtgtactgattttggcttctcataggacccgtggcttcttcccctcagcagagacagtccaatttctatgggccatgggctagtgttcgaaagattcctgtaaacaacaggcactgcctggtgccggaacagtttgtgtgtccctttattgagacggttacgctccagcttgccccataggtagttactgtggtgttgcggggagtggttgcttggaaatctagacccatactatccagcggggcacccagcactcctgtgcggggagatgggaggagggggcacctgtgccttctcttctcttgctgttgcttggcttgtagcctgtcctttccctgaaaaggctatccttcattatccatgctgagcgatgctgtgacataatcctgaacactattgcatggcacatggcaaccacagaggtacccactgggcatgagggatgctattcctcactatctctatgattattttaaacatacctacttacaaagcctgtcagaaaagctcttgattgattatatttcactggacatgatatattattattattgagttttttggttgacatttttagtattaatgttcctcataggagtttgaattatagtttgcagatttatctttatttattaattatattactttattaattatgaattaattccttccttccctcccttccttctctttccttttctttgctgatttttctctagttctccctaggtacaccttccctatctgatagtttttctattacctccacatctcattactttttgaaagcaaaaactgtattccattctttgcctgccgcttctgatcttttttcctttgatgaagcaagcaaagttgcaaatccctgtagaaggatatatattaagaaggttctccttttccaagtgttggtatgagattctgtgcagtgggaaaatagttctacataaacttgtttcttcagccaaacttgtgatcgattagctgacttttgacagaatctggtagaatgtctaaccctgatggcctgggacagaagcagtccatgtgttctagacagaatcttgcagcttgacctgaccaatcagagacacagtggtaatttcatgcagagcttttattcattagttttggacagtgcttttctgaattttccttttatggaatctgttttcttgtctccagtttctatttttgcctcagacctcattgtatatttatttgtttatatcattatacatattcccatacttatgtctgagcttattccactgaaggtgattgtgacagatgagtttcaataaataagccccttcacatgacatacatgtgaaaaataacttttggtttataataaaatgcttgttttacacattcttatcctatttggttataatataaattcttaaatgtaacaattatacttccagaatgtgttatttgaattacttggttattttatctttttctatgagaatttgttcccttctcattttctaaccacatttaaattgatactgtttgagtataaacttagtatttcccttcatgctataaataagttactatcttttttttttaacttttccatttgttctttttgttgtagacagggtcttgctctgtcattcaggctggagtgcagtggtgcaatcacagctcactgcagactccacttcctaggctccagcgatcctcccttagcttcctgagtagctgggaccatatgtgtgcaccaccacgcctggctgatttttgtattttttgtaggcatggggtttcaccatatggcccaggctggtcttgaactcttgagctcaagcaacccacctactttagcctcccaaagtgctgggattacaggtgtgagcccctgcgcctgtcctccacttgttcttaattcaatacaagttgttagtgaagattctatgtacccatatggtttcttttattcagcaagtggctaacgaggaaataatagtgattgattcattcaaatcagagaatacatttgttttagatcaggcaacaacatttctgtaatgatttcttggggaacaagtgagtgtaaaaggcagtgctgattcgtccctctcacacattttatacatacaccccccttcttacaaccatgtccgtctgggtgagctataaccctattgtgactaggggagcttccttcatacaatgtatcagtatcaaagtcagtctctaagggttctattatgttgctgttttcacttcctgtacagtgcttttctgttgaccaaatgccattctgttgaccaaaaggttccccatgctttctacattttacataatactgttgagtttttagccatccctggagttacatcagaaaatttctgggacatattgctgtatgataataggttcctgatgtgttttttttttttttttttaatttaaaagtaaactttagtgtcaaaaatgcaaacttggggagcgcagaaagatcacacacaaggctgccacttcacacacttggaggggttgcacagcagccgggcagaggggcccctcacttcacagactgtggggcgggccaggcagaggccctcctctcttcccagacagtggggcggccaagcagaggagctcctcaattaatagactgtggggcagccaggcagaggcgctcctctcttcccagcgagtggggcggccaagcagaggggttcctcacttcacagactgtggggcggccaggcagaggcgcacctcacttcacagacagtggggctgccgggcagaggtgctcctcacttcccagacggtggggggcccggggagaggcgctcctcactaggttcctgatgtgttcttatgaaagcagttactagttacattaaacatttccagtttttcctaatacctgtctaagcaaagatgctgcaccccagtggcacgaactttttttattaacttatgtattatcagagatgcagattgtaaaggagatttgggttttgtactagaacatcaggttaaacattatcaaatactaactaaaacgacatcaaatgagtcaaaaaatgccattattttatttatttatttatttttttgaaacagagtctcactctgtcgcccaggctggagtgcagtggcacgatctcggctcactgcaagctccacctcccggattcacgccattctcctgcctcagcctcccgagtagccgggactacaggtgcccgccaccactcctggctaattttttttgtatttttttagtagaaacgcccggctaattttttttgtatttttttagtagagacagggtttcactgtgttagccaggatggtctcgatctcctgaccttgtgatccgcctgcctcggcctcccaaagtgctgggattacgggtgtgagccactgcgcccggccgccattattttatttgtcttgggacggagcaaaaggaaaaaaggtttggggtacggttatggatatgtatgtattctctagaagggtagagctttgctcctgacttgaggaaacatctggaaggaacttacctgcaagtaatgctggtcagagcctcttctgcccattgtggattttgaatcaagccttcaagcagccttaggtgcttcccagggaagcagaaaccgacaaccatgataccaagatcgtgcaaagtagctttccaggcaaggtcatagaagttgatctagggtgatatcttcctaaatgactagtacatgatgttatcattagatgggagggagaaaaaaatacctccttatcccacagagggttattcagttatctgaaagaggcaatatttattctgaacagcttcaactacattataatctataatctgattggcgaatcaaatataaaagaccggttattaaaatttttttttgcatgttttgaagggaggtgaggatagaagaaggaaagcatttggcacctgaagttagggggtgggtggctggtttatggtgtcactgactggtttaaagaatggttgcaccagagaaggctaccagtacagatggtgagcagaaggccttgcagtcttgctaacttggcaactttgctgaggatggacctccttaaacttcagtgggatagggataaatagaaggcatgcaccaagttattttaatcatgcagctgcagatgtaggcagctctacattgtaggatttggaaaattctatttttaaaagcatgattgcccttggttaaattaaggagctggattcccattaatcagtgccagtatttatttatttattgagatgggtctcactctgttgcccaggctggagtgattagcacaatcatagctcactacagcctcaaactcttggctcaaatgatcctcctgcctcagcttcctgagtagccagggctataggtgagcccaccatgcccaactaataattttttttttattttttatagagacagagtctttctatgtggcctacgctaacctcaaactcttggcctcaagcagtcctcccaccttggcctcccaaagtataggggttataggcatgagttatcatacctagccagtgctaaaatttagtttaccctatagttcatataatattactttcttatataatttttgctattgatgtaaaagtttccttgcctgatgcaaaaaaaaaaaaaagggaggaactatctttagaaccaatattcactctttgtttctctgcctagaaccctgatgccacccaatttctagactattcttggtctcttgtttttgaacctactgttttatgttatggtatatactatgcaattaaaaatacagctaccgctaagatcactgcactaagctgtttcccatattctattagggggaataaatttaggttctctagatgataagaagcagttacaataaaatgcaaggacgtttggagcatcgtatttatttttcatcactattgtcaaaaggatcatttggagatgtgctacgagccttttactgttctaagtgtcacacttttttttttttctaggcccattcagctctgggatgctgcataagtcatacttctacattttgcacttttctaatattttgtcattagaatagattcagggttttgtagattaggccagtgatgtagggctaaagtttatagaatgtaaagcattgtataagacatgaagaatacagccaatttcagctctttcagaaggaaaacttttggagcacctttatttagaccattttggcatcagaattagaaaacaaaacctaattgtagttatatagtttacatatttctcaaattaccctgatgactgctttggaatcatccagatgttccatgggtttttgttcaatttaattaaattgaattattttctgaaattaaaaggggttgtttgttgaattttccaatgtcgctgccttttgttgactgctagcaattttaaattaaaatcattatttttcaccaattcccacacatacagagtttagcattgtctatgtgcttcacctgggctgaactaaagagtatgactttttgtaatgtagtacattttacctaagattacttttcttaaaacaagacagttgctttttcttcagattattgcttgaaaaacaggcttaaagatatcgaccaaagcttcacctgcctttttaacagctttctttaaagttgacatacataaaaaatatctcttttctaactaagaagctttgtcaatctttagagctggtaatgtcttaatcctggtttgtggtacaagtgtgtgtgtttgtgtgtatatgttttagtatttcttctcttacagaaaaaaaatgaaatggccttttaaaaatccagccttcacctttgtgatcagaaaaaggaaatctaattatatttttagcttttgcagtttctacttctcatcaattaactatttttgctatcaaatggaaaatctgttttatactctgacctctagcctctttccatctaaatagttttcattcatcttagccactgggttgtgttttctcttctacattggctttactttcatgtatagtttaacactttctcatatatatatatatatttttattttttattttttatttttattttttttttttttgagactgagtcatgctctgtcgcccaggctgcagtgctgtggtgcaatcttggctcactgccacctccgcctctcaggttcaagcgattctcctgcctcagcctcctgagtagctgggattacaggcatccaccaccacatccagctaatttttgtatttttagtagagatgggccagactggccagactggtctcgaactcctgaccttgtgatccacctgccttggcctcccaaagtgccgggattacaggtgtgagccactgcgtccggcctctcctataatttttaagattcacttcatgattaatgtcttgcaggtaatatcctgcattcttttctctcttttatttacctggagtggtggttggactgctttcatttctgtccaaatattcattatgatagctaggcgatatagctctggagtctaacttagtaatgttttgaaggctttcagtgttttgatcttttactttttgcatttccaattctagtgagtatgagtgacaagtggtcagcaaggtagaagctaacagatgagaaagagtcattaaagggtagaaactgctgttttacaagaaacagggatgaagcagggagaagaggaagaagagatggaatttttgaattcatgcatcaaaaattttgttcttggagacacagtggggaagatagacaggtttgtggatatcactggaaatttttgaatggaaaagagaaagtgtccatgtagaggcatttctgtctatacagtaaaatgggaggagggggtcacttgttaaagtgaagttgagactgggagcctcaggacaatatttgccagaaaagaagcaaaagaaaaatataaagctgagtgaggagtgttttggctcaacgtggattaagttgctctgctgcttgaagcctttcatcagcactgtttgattagcaaggaaagtatttttttctttcttgatgtttattaattttgtgatttgtcctggagcacagtaggagaaacaacttgggacaaataaatcatatcaattggcctcatgtatctttgtaactttttcctgagcttaaactagggtcccctttaactgcaagcgcctaacaccatcattatagtcaggagtttagggtgttctggacccacattgaacttgacatgcctcccaagtgcaattttgaatagatcgtaaataagggaggccatcagaccccactctgattgcccaatctttgcgatggaccctgtcagttcttgccgttttccatataactagtgtgcttgttcttgctgcagtacctttggctaaggtgacttcttcttcacctggcaaggcttttccctgctcatttaaacatcctttatgcctaagtagacagttttcatcgttctagaccttgccttaaacttgacctccttcgtaaacttgtctaaagctgcagctgttctctttctctctctttctgaatagtgaattctgcccagttcaaatctttattgatatatttctccctgttttcttaggcagactgtaattttcttgtgagaaggaccatatcttctttgtatcccttttagatccattcaccatagtctagtgccaggtgtgcatgacgtcttcataaatgttcagagtggaattttttgtcactggtgtttgattttcataaggtgacgccagtagttgatgtttcaaatatgtccactccccatatttgtgatactacagataatagttattataattaagtatctttggtgtttcaggttttcttaataagctttattaatttggtaatttaaacattttattttaatttgctttttatttttctctcttcattttcatggttctgtatgttggcccggagtcgtgactcttaaggatgccatggtaacctgtcagagaattgttgtgttaagttgttctttgctcccttctctgagatgtgctcagctatgatgatctgctccatcactctttttttcttgcagttcattcctagtgattaaattatcttttatgccctgtattttcactatttcttctcatataggcaatataaagccacagcatgtctgagatatatatgtctcatatggatatgcactaataatatgtatgaaaactttacaatttaactcatataattataggtcattccagttaacttgtcattgggttctcactgggtagcggtaatttgcatggctcagtcaagccaaggaactttttatgcaataaaaaagtacaaaagaaacatttaagttgaataatagatttattacaaaataattacaaaatatatttattatttaatacaaaagaaataaatgtaacacaaagctacaaatggcataaaagtacatatttgtgttccttttaggaatcaaacattttaagtccagtgcaggatggaacaaagaaacctcagattgacagcaacaagagcaataactaccggattgtaaaggaggtcagcagatacaaaatattcttatataggtttatatttgcatgccaaataagttttgcttatatattatacttaatattgttatttattatatttgatgctttccctcttccttttaaagattttgatcaggctaagtaaactctgtgtgcagaataaaaagtgtcggaatcaacatcaacgattactgaaaaatatgggggcgcattcggtggtgttggatcttctgcagataccctatgaaaaggttagtcctggttattttttgttctttagctttttattttgatacaatttcaaatgttttgcaaagttccaagaaattttttctttcttaattattttagaataaatcacccaccaggtgccccatcacccctgagcccttttgtgtatgttttctacaaacaagggtacactaccatgtcaccacactagagtcttccatatcaggaaagagcaaggcactttactgccacctagtccctacacgctactcagatttctccctttgtcccaattgttttcgacttgaaaaaaagatccacttcagaatcatgcgctattcggttgtcatgtttatttaaatctcttcatgtgggaactcccatgacattgacactcttgaaaataaccagttattttgaaggatgtcctttaatgtggatcatctgatgtttcctcgtgattaatacagttaggcatctttggcagggacataaccggagtgatgctgtgttcgtctcattgcttcctatttgttggtgcacgattttgatttgtcccatgactgatgatgttcactttgatcaattgattgaggttgtgtctgccaggtttctctgatttttccctttgtaattcccttgtaattaataggtattttgtggagcagttctgtgaaactaagtaaatatcccattcttcatcaaactttcaacttattcatttattgtgtttatttttatcagtatgggtttgtatatattcattttattcaataggttataaagggttctatcattatttattttgatttccagattgtctcagatttgaccagtggagttcctttgagctagactatctgtcttctaacatcacccccaccattctttgattacttccttgctttctggcacaataaaatgttccaggttcatcttgtattctccttgcttcgactctagaatcagccatttcttcaagaggccccatttccatttggtgggaaatggtatttaggagcaaagttctgagaactgagttctcagttcttattgctttggggtgttgcccccataggccctctaaataggcaaagctagggaatatgcatatgtatgggtgcatgtagaaatttatttaatattaatataaaataccactgaaaacatgagtccatctgaattcgtaacaatgcccacatgacaaatggtacaatcaactacatggggaaattttaggtagtttcactgatgttgtcacaagaccacttttaagaagacaaatttgcttctctgtgaattttgagacttaagtttcttgttaagattcttataatcaaatgatagtagcttagtataggactttggaaaatggcaatgaataaggatattcactattaagagtgttaagaaagagggggacaaaaaggaggagaaaatagaagagaaagcaaagaggaaaagaaaaagaaataggtggaaataagagacaaggtaaatagcaaaaggaagggacagagagattggagagaggaagaactgagatgagtgagtaataaatatatatacagagaagattgacagagtggaggaagagaggaagtttgaatagagaggaaatagagtgagagcagagcaggagaaaaggggatgggagcagaagaaataatagataggaaaagaggaaaagaagagaggagatggaatagatgtgggagaaagagtaggaaaggaagatgtatgagaaagagagtgaaatagagtagggaaagagagacaagaatagaagcagcatgatggagatataggcatactgcaaaatgagacatttaaaggaagggaagaattatggggactggggagtacagcagagaagggaggagaaacagagaaagatagggacagagaggaaaggaggacagaggaggtgtggagataaagcagaggaggaaaaggtggctatgtacagagatgaggaaacgtggtggacagttggaaagattggggagaaagagaagggctgtgaaatgaagggggcattggaaaagtagagcagaatagaatcaggaggaataaccaagagaaggtgagaaagatctagaaaacagagaagagggacaggaggggaaactgggagaggtgtgaaacataaaggacacagagaaaggagatcaaagatgggcagagagaaaaatggtatgtgggtgaaggagagatttttgcataacatttgctgtctcctatgtttgtttctatcatgtgctattctttaacttacagaatgatgaaaagatgaatgaagtaatgaatctagcccatacatttctgcagaatttctgtcgaggaaatccacagaatcaagttcttcttcataaacatctgaatttgtttttaactccaggtgtaagtattttagtggcttctagtatttctagtaaagtgtgcatcaaatttgtctcagtaacattcatgaagagaattttgttacacttccttgcttcatttttttttccttgtggaaattctctctccagaagtgaatatcttttttttttcattaaggaaacttttaaagaaacttgaaaaattgcacaagttttacatgcaaatgacaatgtattttatacgtatatagttaaatgttagggaaaagatatggtagaacaaagaactaactcacaataccatgagtaaggtaaatatggaaaactcagaggtggagtttgcccttgtctgtaaaatgtgtttgagcagattttatggaagacctaattttgaattcataattagtctcaagaatactgttgccaatatgttgcactttatgataataagctcctttctccaactaaattcctctgtgagctcagttttcttttaatggttaatgatctcatcgcattttttgaaagacatgcacagaaaattcactgtggcttcgtataaaatataaaactgatcacaagcagggcaattagtctaagtactgtagaatagaaaattgatcttgtcagaattacaagggcatgttcctctgtgtttagctccttgaagcagaaaccatgcggcacatcttcatgaacaattaccatctgtgcaacgaaattagcgagagagttgtacaacactttgtgcactgcattgagacacatggccgccacgtggagtacctgaggtttttgcaaacaattgtaaaagcagatggtaaatatgtgaagaaatgccaggatatggtaatgacagaggtatgttctcagtttgccttttatcagcttcacctaaacagtatgttcaaatatgcattttctattacagtgaaaaagcccccaacaacataggtttggaaaattatttaatttaatcatgactactcaagtgcaaatatattttgctttaatttagtgaagcaacatatcttaagttggttttatgatttttctaagtttgtttttctttttgacctataatgaatttgtgtattttaaaaaatgggtaaaatcctatgaaatgttgtcgattgtttggaatgaaagtgacaaaattttatatttttaagtttccaatgatataagaaagacagattaaactgtgcttttccagtgcctttattgctctgtttctgaaacatagaatgggtgttctctgctgctatttgcagaaagctttgaagagaatcaaactaagtaatacaaactacctaacagtgattttttttacaacatgtggaaacttactacttagagtaagttacaaatttcagcaaatgaatagatgaaggtacttcatttctttatttgcctttttcatgtttatgtttgacattgagtgatatttatgtaatgagtaagttactaggaagcaagtatgatacattggagaagtagcagcttaaagagcccgttgattaaatcaccgctctgtgaccaaatggttctctagtggcccatttgggttaagggagcttccacccatggctaccaaacagttacatggtagatttttattggtttctgggcattttcattatgacataccttaaatttgggaatggaggagatttccataatgattcaaggagtccctcctgccacttagaaatcttaaaattaatttagcttaaagccttgaatttttttaaatgtaaattattgttattaaacattttaaggaacattttaagcttgtaaaatgcacctttttcttatctgcatttgcctacacattagctcttcattgtctggaaatgtgagaactaaaggattttgtgttatgatcagcaaggaaagaattagaatggggaagcagcaacagtgaaaccatccctatgatactgttgggtgaagtgtttctgtgcacaaagaagtatttgtaatattatgttaatatataatacatatttttgatacacatacattctctttcaacaacactttcaaagtaagccaatgaatcggcttatagatttaaatatattgtcactttaaatataatacctagagaaaaaaattgtatgtccttagttacccaccaatgtatctcacactggggttagaaaattggtactgataatagacaataagatactatggagcttgaacaataaaactgccacctgatggaattttctactaaaattatataaacaaaatgtgaaggaaaatttatgtcttaaaagaccctacctattcatatctttgtttctctcggttttttggttttagttttctacttatttctcttaactctgcttttaccttcattctctgctgatgccttcttatgacacatggaattttgtagacttttgtagagctgtaattagctcaatgtacttgcttccttatgtagtcattattgcaatggatgaggatattttactctgctttagtaaaattatgagatttcttgtgctttggccatggagtctcccaaaaaaaagtagaggaaaataactttatttttttacaggtttaatttcagtgtgatgaacaatttactttcatccatgttgtttcattcttgccctatctgctgcttccacatcgcctcaactggttttgatagcgttcatagctggttccttggcatgggaccataatcttgtcaccaccctccccaagcatagctctgtctttgccgtattatatatgtttttacgaagagatatacgtgtttccagatatatcaagcctttggaaataactgcaaggatgaatgttcggactgctacatagactctcttattatcatttcagttgataaatgggggtgaagacgtgctgatattttacaatgatagagcatcatttccaatccttctccatatgatgtgttcagagagagaccgaggggatgagagtggccccttagcctaccacatcaccctggtggagttgctggcagcatgcacagaggggaaaaatgtctacactgaaatcaagtgtaattcccttctcccgctggacgacatagtgagggtggtgacccatgacgactgcatccctgaggtaagcctggcaaaagcttagcagctctaatagaatcattattaatttttgaagtttatctaggtgccagaagtcccccatactaatatttataatgagatcatatatttagtcagggaattgtatttaactatataatttggaaaatgtaaaagagcatagaaggtctactttttaataagaagttctataagaagttctgcaagatgataaactttttttttttttttttttttgagacagagttttgctctgttgcccaggctggagtgcgatggcaagatttcgactcactgcagcctccacctcttgggttcaagcgattctcctgcctcagcctcccgagtggctgggattacaggcatgtgccaccatgctcagctaatttttgtatttttagtagaaatggggtttcaccatgttggccaggctggtctcgaactcctgacctcaggtgattcacctgcctcggcctcccaaagtgttggatttacaggcgtgagccaccacagccagcctatgagaaacttttaagaactatagccactgctagtttagtggaagctactagacagctctcttcaattctaaacatggccatatgatcaaactgaaaggtttacttgaaactttagtatgtacttgagcataaaacaggtgcttcaaaaattattcataaccattgattggagaggctaggatagtgctgcaggaccacataaaagactctgcaggtttacctggctttatggaatagatgcattcttgaaaatatgcacacacagtttgctttattcccacatcatttaccctctgtcctagtttgtttctgatgatagaaaaagtctcagtagcagctggttgtctgccaataggcttctattaatgaggcatccaggaatgtacattgcgataatgtctttcttttctactgttgggaggggattggaggggagggaaggagaggggaagaagaaagaaagggaaaaggagaggaaggagaggttgcttttgactccttgtatctcaaatatgataggcttgttttgcataaagttctttctcacagcaatggttggcccagggggatggagtactaggccccgtgttttcacccttaggtcagtggactgttagcaaaagaagagaaatgagaatactttctggatagacaaaactatgctatgatctaccataaaaactaacagattttatgttaacctttcataattgatatttgaaagtcatcaataaagaaaactaactttcttttgtatttgaaacttgcacaggttaaaattgcttatgtgaactttgttaatcactgttatgttgacactgaagtggaaatgaaagaaatctatacaagtaaccacatttggaaattatttgagaacttcttggtggatatggcaagggtaagttagattttgactactgaagggtgtcaatagatatttcgactaaatagtattaagcatctggatgaaaacttgcagttaaattcactaccttttgatttgttgcattcattcataaagttgtgaataaatttcagaagattgtgagtgagatttaatgagttaatatatacacaaaatacttagtacattgtagatgacaataggtaaagtgttcatttttacctttatgagtgactgtgtttgtctgttattaaatggaatcttagtggcctctttatattggttagagaagatatttggcagaggtcaatttgcatttaatctcttattctaagtgcaattacaaagcacagatcaagagacctaaagaggtcttgactactgctttcaggcagataggtacttgaccagccgactgaggacttggccttgctcgctgttgcctattcaaaatcttctttggaagtgtactccagtaatttaatcatctggcattttcactcgtgtccaccaaattatattcgcttattactgtttgttttgttgggggctgttggggaggacatgtggagctggttggcattttctagatactgcctgacatatgtttttgctctgttaatattgagtaaatgaatgagtgaagaaatataagaaagaaggaatatctttgatggacaacacaattttctttagcacatcttagccttttttttttgcatactgaattatcataacagccagtgtctaaaaaaaaatctaattttccctttaaagttatgggacttgaagttcaaataaagtttcactaaagaagacagtatatagataactccttagacctattatgaatgatggtggctggactcagcccctttggccttccaacattcctgagtgctagtagctttgtataggccttatatagatgtatttggaggagaaagattagtgaagtccatattttcattatctcaattacaagaacagatgctgttatctgttagctcactgcctctctatacctttttctgaaaggagggatgacaaggtacatccttgtcatccctcctttcactgcctgtagactcagacatgtaagagcacccttggataatacaatgaatcatacgttattccagaccacggactctttttatttagccagggtttccaagtgaaatgtgcttagtttacctttggtgtggtgtagtgtggtgagtgaggtagttcctgttttacttcatttccatacagctaaaagccacttattgcctatctcaggtaaatatgcacctgtagagaaatcgtcctgttttatgcagcatttaacatagtactcatatgtgtccccattgaccttgtgaaaactttgtttctgaccagctatagtatctccagagaccttcaagtaaggagtgacttccatgccaatgactaagctttaaaactgcacgtgcaggaggatattaaagagattatagactgatttgcggagttgcacagtgctactgactaaagataagcttgaaacagatcaaggtcacattgtaggcagcatgagctataaagctgaaaggatttttattttttaaaccaaagaaagccaatgataacttccattgattatgccacctgagaaataccgttttcaccgatgtatttgcaaggcaaaggtgtacagatttacattctttttttgaaaaacacaaaaaaaaaaacaaaaaaaatagcaatgattttaactattgcttaattggataattaatgttatttattatattaaagctctaggggaatttcaatatcttcttgatctatttattatttatgtctaaccacaataacttagctatactgcaaaaaggtttttaaaaatatttccctcttgtttatattttaaaacagtagctctctaatcccttcaccagggttgacaggaatcacctttcctttttcagggaaggaaatagaaacctgactttttcatatctgggatttctttctctccccatgaagaaagatcagagtcaccagaaactttcaaattcaagttataaaactaagtgtggttaaatgaatagaatgtggccttctaggtaaattttcagttcagttgagcagtttttaagctttagtgagcatcaggcctagctggagggcttggtgaaatacagattgctggtccttgtccccagaatttctaatttccataaatgaaagactttacatttttaacaaattcctaagtggtgctgcaggtgctggtccagggaccacactttgagaatcactgtagtagacagagcatggtagctaagagtagggatttcaaaagatttagccagaccagagttcgagtccagactgtgcctctcagtagctcagtttatcttgggcaaagtacttaacccctctgggccctgagtttcctgatttgtaaaatgaatacaataaattcacattccccatagggttagtgggagaatccaatgagataatgtgtataaaattcttagcacatattagcatcagtaagagagttggtaacatcatccatatcattgtatccagaggaccattcagcatagggaaaaactagaaattatgtccataaagctggacatccacaacagtagttgacatgaatagccacgtatgagataaaccaaatccagatgttccaacaaagttatgacattctggaagaactgatttatatccatgagaaatgatgaaggtaatctggaggaaaggaatttggtaagttgaacctaaagaatcatagcatcttagggttggaagagactagtagtcaaatttatatacagttcatagtcttcagcacttactcaaatatctgattaacaatgagcttactacttttttctttttctttttaaattttgtggataaatagtagctgtatatatttatgaggtacaggagatattttgatacagccatataatgtgtaatgaacacatcaaggtaaatgggatatccatcacctgaagcatttatcctttctttctgttacaaacaatccagttatatttctttagttattttaaaatgtacaagaaattattgttgactgtagtcactctgttgtgctatcaaatattagattttattcattgttttcaactgtatatttgtacccattaaccatccccacttcccctctgccccactacccttcctagcctctagtaaccatccttttattctctatctccatgaatttagttgttgcaatttttttagtgcccacaaataagtgagaacaggcaaaatttatctttgtgtgcccggcttatttcacttaacataatgacctccagttccgtctatgttgttgcagatgactggatcacattcttttttactggctgaatagtactctgttgtgtatatgtaccacattttctttatccattcatctgttgatgggcacttaaggtgcttccaaattttggctattgtgaactgtgctgcaacaaacatgggagtgcagatatctcttcaatgtacaatttcctttcttgtgggaatatatccagaagtgagattgttggatcatatggtagctctatttttagttgttgcttttttttttttgagatagagtctggttctgtcacccaggctggagtacagtggtgtgatctcagctcactgcaacctctgcctccggggttcaaccatctcctgcctcagcctctcgagtagctgggactacaggcatgcaccaccatgcctggctaattttcgtatttttttttttttagtagagatggggtttcaccatgttggccaggctggtcttgaactcctgacctcaagtgatccacccatctcggcctcccaaagtactgggattacaggcgtgagcctctgcgcccggctatttttagttttttgaggaaactccaaaatgttttcccttgtgattgtccaaatttacattcccactaatgtgtacaagggtttccatttctctacatgctcttcagcatttgttattgcctgtcttttggataaaagccactttaactggggtgagatgatatctcattgtagtttcgatttgcatttctcttgtgatcaatgatgttgaacaccttttcatatacctgtttgccatttgtatgtcttcttttgagaaatatctattcagatcttttgcccatttttgaatcggattattctattttttcctatagagttgtttgaggtccttatagattctggttattaatcccttgccagatggacagtttgtaaatattttctctcattttgtggattatctctttactttgttgattgtttcctttgctgcacaaaaggctttttttttttttttttttttttgagatggagtctcactctgtcacccaggctggagtgcggtggtgctatctcaggtcactgcaacacctgcctcctgggttccagtgattctcttgcttcagcctcccgagtagctgggactacaggcacctgccaccactcccgtttaatttttgtatttttagtagagacggggtttcaccatgttggccaggctggtcttgaactcctgacctcaagtgatctgcccacctcagcctcacaaagtgctaagattacaggcgtgagccactgtgcctgacctgaagccttttaacttaacgtcatcccatttttccgtttttgctttggttgcctgtgcttgttgggtgttactctagaaatttttgcccagaccaatgtcctggacagtttccctgatgttttcttgtagtggtttcaaggtttgagatctcagatttaagtctttaatccattttgatttgatttttgtatatcatgagagataggggtatagtttcatttcttctgcttatggatattcagttttcctcgcactatttattgaagagactgtcttttccccagtgtatgtttttggcacctttgtggaaaatgagttcattgtaggtgtgtggatttgtttctgagtcctcttttctgttccattggtctatgtgtctttttatgccagaaccttgctatcaagtttttccttattacattttttgcctagttattttttctccagcaacacaaaataattcagttaaagatgtgtttactataaacacctcctcactattcttgctagtgacctattttgaaacgacaaaattatataacttgaagaaaatgaagatcatcttagttggtctcataattttgcctgtggcttctacagagagaattttctgggtgactctcctagctagatatagagtgggagggctgctgtagcatcattcagtgcttttccccaacagctggtcagatattttctgatagccttcatatctcccatcattttctccatgtctttcagttattcctcttctgatatagtttctgggattctagtttcaacatacttttgagatccctctagtttctgtgttttgttgaaaggtatgacattcaggatggaacccagtacttcaggcagcagatgacccagcacagtttattttagtagacatttggagaaatgtatatgtgtgtgtgtgtgtgtgtgtgtgtgtgtgtgtatatatatatatatatatatgtttatttatttatttatttattttttatttatttatttttttttttgaaacagagtttcgttctttcactcaggctggagtgcagtggggcgatcttggctcactgcaacctctgtcttccagtttcaagtgattctcctgcctcagcctcccgagtagctgggagtataggcccccgccaccacgcctgactaatttttctattttaagtagagacagggtttcaccatgttggccaccctggtctcgaacccctgacctcgtgatctgcccgcctcggcctcccaaagtgctgggattccaggtgtgagccactgcacctgacctgacaacaatattttttaaaatgcaaatgaaattactaatagtaatgaaattagcactcataccaccttccatcattcttctcttgtgtttctggagtcagcactaccagggtctttttgtctgtccttgagtaaagctgtctaaagtcacctttttttagtatttttcattttcctattggcatttccttgtctcttatcttgttaagacccatacaagaaaatctttcccaaaagattatttttaataaactggtgctagattgtttcacattcttattccattctaatatcctgacagagacagtatccatgtcctgtaagcacaccagatctaggcaggcagcgatgctattagacccatggaaagttgttacactgtctttcagagcatttaatgacagcccactttgatctatgttccagtgcagctaaaactggtgtttgtagggcagaaaagcttttctttggctttataactgattgttgttgatagtcaggggatttgagtcattattagaaggcacgtaaagagggtagactatggtcaatgttagcctcagactatattttttctttgaagatgtttccaattttgctatcaatgtcaggatcctataaggaccaacagtactctaagtgatgtactagcagaatgaaattagaccaagaaataatttaggaggctcacctaactctctgtcatgtcagtatcccatcagtcactggttaacaagacaaacttgtgtatttcactttcaggtagataacttgagccatttttttgatataattggttttattattctacaactttgttaacaactcttatattgagtcaagtttttacttaaaatttttgctcccttaacttaccaaataaatatgtaagaggttggagtaaagatataatttatatgcacattgaaacacactttcctagttctttaatttggtgacattaagtcaatttaaaaaaataattttcttgaatttcttaagttgaatgagctattaaaaaatctcattcaaaagggctcattttatatggtcttttaactaatatttcagggaagtgaagaagtataaagtattctataacttatacaaggcttcttcccttggaccccaggatgtcaattccactctatttgccacccaccacactgtccactcctcagtctcttgtctgttttctctgcaccttcccaacttctaaatattggagtgtgccaggctcagactttggaatggatcccttctctgtctatagtcactgtttgctaatctcatttactctcataactttctatggttctcctgatgtctagtttcacatattcaactgtctacatgacacctccacttggctgtctaacctcaaactctttattcattcccatgcctcactctaaaataaccccttttcaagactgtagcatctctataaatggcaattctattactcactctaggcattcaggcaaaccattttggtgccatctgtaaatcttattttcttctacccaaaatccagtccttccacaaattctgcaagttctaaccataaaatattccaaatttgactactcctgaacactcccatcacaactacgctaccccaagtaccattctctctcatttggatgattgcaatagcctcataacctgtttccaagcttctgctcttgtccctctctccatctattctttatctagcagccatcatgattgaaggaggtggaagaggaggtggaggagatggaggagaaagggatgaaggggaaagagagggagaagaaggagaagatgatcgtcactcctctgctcagattcctccagtgacttcctgtcttgctcagaataaaacccctgtgtgacttagcctctgccctatgaccacccttcttccccttgtcctcttattctccccctagctagctatctgttccatactgtggcctccttgctactcctcaggtatgccaaatgcattcctatctcagcaactgtacattttccagggatgctggacttccctgtatctgcataacttcttccttttcctttaggtttttccttcaaagtcactccttcagagagggctttgccaaccaccctatataaaataacaggctcttttctttatccttcttaacacttgcttcatttttctccatagaatttattaccacctgacatttacatatatatatatatatatttatttgtatttcagtaggaacaaatgaaagacaggaattttatctctgttcactgctgcatacctgacctagaacaatgtctcacacataatagatactcagtaaatatttgtgaaataaataaatgtcatatgaagctaaaaatatttaaaaagtggatttgaaaacaaagaaaatgtggtctgagcatagaattaagtaggcaaaccaatggaatgaaatgaatagccagaaatagacttttgcatatataatatattaatatataataaattatcacctattagtggaaagggattggatatttccagggattggtgaactttttctgtaaacagcaaaacagtaaatatttcaactttgtagactcctattgccactattatgacaattactatagagaaaggagtcctaggcaatacaaacatgaatggatctggctagatttgatgcatgtgctgtattttacccacccttggattattagtaatagaaactctattagaatagtggtttttatatattttgtttactgatggatctcaagtatgtagaatattcttggcatggaatagacactcaataaaaattgttgatttgaagtaaaaatgactgttgatgacactgactatttagggtgaaatgaactcacataatagcaataattgaaatggatttcatggctaaatagaaaaaaacctgaaccagtaaaaatggatggaaatgtagataatatttatctgtctttagatgaaagcaatagatgaaattagctaaggaaaatcatagccatttcagtgtttgaaaatttaatacttaagtacataaaaacatcataaataaaaatgaaaaatatcctcacacttgtaaacccagtgttttgggaggcccagttcagggactgcttaaggccagaagcttgagacccagcctgggcaacatagagggagcctgtctctacaaaaaaataagctcggcatggtggtatatgcctgtagtcccagctactagggacaccgagggaagaggatcccctgagcccaggagtttgaggctgtagtgagccgagatcatgcccctgcactccagcctgggcaacagagcaagaccctgtctctgaaaataaatgaataaataaaacacatcaaaatttaaatagctatggtacagttttaaaaagggtaataaccaccacatgaagaacttatatgtatttataagaaaaactcttaacaatttaataagaaaatgggaaaaaccaaacattcatgatttatagaacaggaaatacaaaaagttaataaacctctgaaaaatgttcaaatattaataatttttaaaataacacaaaaaataagatccaattttcaaccatctaagttgcaagcttggaaagataatattaaatgttggtgatggttcagcgtatgtatttgcatatcctgctgatgagagtataatttcatgcagcctttctaaaaagcgtttagaaaaacccttcatacttttctaatgtgtcaagtaatttaccctccaaaaatctgtccttgggaaataattagaaatgctataaagggtcaggtgtagtggctcagacctgtaatcccagtactttgggaggctgaggcagccggattgcttgagcccaggagttcgagaccagcctgggaaacatggcgaaaccctgtctctacaaaaaatacaaaaattagtcgggtgttgtggcatgcgcctgtagtccctgctacttgggaggctgaggtaggaggatcccttaaacctgggaggcggaggttgcaatgagctgattgcaccgctgcactccaacctgggtgacagagcgagactccgtacttttatgataatacgataatatgtagtaggaaatagcttaaatatttaatatttgacaaacggttaaataaattattatatatctatatgatggatgttaaagtcactgagattattttttgagaatttttaataatgtaaaatgcttaagcatgaagtataaaagggaagatgtgaaacacataatctagaatggtttcaattatgtaaaatatatatggcagaacaaaaatattagaagaaaaaattccaacatgttaatcatagtcttatctgaattataggattataagtaattttcatttttccattttatattttctgtatttttcagagttcctacaattaatatgtattggtattatgaaaatgttgtctgtttaaaaaaagaatttcgaattctaagaaagccagttgagtgtatgagctgatgattcacataaaaaggagatatagaaagcaaatgcttgcaaaagttttggcctcacaaataacggaatgcaaattaaaataaatatgagatatcacctcagatatttagaggaacatttttactgtttatgtaaaatactaaagtgatcttaggatttgtattccttatgatcaaaagtatgtgactggctctagaggtgccctgccctgtagagtagccgcttcccaactgtggctatttaaatgtaaattttaattcagataagttaaaaaaatgtagaaattcagttcctcagttgcactagtcacatttcaaatgttcagtaggcacctgtgtctaatggctaccatattggacatcacagatatagatgatttccatcattataggaagttctgtaggaccgtgctgctcaacatatggtaacttatttaccatagacgatcatccttggaagggtagcagtcacttttagagcagaagagaggaaggacatcatatatgcaaggggagaaaatcagacacaattgtatctagaaatttcacttaacatctgcttgttcaacaaataattttagaatatctgttatatgctgaggtgctgcatgtccagtggtgaacaagacagagttgttcctggtgtccaggagcatatatcctaatggcagagacaacattttacttgctcttcccacagaaacgttgatggctgcttccaacttcagttctttgtgaaatgttgccttatacagagataccaccaagctgtttaaataaacaggaatccttgaccatccccaccctgcctgctacattccctgtaccacttgccctgctttatttttctctagtctgttattttctttatttttactacttagcatgttatatatttattaatttgtctattgtgtgtctctcttgattgggagaaagggtctaatagagtagggacgttgttctgtttgattcattgttctaacttctagtctaatatgtagcttcaatttaataatttgtgtccttattacgtctgacaaatatatagtaaaattcatctggaagtagaagaagacaaatatttcaaaagatggatttttttttcttggaaaagacagtgatggtcgacttggttgtttcaagttgtgaaacatattacagattgggaatcatttcattctgtggagttaggttaaaatatattttttaaaaatccatggagtatattagagatttggggagagatttaggtactcattagtgacacactataagacaaacctcaggtaacctaggaatgaaacaggaattaatatttaataaatgttttgaggacaattgaatatccgtatggagaaaaattaatcagaattcataaattaggtcaccttcatcaacaaattgcagatattttaaagagttaaaaactagaataaaaatgtatggactattctttttaagagggagtttttttcttctttatattaaatattaataaatagtaatgaacaaaataaataacagtgcctgaatgttgaaaagtagtttacacaatgaaatataatgaaatattttaaatagaatgcaaaaatacatatgaaatgacaattgaaaagagctcataaaaatatgttaaactcatactaaatgtgcagtcattaggtttttggaaaatggtttacagggcttgaactgttggtgtatgacagaagatagaaatgaaatgattccatgaaaaagaggccaaccttgttaacagcaagggaaatgaaaaataacttttaggtataattaaattgataaaaacaattataatttactggtatagcagtcagttctcgtaggaaacacatggcacatttcaagaaacgagggcagatttaagaagggataggagagtactgagggattttaccacctctagaccctgaaggcacatggagcaggcattattactagatcctggggaaagcctggagacatggaggaagggcttcagtagcagctgtatccagagaacacagaagcccctacaaggagagggagatggggatggaggcagaggtagagtaggtgcctgacttctttctcttccactctgtaatctcctgcaagagcctcacattagctgaatacaaccagagccccaaagcaaaagctatttggtggtaataagggaccatcctgtgtatctgtggatagtttgttgatagtattgtaaatttattattttagaggatcagcccagcaagcagtataaaactgtctacataccctcatctggtgattcctcttttggtgaaatatgccaaaaaaatctgaaagtgaaaacagtaactttgcacaattctttataatagcaaaaaaaaatcacatcataaaagatgagcaagaaggaaataactaagaagataagaaaatgatttgtaatattggtaatgtgtacctcaactcattccaaaaatggcttaaagcatgatggtgcattagaattatggaataaatatagctttttaaagtaagtgtttagataatggcagtacataaaagtgttttataggaaagaatgttatgtgaataatatgtgcaaatggattaaaacttttaaactatatgtattgcacataaaaagatcatttgatatgatgtaattttacttgagccatggccaatctattgtaaagagaaaataaattaaaataaaagaaaataaagaaatattcatatgtatgaggatcattttcctgaaaaattttaaaatattttaataagtgcttcctacatttcttggctgtccatgatattataatataagatgcaaggtgaaatgttatcattcataggggacaggaaaaacatcttgaaaaattatttgaatttcttgtttaaatgaactgaggactaggttccacatagctttgtaaaacacagacttttcataaccctggattttgaagaaagtcttgatccagaaatagattattttcattaatccactgactaaaaagcaaatttctgggtggttttttggcaagtgcccagttgcagaagatgcagtgtggtatactctgatgactccagagagccccacgcaattgcatgaaatgtcactgaatgagggaggtcgtttgttttggttatgatggaattggtctgctacctcttcaactttattatatttttaacctatgtatcaggaaggttcactgtaaagccagtgttaggaagatactaaaagaagtaaatcctaattcttatccatcataggaagatcaattttatattagatctgggaccatgtaaattaaattaaattttaatcctaggttagatgttccaggaatatagcccaacctaaagttaacctaaaacaaaataagagtccttaatccctctttcatttaaaaatttactaaattattaattcatttcacaaacgtttgttgaacatcttgtgtatgccaggcaccatgttatatgctggaacaataactagaaggttacataatttgacataatttatttccgttaattgcactgttcctgcagttatcctatgaaattagataccctaaaaatctttaaaaacaaagtcaggtaggggtcaattaatagatgaggaaaaagtgaactgctcagatgggaagtgacttagatgcaaaacaaaccctgttctctttctcccgcctccatttggcaaatgctggcattagtgctcccagatctcaaaacaaaagccccaggacacatggtttgagaaggaaaatgttctcttttatgaatttgtgtgaaagcttttaaaacaatatcagattaagtgacattgacttattcttttggttaagcaccttattgaaaatttttaaaaattacataaaaatttggatggtctaagaacatctggaacatctggccaccatattaccaaccacaattttgtgaaaatttaaactttctttctctgctgcagtttttcagtcttttctaacattctctgcccaccactcccacttctttttctttttatctctatgtttttctgtcttttcaccagccaactttttttcatgtgtttttaattaggtatcttagcttttgcaatttgttcatgctgacattgaaatttacagcaaaatgcaaaatgaccaattactgcctcatttcatcagatgtaaagatcagagcacgagccagggatgctcttttctggtctttctccagcttcagcattgtctctttggctgagaccactctgagaagaatgcacgcaaacctatacttccatgcttcttagataatccatggatgataacatcaaaattattgggaagggtttgatttatcttctcctacctttctgttttcctctccagatgctttctgtgtttgtgtcctccaatttgagtgagggttgggagtgaaaatgtttggagttactaactaccattaatcacctttcttacacttagaatgactgtttcgtctttggtctcttacattgagtggaaaagtgttctccagcaaagccaagcttggaggctgagggagaggttggtgtgcaagagaagggagaagcaaattaaaaagaagaggctgggggtctgtgaaagaattctggtttcaaggctgaaatgacaggctaacttgatggagcagctactgaagattgatacaattatcatgatttcaggctgaaatgcttctcttctcagcaactttaaaaagcagaagaaatgttactgacaactatttcaggacaatttttaggtggttccaatactgaattgtggtttaaaaatgtgataaaacatattgagttgttttattttctctccaggtttgcaacacaactacagacaggaaacatgcagacatctttttggaaaagtgtgttactgagtcaataatgaatattgtgagcggcttctttaattctcccttttcagacaatagtaccagcctccaggtaagttaaacaattgcaaagcattctgttgcaaagagtttctcttatttgagtaggagaaattttttctggtcaggaagtcatctcctacacttcagatgtttattcttctcttatattatttactattatgcctctttctgagtttaccaaactttactttaaataaagagacctcatctttaaattgaattatttttcctttttctctaagcagactaagaacttcatatctgtatgttgattgccaggtgttgaaataactgcacaattaattctttaaatgatagacattttgcccctaaagttttactttagtaacttatcctaaaagaattaacaaagatttatgtactaaaacttctaattcaaatatttgtaatactaaaaatttaatcaattaaacatccttaaaaggaggaaaagctaaataaattatgatatatctgtaggatggtttattatatagtaattaaaaatcatgttttaaagggaaaattgatgaccaagaaaataaacatgaagtaatattaggccactgaattccattatagtattatccaaatttgtttgtgtacagaatatataaacatacatgcataaaaaaactcagggagtaaatatcttcaaatattgatactatatctctatgttgtagcattcttgatgattttcatttctgtggtccacaaatattctacagtgattgtgtataactcttctaaaaatatcatttcaattatgctttctttagggaaaaattttaaactattagatagaaccataggaaattgtttctgtagttcaaaatggttgtctcctctacttgcccatcatatgaaaccaaaacaaaccaaccaacccagaaacacctgcttatttgctcatgggaataaaccatggattataaaagatattcatgtcattggcttcaggaaatggcatatttttttctgattaagaatataattaaaatgaaaataatcaatcccctatagtgtgtagcatcttgcctctcatgaagagagtatctaataaatgtttcatgaatgagatatttattaactagcactgaaacttgaaagattgtattttattttattttgatgaacctttctgagaatgcatagatgctacatcagggctgttaatggtttagcatctctttttgcctaccttctttctggttttagacacatcagccagtttttattcagctactgcaatctgccttcagaatttacaattgcacctggccaaacccagcgcagaaagcctcagtggaatcctgtatcagaactttggctgaagtgggtaagtcatagtttgagttttacttatttttacatttcttgaagaaattaggtttttggctaatgggcaacacaagcagcttcccaatttacaacttaagaaaaccagtatgttttctgttaaactgaagagcagccatcagcaaatgattctgaatgttgcatactttttgggaggaggatataatcattatattaaaaatcttaaatttaatattattgcatatggaactttaatatggctcagtcagattttagaggattttagttaattgttacctcagatttcattatggaattgtcttgtctattaagtggcctgacttgctaataccttcatatgacataggactttttgagggtcttgtagttttccaattttgtttgaagtgtgtcaatattcaaggcttcagaaattacaaatgaaattgaaggcaagggaattacagctaaaggaaggtgagtagattctagaagagtttctcatagattcttctctgtgtatgggggtggggtgtcgagagagagagagagagagaaagttaataagttaattagggccattcccccaatggtggaggggagaggagagaagaaatgcacacttggctgtactgaacaaaaaaggaagagcttgatcatcctttcaactaatggtggctctgcagacattgggaaaggcagtttgtagcgtatttcattatcagtcttcatcactgttaacatttgttgggtacttaccatgtgcaatgccagccatttacatgcattatctcatttaatccttagataggttttaaattatttacatttgatagttaagaaaacagagagttttataggttatgcaatttggccagggttatagcatacctcaacaaatatgtgagaaatgaataaatgacttaactaattaatgaccatttaaaatgtttttagtcatttctccctgtttgcaatttgacctaggttattttatattaacaaaatttagtgacagccctgattttgatttgaatacaatgaaaggcagttataacccaagaggcttaattgaaaattagtggaactaatagactaataatacagttgacttaagtaattaattataaatgagtattatacttaacagactttctgtataccacaaaagagaatgtaatatgaaaaagacgtcattatcaatagcaacaaaaacattaaacatctaagggtaaacaatatgagagaataaaattttactatattgaaggatataaaatattttaataaatagagaaacataatttcttgattggaaaattcaactgataaagatgccagttctcctcagataaactaataactttaatgtttccacacctggaaccattctttgcacataccctcctcacctcagagcccacatgagctgggatcccccttggtgggccacaccccacaaggatgctgtccttttgcagcttggcctctgctaccctcctatggagggacattgccctcatctctggtcttagtctgttttgtgcttactctgttttgcactgctataacagattacctgtgactgagtaatttatcaagaatagagatttatttctaacagttctggaggctgggaagtccaggatggagaggcgtgcatctggtgagggccatcttgctgcatcatcccatgggggaaggcagaaggtggaaggcaagagaggaaaagagagagagagagagtgaaaggaagggggctaaactcatatttttattagaaacccactcccaggataattaatccactcataacagcatcaattcatttatgagggctctgtcctcctaaaagtcccacctctcacctctgttttattgaggattaagtttctaacacacgaacttcgagggacacaataaagccatagcacctcccttgggctggtgctaggtcaggctgctgctctgcaggggatccccttcacctggcttggcctctacctctctatcctgggccactcctttgcatggatacactccttgactgtaacccccaacccaggctgctcctcgcatggacaccctcctcactccacttgagttctgattctctgcaggcagtcctcctacatagaccttccactcccttttgggtccccacattctggagcgccatggctcttttgcacatcttacccagcacggacacttactgcgctgcgctcctcctaaagattttagaactgaatggtgtgggaggggaagtgaagaggtacaggaagaggaagtggtcacaatatgtatcatatcaagaataaagaaggacacacaaaaataaagaaggagaaataaagaaagagaacgtaatttttattttaaaaggatgcacagaagaaagtgttcagagagataaataaaattttaatattgattatctctgagtggtggatggatgatgtgtggatctggttttcttcttcacacttttatgtaatttctgctaatatattactttcaagttataatgaaacagcagtaaatgtatttttatttgggccaaatcggttaggaaacacactaaccaataaaagataaaatcaaaggaaaagcaaagaaatatgatggtgttaatttttacataggaatacattgtcttagctgctaagtatttttctttcagtatttcacatattaaggtagtctcttctctttttccttctttctctctcctcttgttcctcctcctctacccctcaatatttagcaaacgcaaggcagggaaataccagttggccctacacagggcgtagcgggcatgttgttgatcacatgtatacattgagagaaaaagaacttggagccacaagtgaaattccatgttgtgactgctttctgaattctgacttcagtgatactcattgtgtaatccaatcagttcatgcatagaattgcagagatttgggggcttaatatagttactgaaactatattagtctaaatacatcttttatttctaagtaataagacttcatttcctaccatgtccatactggccaaagcattataatttaagaggaaattttagttccttttcgtatgctataaagacatgtgtgataagtctaaaaaataattatatcgaagggtataatcaagataggtgaagagtgaggtttccatatcaatctcagttttctctttgtgagaaggcatgccttcttcgttttccttgttggtcccttccatctgaacagttaaggctctggaaattctgtccccactctccttctgcatttgttcttcccctccccttccccgcatcgtggcctcattaacccttcattactttcttcttggaccactgcaggaaattaatgttatctccttctgtctttccttatttagataagcctgataccagagtaatctttctgaagtgaaattctttgtcggtttaaaaaatcaacactacatccccaaccttcagcaacatccctttgcctaacaacctaaggctagattcctcactgttacatctaggatgcccccacatggctcacactagctttctcgagtttccaccattgccactcctcagcatctttcccattactcgactttttttctgctcaaattcctccatagccacccttggctcctacatccaaatctgaactcaccccattcgtccacgtatgcctttcttagtgtctgtgatatggtttagacgtctgtcccctccagatctcatgtggaaatgggattccgacgttggaggtggggtctggtgggaggtggctggatcgtggggacagatctgtcatgaatggtctagcaccatcccctcggtgataagtgagttcttgcttggtgagttcccgtgagatctggttgtttaaaagtttgggacttgccccgactccttgctcctgccctcgccacatgaccccgtctgctctccctgtgccttccaccacgagtggaagcttcctgaggcctcaccagaagctgaataggtgcaaaggccatgcttgtatggcccgcagaacgacgagtcagttaaaactcttttctttgtcaattatccagcgccaggtatttctttttagcaacacaagaacagcctgatacagtctaatttcattctaacttacatcatcacaagtactattcttgtctcccatattagattttgatgggcaactataaagcagctgtcaaaaagaaattaatagaaagttgttacctaggatgaaggtgaaaagcagattctgcttaatgatgattagactgtatgctttttggttgtttttggacgctggtcatagaaacagagaaccaaagtggaacacattcagaagtgaaccctcagtcgtcaagggatctaaaatcacctcactttagtgattgaaaacatttgaaatatttagacaaagaaaagaaatctgaggaggaacacaataattatttttaaacttttgaaggttagaataggctgtttttttttttttttaacaggttcccaaagacagaattataactcatatatggcagctgcaagaggcagatttctgtgctacttgaaaaagtaactcttttgcagttagtactcttttaaaaccttaggggtcacagtggattcttcccttttgtttactctcattaaacacagcagcaaattctgtcagacccatttccagaatctctctttttctttctcttgtgtcacccttgtccaaatctaccatcatcggacatggatgacagaagagtgtccttactaaatgtgcccctgcaatccattgcctgcacagttgttagaggatcttaacatgtaaacctgagcatgtcactcacccactgacaactccccactgcacttacaaaagcccttcctcatctgagctggtctagtctgaccttttcccatcaccctccatctcctccaactctgctccatccacactgaccttctttcggagtctcatctgcttcaggcatttcctcacctgaggacatttgcatatgccattccctctgtttggatcctcttcctggagaatgtcacttgctggtttcctctgtcagtcagatctcagttcaaaatataagggctcagtgaagtattccagaacaccccccatgcagtgtctcagcttcttcctgctccttatcatcttagaccatttcattttcctcttagctcttgtcactatttgaaagcagcttgtttgtttatttattgcttctttgttgtctgccccacccccctttagcatgtaaatgataaaaagaggaactttcctttcttcaccactggagcctgaaagtgtttgttcttgactaagcagattaataagtgtttgttgactgacaataatccataggctgggagtttcacagagtgaaagttaggcttagaaaggttaagtaacttgtccaattaataagtatttgagttgggtttgaaatccaagtttcagccaggcaggatagctcatgcctacaatcccagcactttgggaggccaaaaacaaaattagctgggcatggtggtgcatacctgtagtcctagctacttaggagcttaagtgggagatctttactgcccaggagttcgcagcttcaatgagctatgttcgcaccactacactccagcctgggtgacagagccagaccctgtttctaaaataaataaataaataaataaataaataaataaataaataaatgaaatccaagtttcttttgagtacgaattttatgctttatcatgttgccccaaaagtcctgtcttagaaagtcctgacatataaactagaactatggacatttggcttactggagtcaaaagacaaaattacaacaaattttatttaaagatctaattgccttttatttgccactattaccatgtcaaccctgtttctactactctcaccaatactttcaacatgaaactagaaatttaggttaagtcagaccaagaaccttcaaagccccaagtaaggaaaccatacttaatttctgttaaccaaaaataaggactgcaagatcttatcttacatcaactgaatgcaaatcaatcactttaattgagctaactccttcctagattggtgggatccaaccccacgaaaatttagccaacagctaaataccctagtcaactggcttcagtctacttaacgattccattctagaatcaagcagcacctcagttgctttttagacagaaaagggctgaagaaagtagaaacaaggaacaagaagcaaattggccttttcaaagttcccttccttaaagggttaaaaaacatcgtgccaaactaggccccttttaatggattgccatgaatctcctgttttcttggataaggcccatttcagagttctgcttgattatgtggcacttagcatgaatgacttcattctggcctggtctgctggggcctagtgcaggaggctagatcaaaacaatggcctcccataaaactttgttgggtggggatctgtctgacattttacaactcaggtgcaaaattatttttgtgtttcagcaattctttaaaaacacacagaggcactaaagtttagcagaattcaaatatgcaagaatttttaatattaaacagaacaagggatatgcatatttaaaatgcaacaaagtcaagagagtactttgtttataaggcagattttcagtgcatttccaagttggtaaacacattgctgtcaatgtaaagatcaattatagtcatatttatataacattttatgatttgtaaattgctctcaagtacagtagctcaactcatctagcatcaaaaatacttcattctttttcttagttgtacatggaatacaaaaggtagtaaaaatcagcagaagcactctctaagtcagtgtttgctttgctgagagcagcaagcatttactgagtgttggaaaatctagtgaaatctatgatgtggacataattcttagctccattttatagatggggaaatgacgttatcagggtttggcagctttctgaaggtcacacaggtaggcagggcctgagccaggatctgaatcccttctgcactgacgtgctagcggcattaacctctcctatcacaaatctctgctctgctatcacaaatcagtttaagcagatgtgttacctgttttataccgtgtgcattgtggatcaaggtggtaatttaagctatacatgagacaaatatatagagttttcaaataaagtaaaaagaaggtgaggagctagtgaactgagttataagggttttgggaaagtcctttatagaaaaagaatacttcctatcatctattgcttttcctcctttcccttgattgctccagaagtttgctgtaactttatctattgccattaatgttttgaggctatgatcctctgtgagtttactatgtcatgtcgaatttttctgataaaacttcagaagtttttaaaactgaagccacgatcaattgtgaatataccatgtatatcatgttagatttttctgataaaatgttttaaacttttaaaggctaaagtgcttttgaatgtctttttatatgtagaaattactgatatttacctccattgttacgctgtcttctaagatgtaggacttgaaattgataagaagatacaagcttttaagtgatcataaatgcaaattccccagcaaagtcattacatgcagggggcctaactggaatgtaaggtataaacatctttatcatcctctgccctcaatgagctaaattaagggtgatggtgggagcaagtaaggatggagagctctgcagtaaatgtacaccatggtgttcacagagatttgagaaacgttcagggcattaaggctatgcgaatttttttaatgcacttggtcaattgctgttcctcagttgattcgtttatttgaagtaaaatagcacatggtagaagtataggactttgagaaaaagtatccaagaattacttccatattattcctcttaaaaaagaattttgttccatgtgtttcataatcttcaaatgatttgggggaattaatgctgggtactttgttggcaacataatctattttccaagtggaaattccataaaatatcttttacaaatgttttgaataataaacatcaatttacaagccaacttgtcccaaaaaattgtacatgtagaaaatattaactctttcagaagagaaattcagtctctattaaataaacattatatctattttaatctatctaaggtgttgtggttgattttagaaggagcttgacatcatatatccctgtgatcacagtttttaaaaactcaattattactaaaaaaattaaatctgagtaagttataaaataggacaatatcatacaatttttcacatatttattaactcaactgatttataatgattcctcattatctgaaatgcattattctaattttgggggaaatgcaatatgtcaaaccatgttttctaccctcgattaatttccagtatattaggggtagatataacatgtacagaaataacaaagcagaataaaagtaagtcccctacctgttataaaattctagagcctgaccttgtctatagcacagtaggtactcaatgtatatttatcacatgaataaaataaatgaatacaaataaatgggtgagtatctcattcttctctttggctgcataacatcccatttcatgactattaaaatagatttaacctcactattggatatttatgttgttttcaatcattttgcacatgtgaataaggtaaatacctaggaatagactttttgggttatttcacttctgacggatgctgccctctgtagagattgttcaatttacactccaccagcaatgtaggagaatgtctttcttcttcagtgcgttagatttttgccaaccttgtaagtaaaaatatttttgtagttttaatgtgtgtttctcttttttatgagtgaggaaaaaaacattaaatgattgatatttccttttctgtgaactgtcacttcttgtgctttccttatttctcctaataggtttttttcttaataatttgtgtaaccatttttaagaaaatgatctctttgcctataagtaacaatttttttctctttttttcttttctgatttttttttttttgagacagagtcttgctctgtcgcccagggtggagtgcagtggcatgaacatggctggctacagccccgactcccctgggttcaagtaatcctcccatctcagtctcccgagtagctgggactataggcacgtgctgccacacccggctaatttttgtatttttttgtataaagagtttttaccatgttacccagggtggtctcaaatttctgggctcaatcaatccacccgccttgacctccctaattgttgggattacaggtatgaaccaccgtgcccaccatattttttttcttgccatttgtcatttgaacttttatttattttttggcatgcaatatttttaaattttcttttaggcttttaaggttttctttcatcttcggaatagcccttatcagtctaagatgttttttgaattctcatggagaattttcatagttttggtttgtctctttgtgttttgggagttgctgtttaaaattgtgagctatctgggatacatttagttgtgaggtataaggtgtggaaccaactttattttttccagatgactaatcaagtgtgccaatactagttcttcaataacccataaaaattacgtgcattattcaatgtaaggattaattgaggattcactcagtataatttgagtgccaaacaggaaagatgaatttaatatatttgatgttcttcctgtttatgtatactggtgcttcagtacagatttattctgggtcctttgacatgatacaggaaatgtgccattctctgtccctgccattccactttcctgtgctccacctgggctatacagtagaacttgacaaccaaccaggttttctaattaatgcttacactttctgttgcctttcccccctacctgtcagtttatctagctaagcatttttctccatggcacctatcactgcattgtttgtattctcagagattttggtctggcagataccatcagtaattccatctaattaaaatttttttatataataagcaatatttaataataataattagaaatagattttgattacatcttaaaatcactgcaaagacttgtcatatccagagaacttccgaggtttataagcctaattagacagttgcctaaaaataaaaaaaattgtgaataaagatagcctattttagagaactgttatctctaggcagagctctacaaaagataaatgcattgataacaacccatcctctctcttattagttttttaagggatccatgtacttacttgctgacagtgtatccttaacaaggtgtatctcaattgcgttccaacttagaagtgaactaggaacaagtattttaaaaaatattttaaactttaaagtgaccctttgtattaaagtacatagttggagttaatgctataggccagaagaatggctaactgtagtaaatttattagctcttccttattgagagacagatggggcagagaataactgctaatcccaagaatacattctagttcacattttgacattttatatatatatatatatatatatataatatatataatatatatatatatatataatatatataatatatatatatatatataatatatatatataccagaatttttctagcttagtaaaagtaagctaactttggattgtgtttttgattgcatttgaaaaatattgttctatttattaatgtccttgtaagtgaaatgataaattaatgttttcattttttagacataattttcttttttgttttttctgctttaatttttaaacaatggacagctaaattggcattgttaattttggttttggattagtatttatactatttggacagtgcagtgaatttatttccgaccatatctttagaaatacttgtgtttttacaattgtttgaaaaaactttgtctacaaagcagactgattttgactcaaaaaatctttttctcaattgcatagttaattttctattattgcctaaaaattgtcatttagctctgttcaaagtttacctacagttgtggaaagtagtatattttaccttgctaattttcattgtacagttcatgtgaagacaggagactagataatatcaatcgaaatgggatggtttgagggaaacaaaaaaacctttcaacagagtttgggatcgtggagtctccccagcctggtttgtccatggtgctggctatagaagaatgtgttccatcagcagcttacaagagattctggaggtggatgagatttccctgaagtcactaataaaaaggctgcattgttaataacagaggtgctgccattgaactaaattttcactggtgtcattagaaaaatattcattgagcacttctttgtgtaagtcatagtcatagcagcaacacttatttgatggtcaatttcacctaatgtacctgattcctaaagggcagataaatcccaatctcctccccaatttgtttaaatgtcagtggaaacttgtttgtaacatgttttgagaaacattttattttcgttgcttagaaaataacatagaagcagtattgtcttctgtttgatttttgaatgtttagagcaaacccagtttatgtgtgaagcagccagaaaaggatgaaaatcttgccaggatttgatcatggtgcaggattaagtatttataaaactatgtgctgtttggcagagttgaggccatctgtccttcagatgagacagaagtgcagttgcactgctgtgtgtgaaagacataaacagagatattgcatgctttgggaaagggaagcgtatcatgaatattaggaaaacatttactaaggaaatttaagcagtggtgaaattgattgtttaaggttgccttatagctgttattatttctataaaacttcagagtgagtttttgtctacattagtacatgtttttggtgtggctagtgaaaattatctattttctttcttcctttctttttcctttccttttcctctcctctcctccttatccttctcctctcttctttcctctcctcctcctcttcctcctcttcctcctctccctcctctccctcctctccctcctcctcctctcctctcctcctcccctctttcctctccttctcctcttacctctccttctccttctcttctcctttccttctcctctccctctgcctctcctctcctctccttctctttcctcttccccttctccttctcctctccctctcctctcactcttcttttccctctccctctcctctcctcccttctcctctcctctccttctcctctccctctcctctcacctctcctctttcctcctccttcttctcctctcctctcctcctctcactctcatctccctctccctctcctctcccctctcctctttcctctccttctcctttcctctcctcctctccctctcctcctctccttctcctttcctcaccttctcctctccatctcctctccttctcctttcctctccttctcctctccatctcctctccttctcctttcctctcctcctttccttctcctcttcttcacctctccttctcccctcccctcccctcccctcccctctcctctcctcccctctcctctcctcccctctcctctcctcccctctcctctcctcccctcccctctcctctcctcccctcccctctcctctcctcccctcccctctcctctcctctcctctctactctcctctcctctcttcttttctttcctttttagagacagggttttgctgtgttgcctaggctagatgcagtggctattcgcatcacagtgtactacaacctcaaactcctggactcaagtgatccacctgactcagcctcctgaatagctgaggctaccattgcatccagcaaattgtctattttcaaacaagtttttgagtatctttaagcttcagagaatttccaccagctggtaatattatctactatttgctttcctttcattatatgaagcaagccagattatctatctatctgtctgtctgtctgtctatctatctatctatctatctatctatctatctatctatctatcatctgtctatctattcatccaatttttttttatcccttccttcctattttcattcatttaaagtaagccttctggggactatcattataattttaaatatgatctttatagttctgctataaccatttaggacaaaaaatgtagcactatgatattaaaacttttccaagtagaagagaatttcctaaccatggaaatagctgatggatcttttttcatttgtttctaacttaattttcttcttcagattcatacttagttgccatagtttctcatatccatgtggacatgtaaaaattatttgctctttttttagagtaattttttcatagggggttcattgaagaatttctgagcctttacgtattttgaaatgtttttgtttgggaattacatttgatttttagtttagatggacataaagtccgtgtttcaaaatttttcatctataaaggtattggatcttttagcattcaatgctgatgatgataagtctgatgctagtcagactctttttaggaatcatcttttctctctggaagtacttgatattttctccatactattgacatttgtatatttttctacggctggccataaattagcataactgtgtagcttaaaacaacagaaattttagtgtctcacaatttggagactaggagtctggaatcaagggttcatcagtaccatgctctctctgaaggctccagggaagaattcgttccatgcctttctcttagcttctgaggtttgctgacaatctttggcattctttggcttgcagctgcataaatccattctcttcctccatcttcacatcgtgtgtgtccctcaggtatttctctgtgtctctccttcccttcttataaggacaccagttgaattggattggggcccaccatgattcagtatgacctcaacttaacgtgattacatctgcaaagaccgtatttccaaataaggtcacattcagggggagtgatgattaatacttcaacatatactttttggggatgcagttcaacccaaaacagcattctaaaattctaccagaatacggccaatatgcttacttaatcctgtttaacatattgtggacctttttaatttggagatgtacatgtgtcttaagctcaaggaagttgtcttatattgttttcttaataatttcttctctcacattgtatctgctatttctttctggaacttatatttgttagatatttaaattcctgggtttaccctctttatttcacagtctctctgttttattctgctttttgatcttttatgcttaatttttagaagattccttgacttcctttccagattaccaattgtgtttctatcagttatttttcagccaatttttcacatgtttatgtatgcaaggacattttaatttctaagatgtcattcttctttctgattttctaattttttggatgcagtatatactcaaattctctgaggacaataattaggattatttaaatatttcttgcttttccttgagtcatccctgttttcactaggattggttattcttaatggtattggttttccttgtgatcctaggtggtgtgttcgtaattaggaaagtccgtaatgactggcataggtttccactgcagttttaaaggcctgtttccttcctagaattcttgtataaatgacagggctgacctggaattctgtatgagaggccaaaggctgaccaaatgatactcaggctttcctttaggctgtgtttgtgtttgtgtgcgtgcatgcatatgtgcatgtgtgtgtatagcagaggcagactgggaacaccagtaaatgttaagtaaggagggctttgcgcaggagttggagaatttaatatatttcctctctctgctggtgctgcctcttctctctccccacattctatcttttttttttttagatggagtctagttctctcaccaggctgcagtgcagtggtgtgcaacctctgcctactgggttcaagcgattctcctgcctcagcttcctgagtagctgggattacaggcatgcaccaccacacccagctagttttcgtatttttagtagagatggggtttcaccatgttggccaggatggtctcgatctcctgaccttgtgatccgcctgcctcggcctcccaaagtgctgggattacaggcgtgagccaacacacccagcccacgttttacctcttacttgatggtctctgccattacttcaagctccattttgcttctctatcaagttctaacacctgcatttggcattctgtccagtcaggtattctactttcttgagagaacatttcttcatttctctgactttgtcctccaggtaaaaactgcttctgccaactgctatgtctatgctaatcagagggaggagggccttagcttcccagctcttcagctgttattattttttttaatccgttgtcattgatttaatttggataaaatatagaaaaatatatcctttgtatcttacctttgtcttttttttttgctatacaagtttttcttcatgttttgtgttatttctttttttttttaattatactttaagttctagggtacatgtgcacaacgtgcaggtttgttacatatgtatacatgtgccatgttggtgtgctgcacccattaacttgtcatttacattaggtatatctcctaatgctatccctcccccccttcccccacccctcaacaggccctggtgtgtgatgttccccttcctgtgtccaagtgttctcattgttcagctgttattctttaatgagttgccccatatccctgctgcactttgttttggttgactgcacacctgggaagaccttttctaactctaatctcttgtggggcagtttcttctcttctttcgctgatggactaatcccatcttcattttgccttgcaaaaatgcttcaacattactgctttctttgtgacaagcattctcaattttcagtattgttgtgatgtaaacttgttaaaatataaatttcagcagatcttgggaagagagcagatctcgggaagagtgccctcttccaatgcagatgttttacactcttcaacttgttatttctattctcagatgtttcatcacatacaattttgtgtgcacacaaacactacttaaattaatgaatggagtggaagaattatatcgtgtgttttatgtctgctttcttatttatgttggcatctgggaaggtacaaatatgctggttgttatacagtgtgtttctgtattgatgctgtataaagtacatttcaagcatgaatcattaagaaatcaaataagttcttgaatgtttcatgaacccactttactaattggtcttaagaattgaaatacattcaggttagaagcttttacagttatataaaacaagttaatggcagagtttaaagatttaatattttttcttttatgtttataagattgtatggataatatgtaagaaactttagtcaaattaagagggaaatattttaaatctttctttttcagcaaaaaatcgtggaattgccattccagtggatttggacagccaagttaatactcttttcatgaagagccattcaaatatggtgcagagagcagcaatgggttggagactatcagctcgctctgggccacgctttaaggaagctcttggagggcctgcttgggattacagaaatattattgaaaagttacaggtacatgaaagcgtgaaatagcattaatattttctaaattatattttttaaaaatatgtagtcacataaataaaatatggtttaaaatatcaagttctatttggggaccaggccttgctttacaactctctactaccactgctctttttaaacatatagcttccatatgtcgtgagttattttttaatgagtgtatattaataactctgttttgatagtatagtagtgaatagtgggtcttaatatcaaaataatgatcataatagcaatgataacactggtaaatcaactaaatattcataatcttgcttcaacttatgttttagtattcccttctaatcctttggtcagaatgatccaagcaccttgctcccaaattacttgtatagtatctcactcctgatttaggcctggaaattgtattagtttgccagggctgctgttgcagaatgtcacagacttggtggcttaaacaacagaaatttattttctcatagttttggaggctagaagtccaagatcaaggtatcagcaggtatgctttctcctgaggcttctctcctgggcttgcacatggtggacttcctgctgtgtcctcataggctctttcctctgtgtttgcacatgtctgtgtcctaatcccttcttcttataaggataccagttatgttggattagggcccgctcatatgaactcattttatcttaattacacttttgaaagccctagctctaaagacagtcacattctgaggtactgtgagttaggccttcaacatatgaaatttgggggagttctaattcagcccataatagacatcttcccattcacataattagtagaatattgcatggagttgaattggggtatagtttgaagaagttttttttctacaaaatggccaagacattaactgaaataaatattatgagaggtaacatgtagatgagtgttatacgggattagaaggacaagttagattcagagagtatgagaaacctaaatggtgtgagacattaaaaatttgggggaaaatgccattataagtggttcttgatttgtaggatagggttatctaaaagagactagaggaagagggactagtgagaagttacttaaggtctaagccaggtggtgatatggatgaaatgaagaaataggtgttgcagataataatgaaggcagggtcagcagacctggggctcttaggtggaagtagagacagggcatgagaggagtttaagaggccccgatgattagagactaggtagtatcattaagactgtttattttaagagcagaggagaagagaatgcaataggagggcaatggaaaatacagtgaactagggtagcaggctactgagtatattggaagttaagtctatatttgaagataatagttggagcaaggatagtggttggtattgctaaaagagaaaatacagtgataggagaaaaaaaaagaacgccctatgagaggctaagggtagcagaatggccacataaagagtgcaagaaaaaaaagtgggtcagaaaggaggaggatcaggagagcaaagggagtggaacatttcagaggagaggtatatagtagtgccaaccagcacagagagggtgtgccttaaacttcttttagtaaacttcttttaatagattgatatccattaagtaagtatttatttagtgaaaattctatgctagccactgtgtgaagtgctaaagagagagccatggggtctatgctcttctgggacatgcattctaactcattaaataaatgataaattgttggataattaaaactgcaatgtaaaaaatagaacagagtaacagcatggtggagaattactgggagggtggccctgtaattgtgaagttcctctctgccagagtaacagttgtgttgagatatgaataatgaagatgaataatctattccaagatttaggttcagatagttttatgggaaggaaataggaaatgcaaaggtgcttagacaggaggttgatgggtttgaagatccaagaaaagcccactggggcaggagtttagtgagtaaaggaagaaaatattatgagataaggggccaaatcatgtagagacttacatggtgctatggctgtgccctgagtgtttgtgtcctcccccaccccaaattcatatgctgaaattctaacccccaaggggatagtattaggaggtgatgtcttctgggagttgcgattagagtccctataaaataggcccgtgcaagctcattcagcccttctaccatgtgaggacacagcaagagaagtaccctctatgaaccaggaagtgcatcctcaccagacaacaaatctgctggtgcctgatcttggactttgcagcctccagaactatgagaaataatttctgttgttcataagctactcagtttaagctattttgttatagcagcctgaacagattaaggcacatattaaggcattttaattgtattctatgtgtgatgacaactcattgaagattttcagcagaggagaggctgacctggtttactttttaaaagatcactgtgaattctgagtgtattataagatccagacatggaagcagtgaatctagttaggtagctttgcattaattcaggcaaaaggtgatggtagcttggcttaaggaggtaacaatagtaatgcagagaagtgtattaattttgtatgtatttagttgtagaactaatagaacttggtggatgaatcgatgtgttgtaggataatggaaagaagaatcaaggatgactctggttttgatatgattgtgttatttactaagataggaagtaatgggagagaaagaagttgaggctgagttgaaattaggagttctatttggggaattttaaagttgagatgcctatttagatacctaagtgagtgtgtcaactaggctgttagataagtgagtctgaagtggtttagaaagatgtccatgctggaaatataaatgtgggagttccaacatacagatgttattaaaaccatagaattggatgagatttctcggaagaaaatgtagatagcaaagagaaaaggagcaggagctatcaagagttgatgaagaaatagtaaggacgtaggtggaaaataaagtgtgatgtcatagaagtcaagagcagaaagtgtttcaaagagcagaaaccagtgtgtaaaatggttaggagtgattaagatgaagacaggcaagtaaaccactgagtttgggtgatgatcacagctaactggtgctcaataataaagattactagcatttatatggaataagtggcctgtatgtgttagaggatgttctatgcacttacctttaatccttgcagcaaactcacgtgattgttagtatcattatcctaagctttcaagtggggaaacaatgacttagggaggttgcatagttgcctcatgaccaaaataagagttaaagacagaattcacatcacagcagcctgagtgctatttgtttaatagatgaaacaaagaagaggtaatctaaacaacagggacatttaattaaatattgtcatatttgataaacatgctctccccacttttatataatatctagttttcccctttatgctagttcccattagtctcttttaattgttttcagacatttctcagaaagcttatttagagtggttgaagtagaaatgatcactttttcagaaagagaaagaattaaaacatgaattaacataatttataagaaatcaagagggtgacatccccatctgtgcttctgtagctaagagtgacaataagcaattggcaatgttctgcttgataaaaatatgccatagctatgggtgaataaattgttcctttatgtaagaagttagtttttttttcttctaatgtagtttaaaaataaaatgggggtgctttaaccattaaagaatgtttaggaaattatgattacctgcagttcattttagaaacatatcagttaagatgctttcagctttaaataacacaacattcaactaaaagtgacttaaataataaagaccatatcatttcacatagcaagaaacctggagctgtggctttccttgagtttgctaattgtaggcctgggcccctaaaaccaaaggtctgtaggcattcagcttgatgctggtctcccagggtcacacgagggctgtctcagatttcggattcacaccctcaagctgccttgagagcagtaggtggttttgaaagaacctccccacacaccacatgtaccctgctctctcagctgacttcacctgatgtctcattgactgggactgtgtcgcataatcatacctggacagattgctacaggcggaaatgggataaccatgcctctgcttagagtaatcaatcttgaccctaagctgagggggctcatcccctgagaatgttgtggcctgactcagaaatgacattgagattctgttagcaaggaagagagtgaagaaaggctgttgggtaggtgaccaatagggtctctcaaaaaatataatttgaaattctgttgaatgtcactgaacccatgtatagtactaatattgcttcaaataatatttcagtgactttccccattggatgaaatgattcattctgaatgaccaatgacacatgggaattttttttttttcaatttgagacagggtttcgctctgtcacccaggctggagtgcaatggtgctatattgcgtcactgcaacctccgcctcccaggctcaggtgattctcccacctcagcctcctgagtagctgggaccacacgcgcatgccaccatgcctggctgatttttgtatttttagtagagacatggtttcaccatgttgaccaggctggtccccaaatcctggcctcatgcaatccacctgccttggcctcccaaagtgctgggattacatgcgtgaggcaccgcacctggctggaattttttttttttttttttttaagctgttccctgggtattcccctaatttattgcaaagtaatgagtacctctcatgtctccattataatcctaggcactgcagggcacatacagtggcttaactgacttttcctctataggtgtatatccttagaagtcttatagctacctgtccgtcccttatcttataaacaaaaacacacacacacacacacacacacacacaaaaaaaaaaatagagacccaggcaatattcttacataaaaccagactataattatggcacagacatttgctgctatggaaatagaggggcatctataaaattcccattagtattcttgagcttgtcttatcttcgaaagatgaaatctgacttacgccttcatgtgggttctcttgtgtttcattccctaggatgtagtggcctccttggagcaccagttcagcccaatgatgcaggctgaattctcagtgttggttgatgtattgtacagtccagaactgctgttccctgagggaagcgatgcaagaataagatgtggcgctttcatgtcgaagtaagtggatccaatctgagattctgctagtgtcgtcaaactgacatggcctctaacatttccgctttatacttcactgatataaaatgacagtccgcaaagtatgcgaaaggtctaaaatccatgttaaaatatactgccagaataattaaattgattcatttgaaattttattttggtgaaggtcaagttatcatattttactaaatttactgaaaataaagtgtgtcattatggggcacaaagtatcatgcaaaataatattttggtcctaattcctttccataattatatggtgtgacctttaaaaaaattcttgtttaaagtcacttattttcattaacatagggagaaaggaaaaagagctagcttttattgaggtcttactattgtcatatgtgtttaactattattttatctaatctgcataaacacccagagactgggaggtcagcctgattcagagaggagattgctgaggaccacgtgtgcttcaggtgcagggttagtaagactcagaccccgcacatggccatgctgcctggatgatcctcatctgccgctcttccgtttactgatgtttcttagcgtttgtggtattgcagatctattatagctgatatgtttaccctagagtatcttcatcttaatgataagtgaaaaattctcaagggagatgtgcaaggataagcagttgtgagaaaaagcataactagttccagaaagaagagacttgtctttatgtggagggcacgttattgagggggatccgcaggtcgtcacatgtagaccctagatggccagtcagaaagagggtgcttggtcttcctgggaagagtatctggatggagagtcagtgagatgagcttgccaagccccttgaccatgactcatcccagctaattcctgtgtggtagagggtattaccaaaatagatctggaaacctcttctatcaactgtgatatatcgaggcagagattaaaggactagggcacacaagaagtgtgttcctttctttcaccatttaagctggaaccttgggagtgaaaacaaggtatgggatgagaaaaactgactacagggatcatgttgaagaataggtggggtttttatactatggccagaatcaggtatttttggctttagactcattgcgtcttagggagattgggaagagtgtatttgtccagacacctgccagtcttgtgagtaaggattttaaagtgaagaggccctgagtgtacaactgatgactgctgagaacagtagaaagaaaattttaagtggaggtattgcctagtaattcactataaaaatagggtgttgagcgcagttcattattcagatgatgggtacgttgaaagcccagacttcaccactgcacatacatgcatgtgagaactctgcacctgtacccattacagatctaaacataagaactaaatgaaaaaaaaaagcaaagataataggatctttgataaatacccttcatctcctataaatatatgtcagtgtatggaatatgggttaaaagttaggcgataaacctgttaaattcagtaaattaacataatacaatagctatatccccgagatgtgacagcctggaacgggttggcaagctctggccctcaggctaaattggtcctgctactcatttctgtaaataaagttttactgaaatacagtagtgctcattcatttctggattgtctgtggctgctttcatgccactgtggcagaatcagttagttgccacagagactgtgtaccccacaaagcctaaaatatttactgtctgatcctttagagaaaaggtttcctgactccttgtcgagaactagggtgccagtatggtagctactagccacacatggttatttaaattatagtttaaatgaattaaaatgaaataaaaatccacttcctcagtcatatctgcaacatttcaagtgctcagtagccacatgtggctaatggctaccaaatttggcagcacaaatatggaacacgtgtatttttgcagagagttctgttagacagcactggtctagaacttggagatactggtctatgagaaagtgttatgaagtaactcatgatatcaagcaaatattgagctgtgctgcagatggagacaagcctgtggcatcattaggtaacctgaaaggagagaagcagaagtgatgtgataataggaatacattgcagatcccacacgcacatgaagtaaaatgatgttgtgtttacatgagtagttctagaagggatttttgtgctattgcaattatattacagccagagcctcaggattgtctgttttctgccttactgctcaccctaccacttccccaactctgtgaagaactaagggtttcctttgtaagaatatcttacaaaattaaaatccaactttatgaatagctttgccaggggtctttttttttgagacggagtcttgctctgtcacccaggctggagtgcagtggcgcaatcttggctcactgcaagctctgcctccctggttcacgccattatcctgcctcagcctcccgagtagctgggactagaggcaaccgccaccaagcccagctaattttttctgttttttaagagacagggtttcaccgtgttagccaggatggtctcaatctcctgacctcatgatccacccacatcggcctcccaaagtgctgggattacaggcgtgagctaccatgcctggctgccaggggtcttgtattgctgtgcataccatcctggtaaagcttagctggagaatataaatttagggccaagccctaagtagggcttcctgctttctcaaataaatctaattcttggaatctgttgactcagatgagtctgcaggagaatatgaggatagaccccaggacaggagtctacttaacacatagagtgaaagagaagagaataggtcaatgatactgttaacctttaaggcggctgattagagtccattcaaatcaacacctacttctcccttgtgaaggagaatctcagtgtttttcaaaccgtggggtgtgatccatttatagatttttaaactgacttaggtagacgcaaccagctaatttaaaaaatgaattagagaagatacaaattatcagagtgcatctcatagtgagggtgacatttgtgtgagtttatacacacactcccacacaggtacttctttactgggttgttttgtgaaatatatttcttactttgatcatagaaaaatatttgaaagtcaccgacctaactcaaccaaacattatgtggcctttgaataccttttataaatctgtagcaagtggtcattcaaccttatggttgatattttcaatatggtttatctaaggaagagttaaagaaaatggaaatacttagcctgagagagcgaaaaacaaaatcaaaagaaatttatcatgtccaccaaaacgattttcccatatttaaagactattatgtgaatgtatatgcctactatgtatccacaaaaattaaaaattaaaaaaaaagtgttgcgtgaaagaaagaatcgaatagtagaagttttagaaaggcaggcttcactttccttgccaggagaacttttgaaattcttctgcctgctaggcctgaccgcatggatataacaccttttctagactcaacatgtctaaaaggacatcagtgttactttcattgtgtgtttgctacttcttcaccatgtaacagtgtcattttaaactgtcaccattgagctgggtgtgatggctcacacttctaatcccagcactttgggaggctgaagcagggggatcccttgagtttgaaaccagcctgggccacaaagcaagaccctatctctgcaaaaagtaaaaaaatttagccaggcatggtggcatatacctgtggtcccagctactcaggaggctgaggtgggaggatagcttgagcccaggaggtctaggctgcaatgagctatgatcacatcaccgcactccagcctgggtgacagagaccctgtctcattaaataaattaaaaaaaaactgatcaccatccacacattagcctagtctatacatttcaggggtctctaatctgccctgcttcctcttccacttcccacatgtcatcatttacaagtctctgctgtgggtcttctctgttgcttcgtacgtcctcacccaacctctgccactgctcactcgccttgctccgtctcctctgcttcatctttcccgctgccatcattggtctctttctcacaatgggaagaggcattcaggtgctttagaacagtggttccctattttctctagaaaacattccagactcttgaggttaatattccagtcccttctttccaaaccacatctcttacactttcctcttccaggtctttaagtgtcagcgggcagttgtcatgcttctcatttcctggacatgccggccaggtttctgcctctgtcctgtgttcataccattccctttgcagggatgtcttctctcccgagccttccttgccaggtgaaatcttcattagtagcatgctatctcttcactgaaaccttctctgatcagccctaggtaattccccccagcagaatgaagtggtttcatgtctggttcacagcatttgccaatgcctctgttgtggcacttgctcattcagggggctgtgtgcagcctagcatgtgtggggactctgcacaagacccctgagactcaggagatcagtgacctgagtcctgtcaccacagagtcgttcttaagaattttcgctctgaggtcagatggacctgaatgcatttgcaggtctcaccacttaacaatttaggtaaccagaggcaagttgccctatctccctgggcctctgttctgtcatgagcaaaattagtctgaacctgtctcataggcttggtgtgagggtaaattgggagtccctgggaagcccttacacttgaccctgacacctgataagcacttggtagccattaaccagtgaaagttcactttttccccagggttatatcccacagtactcatgttatgtcactgaaattggatcatttaaggaagacatcttacagggtcattttgaggatcagctttttaacaacatgagctatataggcgatatatatagctatataagctaaattctgttaatgaacattttatttgattttaagttcttggggatggtgatcttgaaactcttctcctaacggagcaccagtgcacagtgtaccacttgatgaaaattgattggagtttttgcccaaattatacccaaactagtaaatggttagactgtcttgatgtcacttttgttttgttttgttttttgctcttaatacaaaaactgcttgttcctaccaaaccctggcagtgaaaaatatcatattattatgaatggaaactggaaagcagcctgttatattaaggttgcagagttgtatacagccactgctactgtatgcttaatgtaatacagtatataaaaataatatagtataacataataaaatgtaatataatataaatatttgtatttctctaataaatttgttttagttcatatattggggtgagaatattagtatttcattgtttctcagagtattgtatcccactaaaagaatgccacctgagtaagtttgagaagccctgagatattttgttgtaagacaaaaataatgtgttgtactacaaaatttataagctgaagtgtgatcttaaaacttttgaaaacatgtacctggtttgcttcatattctcaaataattgtgtaaattttttcccctatggcctttgatgtttgtatatagcttgaagagaaatcactgtctttctaaaggtctcatgttttgctttaaggttgattaatcatacaaagaaactaatggagaaagaagaaaaactgtgcattaaaattcttcagacattacgagaaatgttagagaagaaagacagctttgtggaagaggtatttttttaaaaaactttattatttaaaaataaagtaggatttccccaatactgtaacctatgaattacaataggctattacgtgattacttgcattatatcttaatgatgcatgtacttagatgaattatataatttgagtttttatgatattcatctctcatgccttgttttaaactgggaaataactaaaattagagtttcctagatatttgttttattatattcttatattatattcttggatctgtgttttttcctcttatggctttagtggaccaaatgacctttttaaacaatgagtaactgagatgcattatttagattttgtgtaaagttctgccacatactgagaatgtctatgcattttggcatatgttgatttttttattataaatatatattcatgttattttttataatattctgccaagttttataaaataatactattttagtaagtggaatagtcagtttctattcttaactatattaacttgagattcacaagtgattttcagggaaatatcaacctatagataataattgtcagtctgttattaaaaatgacagctcaggtgctcattaagagatagctagcagcatgtttgatacccaaggtgatacacttaaatataaagtataaatctagagaattttttttagctagctgtctgtacttttatgttagatattaaacaaaatttgtaccatgttcctcaataactttttggtctgtttcggtaaatactaatcatctgatattttaaaactggaaggattttatatattactttatgtatatgctaaattccagaaagattgtagtggttgggttttttaaagtgcattcccatcttagaaaaaaatgcaatggaaacttagatattaatagaaagagcattgcttcaaaatattccatgtgaatcaatgtttgtttcagtaatcaaaatgccttctactttgcattagttctctgcatcacttaaattatatttggaaaacaaatgatcaaaataaaggtggtcaatgcaattttagcaaatatttctctaagataggactcaaaaacgtgctttcatatttaaaaaatgataaagagaattccttgggacttttggttgtctttctcttaaaatattgctgtagattgtgggatattgactgaagtaccagattctgaagtagaaaaatgaggtcaatatccttttctggcaaaggacgaggttcacaataaaagtgacttgcacttaacaggaggtacatggcaagtcttccatttttatgtaacagatttttattgaattactccaaaggaaaatcggaaagaaatcaggttaaatttttactttggctagtcaagagtatttttatgtgtctcccaaaccactctaaaataaatcacttgttttctcctttccattcccactgctatcactagttcaggcttttattacctcctgttgagaaaattccaggagtgcagtttcctgagacagaactgctcccttgggtggaggcagggctgctgttttcctaactccaagggtccccatttatgcaagatgtgatgtaaaggacacccccagcacatagccctcacagaagagttgagatgggaaaggctaattgcaagttcttcattcagtcacccaacacatatgttgtcagcaaactattaaatggtgattattgtgcctgggaactggggatactgatatgaatgacacagcttgccaagggccatgaatggatacaattcctgtgctagtggactcccttaatagtgtagggaagagatcactagagcccttcagaaaccatcaggggctctgcacagcgtcagtgttccaggccctccatttgtcctctccacttcacacccccatctgtcttcatccattagcctccggaaatctgtgttactcaatgtacctataatgtacctcaggcttttcctgccctgacctttgcttcatctggaatcatagattgcaaaaatccagtcaagcctcaatgccaccggctatctttgtggaggagctactgggtagtacttatcaattgttccagcaagtggtgattactttctcaatagaattaccaaaatacttcatgcttctcttttaggacactttaggctgtatctggaaatttagtccaagctccttattttatagatgatgccacagagtcccagagaggtgatgtgatttgactgaggttacacagcaagagctagaaccaaagtttaaattggaactccttcctctttgtttaatcttcttactcctttgatcatagccaagttttacaaattttttgcattgctattaagaaaggttagtatactttgtctagcaggtttatggcgccaaattttaagacataggcagacagaatataagacaggaataacatccaaaataggtaaagattcagataaacttctaagaaaatagtaaatatgggggaaatgaagtcatttaactaagaaagaaaaacctgatttcatttttttatggctgaataaaattccattgcacatatattcatcacattttctttacccattcatccgtcaagggacatttgggttgattccatgtctttgctgtggtgaataatgttgcagtaaacatgtgagtgcaggtatccctttgatatgttcatttcttttccttggataaatactcagtagtgggattgctgaatccaatgataattctgtttttcattttttgagaaatctctgtactgtttttcacagtggctctactagtttacattcccaccagtaaggtttgagtttccttttctccacatcctcatcaacgtctgttatttttttgtctttttaataatagccattctggctggggaaagataataccctgttgtcattttgagttgcattgctctgatgataagtgatgttgaggagtttttcatatgcttctcggccatttctctgtcttcctttgagaaatatctagtcatgtcttttgcccactttctaatgaggttatttgcttttgtcctgttgagttgtttgagtttcttgtatattttggttactagtctccagtcagataaataatttgcaaatattttctcccattcaacaggttgtctcttcactctgttgagtgtttcctctgctgtgcagaagctttttagtttaagatagtcccatttgtctatttttgtttctgttgcctgtgcttttcagatcttagccataaattatttgcctagaccaatttccaagagagttttccctaggttttcttccagtatttttatcgtttcaagttttatatttaagtctttaatccattttgagttgatttttgtatatggtgagagatagggatccagtttcttctgcatgtgactgtccaattttcccagtgtcatttattggagagggtgttctttccccagtgtaagttcttatctgctttgttgaagatcagttggctgtaaatatatggctttgttcctgaattcttcattctgttccattggtctgtgtgtctatttttataccaataccgtgctgctttggttagtgtagtgtagccctgcaatatattataagttagataatttgatgcctccagctttgttcttttcactcaggattgctttggctattccaactcttttttggttccatatgaattttaagattcttccaaaagaatatgatatcatgtcatttgcagcaacgtggatgctgcatggaactgaaggtcattatcttaagggaaataagccaggtacaaaaagacaaatactacatgttctcacttatatgtgggagctaacacatttgatcatatgaaggtaagagagtggaaagataggtaacagagactgggaagggtgggagtgggaaaatgaagggaactgggttaaaggccacaaacatacagtatgacagaaggaataaattcaatgtttgatagcagagtagggtgactatacttaacaaaatatgttgtatttgagtgatggacacatcaaatacactgacttgatcactacacatttatatacatgtaacaaaatgtctcatttatcctgtaaatttataagaacaaaaaagaaaaaggaaaagccttataaaaagcatacatatcttatttcttaattttcttgtttcttaattttcatgtttactaaggacagaataaaaaattatagctaaagcaattctagctcttagacaactttttaattctaagtgttttgaaatgagaagtatttctatcagtggaagcagaagacatctcattcccctctcaggaaatcttaaagataagcatattggatctagaaggattcaaacaaccagtttgggaatgagttgggactccatgatctctgtattttgtccattggtccttctgaaacagctggtgctcagtgatccatgccagtggaggggagctaaatggctcacccatttgggtgaaatggccttggatgatagattcaaaaagtagcaaaagatactattgtacaaccaatggtgggctctaataacaagccctaattatcaatagtgggataaggggtggctgtgtttccatgactgtattttttcctactgaccagaaactttgtggtgtgtaaaaccacacaaatttattatcttacagttttgaaagtcaagagcttaaaatcaaggtgtgagcagtagtgtgttccttctgcagactctaggggagagttcatttccttgccttttctggattctggaggccacctgcattccttggctcgtggccccatcccctatctttaaagccggtagtgtagtacctttcaatctccactccctatttcccgccccccttcccacaattgtcacatctcgtcctactctgatgctcctgtctccttcctataagaacacctgtgattacattggaaccacctggataatctggtataattttcccatctcaagagccttaactcaaatcacacctgccgaatcccttttggcatgtgaggtaacatgtttacaggttctggtgactaggaaagggatcatgagggcatgtgcatctttggggagggccattattctgcctatcacaatgacccttttattgacagtgagaaataacatctagaatgtagatgtagtatttacttgtggctgattaatattactgtgtagggcaatttaaatgcaaatgaatagaacaaaaatgcttggaatctatagcactttgctgttttcaaaatattttagaatattttgctacctttcaacaattctaacacatacacagaacaggcagtgttacctccacattgcaaatgtgaaaagagagactcagaaaagtgaattgcgttaagtcacataggttacccaatacctgccctgtaatgcctaaccagctggatttcgactgtgtattgaagcattcccaggagatttatcagaattaaatcaaaacagaaaactcaaaccagggtttttcacacgagctattctaatattacatttgagactccacttatttgaatttaaaatgtcaacttaaaagaaaattactatttttatttccttggttcctgacaccagaagtggtgtatgtgtgtgtgtgtgtgtgtctgtgtgtctctgtgtgtttgtctgtgtgtgtgtgtgtctatgtgtgaaactggtaaaaatttaaaaatagggcaatgaagcataaatttgcttcatggttgaaccaaatgtcctttaaagcaattcccaaccctgggattctaaatttcccgagtttgttagccttctctgtatgatgtattaaggaattacattaaggatatttaatgtaactaaatgtaattagattttacctactggtcaattatttattaaaagcttataatttagaatacccttgagtacaatttctaaattaattatacttagggatattcttccttgacccatgtttcttagtttgtgcctaagacactgagaaataagatacgggtgggcaacatcttaaagattcttgaaagaataaaataaataaaggaaaatttaattttctgtgaagtgtgcctatatgtgaaatcatctagggatcatatagttagttaagctatagtatttatttttaatggaaggataaaatgtgaaaattttttatagaaagtctttaaggggaaaattacctgagttttaaaaaattcccccttaaaatactgtttgtttaggtgactgtgatagaaaagcaagagtttacaaaggatgtaactaacaaccctaacaagtctgagagcttagttttcctttggggttggcatatttagaaggctttttaaacgtaacaacagcaggcatatttatttgtactttaaaaaaatatgtatgttggaacattggggtagggaaagagaagagaaggaatgcttcaaaatggctggagggcagtgtgatttctctttttctttgagacagagtcttgctctgtcacccaggctggagtgcagtgatgctatcttggctcactgcgatctccacctcctgggttcaagtgattctcctgcctcagccttccgagtagctgggattacaggcacctgccacccagctaatttttgtatttttagtagaaacagggtttcaccatcttggtcaggctggtcttgaactcctgacctcaagcaatccacctgcttcagcctcccaaagtgctgtgagctaccgtgcccagcctgagggcaatgtgatttctaaaattctctatccttaaagccattttgttctactcttatttccatgacactctctttctctctccctctctctcctctctctctctctcttcccctgtctctgtcacacacacacacaaacacacacaatatctgatagtatgtgtgtgctgatgaagagaatagctttattaaagtactgtgccttcgttctgtgtatttaaagatactttagaggtccaaatctgtgtagtggtgagttgctaatggagacagaaagagcttacgtggattggatagaggtgggctgatgaggttggagcaggaaataaggactgcactcagaggaatggtttggtttggtttggttttaaggattttgggggtcaatttcccgcatcttgtactctttagtatacattttcatcaagatttatagagcattacaagttatttctctcataaaaagggaaaaacatatataaatcatgaaagtagagatgtctgtcaactccaatcctaagtatataaaattcatagcttctgtactttagaattggagaagagaacgagcattgaaaatattcatggatcgcctgtggaaatggtaatttacagttattctctttacattctagtcaaagaagttgacctatttagaatgacagttacaatttccccatgactatattcctatctgttaatgttacactgacatacatataatctatagggcaacagagatgtttttatagtaaagttcaatattcttaaaatgatcagatttaaaataccatctatccttggaatattgttgcaaaaatattgagagctgcctctgcaatagctatggtacagttttaagcaacggttttaaaaattaatagctagcatttattaagagcttaccgtgtgacattgttattatcagacagtactgtcagacactgttcctaatcacttatatatgttaccttatttattcttcaaccctatgtcatagttttattatctcccttttactggttaggaaactgaggtatagaaagtttttaaggtcacacatcttaggagaaagagacctgggattccaacctaaacagttgcgcttctgagctcacacacttcattggcatgttagatccaaacaggttataggacttataatcacaactcatttattttctcagttacaaaactaaataacatgaaaagttcttcaattttattcttgataaaatttgcctaagtgtgtactggaaagcataatccatttattcagtgagctgcccaggaaaggcttgacacccaccttgtgatcacggtctgagtcgttattaactagaatattagttataaaagttctaaacaatattttgtaagatgactactggagatagccccttgttgaagtgtggctttcaacaaatagcatagcatctaattgagagctgtgatctttacaaatgcccaggttgggtaggtgatatttagacattgaatagtggtagcagacaatggattcttgatttgaaagttgatatccggagtgatatggaataaagatctttaagaaatgatgcctgaattatttttaagatgtcctcttttttttttttaactctaaaatatactgactcctgagttaacaagaaatttattcttatcctcagcaggaaaaaatattgtaactaatcttttatttctaattttgagaagtcacaaaaagaatgtcataattataccaagcaacttaactcctacatcaaatatgcatgtgtcagtcccagcaataattgcattgttgcaaatttgtaaattgtatcaagctcctcttattgtatcaatctgtatagaatcattcacatctatgcatatactcatttcagtttctagcaggcaaatgaatgaatttaaatagaaatgctacatagactgcattgtagcttaaaaattggataataacttttgctgagagaaacacattttagttttattatcagctgtattttataatatttcttattaaatacattttagaggtgagtacatttgttttgtaatataagtgctctaatgttgttttaaatcaaatattagtgatgctgcaactgtgtaccatcttagtcattcccatgtatattgtggttgtgtgcacctgcatgtgttattttattttatttttttgagatggagtttcactcttgtcacccatgctggagtgcaatggcgtgatctcagctcactgcaacctctgcctcccgggttcaagtgattctcctgtctcagcctcccgagtagctgggattacaggcggctgccaccatgtccagctaatttttttttttttttttttttttaagcagagatggggtttcaccatgttgaccaggctggtcttgaactcctgacctaaggtgatccacctgccttggcctcccaaagtgctgggattataggtttgagccaccacgcccagctgtgttatgttttaacacaagtgctatgtcgctaagtggttggaaatatgaaaatgagttgatgtgttcttataataagacatctgctttagtatacattattagcatgctcttccactttggaatttttattttatattttcacttaggcaaaaatactttcaaccattaaagtgggtataaaagcaacagttgcttttagaaatttactcttttcagttgctgggctggtttggtcacttgttagactataaaagtgataaatttactggatgaattatattcattttaacctcattattacaaaaaaattacaaagttcttaactgtgcctcacatttactttactctttcaaaatctcacataatagcactcattgcttcaagggtttttgagatatgctaccactctttagagatctatgactaaaaagtcatattgaaaatattgcctgtactcagaaggtaaccaccattcattgcctctagtaagtataggacatttggtagctaatgattgtaggtgaaaaatggcattgtgattaaaaaacaaacttggatagcattaaaagaaaaaaaaggagaagagaataaggaactaaaaggagaatcactaaaatcaatgtattattaagttatcatgttcatcatttccacctaaatctaaacctaaaaccttttccaggaagtatttcccatttagtttaattccatatcattctaatttgtaatcatttcagcacttatcaaattatatttatcttattagtgtagaccttttcatatcatgccttatgaaggttttctttggtgtatgtactgccattttaaataagttagaaactccttggggatagggctgatgcataatgtaaggggaaagaatgcctaaaaggcctttcagtgctgagaatctaggagggtagagtactggatttctctccagttccagcccaccctccacaaaatggtatactatttgaaagcagagactgttgatcttattcactgaagtatttctatgtctagaattgtgccctgcacttagttgctactcaataaatgtttgcagagggacagattgacacatagtacatgtaaatgttaccagctctctgcaatgcagcacattgaccttccctagtcctatccaagaagtagattctagacatatcatgtcatgttatactttgcatatctctgttacccaggtaacagcaggtttctttgtatttgacatccctgcaaacttgggtgggcagcagagaaccatagcatagagggctgaggaagaagacgtctcgcagaaggcactgggaccaggggactgctgttgtcttttgctcactgtgtggcttagaaagcaaaagaggatcccagacactgtgcacagttatggtgtgagctcagccaagggggattggagcagatgatgaccaaatctgaaggccagccagtggggagggggttccagccatggggcttctgtcccaggaagggcgctcgtcctggatccagtaggaacaagcaagagagccaggctacaaaaagaaaccatgtaggttttcaaaaagaaaaaccatgtagactttgaaccaggaaaaaaaaaaacttactataaaaccaggagaacatggcagcatttgggacttatggggagaggccaaggtccagtcacatgaactgggacactgagttagattaatgagagcaactagctgcagagtccaagtactgttgatctcaagcagcatcaggctctcctgccacaggatgaaattggtgttctgaactgctcaatggtgttacggttgagaggagaaggaatagaaaggctctggataagactgggcctgatacatttcaccttttctatcaaatacactaatttcgggatactgtttgaacaggtcctcacagagaatatttgcaacctggtatatgaggcaccaaaaccacactattattgttgttattatttaactgctattgactaggcatatctagagaagctgtttgcaaggtaacaacgtgtctgtgtctgcttggatcttcacactaactctctgaggaaagaaagtattttaatctccattttatagataaaaagaaaggcacagtaggtaaaatgacctggtaagaatcacaggctgtccgggcgcagtggctcacgcctgtaatcctagcactttgggaggtggaggcaggcagatcacgaggtcaggagttcgagaccagcctggccagcacggtgaaaccccgtatctactaaaaacacaaaaattagcctggcatggtggtgcgcacctgtagtcccagctactctggagggtgaggcagaagaattgcttgtacccagaaggcggaggttgcagtgagctgagatcatgccactgcattccagcctcagcgacagagtgagattctgtctcaaaaaaaaagaaaaaaagaaaaaaagaataaaaaatcacaggctttgtaaatggcagagcaggaatatgaatcaaggttttctgattctgctttctttgatgcttctccacatagtagggaattaaataatgctggtgaaagtaaatgataatttgaatttgatttcagtttttcaagccacttctttcagacttatttcctttgctagttctagcaacctgaaggttaagcaaatctttttttttttcaaaaaggtgtgtttgtgggggatatattcttatctaactttcaggtacatgccccaaataatagtaacagcttaaacttctatggggtttactctgttgttagtttaacaatcataacacattgaagacctgtagcacagaaaggttaagaaacttgcccaagatcacacaacaaaagatgacacaaccaggaggaaaatccagccaatctggccctagagcccatgtttccaatcactacatgatactgtctctcattctatgatgatatcaatttgcaaagctgtaggaatttcacacatggctgccagaggcaactgtttttttacgttaaataacagaagccaacttaagatattttttatgtataatgattttgagtatctaccatttactgatttcttcagagtaggcctggttcctgcatattccatctggtgcttgaacatcttaaacatttttggataaatcttagttgcttaaaacaaaacaacacagaacattatgaatatttgcagattgctcggtgaagttgttaggtctatcttatctcagttatcgctggcttttggctgggtttttaattaaaactcaatatagactatattacttatacagtcatgggatacagaaaacaaatgtgatatgtaaatgagcacagcatggcagcttgataaaatgagtctgtggcacaaaataatttaaatgaggactcatggacaattaaaatctaatcaaatgcttataattaatatcacatagctggaatgatgttgaagatactgactcagagacatgtacttatataactccatcccaggtattgagttgattttattttctctgacagtgccagagtatagtaatcagggaaacattcaccagaaggtaagcaataaccgggcagtaatctcatacttgggtgcacctttgaggatgcttctttaggcttcttgccatctaccaccctggtgtatgcagccatttattcattcaacaaatagactgcagcatatatacaattggcaaagagtcccccatcctcttggctgagttaggcaagacctctggttactaggcccactgcccactctcttgaaataaactgttggtatcaactccaccatgcttggattagttaatgcacaaaatgtacagaccaaacccttcctatcaccaccatgacattgccttgccatttctcaacacttcctctcccgctccagaactgccactcagcaagctctcctctatccttgtcctcttctctaagcggtccctccagcttcttgctttatttgaagactccctggcccccaaggtcagcccactttctgagcagctgtgtgaagtgctgtctcttttctccttcatcctccaggggaagaagctttttgtccctgtggtttcccattgttatttcaagacagattcctctgccttcttttaaaattcttagctcctttgaagttaagaccctccaactatatcacgaccacatcagcccacatcccagtcaattgctctcatccatctaagactttggaaccttgatcttggccctcagcactgccatcatcaggggtgaccccagtcaatctcggctgtgtagccaacactggcctggtggatcctgccaacactggcctggtgtatccgcactgaccatctctcttccagagtccaccacccagttcttgctgctactccatgattgctaactcaggcagtaattgctgctactccatgattgctaattcaggcatcccaatgctctgacatttactcctttccattcagtttccttgttcacttacatccatttcaactgtccttcaacctgatgaaaaccactgacccctcaaatttcccggttcttcagcttgcccccttcctcttcttattcacctcagatttcatagtctcgagttctactgttgagcagctgtttaagacaggggactaacaaactgtcctaataaaatagcatagaagagggaaggggctgttcctcctgagaaaattgcagtattgttgccaacagatgggaacagggatggcaggcaggccagaataaccagtgaccaccctgagttcttcgggaaaatcttgacagattgagttatttggattatttaagttatttggctgcttttcttttaatattccacctaaatgtatatgccacctctttccaaatgaagccagaaatcttggctcaaagttcttgtacaaaaaaagcttctactttgctatatacacaggcactctgtgttctccaaaattcaaatgactgaggatattctttcttaaggctgagaaaacatatggacgaaagtatgctgcttctcatcgtctgtagcctcttgacaagacatctgctgcaacagtttttgttcttcgatcatggacggttgtttgccaattgttttcataaatattaatctttgaaatcttgactgacatataagttgttctttttggattcctttcttcttttcttatttatgtgcaccatctttaaatgattgtgccacagtacaacaaaaaaagattttcttatgaaaaattcttattttaaaagtggaagccatataatgtctaatttgaaagcttgtgatttttttctttacatttgaaatctcctttttcttttgctcaactaaatttattccattggaataatgtttttacttcagctctttgaagtacccaaggaagacatctaagctcaacttccccaagtacttgactgatttagtcccaaggtagataactgtttcttctttctgtgaagctataaactttagaaccaaataattattttgaattggacagtgatagccaaggtgttctccagtgatatttgatgcatcttaatttctaatcatactttttcatgggaagataattggaaaatctttaatggaacataacaacactgtctaccaatgggtgttatttaatgacattgataaagttttattggtcttctgtgacctcgaccgtacactaaatagaacatatgaagcattttaaatgccatatatagcttttttggaatcatttttattgtgtatagtagttcctgatttattttaatgttacctctagggataagtaattcagcatattttaaattgttccaattattgctcaattagtagaacaacttttatggacacaattgtacatatttatggggtactgtgtgatattttgatacatgtttacgttacataaaaatcaaattaaggtattcagcatatccaccacctcatacacatatcatttatttatggtgagaactcaaaaaatcctgtcttgtagttattttgaaatatacagtagagttaaccatagtcaccttgctgtgcagtagaacaccagaacttatttctcttaataaaacaatttttaaccttaagaatgaaaaatgcttcacacagatattgatcctaaccctgttagcaaagaatcctcagttcatgtgaagctaatgatgcaaaatacagcaagtgactaattttgaaagactgtttgattacagtgccatagtatcttttctttcttagtaaaccacctgttcagcatctaaactagggacaattccttaagtgttcaacatttaaactgaaatgttcgatattccttaaatctagctgttcaacatcttttttaaaaatttacatcataaaatcttgagagagaagctccattctctggttttcataaagctttgggttttcttttgctttttctttatttttttgaagtgagaatactccgttgttaaatgagagttaataaattggaaaatatactaactcattgataagtgatgaaatttctatttcttcagttttatctagatcatgtgaaatttatatttagaatagaagagatttctttacatcttttgctctcttcaagggccgtatcagggattaggaatttatcttagttgagatcaaaccatttcctctgagatctattggcaagtgtcatctctcttccacatctgccattttctgaaagcaaaatgaaattcacatgtttgcatacaattttgctgattcttgccaggaatacttcctgggaaaagcatgctgaatatttctgcaatgcttcaattttagggagaaaagggaatattacaaaaatttggaactatcccatgacagagccaggagctgaggagcagatgaaggacctacttctggaaggccactgacgtgatggctggtgtctccacggggttaggagaatggacatgtcaagcagtggccctctggatcagggattagatgccagggagagaattacttggagaaaaggctgggctgacttgtatagttctagtcagataactgacacctagggggaatctgccatgtattgtatcatcttctgtgggaagacacagaggaagaaatgatgccacctgtattagtttgtagggctgccatcacaaagtcccacagatcgagtggcttaaacaacagaaatttgttttcttatagctctggaggctggaagtcagagattcaggggtcaacaggtggtttccttccaagggccaggagagaaggaactgtcccaggtgtttctccttggcttgtagatggccaccctctccttgtgtcttcatattattttccttctgtttgtgtgtctgtgtccaaatttcctcttcttatagggccactagtaatattgaattagggtccaccctaatgacctcattttaatgtaattacctcttcaaagatcttatttctgaatacggttatattctaaggtgttgcaggttaaggcataattcagcccataacatatctaagtctttaatcttttcatagatgagatgtgcaaaggttttctgtgtatgcttctcttgtgcgcattttgctgacagcagccaaaatgcaccgagcagcttgcgggcatctacaaacagatttaagaagtgatttctaaacattattgtttaagttggtttaaacccatggaagaaacagaaaagaggtttttctcttgtttcctatcttaggttaaggttgaaaaaaaccagttgattggaataaaaactcaagtgacaatgactaccagatacataggttttttagcagaaagtcaaaacatcatatagactggttccaagataagtgggaaaatttgaaaatttgatagcactgtgtttgtggcagtttttagctttgggctgactcaaatatagagtccagtttcttaccaagcacttttcgactgtgtttcagcatgatcatgaagaatgcacattttagataggatctttggggttttctatttgctacaaattaaattaaagaattattctgggccgggcacggtggctcacgcctgtaatcccagctgtttgggatgccgaggtgggtggatcacctgagatcaggagttcgagaccagcctggtcaacatggcgagaccctgtctctactaaaaatacaaaaattagctgggcgtggtggtgcatgcctgtaatcctggctactcagggggctgagatagagaatcgcttgaacccaggaggtgaaggttgcagtgagccaagattgcgccactgtactccagcctgggcaacatcgaaaactctgtctccaaaaaaacaaaaagaattattttggaatatcatttcatcaattcatcattacagtccattgtgtgcaaaatacatgcttaaaatcttttaccgggggctgggcacagtggctcatgcctgtgatcccaacactttacaaaaagttactttaaaaaaattagctgggcatagtggcacacacctgtagccccagctacttagcaggctgaggtgggaagactgcttgagcctgggagattgaggatgcagtgagtcatgattgtgccattgcactccagcctgtgcaacaaagtgagaccctgtctcaaaaaaagaaaaaatatttcattgaaaaatgtcccttttctggaggagtgttttatactgttcacaagtttgtgtaaaccacacatacacaattttgctatttgttttggcaagtggtcagtttttaaaatgttggtggttgcttttaatatctacctaaagatagagtgaattttacggaacataacacaaacaagaacactgcttttagctcgtgatatagccaagcctcaatgacttattccttgcacctgtatgtgggagataacaatgaaataataaattgtcatgattttaaggaagaaaatgactcatgtcatagtattacttttgtaaatatcctttcacaaatatcctataattttaagctttgtttttaaatcttaaaaatatttataaaatacttttctgatattttaagacagcattaccgtattttcttgtgtgtaaagttttcctgcttctagtatattttaaccagttctcttatgccaatcaaaggagaatatgcaatttcagaaaaataaacttcaagatagactcacagtaattccttctgtcctcaagcaagtatctattccatatctaaatcaagatgattgatcattttttgttttggtgttggtataatctttcctatgaggttctaagtggtggggtacttcactgactgtacaggaaaagagaattgtcttgaatcattcagatacacacttgtgtgtgtgtgtgtgtgtgtgtgtgtgtaaatacagtaaacatgaagcttagaacatggtagaaaatcaaaggtgtatgtgagaaaatatcaccttttaaaaatctgagatacattattctggaagtgaagaggcaatctaatctgcacaagaataacaattgtcagagcattgctttagatgggtcacaaagctaagacgaatgaaaaaatcaaggagcattttaagaagccactatttatacttgtctgctgctgaatttctctacaattcgtttctgctccagtttattacacatgaccagtgtatgtgataaatgaatggttaaaaatgagttatagactttaatgtgaaaatcttttgtctgattttactgttcactgctgttaccctcagtacatttattgaaatgtcttacacactttaatgctgtagtgtgttatgcgtgtttgtacttctcactgcctccgatatttcagtgggcagaatacagtgaggtgcattaggaaagcccaatgaatatttatggtaatccaagggaaccagacacagaaatggacttgcttggttcccagacctctatcttttatcttattcttaagggtatttaagataaaaacaatgtactgtaattgatttattttaccaaatctacttagcattcagtggctatatccaaatctaaaaatattgatagttcagcactaaaagtgggtttaaatttaatcatagaagagtttaactctgaaaaaatttatgatttattttgggcttttatctattgtcacctcttctttgctgaatgtaatttttatgacttcagatttataaattagacagttgcattaagacaactcaaaatgagaaaagaaaatagttctggaaagaattatttcttttttttctgaatttattggtacagtcctatgtagatatactacagtgtttgagaaagctacataaacatggcctttctacccacaaccacatccatagtatttaagaacccagtaggggagaattgaaggctgaggctgacttcagagaatcctacacgaggcagagttcctggaatcagaagtccaaagcaggatagcttatgtatagaaatattagctgtcttgattctagtagttcatagccccaactggggagccagagaacaatggttttcttcctacatttacttctgaccatcaagaaagtaaaaatctccaggattcacgggaaatatgatcctcagtgaacagtatcatcagaagatgatgactgttggcaacacaaacaatgaactttccaaaatacagacacagacacaagagagtaatccagataatttcaagtattctgtggcttctgggcctgtctttgtggacttcaggtgtagaaaattccagaataagtgtttgagatgttagctggttttctgaccacattaagtgtgctggtctgggacattggggcccttgctacatcacttattggctgtgggatcctaggacccttggctctaacctgcatcatctgttaaattaaattaaaatcccagttgagccaggtgagcttttgaggtctgtatcctgattctctgatctccttctctcttatggatttagattcttaatgggactacaaagcatataaattccttttcagaaatattggaggtagacttaaactgcaaaaataaaaatttaattaaatgcctaccatgtgccaggagctgaaccagttactgaagatacagttgtgaaagaaaacaaaacaatgaaatggcatggtccattcttatattggagcttacattctggagggggagcagatgatacataaatagataaacaaatacacagtgtgctgtgatgaaaaatggactagccatcatgtattgaatcttcataggtaccaggaatcattttaaggatgttagaggtgctttatatggagatttaatcctcacattccagtgtccattttacagatggaaaaactgaagtttagagacgtttggttattttacttgttccaggttccacagacagaaccagcccatgacccagctggcattagaacccaggcagcgtgattataggatctttaataggaaattattctgctacctgtctcaggataaaaggagagcaagaacagtgaagagaaatgggtttgtgttttctatggggtgttaagagaatgcatctttgacagggtcctgtgtggcagagactgaggaaggccatgcagccatcctgggcagaggaaacagcacacacccaaagatctgcattagcagctggattcctggtttgagaaccatcaaggaagccagtgtggctagaaagggctcagtgacaggtagcactaggtcatgagatcagagcagtgggagaaggggctggatcatgtaggccctttgtaggagatggtaaggactttgatgttgtctgagtttctcagcattagacagaaagccattggaaggtttgagtataggagtaagtgaaatctgatctatgattgacagagactactgtgtcagcttaagtgtagagtacgcttaagagggcaagagtgaaagcagagataatttttaagaagtgattgcagttatctagctgagacatgatggaggcttagagtagggtgacagtggaggcaagaagttgtaggattctggatgtggagcgaagtttgagtggatagcttttgaatgtgaggctgaatgtgcaataaaagacaaagaggagttcaaaatgtctgtaaggattgcggcatgagtaactggaagaatggaagtgccatttgttgtaaaggggaagatgaaaggaggaacctcacccaccctgtgcctccagtgcacaacacagcacagcaaatgggttcagtacagaactgaattagttagccatggaattactcctattcctgccaggtgtcctcaaacaaataccaaaatccatgacagtgaagtttagtggagaaacatgtccccctttgcatgatattctgagcttcttgatgacagcaatatcaaaagggaaaatgtagttttaatttggagggagatggaatctcatttacgataaacctggacataagatgtaatcaacatttcattcttgtacaatgtaaagagttattttgagcaggttttcagtgacctgtgaagaaatggcatttcagtacaacttcttccttcaggttttcatacagatgagcattgttataagtggctaagaaagatatggaagaggacatgataggatagaaactatttttctgggatagatgcagtgttcctcaaacatacaagtgcattgaatcttatatttacttttgtagctctaaacaaaaatccaacatcctttgtggttctatttcgaacagtttgttagtgttagggcttgcagaggccccgaagtaacatccctctctcaggagctggaaccattgaaagtcataggaatctttcaggttgagatcagaatgtcaggttcataactggaatatgcaactggaaaacatggcttgagatctgtgggtgtgtttgctaatatttccccccaacctaacggcaaacccagactctccaaaggggcaagccgcttagaatatggcagagagcagtccaggagtctcctgctcttggggtcaggcagaacttggggaggactttgctaacatctgttattccttctttccaaaccaccagtcacataaggcgcttccctttttcaaaggaggcatgagtgagtgggcagagagaggccaaaggtatcactagcggaagttcctccacctggggcacatgaggtaaggagaagggcacttccctattgacctttctccattgggagctttatctcattacgtagtaaattgtcattacctttatccttgtcaggttcatgtttctgtgggagatattgtaggactccttgctttatagtatagaagaagtatgtctcaacttgttttcccacagaaacatatctgatgaataacaaaccattagtattggtatctcattagctgctaccactaaactatgcattactcccagtttcactggtgccaaatccattcttttctctgtgagtttgagaactattaatgtagatacgtttcagtcaagactaaggaatatttctataaaatgaatatttggaattgattatctcagtaagtctaccagtatacctgaactgaaagggattccccaaaatgccaaatattcagctataccagaactatactgattggtggtgtaatgtttgtagaattttcagaatttgatgacacttttaggcattctatcatcatcaacaacagcaaacatttctcaaaggcattcttcctacaaagtgcaatgccaagtctgaggacacaccaagaagtataagttgtctggacacaagaagtttgtactccagtatagaatgtgtgccacatgagtacatgtgaaaagtgaataatataaatgtaccctatactacctgctaagtggattacatgagcattacaggcagaatgttaagccatgcaccaaagacacttttgacaggtttgggatgattgtaaaccatttcctaggaattgttcataaagcttaagacactagaagtgagtgttaactttgcaggaatagatcattaggggctgtttggtactaggatatttcataaagaaggtagaaattgagccaggcttcaaatatcccaggactgagtgtttggttcccttgtccactccatctgcattcctcttattaataaataatatcaccatccaccaagctgctcaccaaaattttaggtgtcattcttgatttcttcttatctctcgccccttatggcaaatgcatcagctagtcttgttgattttacctataagtgtttcttgaatacacccagctgcctatctgccctgccacccccttgtctaaacccgttatcctggtccaagaaaccgtcatctcctgcctggactaccacatgacctcctaactcttctccctgctttcagtatttgtaacctccaatctttttttttcatagagtaacagttgtaaatgataaatcagataatgtcattctctttttaaaaaccctttgatgtttttctgtttctctttaaaagaaaatgtacatttcttaccaaaattagtaggaccctgcacaacacaacttgggccatcttttcaacctctttcccttattttattatagtgtagccacagtggtgtcctttctgttcctcaaacagaatcacctctttctgtttagaggttttgcatttgctattccttctgcctggaataccattcccttggctattcatgtgcctgactccttttatatttttcaggtctcagtcctaatgtcacattctcagcacaaatgcctttcttgacaactctatctaaaataacttcccccagttcttctctattacaacatttattcatttttttcatagcaaatttcagaaaatgtacattttttcttatttccatgagtctattattactctagctgcagtgcatatcacagtgtcttggactacccaataaacacatgaataaatagtgcagctgatataagcagaggagaaagaaaggggaccttctcgtctgggtgagagtgtgagcaaagagctggagataaagtgtgcatagtattgtagggagcaacacctgagtgctgctcaaaggactggaggagcctagcaggaatgctggcagtggtgacttggattggaggttggggcttagggttgaattatagtggctgaaagtgagacagtctaatgggtagatacaaattgtgttcaaagaaggaaacaggagaagtatcatattaagcagtaggtctgatagggtgagcccaaggttgtagagagaagagattaaataccaaacaacatcaggaaggaacagggcatagtagggagaacaagggtaagtgaaaaatattttgttcaggatgtggtttgtgaacaaatcatctagaatactgttcttattgagagcaatcctatttatatggtgtaaagttttgtttcagtagtactgatatatgaatttggagaataaaaacaaacatatagagagggtctcaaagtcaaagctgtatggatggaattcaccttacagtcagtcaacttgatgttactgaggaaatatttttgatcaaggagtgactctataagattaatcctgctgtgatattattggttacaaatgctgtaggtagagatgccagtaggaaaggattgtagctgtctaggtgagcgcttttgaaatgtgtttctaagtctgtttacttaacaaggatatactttatatgtctgtcataaatcccatactaaaaagtattcaaaggaagttgttatagaatgaaagacatgaagacctgaactttgggaagctttagcaacagaaagtttggcagggatattagagtagctctactttgccatcccctgccttccatgcccacactctcctcatggtagtgatatccatattttacagtaaaatctttggaaatttctttatcctgcctcttccctgagatggtgaatggacggcctgtagagctgggctgcaatatcacagctcatcactaggtgtcatcctctcaccaatgacttattccactcagtgtttctcaggtttagttttaaattatagaaatgttttatttttattccatctatattttgagttctcactccataattataaataattttttgagtcacatgaaatcaaagaaaacattttctaaatcttgttacagtaacagtcacattttgtttagaatactcttttagtgatatttttatacaattgataacctgcttaattttaactgctgtagtattatgctatttattttgataatattgtaatgttggtggagatataaacaagtcatggaatctgaaaatatctggtttgtgtactttgttttcagcccttgtatagattaaaccaatcttttttatttttttgaaaaaatctgcagacattgccatgtacttgagttcaagatcctgtacatagacctgttttttaaaaatttaaaaacaaaatatgtgtaggaatttgtttagcatgtattgtatttcattatcaattttagagatatttttacatttgggcaaaaaattagcagtgtaataataataaggcaagggtaaatatttatatacaaatataatggttcattatttataaatccaatggcattacttaaaaaccagatgtacataatatttcatagttgtgcatattttttgattaatccctgcaaataaaatgatgagtatatgaggtttagaatgtatagtaccccctgtggctcatgttcaggaatatctagctcatatttgtcagttggttatactctatgtagtatctgaaatgtatcattcccacaccttcccaatttgaaaactcctttgaaatggcagagatactattagccttattcgtttgaaaaatggagtatttgaaatttgctttctctgttgcttggttagaagcatgtgtgttacatatgccttctatcccgttataatcttgtgtactgtgtgactggttttaatgaactgtttctaccagtagggaaatggtccctgttttatttgctgctatgaaagtcccaaagcatgtgacagtacatgtgcacactccgtgcagattaaagctgcggggcatgattggaggagacacagactgccaagccactgaggcggctctgccaacaacagcatgtgattatgtaacgcctgcagtgtctggcactgtgctccactggagacacgtcacgtgttgtgcaatgctcttggccctgaaattcaattagattgctttgaacgatccgtgagtctgcatgagataagcttttactgctctacagtagaaagcaaatgggttgattagctgcacataaattgataaattgcctttgtaattccagcaaggatatttgcattatgtatacatcatcatgcccctgaagagctgagtttaagcattatataacctggataaataatgtaggggtgggggagtaccaaccttcacaagtagagaaaaatgttttcttacagacagttagcagtaggctttttaaaaaaaaaaaaaagattttgccattgtttttgagaatctgcttaaaaggctgccagtattttatttttcaatgcaattatctatgagtgagaataaagaaattgatacagtgataatttggtggggggaaggaagattagcgagaaaaagtgtcaaatcgtgagttcaattaaattaaaactaagttgtgagctcagatggccttttaatgttgaacaaattaattttttgtgagattatagctgatcaatttaaggaaccgtcagaaattaaccctatatttggttgaggcttctagttatctttttacgaaaagagatgtgggataaaagaaggaaggtaatagaagttgagaaattggggcttggtaaagaagttgaggattattatcatactagaggcttaagagcctctggggaacaaccaaaatcaatgatgtgagcttggctatcccagctccctctacttctattttactccaaataggatttatgtttttaaccaaaagaccttgtgagacaatgctcgttagaattgttcagacactgagctgaaacccaaggcatcgaaatgttatgcagaatgcttccattttgttatatcaacagggattaggtgtacagttcttttgcgattttaggtaaaacagtcttgaactgtagcaaaaccggtgttgttgtggggttccccccccgccgtggaagcatggctttttttcttctattctttgaaaatcttctcaagaatttgcttaaggtaaattcttatatcctgattttgatgtgagtagattattttctaatatgtactaaaacccagaatttaacaatttttcaatttaatagattatctaaatgacgtgtgagatttaacttgcacatgtactttcccattcattcaatttccataactatctgcagtaggtattattccatttaaccaaagggaaaatggatgcatcaagaagcataatgaactgcttggggtcgcactgctcagaggtgactggataggggttccaaagcagatcttagatgttttcttccactgtaataatggtccccaaacactgacccacaaactgggccaagttggaccatatttcaaggaaatcctgatttattatgtgtaaagcgtaaacctgggaatatatagttttaaaataacttcccaggtgattgtgatttaagatcaggattggtggctacttcatgtctaatagtctaagctacagagatagcattagaacatctctatgctgtacttctgatgtgtgtgtgtgtataaacaggatgaacactatataatatctaaaaaatcttcagggaattaaatcagcattatacaggttggttaactgaaagtttcgagtatttatactatatagtgttcatcctgtttattcaaatcaaattgtaaaaacatagtttattctttttggttcttagtaaaactttaatagaaaatatatcttgctagaatagacataaaatattctgtgtctgacgctgtagtattttatagtagtcaaaagaatatagtgggaaatgtaattcagtaaatggcatctgctataaaaaggctagcctccaggtcttaaattgatgctagctggagtaactttgttaatgagtgaattcagagttggtttaatgagttagtgatgtagggatagctcattatcatcagggaatataactcgctgctgcatctttgcaaaataataaaaagggactagctaatcccttaccctgacataattgagtctggctttgttgttgttgttgtttcctttcctatctgcgtctttaaaagatgagatatgatccattactgttggggatgggactccctgagcatctctcctttcttcattcctccctcccactctttttacgaagatcgtcttgttttgtaccacagatatttgttttaaaggaaagtgtttgaaaaggccaaattaagtctgtaaacctacatgcttgatgaccaaagcatcctggctgaagctttggaaagactcgaggggcccctgactgcatataatgaatctgaaaaatattgacagttaataacagggtacatgcaactttgcagaacatgtattttctagaaacgcattcttaattgttcagctgtcatagtgcattaccaagtatatgattgacagctattaaggtatttttatcttaaattttactctttatattacataattaatataaattatttttcatgcgctgcacttataaaaataaataataatacagtatcatggttttctgaacttcagttaagagtgtgtgaacttttctttgcaaatgaactaaatattaatgtcagttttgtataactattgaaaatgcaccacctcccaaaaaatatcttcaggtaataaaataaatcagcattatacaggttggttaactggagtttctatttgagtatttataccatagaaaggaagctacttaggggcaaaatctgagtctttaatgtactttctttcacagtgactcatattgctacttcaatgtgatgtttggttcaggaaataatttatccagatgctctaaaaaggagcatgttatattccttacataaactaattctacttgattcctgacttgttctgctataatttttcaaagttatatcagcctatagaagatccataccccataaatatctaatcaatcaaattcatatatagatatagtatgtgcttaaaaaataaagagaaagattttcttggttggtctatcaatcaggtttgaatcaggagacaaaaatccacaaattattttaacaaaaaatttaatatgaagaattgatagctaggaatgaagaaatgaaagatgaaaagaaagacactaaagtgtcacaaagatagccatttcatgaagcagatctcacccctacatcaggagcaaagagaagtaacttaaaacttagatgagaggtcccatgtggctggaactcagaccttggggaccactggcaaagaccaggagccgctatttctgagggaaaggcgtgttggaaaaactacagactgggttagttgtggctttgagcaggaaacacccttgccagaataaagtgtgtttggaatgacactcacaagaacaggaagcaaaaacaggaagtcaacaggaagcccataggaagcagagaagaggaacaagtctcttcttccttcctggagtctgttcttcctcccagattgcctgcaatctccctctcatacttcctgctggcaaagcctatcctagatgtagccagcaaagtagaaatgtgatccataaaatttcagtcccaaatcacaagggggagtttggagctgagaggcaacagctcaataactggtatgtttctctgaaaaccttaagaaaactatctcaattaaaagttattttacatttaatttttgaataggtaatatactgcatagtaccaaaatgtaacaagaatagtttctttcccaccttcattgcccttgcaccgtgttcccatcctcccacctacctcccagccaggtaatcactattattggtttcttatgtatgttttcagagtttctttatgtatatacaagcaaacacagtatgtatgtttgtttctgtcatatcacttatcataccactatttcacacctttctctttttacttaatatatctcgttgattttgccatataagttcatagagaacctctttatgttttaaacctcattaccttaataaattctcttactgttttcagtagtttttcattttattgtctttggcgttcacaggacaaaatgacatcatctgcaaatattgatggtttctaaatattttgtctctacatcatttatctctgccaattgttttggcttgtgcatccagcacatgttaaatattaatggtaatgaacatctttgtctctatccggccttattgagaatgcctttaatatttctcagtaagcatgatgctggcttttgggacaagataaatatattttattttgttaaagaagcatctatttattatacttacttttaaaatcagaaatgaaattaaattttgtcaaatggttcttcagcatctgtaaagcataatcataggacttttgctgttttatgtaagtactatatttctataagctttctattttgttaagcagtttcctaatgtttctaacattgagccatctttgcattcctggaacaaattccactgggtcatggaattcaccaacacacaaacacacccacacacgtgtgtgtttgtacacaatgatatttataaaaatattgtaggttttatttattgttgattactatttgttagttttttatttatttcataggaagaatttggaagtttttcttattttcttctgctctgaaacagttaaaaagtgctggattgatcttctctttgggagaagttccctgtgaaactatctgggcttggtgctttttgagctgtttgctctttgacaatttcctttatttattacatgaaaatggtccctttagattttctgtctcttttgggttcaattttgataaattttatttttctagaaatttattcgttttatgcagtctttcaaaaaagtttacgtgtagttgaaaaatcttgttgatcatagaaaatcttgtgatcatttaatttttttctgtttctttagttatttccttcttgcaatgttttacttagtatttcaggctttccttctttctttactagggtttctgctggttaattttctcagaaagcaagtttttaaaaaattgttaaattttaaaaatttaaaaattagtgctgtttgtatttcttttcaacctcgttacaccatgcttctatatttaatgagttggtttaaaattttgctattttttatttttgggtatgacatttatttttatttctatggatgttttgaggatacagatttttctcttagcactactttattttttatttgtatttattcccgcccccccttccccgacaacatttattttaggttcgggggtacatgtgtttgttatataggtaaattgcatgtcacaggggtttgatgtatagattattttgtcaccctggtaataagcatagttcctgatagctagtttttaggttgtcacccttcttccaccctccaccctcaagtaggacctggtgtctgttattcccttctttgtgttcatatgtactcaatgtttagctcctccttataagtgagaacatggggtacttggttttctgttcctgtgttagtttgcttaggataatggcctccagctccatccatgttgctgcaaaggacatgatctcattcttttttagggctgtgtagtatttccatggtatgtgtgtgccacattttctttatccattccactgttgatgggtttaagttgattccatgtctgtgcaattgtgaatggtgttgtgatgaacattgtgtatatgtgactttatattaaaataatttatattcctttgggcatatacccagtaacaggattgctgggtcaaatggtagttctgttttaagttctctgagaaatctccaaactgctttccacagtggctgaactagtttacattatccccagcagtatgtaagtgttctcttttctctgcaacttcttcatcatctgttagtttttgttttgttttgttttgttttgtttgatacagagtcttgccctgttgcccaggctggagtgcagtggcgtgacctcaactcactgcaatctctgcctcctgggttcaagtgattctcctgcctcaacctcccgagtagctgggattacaggcaggcaccaccatgtctggctaatttttgtatttttaggagagatgtggttttgccatgttggccaggctggtctcgagcttctgacctctggtgatccacctgccttggcctcccaaagtgctaggattacaggtgtgagccatcacgcccggtcagcatctgttagtttttcactttttaataatagcctttctgactggtgtaattgttatctcattgtggttttgatttacatttctctagtgattagtaatattgagcattttttcatatgcttgttggccacatgtatgtgttcttttgagaagtgtctgttcatgtcctttggccatttttcaatggggttgtttgctttttgcttgttaattttgtttaaaatccttatagattctggatattagactttcattggatgcagagtgtgcaaatattttctcccattctgtaggttgtctgttaagtcagttgatagtttcttttggctgttatcactactttagttgcatcccatagcatctccctatatatagtattttaattattgttgtttttcagaaattctctttagaatttttctcttctaaaagttgtttaaggagagtttattttctagatgcaagggatcttttgaagtttaaaaaactagttcctagttttcttacttgtcatcaatgttatactcttcaaatattcttacatttaagataattctattacattatatattttaaaactatttgttaacttccatttcttttgtttccttcttcagatctccaattatgtatatgctgagtcttccattcactgtcttttttttcttttacgttctcttttaacttttgaagagatttttgaaatacccattttatttttttctcatatctatcctctccatctctttgtttgctgtagtgtcgagcttatttgtgtcccttccaattatttattcatttccaaagaaatactttttaaatgttcatctcctattttttccacaatttcttcctgaatttcttatctttttgctatgcagcattcctttatagaggtgatttcatcatgttaaaaagtgcatataaaaatttttttataatgattttaatttgtttgtataatccatgagtgctatttattgataaactttgctcttgcatctctcacctttcctttcccctttatattccttatatatattctttcagttgatacaaccagtaatttatgggaagtctttgaagaccccaaagcccttttcttttctgctatcacaaagctggagcacatcctaaaaatatggccactctgatggtatctttcataacagtagttcctcagcttagctttcctttcctttcctttcctttcctttcctttcctttcctttcctttcctttcctttcctttcctttcctttcctttcccttcccttcccttcctttcctttcctttcctttcctttcctttcctttcctttcctttcctttcctttccttcctgtcctccccttccctcccccgcctcccctcccctcccctctcctctccccttctcttttcttcgtcttttcttttcttttttcttttgagacagggtctcactctgtcacccaggctagagttcagtggtgcaatcatggctcactgcaacctctgccttcagggctcaagcagtcctcctgcctcagcctcctaagtagatgggattacatgctcatgacaccacaccaccacacccagcttttttctttttcttttttttttgtagagatggaatttttccatgttgctcaggctggtcttgaactcctgggctcaagcagtctgcctgcctcagcctcccaaagtgctgggattacaggcatgagccaccatacccgggccctctacatttctgaccttgccttttctccccctaattctgacttctatggatacaaatatgaactgcggctttggtgtttcttggtgggctccttcacttcaggagatagatttttgccttaacttcttggggatgcggctcggccatgtggccactctcagtgcttctctgtactttctcctgcttggcttctgcctgatggctgctgatatgggcagctcttatgtgtcttctgtagtttgtggattatatctgtctctttcttttgctgaaaatggagttttcaggcttttattttcttctccttctttttgttgatttccacagcagtataatgatactaaattcattagccatgcacatgctggaagtcagtgtgggccttaaggaatagcagtttaatatcagggctttgatagtttacacaggcaatacaataattacagcaggtgctgttcaaatatggaagtaaaataatgttcacacttgccccagaaaatcactgtagaaaatgagagacatgctgcttttctctttcttgcctttcatttattttaaagaaaaactttagtattagaatttggtgctaatatttgagcattccaagaaaactactttctttgataaatgatgcaaagctcctattttctccctatatcttttaatttatagattgttctttcttgttattttgctgatactggagtaaactggttcaatctgagtaagatcttgtggaccctgtttttcactattctgttggtattttgctactgaggtagaaattactctgtatatttgttaaactacctggaatttaggaggataattttccatcatcttacttttaactgatgagaaaatacatagatactattctgatcaaaggctgatttcttggtcttttgttatagttccagacagtagaaataattatgttttgcctggataattagtcatagctacaatacaaattttaattgataaattaaaataggaactattttatagtcagctcttcattaaatcttatttattttttattattgtgcgtaaccaaattgaaaatggtgtgaatttagattaaaggtgaagctttatacttaattttccttttaacatacggttcttggcaacaggcagaaaataaatgcaatgaagtcagtgtttcagtagtgaaactgtacaaacagtagcaagttactggagctgacagttttcaaatgatagtagcgggttatgtaagtcacccaagatggctcaatgtactattatttccagacagagttggaaatagcacgtgccaaggcaacaggcagtcagacaaaaacataacaatttactttccaataattatcatcacttcttgccaggctggaactcaattgatctgatacagcagaatatctttttgtatggatttctttcaagcttagaaacatcatgactgcagtaaatactcctgtaaatcattttcgggacttcattaaaggaaacagcaatactgtaatcgctttgttttttgcatttaaaacataaattgatacaaatcccagccagtgctatccttcaattcatttaccctttcttcttttccctccctttttctaaactctttctttttttaaaaaaacatcgtagttagttggaagcttttaacaaaagagctgattacattaaggaatttagctcactcttcttccatagctgataaaatattaaaaaataagactaaaattatgcagtctatggtttataagtatcacattgttcttaagatacagatttaattgacagatttctaaggaggcttattaatccttcagccatcattgtgaaagggaaatattttcagaagttcaaacatgggacaaacgacaaatgacaagtttggtggaaacacaacaagtggatgttagagatcattttgaaatagttgatgacatacatgtggcctgaagtcagttgattttcctcctgggtagcttttatgtatgagacttttgttcagggactaccacggcgggggaaaaatgtagggttgcatgtgtgtgtgtgtgtgtgtgtgtgataattggcaataaaggaaatttggagacagtggaaaaattggatagaagacataaggcaaaggtgctggaaacagggagtgctgagacaagagaaacctggaaaacttgggtgtagatgaaattatattcccagatgacttttcatggcagcttcatggctggcttatgctcaaagtcagggtttctgcagagagagagagagaggtctgaacaaagtatccgaggaagagtaacagctggagctgcccaggacaggaagtaattgcccattcagagtgacccaaactggcctatattatttaaggtaaaactagctaatgagtctttgacactggatctttagaaaactttttacattttccagaataaaaagaatattaatattcttttttcactgggttaaaatgttagtatcatggcaaaagcataatgaatcttaattcgaatttaagcaagggcttttaaaatgcaggatggaaatggctttcataaatctgtgaaatcccctgggcatacaggcagcattctgtgtttcacaatggtaactgcagagtgtcttatagtaaggtatctgctcatatgctttagagttaaaaattgtttcccggccgggcgcggtggctcacaccggtaatcccagcactttgggaggcctaggcgggtggatcacgaggtcaggagttcaagatcagcctggccaagatggtgaaaccccgtctctactaaaaatacaaaatgttacccgggcacctgtaatcccagctactcgagttggtgggcacctgtaatcccagctacttggggaggctgaggcagagaattgcttgaacctgggaggcggaggttgtggtgagccgaaatcgccccactgcactctagcctgggtgacggagcaaaactctgtctcaaaaaaaaaaaaaaaaaaattgtttcccttccctgtccgttgagaggtgtgaacccaaaagtatctgagacaggtctcagtcaatgtaagaagtttattttgccaaggttaaggatgcacccatgacacagccttaggagatcctgacgacatgtgcccaaggtggtcagggcacagcttactcttctacatttttgggagacatgagacatcaatcaatatgtgtaagatgtactttggctaggtccagaaaggtgagacaactcaaagcaggggcttccaggttataggtagataagagacaaaaggttgcattcttttgagtctttgatcagcctttcactcgatacacgatttacatgtggggggtgggtagagaaataatcacttatgccttagtctggcccagtgaatctgcatttttacataagcaatagggcagaggaagcaatcaggtatgcatttatctcaggtgaacagagagatgactttgagttttgtcctttgtcccgcacctgtgaagataagctatcaatttacattgccagagtgaaattcaacagacttgttttagggtaaaggtctggaggcccacaaggaatcttcttgtgggcaaattgtgagggagatctgcagctttttttttttttttatctttgtagctatcttatttaggaataaaatgggaggcaggtttgcctgacacagttcccagcttgattttcccgttggcttagtcattttggggtcctgggatttattttcctttcacagaggtaaagcaagagcaaaatatgtttttgactgagggtggaaatgagatgaagagtagatgaggcagagaggtactgggaggttgtttaggatgacagatgtttcagagaaggagattttagtgtcaggaatagtaagatggtgtggaaagacgttgaggaggacagaactaaagaaactgatggggcctgagggcgaaaatggtggacagagatggcttagacttcaagacttgatttgtagctatgttctaccagcctccagctgtctatgcgttggcctcacgcatgtcccaaacgtggtcccacacatgtttacacattggtcccacatatgctgagagtaattactttctattcatcagaggtcaaaatagaataaagaatgtttatgtcatagtatgactttttaggtgattttgaaaagcaagaatatgaattctatgaaaaaaatctattaggaaattatggaaatgacagaatgcagaggtatttggaaatagaaaaaaaatgggtgagacagtaaatacttacaaaaaaagttattgaatgtctgctcagccctggaaaggcactgatgaacaatcactctaccttcttggcgtttagtgagaaaatcataccaaccaaatagttggacagggattaattaatttctgttttaaatttactctgaaggagaagtccagagtactgtatgagtgtgcaaccagagggcacaaactgggctaggggaggggtgtcagaaacagcttctccaagacagtgacattaaacagaccagaagagcaaggaggatttggtggaaaaggccctgggagcagtggaacacacacacaggtgtgaaggatgctcctgttccactgatgggatgatacttgtggagcactcttttacttttaaacaattagacacccagaagaagcaagaaggattgcagggaaacgattggttacagctcaggaaaaaagagactgagaaaacagaatttggggaagtcaagatgatagtgaatttgaaataggggagaagagttgataatagcatagaaaatgttattagagcagagatatacttaatgtattttttggtacagttctttttgtgattttttaccaacaacttctgcccccaacacgtctagtgaacattttataatttttcaaaaagctgtctttattttgctttaaattaaaacaaatgcacactcctcaaaaatatttcggaagagcaaataatgcagttgactcttgctgctaagctaggtgttagtttgctatgagcaccaaatgagatgacatttgtgaaactgccctgatacgtaatcaaatattagtttaattcaaattgaatttactgattcatttgtctccattattaaaacaatttgtgttcttcaccttactcctgcgggtcctcctgtaatgactagattaagtggtccaaagaaaatgactgcatttctgtgcatgctgattgtctttggcattctgcgacctgactgcttaacagtggaagtgatttggggacatggaaaaagctgacattgtgatcttctcactcctccttctctagcctgctaaagctgtaagtaaacaggtgtgtggtcaggtcttgtcaacaaagtctgtgggaagcatcttcttttcttatggaagctacatgtcttcttctcatcctttattatgtttaattctgaaatggttggcaaataccactatggcttttctgtcacatctggaagatgtgtagtcttattttatgagaaggagtaaaaggatggtgggcggagtagcctggttgtaattatagtgtacgtttatttggaaagactagcatattagtatgcagtggctagattaattaaactcagctggcataattcaatatggttagttcctgtaaaagcaaactgtctttaaactcttgaggtttgctataaagcttatgatgagagcaacattttgaatgtctcttcctcccatatgaattacaaaggcacttaaaagctgtccttttaaaaatttgtttcccttctctccccacccccaccaccccaccaccacacacacacacacacacacacacacacacacacacacacacaaaacccttatctacttgttaacaaaataaattctgggatctttttttaggaagatgagggcttttttaactaacatattttgtgaaccataatttccatgaagttgtttataattttgagtttctacacatcaagtagtgtgaggtatccatggaaactgtctagcctatattcagtgcactggaccgccttcccacacaggtcaagactcaaacagttccagatactagcttgatttattgtgccctaaacattagacagttttaaaaggaaattggctcctaattgacacatacaatttcatgtttaattagcaatttgagcctgtctacattttactaacagatgtaacattcaaaacgtgccattctaatatatctgttgcacagatgcacctaaatgcagaactttatgtaaatagcagctcagctgcttagcaaaaatttggacagaactgacattattttccttaagagatgtactttaatgttatttaaggagtgattttccttaaccaatctaatggatttattttatattttggtaacagctttattgagatattcacatactataaaattcaccctacaaaagtgtacaatttagtgttttttggtttatttacagatttacaaccaatactgctgtttaattttagaacattttcatcacccctaaaagaaaccccatgcctcttagcagtcactcttcattcttcccagccccagcccttggctatctattttctgtctctttttgtctctatgaatttgcctcttttggacatttcatataaatggaatcatacaatatgtggtcttttgtgactgcctcccttcacttggcataatgttttcaaggctcatacatgttctagcaggtgtcagcacttcagtcccattttattgccaaataatattctattatgtgcatataccacattgtgtttatccagtcatcatttggtggacatttggattgtctctactattatggatcatgccacaatgaacattctgtacaagttcttgtgtggacctctgttttaatttctttagggtaaatacttaggagtggaattgccggaatgtatggtaactctacgtttaattttttggaactgccaagtggctgcaccattttctattcccattagcagtgtatgagggtcccaatttctccacatcctcaccaacatgtgttattgttcagatcacaatgtcagctttttccgtgtccccagatcacttattttagccattctagtgggtgtgagatggtatcaaggggcaactttttttaaaaggagagaaatttaatattgtccatggttcataaattagttcaatgtgtgtctcttacttgtttgcttttccattactcttgatttgtaagataaatatacctctcatctctatcaatattgtcactttccttactaattttaatgtaggggcctatgatatcaaaatttacagtagtgaattgggctacatatagaaaatgtatcatgaaaaagggaaaacactgaaataactgttcgattgcaaaggttaaatctctaaatttctgtatgttttcatcttacttgactttaactagaaaacaggtataatagtgatgccacatactgggaagcaatgagtatttgatacaatgccagattaaaaggtgtacttattttttcgttcaatatagttcatcaatcataaaataccatcaatcataaataaggcataccataattttatgtatccctaaaaataaataaatgctgccaattaaactaaagcacaccatggattttaaagtgacctgtaatttagaaatgttaaaacatgcaggagagaaatgggtgtgttagaatcaatgaaataaagcagaaaagagatgtgcttgctcagtgttttttgaaggcaacccagtcatttatgcttaccaacacccaggggagatagcaagaatcttcatacttcaaagacctaattcattttacaaatatgcatcaatatccatgagtacaaaaatagatatacgtatatattacacacatacacactgacatacacacacacacacacacacacacacacacagagacagagagagaagagtagagagatattcattgactcattcttccacaccttaggagtattagatcagcatcagcaacctgtagttcactgaaatgattcttcctctcttcaattcactgattcagaaaagctggtttacctcaaataatgtttattaaatactttaagctttcttttcagcctgagaatgtttcatcttgttttttccagaagctaatttcaataggtgaatcacaaacctgtgaaaatccacatttataattcagaggctagcaccacagtactaccaagcggctatgcttccttaccagcaaatgtgctttgcatgttattaaaaataaacgtttactttcttagtgccccggattatagttacagttctaaatgcattaaagtagtgaaatatctatcacggtgtatgccacagggaatcaaactgatttccaaaataacattcataagaccataataagtctaataaagcctttcttaaaaagaccctttctaaggtaagcatttggtacttggcccctttaattagctcaggcatctctaggtttgtttgaactgagacctcattttcttttagtaataattgtgttactgctttgaaatgttgatgaaaatttaaaggatttctatttttcattagttctaaatcattgtctcatagttttctctctgcaaaattctttgaaaattgtggtttacatgtagaacacaattaggagctcatgggagcagataattgctcatattaaagtaggccaaatatgtggcctcctggacaaatagatgcaagaaatgattaagattagatttatataatttttaatgtagcaatgaacactaaagaaatgaaatgatttatttcatgaggaaaaatgaggtaaaagaattatctttatcttctattataaattatgacacattcaaacatattttaaaagagaatagtgaatttgtatctcttcaaattgacatattcacataatattaggaattatgttgctgagtcagatccttgtatgacgtgcagccttaaggtggtttctttgttttttagtaaaatacgaaaatcctattgcagtagacatattgtagcagggggataacctggactggacttttgggatattagtgtgttctcttgcattaggctacatttgtgatcattaattagtattttaccttctaatctttcaggctaaatattgaaattgtctgtcttttaagttttataacattttgcttgctggatttcaacacaatttccttctttcagccgaccataggtaatgagttttgtgtgctaattttttttttttttttttttttttgagacaggattcctactcccaggctggacagggtctcccaggctggagtgcagtgtgcaatcatgcctcactgcagccttgatttcccaggctcaagcgatcctcccacctcagcctcctagtagttgggaccacaggcgtatgtcaccacacccagattattttcctatttttattagagatgaagtcttgctaagtttcccaggccattcataaactcctgagctcaagtgatcctcctgcctgggcctcctgagtaactgggaccataggtgtatgttatcacaccaggctaattttttttttttaattttgtagagaagaggtctccctatattgcctaggctggtcttgaactcctgggctcaagaaatccttctgccttggcctcctaaagtgctgggattacaggcatgagccagtaatacaatgtaatatttacatattaagtatttttagtacaaggctgggcatcttgtatttttagtactatgctaaatatttgaatatttttagtacaaggctgagtgccttgtagttttagtattaatacaaggcacccagccttgtactaaaaatatgtaatatgcaagtaacattgaataaatctcaaatgttttccaaagttatcagacatgatatacaacaaatatcagccatccttgaataggttggcactcagcatcaaattttgttgataaattgagtgatctctcattcaaaatcattgattcatacattcagtcaaaaatatttattgagtacttagtttgctagctttggggctaggtgttggaatcaatggtcagccaaaaaggaaaaaaagaaaggtatagttcctgtcctcatggtacttataatctaatagagggtgatagaaatcattgaaagattggtataaataaatatacagctaaagcacatggtgatatacatgctattataagaggacttaatgagaattgacttggtgcggttagagaggatgactctgaggaagatatggttgagctgagatctaaaggttaagtaggaattaagtaaagccaggaggactcagggtcgggggacagaaagcatggctggtgaaagagaacatcatctgttaatgtcttgaagcagaagggagcatgataagacactaagaagctgtgtggcagaaggaagatgtggattgttcagaagacaatgagacagtggctcaaatctgtaggtgttgcattgtgtatcatcccctaaagtaatgctatggattttagccaggattcaaagagagctggaaagtaacagaacatcctatgtaggaagctgtcatcatgatgtctaatagttcttgagcattttcttttcctataatattgaatttttatgaagaaatatatacaacataaattttagctataaagcattaaatataataaagactcatgacctcagccaaatgaagaatgagaacattacctgtaacttgtgtctacatatgtgttctggcctccccttccagaggtagctcacgttttgaataccatactgcatatcttctaggacttccctttttttccctgtcatcattctatttctaacattcatgaaagtagttgtgtgttacggtgaggctctgtttaatccatgtttactactctataatattccagtttgggaatattctataatttatttgtcaattttcctgtcacttgttatttgggttgattccaggtgatgttttgcttgttgtttgttttgctattgctatcatgcagatataaatgtctaggatgggatactatttgtttccttgagcatgtttcccctgggagtgaaattggtggctgagagcatacattgatgtgatttccaaagtagttgtaccaatttgcatcccacattctcttgatccatgtcctcttcaacacttgattttgtaagacttcttaatttttgtcaatttattgggtataaaatggtgtctccaccattttattagcatttctttgattaccaatgaaggtgagcattttttttcatgtttattggctgtatgtgtttcttatatgaaatgccagttcagttcttctgtcagcttttctacaagattcttaatgatttataaacactctttgtatagtcatgtattctgaataccagtcatctgttgttttgcaagcctctgaatgttaagtgagcaatgacttagaggggcatcctgtggatatggagagacatatggatatgtgttaggaagcacagcctttccactaatgaacaattgttgctgataataactttataaatatacttaatacatttcttgtgttaaaactaaataggagggaaaatagctcttttcccacagaacatggaatattggttttccatttaacactacttcaaggaaaggctgtctaaattatcttctgaagaattctgctttgtacatgtaataggggtgattgaaacctatccacaagtaagtgttatttttaagaaattgtagcatactgatcaaattggcttcaaagtagtctttcacaaaatgaatgctgtttttcatttgccttctcttgaaaaattatagaaggttggagctggatattgatgtcagctgtgaaaaccatggctgtcttgtggcactgggcattgtaatgtcctctttatgtcatcaattgtacaagtcttccccagattgaaacttattaatgctttcctttaaacataaaataaaatattacagtagctgtttattcagtacttgctatgggccaagaacataaagcttctcctatttaatttcctaatccttaaatagccttgcagtgtaaatattattatccacagatggggaaactgagccttggggcagttaattaaaattctttagatcacaaagccaataagtggaagaacccagactcaaaccaatcacattactctctgagacatcatttccactaaggtccactaacgtgcattgtcattgccaatgccgggagcattcataaactgaacttcttatgtattaaagtgtgtatagatattatctcatttaattctcaaggtttccctttggagttgtgccatgtagaactcctctattccatggattccatagactgtcctatctgaggaacttctaaatgtattctgaatttattaaaatttagcttcatacatattttgtcaaatattgcattgattgataagtaataccagtgccagttttcttcctctcttttaagaataatctatttctagtattttggggaaaaataatgaggtctttgtctctcacttaatccgtgtgtgtgtgtgtgtgtgtgtgtgtgtgtgtgtgttggtggggggcagtgggtcttctaccccattgtttccttgccagctcttcggagccatgcactcgtctcactgccctgtgaaccagccacactctcttgtttgtgggtcaggaggtcacagcttgaagatcaaggactgcactactgttgagaatgcaagaaactccatagaaacaggaaggccaatatagagcaggatagtgctggtgatatgtccccgtatgtattgttcctcatctcctgtgacaccaccttccaaagttgtgcctgtcttcactaaatgattatggaaatataacagacatcacagaatctggggatagaactttaaaacagcaaactagttacaactttccccattgtctaggaggaagacctttctcccactgaagttcatattgctattcagatcagtgtcagtcttctcatttatttaaatctcattccatctcctgctctttcctcttgtactctctgggatgcactgtaagctgagtccattactgagttacatactttgccttaccccccactcagcaacatagtctttgcagaagctttgaaattacctcttgaagttccattttccccagtctttggtgagcatgcacacgcctgcactgacagcactgatttcattcttttcagtaacaaacagtactctagtaggtttttatactgtgtaccagggactatgggcttcactttaatgattgtgtgccactgtctttgagtgtgattttatgaggcactgatttatgttatgtgaatacagtcattttccttcattaaggagatggtatctaaagcttgtctgctcacttcttgcttacttaccctcctctcagcttaaagtcagaagactgcttattctgaaaactaaacaattacaagcagtaaaatccattcttaagtcctattggtgagggattgcataagttctcaaactctgaatttcagcaaaccctgtatttaaaatggttgaggtagaagggtctgttgggtttcatgttagttagtatgcttcctggaattcaaatactgggaggttttaattaatgccccaaggaaaacaaatacagtttgctttattccttgctatctatggagtatagaatcatctcctaacaaaaccttctcagcaaccctgtttgtcttgaggctaggatatttgataaactcagagtggttattgaagtcactctttcattcagcagcagcatcaaatatttaaacctcatcatttactgtttaaacatttaattttcaccaatggaatcaaatggtctggtgaggattatttatattggaaaacagtgccatatgtttcaactccacatatctgaaaattctttcagcatatgctgcagaattgctttttgcatccacttttctacttcctgacacatggtagaaatgtaataaatgtctttacaatcaataaaaacaaggaaagaagaaatttggaagtaggttgccattatggtgaatgaatatttggatctaacattttccacagtcttgttttttcacaaggctctttactagaatcattgagacatcatatatttttcaagattgtaatgagtatgtcattgtgttgatgagaagagcatcttctgagtgcacataactagtcctgttgaaatttgtgtttcctgtcttaagaaagctaggcaaaggcaacagggagagaaattgacttacaacttcttggacagggagactaagatgttcaaatgattaaacagctagattataggagattgaccatattctcccgaaggagttatctgaaaatatagttgattataacgatggacagaatatcactccacaaagatacagttgttacattaatgtattgaaatgagaaatgtacctttttacccctggcaattcaaatgaggaaaaatacctaatcagacgtattgttactaagccaaaaggttacagaaacacaaattatgctaataccaagtttaatgttaaaatgggactatggggagactaacaggtacctatcatcacctccttgtagatcttgtctcagctgattggcagcttatcatgaatctttgaggataagtcttaaattgggcatccttagtttgcagtttttattacattttgaatttctagttgaggacttagttttctaggatgctggttgtgttttttcatgatatcttgattatattttacataatgaaaaaatattactttagtaaattgtttttctaaggggatgggaatgaatgtgggtagctatacctcaaatatcacacatccttgaactcttcattcctaaggctattaactccccattaaggcaaacagagttgtgctttctcaaaaatgaaacaaaattttagtcctttctaggatgcataaatttgattatcctttctatccatgaaaggcaatgatttctgaactttttaatttttgatgcattggactcggtgtaacagggagtgggtgggaaaaacccaatcctcccagatattcacaaaccatcagcaggacttctctggccacaaaagatgtctttttatggagatattttgttgtaatttcagaaggtggttgttagttttcttggctacattacatttagcacatctgggatgtgttcacatgaagacattggctaaaagtagtgtcttgtggcctggaattgactctgatattgaaaaggctgtaaaggacattccttgcttgtcctcactcagcaaagagaccttccatgggaggtgcatcaggaatgcattttggatttggagaaccagcacagaagtcaaacttcttcaactgtggtgaaattcttttcataatggcctaatgtgcttttagttcttccctcatttctgccatggcaattatagctctgagacaattatttgcaaccctggcaccagaatttctgacaatgattctacagttacttttgaattaaagtaatttggggaaatgactcacatttaagctaccaccactgcacagatagtgcgaactatcaagaatgccccaaaagcaaattgggacacagtacatgtctctcaccgcttaagtcagaactggatagttgacaagagaagtcagtttctgctgaacttgtgatgtagcaatatctgaatttttttattcttaaatgaagattactaagacataacagaatcttgttctgtttatacctattcattaatcatttttagcaccagagtttgtcttagcacaaaactctgaagtttgaaccaagacagaatttgttccaactttagttgaagttgtaagggtacattttatatagtgaagtatattcatgctttagggtgactttgccatgttagctaataagtatataattttaaggactgattaatagttaaaaagctaggatttaggggcagtttatcatttattatttttcacattttcttaatatactggaaatttatttcacttttgtgggaaggtttggtataacataagaaagtgtctgcaaaagcactttgcaagttgtagactgttcccatgatctggataatattaatactagcagggataacatcaacaatgtacaacttttatagcacttactatgtgtttggaactgttccaagtactttcagtaaattttaactatttaattatcacagaaatcctctgagagtagatattaacaatttcatttgacaattgagggactgaggcccagagtgatgaagtaacttgtttaagatccccagttagtatatggcatagaggggatttaaacccaggcagagtggcttcagagtcgacaacagaaaaataggaagcccctgccttttctatggcagtctgaatattacatggtgaggaaatagatgcttctaatggggctataattgaataagaagagtgttactcgtttgattttgatgtctatgaatctgataggcactgtgattatatctgccgaagagaatttaaaaataatcacaaatatgatgcttatttttatttggtgtgacataattctactctttggttggttttcaatagtttcattattctagcagtataaacgacattttaaaaagtaaatggtaaaaaagttttctatttcatctttaaaaaaatttatttgtttatctgttggttgggttcttgtagcagtgtgataaatggtgtgattaaaagattcttccagggccaggttcatgtctgtaatcccagaactttgggaggccaaggtgagagggttgcttgaggccaggagtgtgaggttgcaatgagctatgattgtgccactgtactccagcctgggcaacacaacaagaccctatctctaaataataatagaaataataatacataaaaggttcttgcagagactaaaaggggagctagttctcaagggttcagtcctcttcacaataggttccctttcagacagtgatgctgacttgtgcaatttcaagaaaaagtcctggattttcacactgtcagctttagttattacaggtgggccaactgtcttctacagggttagagtgagtggtctgtagaggtgagatccatgaatagtacaacaaactgagctactctttaaaaaaatgagtgcttcagttaatgtgacctcatatttttctccccaacttataacttcaaccctgtagtttatgggtctaaaagatttttcatagcatctccttctactataatgagagtcgcagtaattacccaaaggcgttgactccaaagaaaagctttgttttgtttttcctttccttttggaagaaattttctttggccaggtgaatttaattcaactcaaaggactttctcttaaaaaaagaaacagtaaggacgattttcatgtcttatgtttcttctaggtgctgcacttaagtgttatcaggaatagtaaatagtagagttgtattccttggtagaataagctgttatacttcactgtttcttttgagactagtcaccacctttacttactacaccccattatgaagaggtcttaaagaaagaaaacatgaaataggaagcaataataactgtctatgttctaagaatttaagtaccaataaataaaagttgttacaaggataaacaaactccagacactctgagtgtctattagaattcttggcactgaccgggcacggtggctcatgcctgtaatcccagcactttgggaggctgaggccggcagattgcctgaggtcaggagttcgagaccagctctggccaacatggtgaaatccagtctgtactaaaaatacaaaaaacaaaacaaaacaaacaaaaaaaattagccaggcgtggtggtgtgtgcctgtaatcccagctactcgggaggctgaggcaggggaattgcttgaaccagggaggtggaggttgcagtgagctgagattgtaccactgcactccagcctgggcaacagagtgagactccgtctcaaaaaaaaaaaaaaaaaaaattcttggcactatgacatttaggacatgttagttgagtgttaactgtgcacaaggcaggtctgtctgatgatcacataagttagtagacaggctatgccatgtagagcctcctcagagtcgacagctcctcttatgcttccagaatattgcattcatctcattgtaaactctttgagggtgggttatatcttattgacttaaaatggtgcctaaaacaattgaatatcataggagtaaaggtaagacatagaaggctttgtgggcactggtggctcatgcctgtaatcccagcactttgggaggccgaggcaggcggatcaggaggtcaggagatcgagaccatcctggccaacacggtgaaaccacgtctctactaaaaatacaaaaaaattagctgggtgtggtggcgggcacctgttgtcccagctactctggaggctgaggcaggagaatggcatgaacccaggaggcggagcttgcagtgagccgagattgtgccactgcactccagcctgggccacagagcgagactccgtctcaaaaaaaaaaaaaaaagagagagaaatgatcacatggttcaatttggttaaaatataatgtaggaagactctattggaagctacagctgaaaggtagaatgggcaggatttcatgtcatttgacatttcaaatcattatcaagttggggtgggggcgggtagtaggtgatcccttaaatttggagcttaaatgatgaaaatgggtgtgatcttcttttttttttttttgagatggagtctcgctctgtcgcccaggctggagtgcagtgtcacaatctcggctcactgcaagctccgcttcctgggttcacgccattctcctgcctcagcctcccaagtagctgggactacaggcgcccaccaccacgcctggctaattttttcgtatttttagtacagacggggtttcactgtgttagccaggatagtctctatctcctgacctcgtgatctgcccgcctcggcctcccaaagtgctgggattatgagaatgggtgtgatcttcttaaaagaaattaaaattaaggggaaaacatttgaaagagaaggaatattctgttctgaaaaattgagtttgagatgccagtggaacctcaagacacaggtaaggaaatctaagtggaaacagaataagaagcttaggaaagcaaggttcaggctggaggaaacagatttggcaggcagaccagcagaagtgattgtgcaactaaggagaagatgaaattgccagccaggagaggagcacaacaaaagaactgaggataatacctaaagaacttgagaaagaatagccaaaatatgagaaagtgaatgagcaatgagagctacatgtcacagcatgaaggttgggtgcagcgggacatgaagaaatggctggattttgtagccaagagttgaatcaggtgttgctcaatcacctgttaactgcatgatctgcagccaattacttaagctcttgggccacagtttccttacctgcaagatggaaataacacctctgtagttatgttaatttaaatagtttaaacaagtattccttaaataatgcttttaaatcactctttttattaaaataataatcaccaataaaagatttggagttatctgtgtttcttatgtacatgcaagcaattatattacaaaatgtattattttaaaaatgtcctgtagtcagtacaaaattgaagacttaggaagttttggattatgtaatttgtaaaggaatacactgtcttttgcccacagtcttctgaataaagcattttggagtttaaatataattcagtctgttttatcaaggttaattttttgagtacctgctctgttccccactctttttctggctattttgactaaattcctctacctaagccctttgctttccaattcttagggtgtttattattctgagtcttctttaggcaactgatactccccaactctggaaacttcagcttttgaagcaatcttaaatttttagcatttgtgatttttctagtacattctattgaacacactcttttatttttgacagaataaagttatatttaaaactctttattgagttatgattaattgacattcaaaaagctgtacatatttaatgtcttcaacttgatgagtttggagataagtatacactgtgaaaccaccaccacaatatctgccataaacctgttcgtcacctccaaaaagcttctcccaccctctttatttattatgagaagcaaaatgattattttattgggatgcatttgtaaatttttgcctcagaaaatattatctgatagaaagttaatttttccatgcctcaacatcattcacaaaatgcatttaaagcatttaacatactgacatttttcacttttattagaaaagggaacagtaactctttgttatccttcttattagggtaacacattaagaaagatacttctgaatcgatactttaaaggtgattatagtattggtgtgaatggacacctatcaggagcctactccaaaactgcacaggtgggaggtaagtcctgtcatttgttttctcattttaggattctcatgatacatcttcatgtcagtgttactctagtattttactgaaatggcagatatataaaagagtcatttaaaaatcactgttaaaaactttcatacaatttggggctcataaaacaacagatttgaacatcagaattgattttgctttttgaccttggaaaaatagttaaactaagttataatctcttaatgtataaattaaggacaaaataaagctagttttctctttctgtttttaagaaaaacatttaatcacatgtgtcaaacatttaataaagagttctatttttacaaactttgatatttttaaactcaagcttttttttttttttttttttttttctgaggcagagtctcactctgtcacccagcccagagtgcagtggcgcaatcttggctcactgcaacctctgcctctgaggttcaagcaattctcctgcctcagcctcccaagtagctgtgattacagtcatgtgccaccacgcctggctaatttttgtatttttagtagaattggggtttcactctgttggccaggctggtctcagactcctgacctcaagtgatctgcctgccttagcttcccaaagtgctgggattacaggcgtgagccaccatgcccagcctcaagcttctattatatttaactttgtagggaaaaaatctcaatgattaatatttttattaaaataataaaatttaagaatttgaaaaccttacatattaataatgtctacaattaaggtttatttatttatttttcccaatcacaggaagcttttctggacaagattcagataagatggggatatcaatgtcagacattcagtgtctgctggataaagaaggtgcatcagaacttgtcatcgatgttatagtgaacaccaaaaatgacagaattttttcagaaggcattttcctcggcattgccttgcttgaaggaggaaatacacaaacacaggtacttgttcatcaatcatggggattacatttattattggtatttcttgtttacttgtcacagaaaccaaggaaaagtaatgtgtttcttttagctcttattactatctaaaaaaaaaaaaatccatgtatcacacttttcttaaatttgtttgctgtagaaactacagagcttcacaatttattcagtcaagcagaacattcctctgaaacttccttctgacattattccaggaattccacaacagtgagcaatatgctcacctgcacacaggagattaggccactatttccagaaggcacatgttttcttttgaaacttctgccaagtggcccgtagggttgacgacacccaaaagcaaaacatgctgcatgagcccgagtgctggggagtgttcccagatgacagacattgtcctccagtctttttttttcatttatcattatggttaaataataataattgtacatatttatagggtacagtgtgatattttgatacatgtgtacaatatgtaatgatcaaatcaaggtaattagcacatctttcacctcaaatgtttatcatttctttgtgttgggaacactcaaaattcacttttctagctgtttgaaaatatacaataaatggttaattatggccaccctactgaggattagaacacaggaatttattcctcctatgtagctgtctgttttgctgctcggtagcctgctctttctaggtttgccttggtcagtaaagaaaactgtctacttactactaagtatataattagaaattccaaaagccattttctcgactcaaggccagcagaagccatgtctaatttgaaactgggatattgtgcttcatttaaccatcaaatacattgaacaataggaacattaccatctaacacatccaatcacagtggctttaggagtaaaggcctcacgagcagcaagtggcatggtgacaaaaacaacgctaaatcaatagtacttagttgagaaaagaaagtgtttaaaattctcatgatgctgtagctgcagcatagatttcctctgagggaatttgaggaaggaggtgatggaggaaattgagtgagtttttttggaaattatcttatctgaaccaggtattcagttgggactttttaaaatttaatttaatttttaattgacaaataatcattgtgtatatttatggggtacaatctgatgcttttatatatatatatatatatatatacacacacacacatacacacacacatatcgtgcaatgatcaaatcaggataattagcatatccatcacctcaaatatttatcatttacttgtagtgagagcatttaaaattctttcagctatttggaaatatatagcatattattgttattaagtatcattgccttgctttacagtagaacaccaaaacttactcctcctgtttaactgaaactggactctttgaccaatgttccactgtctacgtctatgacttcaacatttttagattccactatttcacttatcaatggatgaatgatttttaaaaatgtgatatataaacatgacagaatactattcagacttaaaccaggaagttctgtcaattgggactttctagagaaagtgtccagtcaaccacataacattagataaaggcttgttcagtggatagaagtgaaggattttttttttttttttggtggggggcatctctagaagatatcctcaggattacagtcttttgtagatttctgtttctaggccactaagggtcaccagatgggatcatccttcatccttcgcacttatttatgcttacttatatcctcatattgctggggaataagccagctcccattggaaactgcaccttctacttataaattcctggcaagttgttcccctagatctcttcacaaccgaaatatttttcagtccttctttacatgattttctgtggcatttgccactagtgactttttctttcttcttgaaaccttttctgcctgggtcttgggataccaccctctccagcttgtcttctacctcctaccatttcttcttagccttctgcaaaggtttttctccctctacttaactcccaagtttctttggactctctgttctcactctgtgtgttccccaccctgacctccttcatttccacacctttaacgtttactgtgtttggatgcttctgaacttactgacgttctagactatgtatccagctgtcttccagaatatttagtgggatgtgcacaaatgccttaaactcaacatgtctcacatggagtctgctgttgctctccatacacgcactgctccttttgccattgcctctctcagtgactggcactccatctacccagttgtctgaccagaaaatgatagtcatccttgaccttaacttgtccacccttacttactctcttcctgaacatcccactgatgaccaacttctgtgattctgcccccttaatatccctcatatccatactctattattttcaattcctgcttttccagctctcactacagattctccttatcttttcctagacagtgacaagtagtcttctaagaggtgtccctgcttccagttttgcccttctccaaatcattctccgtgttgccttcaaagatgcctttttttttttttttttttttttttgagatggagtcttgctctgtggcccaggctggagtgcagtggtgtaatctcggctcactgcaaactccgcctcctgggttcacgccattctccttcctcagcctcccgagtagctgggactacaggtgcccaccaccacgcccggctaattttttgtatttttagtagagacggggtttcactgtgttagccaggatggtcttgatctcctgacctcgtgatccacctgcctcagcctcccaaagtgctgggattacaggtgtgagccaccgcacccagccaaagatgcctttccaaaaacatgctattcttctgcttaaaatatgtcacctgccctataaagacaaactccctgctacagtccataagatacttcatgatctcttcaaattttccaactttcccttgttcttccaccctcttgcctcctccatccttcctcttatgcatcagctacacttagctctttgccattcctcaaatgcgttgtgttatttctcatgctgctttctcctctttgaggattcaactcaatacatttctcctagaagcctaggctccatatctcactgggtagaattgattactgcttactatgtgcccctgttataacctgtggatgtctttaatgacatttctaccactttgtttgcttgtttgtttgttcttgagatggagtttcactcttgtcacccaggctggagtgcaatggcgcgatagcggctcacttcaacttctgcctcctgggttcaagtgattctcctgcttcagcctcctgagtagctgggattacaggcacccactaccatgcctgactaattttttgtacttttagtagagacagggtttcatcctgtggccaggctggtctccaactcctgacctcaggtgatccacctgcctcggcctcccaaagtgctgggattacaggcatgagccactgcgcccggccatttctgccgctttattttgcctcttcatgtgtgcatcaggcttcgtctagtaaattataagtccttaaaggttgaaactacgttttattcatctttgtaccccttgtgtctggaccaatcttggggttcagtcaatgtgcagaagtgaatggttctgtgaatgaatggtcctaattaaattctttcttcttcacaaagtctttcctagctgtctgggacatttggtgtccattcccttatctcagcttccatgcacttgtttctttaataccacttggcattttgcatgtgctactttgtttggttgtaatttgtattataccctgcctctccaattgaatttcaacttcttcagtataggggatcatatcctattctttatgtctacagtgctttatagccattcaacaaatattttttgatgaaacagcattaaattactcttatatatgaaaaccttcttttaagatggattatgacaataaggaccagccttcctctactcggatgtctcacattgtataacccagatggcaactatgttttcctggctctaagaggtctagttgagattagctcaaatcttattccttgccctatagcagtctaaagcgcactcctccccaagacacttgccagttccatgggggttttacattctcactgtctccttagccaaaaaagtcttgctttctcagcacataaattcttaacacccctgcttctgtcatactgagaactgcagccccttcctttatttcttcctttctaactacattaagtcaatgtgtgtatgttctatactttgttaaagatcaactgaaggagaaggtataggaggtacttatattacaatttcaaatggaacctaatgatagcaataagaaaaattatacctactaaatataaggcgctgttctttgtgatttgtatgtattaacttggctaatattcaaacaacctgtgaggtaagtggtatgttatcctaccttactgaagaagaaactgagatagacccaagcttacatcgctagttagagatagagataggtttcaaaccgatgcagtctggctccagattctgtgctcttagatgcaataagcatctcttttctagaaatagccatctccatcctcaccactaggatatttcacttgaggattctccctgcatcatgctcttgtctttctccattctcacttcccttcccttctctgcctcttccagtctcctgtcacacatatctgttgatccatcccccttagctccaaaacacttggagtttctttccccttacactctatgcagctaatggaggtagtttcctaagcaaaaatcatgtctttagtgaaaggaatacttatgctacttgttgagattatataaatatatatgaaacctacttttcctttttaaaatcgtgttgttcagcattgtagatacctcgttcttaaaaggtgttatctatgtaaataatctagcattttcatcgtaagaggttgttttatacatttagtgatttagagtcagaaaatctagatttaaatcctagctctaccccttactagttatataatgttgggcaagtcactcatctttactaaacctcattttatgaatctataaaatggaactaagagcactctattcatcacactgttgaattgaaagtatctatgaagtaatatatatagaagaactacataaattatgaagctttgttttaatagagccacaaagttctcataactcctcattaatatactggaaactccttccaccttctaaccccattatattgaaaagatttgggctttatcatctgcttaattcatgggattgtagaggtctgtggatgctgcatttgttgtttgaattaacaaaaccagcttgactgttttactgtggttgctatggttaccgtgactttttggccttctttcttgagggttgcttgccctctgtgtaggagcttacccttgtaggtgtgcagctgacatctaaggcttcataagacactctgtgtatatacattgcccacagagaaaattgcagggtaggcaaccatttcaagacctgatgtcattagagtctcagttacagatcccaagacctgtgggtcatgtttccaggaattcctaaaggaaagcatatcctggggcaaactcccccaaactggctgtttaaatgttcttatattggagtagggccagttctgcttgatctggaaattattttttcttatgttttcttcatactatctctcctcaagcttatataactcttttattcactacagttagggagttattatctttattaatttacaaatgatatttatcttgtttgtcttgtatctatctcataatcttggtagtaataagttataattcccccacccacttcaaattctgtcttctctggaatgtgttatctttcctacctcctactgcttctcctggacacttccataaggcattgagcaggcaagaattagggtaaatcttcccaaggttgaatatttccacatcttacaaagatacattttatcatacttttgtttctgaaccatttctacatcattattgactatatttattttaaggtggatttgtctgagaccccatgcaaagcaatgtagctaatgaggaaccaaaagaagttggtacctgtttatcagtgagatcccatgagtgaggctaccatggtaacactttccaaattaaatgtgctgtaatttagataaagagaaaaatagtcctttgtaactttccataaactcatgtttatacaggatgatctttggattgatggctattttccactttagattacaaactcatgagaacaaggattgttgttggtttccatttttgttctatccctattaacagagggcttgacgcatagtaggcactcaatacatacatgttgaatcaatgcatgactttataataatataaaaatcaaagaattctttccatacaacttcttacaatgtccctgtaagtttttaaaaatatataaccagtaaggataaattaaacagcatctgaaaatatgttggagtttagtggaaaatgctaagtaaataccaactattattagtacacattaaatagtacaagaaactggcaaaggctgtcaatttatgaaatagtaatgggtggtgcattaagtgtgtgcttttgcctataatgcttatgtttagttcaagcataaaaacaccatttgtctccccttgggtattgatgtcttaaaatatgttttcttgcagtattctttctaccagcagttgcatgaacaaaaaaagtcagaaaaattctttaaagttctctatgatcgaatgaaggctgctcagaaagaaataagatcaacagtgacagttaataccatagatttaggtaacaaaaaaagggacgatgacaatgaattgatgacatctggtccacgaatgagaggtaaagaagtatttgagtatttgggagaacagagtgagagaaaagaggggaatagcgtttaaatctcattaacatttttcgtctctcttctcttggtttaattatccccactgtggctctgatcatccataaagaattttggtcatggggtgaccctaaaacggctctgcaggactaaacttaaatgagacataatcagtgcaaagcaaccaacggcatgaaagatgtttgatttcattgtggcatgcatggtaaatagtaactgccccaaatcttttaagtgaccatgaaaatgaaactttaaaaacagaaattaccacaccaaactccaatgaaagattcttggtattcagaatgacaaaatcatccatgtattaaatacaaatcataaagacattaacattttgaagtttgtcacattttcttacctccttgaataagaaactcatatacatgaatatatatatgtatatatcagaaagacatgagtccttttaaaatttgctaagcattgagatcttttttatgacccactgcaaatttaatttttaagtgctctctcaaatcctttttggaaattgttgcaccttttgtcagattatttttaattcaattgttagagaatttgggtacctggtttgtttttttttttttaattagtaaaagcaaattggttcagaaatataaaagtactgctttgttttcagtaagagattcaacactacatttaaaagagggaatgaaagggcaattaacagaagcttcttcagcaacatccaaagcatattgtgtatacagaagagaaatggatccagaaatagacattatgtgcacaggaccagaagcgggaaacactgaggaaaaatccgcagaggaagtaacaatgagtcccgcaattgccatcatgcagccaatactgagatttcttcagttactgtgtgagaatcacaaccgggaattgcaggtatttgttctgttttgtgtgaaagctgagaatacaacctatgtttatcagtaattaaattcaaataaaaccaacaagtagtttcggagagcattttagaaagataatcaataaaagcaatagtgctcctctgaaatgggaagaaactttggtatcagtgaagaaaaggaagaagaaaatccttttatgcaagaaaaaaaaatcaggctcatacagtgtcatcctcctcaatatttttagcctcaaatatttttagcctcagtgggcatcctgtcttcctagtattctctggtaaggttatattgttgagagagatcacatttgtctcatctatatctttcatgattttatattcttaaggggctttcattattttcaagccaattcatatttcttgagtgagagtactgagtatatttgtatgtcttcatttgaaacagaattaacatagaagaggatgtttttaaccagagtgaaggtggatacattcaaaaatgaatgtagtcagtgtcatatcttctttcctgcattttcctttgttagataaatgaacttaggattgcctatgaatttctgaattttggcctcttttttgcattgtttgtacacaggcaggccaaggccagaaacattgcttccagagggacaatactggatcagtgcccatgggcctatcctaacccatttcgtctggcagtgtaggaaatagatgtatagggtgtataatacattagatagtatctgattgaacagtttactggtaggagtgtgggatcagtatagaaaatactacttttaaagttgtcttaagaagaataaatggtagatataaattcaaataaacacgttaaataataaattaatagaaataaatactaaattaaaatataaaacatgtttccttccctgcttacccttttactaggtttactccccagagaaaaccactgttaacaggtgattaatctagagaacttgactgaatattgtcagggcccaggttttttcttctagaaatttttatgcatgcataagcatatcgaactgtgcaggtaaacattttttaaaaatcatattctgtggtattccggccgggcacagtggctcacgcctgtaatcccagcactttgggaggccaagatgggcggatcacaaggccaggagatcgagaccatcctggccaacccagtgaaaccccgtctctactaaaaaaaaatacaaaaaattagctgggcgtggtggctggcacctgtagtcccagctactccggaggctgaggcaggagaatggcgtgaacccgggaggcggagcttgcagtgagcggagatgatgccactgcactccagcctgggtgatagagtgagactctgtctcaagaaaaaaaaaatcgtattttatggtattcctcaacttacatttttcatttagtaatttcggttattagtcaattacttattgccaggttatgtttattggtacatgttgaagtacctaatttttatagttttacagtattctaatgtttggatgtactattattcattaagccagtcacattaccatacatatgatatggtttctggtgttcgtataacaagcagtatgcagagaacctgttggtgtacttatgtacatatatctagaaaaacttttttagaagtggagctgtatgttaacttaaaatattgatagatacttccagttgcccttcataatgattatatcatttataattaatgaacaatgaagttgcactgttcatatgagattatttataattgaaaatttgcttctctccctaatgaacttctttctacctagtttttttttctctttttccgacttcccattactctttccctctctgtgtagtttgatgataatgacactgagaaatgtttattatgaactatcttgatatatatatacacatatatgtatatatacatatatacatatatacacacatatacacacatatatatgtacatgtatacatatatatgtgtgtgtgtgtatatatatatagatgcttggggaaaaacctaagggcgtttctccctccttaagtggaggacagttttaataaatgcgaatacttttcttacaaagaaaagttagaaaagcacacatatgggaagaacagcaaacaatcagcacagtgaatttttgtaacccttcaattttattttcttttgccttcagaacttcttgaggaatcaaaacaacaaaacaaattacaacctagtctgtgagacccttcagtttctggactgcatttgtggaagtacaaccggtggcctgggcctgttgggtctctacatcaatgagaagaatgtagcgctggtcaaccagaacctggagagcttgactgagtattgccagggcccttgccatgaaaatcaggtaaccagaagtatccatgactaattagtaaagggattaatttggggaaggagccaatctttgtgtgcacttgaaagatctttcttcttgctttgccagacatttttactttcctaataaaacatacaaagactgaattatagacaaggaaatactatgctgtatttgtagataatttcattgtaaaaacaagtcccatgaaaatgttcaagataaaaatcaacttactgaaaaaagtgaaatacgtgtcatgaccaccacccagttttcatctttagtgaacttttccaggatttgtggaataaactttctttggctcctttggcatccctacaaggagtagtatatgttatttattttatatgcacaataaacttatgaataggtatcattatttctagtttgctgatgaataggttctaacccaaagattaagtgactttccagagtttcagagtgacagaatcaataagttgtagagccattcttacaactaaggacttttgattctgagtctaaatcgagtgctcttttgactatattacattttggagggcacagtttcaagtctcttttccagaatgtttgtctctgattttgttttctgggatatcaaggatatattgtgggagtagaaggcaggacacttgggtcaatcaaggtaagggatgccacctgaaagtttgccagttgactgtttcacctcctctcaggcatcatggagctaccatcgtaagcatggatcagtccagaagacagagttttcaagtcataaacatttctggatataaatattaaaaaagtcattgagagcaaacatcaacgattgacatagaaaattgtgaaaaagaaatttgcttttttaaacattgcagtttacatgagatacgcacacatacacacggtgtctatgcacacacacatacatttatgaatctatacacacatgtgtacatgcataggtgtgtacaatgaaaacaggacagttttggcataaacaatttgttatgggggtattttccctttctgtactgtacatatgaaataccgaaagagtttgtggatttttccctgcatttttctgggttatatttcagtctcccagagcaatgatacaagaaaacctaaatgttgatttaaagttaaggaaaaacatacaaattcagagatttggttttgttgttgataaaaacttgtacatctataatagaaaataattataccatttgtctcttctgctgtttccaggaaagcttgtaagaatgttccccagttttggtctcataagagaatggaatagagctttgaaagtaatttactaaaaccaaataagttctaaaagtaaaagctaattttcaaataacatgaaccccacatataattccccattgctctgaaaatgtgtgggaggaaagattgctggcaaattctggagatgatctgcaaaaagattctctttaagtttgggaaatattttaatgagcagaagaacctcaggacaggtaggagatgggtagaaaacacctttcctctgtgtcagaggaataaaaactccattgtatgaagggagaaataaggcccatgctgaaaaagcagtcattttgaagttgtcttgattttggtctttctcatttaactcaccaggatttcagtttttcatacctcttgacaaggtgctacattgttaacacatagtcctacaaatctggctcgcaagttcctgatttaagacctgtaaaattaaattcagaaccccagcatggtcgatcttaaccttcaaaatgtggatatttatctcacaggatgtttcataaattttccccaatcaagattccctcatgtaagtttaagaaatccagtaaatttttccttcagccatcattattgacagcatgtccccaaacatcaggagagtctcatattacttgtcttcacttccacctggcttggacagcagcatctcttgtcatcagtttagcattaagtagcaacgaaattaaaatgcttcattggtaccataaaatttgcctacaaatctcaggtatgagggacacatgtctttcataaatgggaaaattcttttattgaggataattcagatcttaaaattctgaccttaaagatctcctctgttgattggtatattaaagtttattgaatggaaggatatttaacttaaccagtattctctgaaattctataaacacagttcattttaaaagatacgtgcttcatgcagtgtctcgctcagtgttctgcatacaaaaccatttgatcaatactaatcaattaattgccagaccctatacaaaagaataagtcaaatgctcaaaggtaaatcttacctattttttaaaggtcaaaaattaaggtgattatgttgttttatatcctgttagttctagtgctattctgttgtgaataaaatgatattttacaaatattttgttttctagacctgtatcgctacacatgagtctaatgggattgatatcatcattgctttgattctgaatgacataaaccctcttggtaaataccgaatggacctggtgctccagctaaaggtagagcgattccactgttcaggccagaaaagctacagtctctatagtacaatcttcaagcagctcttgtcaaaagcatattatcatgttttcaactaatcaattgacagaaagggatagtgaaagtacaatgcttactaaactccagatgcaatgtgaagttagctttgaggtaatattccatggcaaggtcctttcctggaagttttccaagcagccactgtgtttcatgacttcccttttgtttttatttttattttattttttattttatttttaactttactttttgagatgaagtctagctctgccgcccaagctggagtgcagtggcgcgatctcggctcactgcaacctcctcctcccaggttcaagtgattctcctgcctcagcctcctgagtagctgggattacaggcgcccgccaccatgcccggctaatttttgtatttttagtagagacggggtttcactgtgttggccaggctggtctggaactcctgacctcgtgatctgcccacctcggcctcccaaagtgctgggattacaagtgtgagccatcgtgcccggctttgtttttaattttatatttttcattatagggagaagcaaaaggtgctgatgtatttttaaaacacattgactacagaattccacccagaaagacacaaggaattagacaaagtcaaaggagtgctgcattttatttttatggttctcttctttctaaaagttgttctcttttacattaaaatttagtttttccccaaaatactttcagtgatatccacactgtctttaagaggtttctttagtttaagccttgtgcacagctcccagcagtttcatttataagagctcaggagcagaaattaatatacacactaaattatataaagcccaaatactaaggcatgatattcaattgagatgagctagtaaagaccacattattgtgtttagggttaaacaggaaaaaataattcttgcttaaattacaatttatctgtgaagccctgtctatccaagactattaagaatgtataattaaatttaactttgtatgggtaaatttatagccaagaagaataggaatgatatttttctaatcctgtttctaaatttaggtttgggtagtacaatggaaagtacatatgtttacgtgaagattgtgctaaaggctcttagtaagcatgtgcttctttatctttattttatttttttgagtcagggtctcactatgttgcccaggctgatattgaactcctgggcccatgtgatcctccagcatctgcctcctgataagctgggattacaggtgcatgccaccacacccagcttaaatgcttttttaatagaagagattagtttgtattttttcatgttttcagttgtaatgtgtataagcttctgctctttctattcatagattagcaaagacgattcttacatagatgtacttgtgcccctcgattcattaccatcatgtttcagttaatgaaaccagcctaggcctgtaagatagtcagcttaaattcaagttattagaaaaatttttgttgttttatcttaaattcatatttaaccataattcattaagaaacaacatagagaggtcttgatctttggcttttaaaatccttcattagtctaaagactatacctttaaatttcatttgtaattaattaaacttaatggacagaaatactgaatggctcatccatttaaaataaagtataagcatatagattatttacaaatcaaagcctatgtaaaaaaattaagtgagagggcatcacttaacagcacaaagatattattaactattcaaatgaaaatgctttttaaaaaatatatattatttaaatttttattgattttagtatgtacaattgctaccttttaaaaatatgacagttgaataagtcaaaataccaaatatagatttggcttgaaatatttaaagtatagtttttttttttttttcttagtgaatgaggtgtgtgtagttttctaaacaatctttgagggtttgtacacattggccaatataagaacaatgtttgtaagacagaataatatatattagtaaatttaagggacttccttgcatagggtactttaaataataaattatctttaacattaaaaagataccatattaaaaattattaaggttttattttatgtcattcattcctgaatttaattgcttaatcatccctaattttaagtatacttagctttatgtactcatttagtatgagattctattactttttcatatttgttgtcctttactttttattttcatttgcaaaactgagctgtaaatatgaagtgcttcatttgtaaataggtaaagatttgttttgttttgttttttcaaagaatctggcttctttaagaagaaactcctgcactaacactgatatttcatttgattttgtggtatatatagactcttatactatcaattcaattcatatttcattaggccgtttataagatttctattcttctgacataatatagaaaagaagattggctagaaaaaataccatattgccaatagcgttctgaaattggatgtatttttaagctatcatgtattgggcctgctgagggtaggttcattagatagcactgtcagtgttgccaaggttttagctttgaattccatggaggtctgttcagattactcctaggatttaagctctccactaatcctagaaccttactcttttaggtatgttatttatgtgggatactagattgtcgaagtggattttaggattggttcaagtccgcaaaaaaatgaaaatggagcagaaaaagataatactccctttcctccaaaatactgacgtcttttcataatgagtcagtgacattagtgtcaatcatcatcttcatcatcgtcactattattggtcacttaagatgatctttaggctgtacttctggggggaaaatagttggatagaatttgatgttaaaactacccaggagaattaatttgcacaaccttaacaaaatttgcatggtcattatttgtttagaccaaacacaattcagtttaattttcattctatgatatgttaactttgagtcacttagaagcatcttaaagccatgttaactccaattcttttgtacttctatcaaagattgtgtgtggaggttaagatttttatctaaatgaatattatgagcacactgtagaaataaatcctggatatttaatttcatattgcaatttgccaaaattctatgccagcactgttaaaaacacagcatgaagtaacatctttcaaaatgtttaggatattgtgctttcttggctaagattttctgtaactctgagtatctattttggattataaattgtatcagaaatatttttgatatctgtatgtagaaatggttgagataatatacttataaaacaaattagaacacttcaaagacaacataagctattttcattctttgttaagcaaaaatagaagatattctttcacaacccaaaggtaaacaaagttgcatatcgcctgccatatagtgagactaggaagccgttatcaataagtttatattatatttctaacacatggaatttgtaattttatagattaattctaattattgcttaaatttattttaggtttcgatttgctaatatatattaatatttcattttaacaattgtgctaaattctttaaattgtataccatttctgtaaaatatgttactgatacctgttcacctttttttttattaaaacatcattatgaaatgcctatttaggaaacagtgagggaaaatatgattatattttagtgtggtatatagtaagtcacttttgcatttgaagtaccttttcaccaatatttaaaatatctcttgtaacatagctctcatgattcattagttatattttgtgttgacaatggagtaagatgttctattttagaatgttaacaagacaaatgaaattagcagttttaaattccgtttgattaaaaaaggtcctagtaatctcaattaaaacaaatgcagagaaatcgttaatccatgaaatagactttgcatgcacattaactcaatctgtgtctctagaacaatgcatctaaacttttgctggccattatggaaagcagacatgacagtgagaatgcagaaagaattctttttaacatgagacccagagaactggtaagaaaacttttaaaagcttggtcaatattgggtagcctaaaaggaaaaaatttagagaatgcatgtcagaaaaaaaagttgattgattttcattgctctaccaagacaaatggaacatcatgacctaccattaccaatacctcagaaggccctgtggtgacaaaggcctgtgtgatttgggccttatgacttcagtagttttatccactctaagcacttttcttagccaacttatcacactatactaaactatatgcaaatgtgtattgccagaaaaaagttggctttggtttaatggtgtattggagcatatgaggaagggatgtaaaaaaaatgtttgtactcttcaaaaattttatttatacttatttctgaaaaataaaaataaaattaatattttttgtagctgttcttctcagtgatatgttgtacaatgcttggcctcaaggaaactgtgcatactctagtagagattccacagagatcattagtgtgtcttcctattgtagaagttatcttttctttctcactcgtggcatgcacattatgaaataatgcaggtgtattttaaaagcattgggttccaaaagcattgagaatgtactcacataatatagctcagtgccctgatgattaagccccactcacatcagggccattgttggtgctatgggcaactcctacgaaagtctggcacaacattcttttgctctcactttattagtaaagaatggagttgaggagggcagacaaaaagagagacaaagtgaagtttgatttaatatatatttaatgagagcataatgtctatctgcaaacagtgagttacaaggaccaacacatttcctatcctatggttaaatgtggcagtgaatcatatatttattcaacaatggcactgtgcaatagccctttgaaaatactagttcctctgtgaacaacacctttattctgtcatccccttcctccttgtggcccaccctccacctcttgcttgagtatatgcccctgctctgcgcttcctcagaaacatacatagccctggattaggaccgatggcaccgcactgtgtttgcctccttgcttgctgactctcccactggagagtaagttccatgagggtactctctcccatccactgttggggtcctcacttcccagggcaatttctagcaccatgtctgcctgttacttagtgggcacttagtaaataatggatgtttattggggttctcgattctcctaattcatgggaacttcggcactatcaacattcaaatatcaaacaaaaatttccaaggaaaaggggaatattgtaggaagatacttccatgttcattgaaataaggatggtttccaaggccattttcatttagagtccttttatacttttgaggcttatgaagctgcccaatttttaattaaatctcataaaaatataaagcagatgttgtttctggcatttcaatattctttttttttttggataggtggatgtgatgaagaatgcctataaccaaggattggaatgtgaccatggggatgatgagggtggagatgatggtgtttctccaaaagatgttggacacaatatctatattctggcccatcaggtgtcacattttatatctttacattattttgctcatcctatcaatcgtgttttgtatccatggcttgtcatattttcaagttctggtcccttcatttattcagcacttaccatcctaggtttgggctaaagagaggaacagcctcccagaatgcctgactatgcaccccaaggtatgctaagggacagtcttcaggaaaagagtgcttggtacccaaaactactggaccagaagggaggagacattcccatgtcagcctgagccatggataaaccatggcaaaaaatgagggtcctgaaggagaggggaagagaggctactggggagacagagtgtgaagtgagggggtgcattcagtcctaatcaggacaaattcggcaggtagtttctggcctccttgaattgtaggttgacatgctttctgtagaagccataaactggcagcctctgattggaagtgtgaggctaaactttaaattctttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaatttttttgtatttttagtagagacggggtttcaccgctttagccgggatggtctcgatctcctgacctcgtgatccgcccgcctcggcctcccaaagtgctgggattacaggcgtgagccaccgcgcccggcctttaaattcttttgaaggaactgtttccattttataacttaaacaggtgcctgatgagtactattcataaatttaatacaattaacatgaagatcaactttaaattggcatctttgaatgcaaatttgtttagaagttaaacattttaaatgtgcatttgccaatttgattttgtctatgatagctcctttgtttttacaaaatgaagttcaaactttagagacttgctctatctttctttctcatcattttctcccattggcaatcattcccttctgtttccctgtacgttttatcagttgattgaataaacattgatagatataaagtcagattctcggaagatttatttttaaggttgctctttagacatttcttatgcccttttctaccctttgtataactgtctaatatatgtgaacttgactataatttttccaaaaccttccaggaaggagtcagattctaaaagatactaacaaaagacaccactattgttttataatatatctggctcattgaaaatattttaaggtctctcataatgtatcaaaatacctatgtagaacagaaagaggtaagggcagatgacttatagctagacagatgagcattttagctgctgagcaactgaaagccaggatgatggacaagtggaaggaagcagaaagtggagatttaggatgtggaaaaggtgtcgttttagagagaaagagaagccatgtgacacaaagtgagtcaagctagcaaaggaatggctagagattgaatgtgagtagaaaggaaaaaatcccaggctgagaattaaaatcatattggctactagaatgaacacagaaacatgctgacccatatgtgtacagggtcaaggagttactttagaggctgtagcactgtggagggaagaaggcaaggaagacaagcaaggtcaaaaaggcaaggtcaaaatgagcagtaataagtttcagaagaagaaagtagggaagtagaaccacttctgttttcttgactgcaagatagtcttgctttgtatgggggaggttgtcttcttgcacgagtgagcagctgcatgagtaaaacctgactgtgtagctgttgagtggggaatgaacaaccagatgagctaagcttgccctggagccagcagagtgacagattggccagcagacaatgaatgaaccacctgacatccattaagaaatttaataaagcagtctcagatgaccagtgtcttaggggtaacagtgaaaatatcaaggtaaagaaaagacttatgttaggtaacttcagtttgaagcagactaagcataaaagtagaggatacaggccaggtgcaatggctcacgcctgtaatcccaagactttgggaggctgaggtgggtggatcacttgaagtcaggagttcaagagcagcctggctaacatggtgaaacctcatctgtactaaaaatacaaaaattagttgggtgtggtggtgcatgactgtaatccaagctgcttaggaggctgaggcacgagaatcacttgaacctggaaggtggaggttgcagtgagcctagatcactccactgcactccatcctgggcgatagagcaagactctgtctcaaaacgaacaaacaaacaaacaaaaaacaaaaaaaaacagagtacagaatacaaatttttaaaaagacgatgatacatgttgagaagaatggacaaagagggtaaagaatgcaagcagtgctcagagatggaaagatgatagaaaacataaagcaacctatatatgaaataaattcaaaatgaagatggcataaaggccaattattttaatgaatttgagtttattacagcgcttgaagaggagaatagacatatgcaaagatgatggtggaattgcccaaaaagtggaaatttagaagtagtaaaaaaaatgttacaaggcgttaaaacaacttgttgaaaggaagataaatcaatgatatcaatgatgtgaaaatgattggggtggatatatcgaagttgtttttttttttaaacttcccagaagcaaaatgttggaaaagcaatgatttgtagagcaacgaaggtccaatatagaagtagagaaacaaaggcagactcgagaagagagagaacaaacatcaaaacaaaagaaagtaaagagaaaaggagattctgaattgctgaatactttaagcctcatgattacactgtaagagattaaatattaaataagagtcctcatgagtccctcttagaacccaaagagggcataggtatggaagaaaagtaggccagttgtatgtaactgacagtgtagagttaagcaattgtccgcttattctattatagtgacacaaggagtcatttccttgccaccatataaatgtattctttatggggtaaccccgtcaccagtttttcatgaaaaattatgagctttcactcacagaagagagaccattgtgctctgctgatctttctgcaggtgactccttggctttctctaggctaggatgtcatatttggtttcttagcaggccaatccctaagattgtttccaagttcctcatgaatctattgtcctccacaaactcacaaggagtggttgcttgtaagcactgcttcagaagtggccatgtggctgtgctataggaatttggtagagtccagtttccactgttttcattgtggatatgcagtcactgggctcctgcaggcaaatgactgtgcaaattggtttctggctttgtacagtttagtaattccaaaaccaagatgcaacttcctctttgttttactataatcatcttttgtgcagacagtttattctggtgctctcagactttcaatttttgttgttgttcttttcatggtagtaaggtagttctgctttttctgccatgacatctcttttggcctttcctgtggttggtgttacaagaaacaaataatgcttcttgtaagtgtcttgtctgatctacataaaactataagtacctcaaaaagggaatttcttaacttctaatactatagtgttgtgcagagaatttccttaaaatccaactatgtgcactttttgactttctatcttctgcgtgtttaccttatgtctctctgccccatctctctgctttgctcttggtcttttatattcttttcttgctttctgtagagacagtcactatacacagtccagagcactgttcagtactttgtgtatgtccaatatatattaaaccatgtccaatatatattaaaccatgttgtttcattctctcctgaagcaatttctgttcctctgtctgagaccctgcatttaatgcctacctgaagtaagaagcatatggagaaatgttatatgcttttcaggttggggagaagtattagatagcaagctgtaggaagcaaaaataactcctggatcataaggcaagagagaatgggtcactctgattggttatatttaattcttttcaaaatgcaggcttgaaaatttttcatgagcttttcccatatcactaaatggtctttgaaaacataattttaatgtctacataattgttcttcatttgaatgtaccatgattcatgtaatcactccttattgttagacatttaggtttctaatgtacttgatattataaattacgctatgattaacatcctcatacattaatctttgtctgccacactgattatttctctaggataaattccaagaagtttaattactgggtcacagggtagtaactattttatggttcctgatgcatattgtaaaattgttttccacagtttatgatggtgcttgtcttactgaatcctaaaattatgaccatttaaaaaaatattggccaaactgatagtatttggaacaacaatgtttgctgagtgaattaacatatgatagatgaaaggagaatcacattttgatttatatcttttggattactggtaaaatggactatcttttaatatgttctttggtcatttgtatttcttctgtgaattactagaaagtatttatctcttattttataaggttcattttaatgaagtttaattagggataataactctttgtcagtcatattagttatatttatttcttactgatttactggcttttatgttttcagaataattttctttcagcacctcgagatcatttaaacactcacctagattttcttctggtgtgtaatgaattcagtttttgtatctaattatataatctttccatgtcataatgcaaaaataataagaagaaaagttctgatgcttcatctgtaaagacatattccaaaatttagtgtaacagcaatccatgagggcaggatttgcaggaattataggagggtgctgtagagcatgggtcacagagaaagttttagtagaagagattagggccaaaatctagccatcttcaaggccagatggggtatgtgaatgagtgatctaggggctggtgaggttgggacagtctgacgttcctcttccaaagcagggagccattactcacttccgctgacttgccagttgggcttgcaggccctggatttccacttcttccaatatttcaaaagaagcctatattttgaaattttgtgaaaatgtggaatctcctaacttttaaaagttggcagatcattcaagatttttacaaacactgaacaggccaaagaaaactcagcagcaagctgaatgcagccctcgatccatcagtttaccactgtggaggaaaggatttacatttcttgttctttctttcattgagtttcacagatgcattgagtgcttactagatgccaagcgctgtgccagatactaggaatgcagtggtaaagaagatccgcaacagatcagctctcagggaatttgcattctggctgggagcaatgaagagtagacaatgaaccagaaagataccagatggtgatataagctacgcagtgaataagaatagatcctggtgaaagacagttactagaggctattagagattggttgatctggagggttttctggggagcaatttagactagatctaagtcaaaaatcaaaagccagcaggataccatgggggtggggggtttgcaggggaacatcccagtggcttgaaagtggcaatgaacttggcatatttaaaggaacaaaagaaggcctgggtagcttgaacctacccccagccagctattagtacttgactattacactaatcacctacagttcacctcaggcttatttattataagatagtctttcaacaacatttattgaacacctcttatgtcaggcattgtgctagtttctaagatggaaagatgactaaaaatgcaatcaagaagctcacaatgaagtgtatataaaaggaagagcgagagagataaatcattataattgaatgtgtttgtcttaacatggaggttatgtacaagatctacttcccctaggagtcaagagagcttcttggaagaggtgacatttgaactaaatcttgaaagagagggatagaggaagacagtccaggcaagcagaacaacttctgcaaagagccaaaaatattttagggagaggagccaaaaatattttaaggagagaaacttcttttggtcatattggtagggatcttgtatggtatctacatatgtttttatatgaaataaactacaataatttgaattgtgtaaacatctttgataactgtaatgactctgtaggcacttaacaaatgttgcacaaatgagtgaataattgagggatgaatgaatgactgactaggacatgatatattctaaagctttgataatttatagtttaagtattataatttaaaaaactgaataaagatatttttctgttactatcattaccatgataaaagttaatgataatttctgccactggagcttacgtttcttgtgtacagatgcaattatcttttttttttttttctgtttctatatttgttcagtgcctagaatatagcaggcactctagaagagtttgaaggaataacttctggcaaaaatgcatgcatgctgataatatttctagataatacatccactatgtaagattaatagactcctacaatgcttataatagcattctggcagtccataatcttattcaactgctcttaactttctttttaattttatacattactctttgccaatattgttagtaaactctgtatcaacaggccctataatatcttctttcttgctaggcacttttcttatttttgttcatgataccatctctctcttttactaatagaatatctccttctgttgttacaattcatcttagtgttaccttcatacccttaagatccaaactgagagctacctaacacatttcctagataaaatacagccagcaactattctttgttttgaattcttacatttgttatgtccaactagaaccacatacttacttttacactaggttgtgctatatatcatcctggaattgttctttgtgtcatgtatgtcggacctggctactaaattagtagtggatctacaaaatctgggcacccaggaggccttatttttacaaaagaaactttccacaaagaaaaagtataatgggaaaaaaatgcctgggtattatagaatagatttaaatcctctaataggcacttacgtgtctttcactgagcaactaagaatctttgggttatggccatttaaatgacctctcaaattgatggttaatgggtacaataaaaaatgcaatctaggaaatggattgaaatgggactcactaattattagtttgatataaagatcatgaagtggaagcaattatttgtttgcttaacatcccttgtttgttagttacgtatttatttctgagtgacataattattagagcatcagtctgaattctagcaatgtaaaatgccattgctgtgtctttgactcctccttctgcctgcttttactatccactgaattcaaagtctaataggatagctggagatatcaggcaaggcttttatgattagtttttccaggaaaaggaaaatgcatagcacttcctagtatatttcagacccttgaatttttagcttatccctaatcaaagtcaataactctttcttaactttcaggagagagagagaaagagaaagagagagagagagagatagagaaagagaatggcaggaacagccatggcattttaaggacagggattttttatgtcatgctaaagaaattttttggatttcctgatagtcttcattaatccacttttttctttaaaaattctgtttctaataactaactacaattgcttgagctatattcattttaagggatatgcatgtaaattactccaaatagctaaagtttaatttatactgaaaccatatgaaatgtatctatcactcagactacttacagtgttttccttagagatttatgctcttcacctctttgcagcttccattttcttatgctaatatgtagtaatcagcattgcttcatttactttatttgtagatgcagaaggatggtttgtaattggatacataacttccatctctaatatctttgaagggttttaagtaacgtacaattacctcatctttattattgcttgtagtgcagaacgtagaaaacacagctgggtttttcaactcacagaggcacttgtagctcagtaatatgttggctagaatgttgtaccaagaatattatgcaaacagtttagctattattccacccctgcaccctgtgttttctctgtgagctatttacatcacttaacttctctggcttcaaccttctcatctataaaaatatgatggctgtcagtgagctgcatttgcaaagtaaactttcagagacttatgaactccagaaagtagttggactgtgatagctcttttactggattcaattatgttttaaataatgtaacaataactaatcagctactagatatttatgtatttatttatatatcatcattataaacagaatttgaggttgaatgagaaatgcatgtgtataattagcttgttagaatacaagatcaaaagccatgagaaggaaagaggatctaagtatacccgaggccttggctaacattcttacagtttatcagtggtagctctgagcttcttggtaaccaagagtataattgatacctatagtattcattaatgaccaactttttactggcatttaattcaggaaggagtttatgcaaggatatagtacaacacagtggacagaaccattctgcagaacgcaacagatgaaataatgcacatagctgttttttggtcctcagggacaatgatcaacacttctgatttgttagcaggagtgaatgtaattaatgttgaagtgtgtttaattcaacagccattatgaaaatagatattatattcaccttatagacagactttgataatgtaggacctttctaatatgtgaacttagttgaaaaaaaacttttgtaaacatgaagagattatcatattaaatcacagaaaatagacttatcctacttgcccaggtatgtgaaaatcctgctgctctcagtgctggggataaagtagtgagcagacacacccaaatccctttcctctgtgagcttacatgctagcaggaatgtctccctccttgagaccacatgattccttttggggcatgtgctttatagatgcagttgtggggtgggtagggaatgcacgggatacggaaaggaggcatcatctctacccccatggagtatacctttattacaggagggagacacaaaaacaaccacattgcatcaagtcctaggaaaaatgcgtatctgaggtgctctgggatcttaggttaggagtgtgcttaggaaagtgagtatggcagagcaagagagagagagagggcgccagagggagcaagaggaacagagagataccactttccctctgttctccctcgtttgatcatttgctcagcattcgtgcatgcaaatctgcttctttaaaaaaacctctagcccactggctcataacttgctgtcttttatagcaaaagtgctcaaaagattgtatataattgctatctccaattcctctctttctattctctctctaacccatttctgccaggctttcattttcaccgttccacctaaaccactcttggtgaggccaccagtcactgcctctttgaccaatctaaaggttgcccccattccgcatcttttgtcctgtcactaacatttgacacaattggccactctcctttctgtgaaatatttcttcacttagtttttgcccagcgcaatctcctgatctttcgttctgcttcactggctcctatttctttctctggcttctgttagaggtcttctagtcagaaccattccatggatctctggtcttcttaatcgacgctcactccctgaatgtcacttagtcacatgactttaaacaccagctgtaccatgataaattccaaatgcacatcttcagcgtgggcctgtcttctgcacaccaggcttgttcctccaactgcttgctcaggatctgcatttgaatgtctttttaggcatctcacacttaacattatccataatagaactcttggtcctcccaccctgtgtacaactcagataccccagacactcagactccatagcctcagctccttagcattcctgtagaccaagcctgggtggatgtccctcctgtgtgtgcccatggcacaccacgcctgctgtgatcatagaacatatatcaccaaattcacatggcctgtgttgacttgtctcctccaccagactccaaacttcataaaggcaggagttaggttttactcatgaatgtcacccagtgcatagtgctgtgtttgatatagtaaattgttttgattcattgagtgagagagtaagtaaatgagtggctgtgatagtcaacaagtgctgtagatcaggggtccccaacccccgggctccagacaggtaccagtctgtggcctgttaggaacggggccacacagcaggaggtgagtggcaggcaagcaagcatgaccacctgagctctgcctcctcttagatcagtggcgctattagattctcataagagtgtgaaccttgtcgtgaactgtatttgtgagggatctaggtaacgtcctccttatgagaatctaatgcatgatgatctgttactgtctcctgttcacccccagatgggaccgcctagttgcagtaaaacaagctcagggctcccactgattctatattatggtgagtacgtaataatagtagaaataatgtgcgcaataaatataatgtggttgattcatcccaaaaccattcccccccacgccccagtccatggaaaaattgctttccacaaaactgatccctggtgccaaaaaggttggggactgctgctacagatggctagaaaggaaataggtgaaataggttaatattagctggagttactgtataaggctttgtggtggggcttgcattttagatgaatcttatggattgataagatttagataaaccgagaaaagcattttcatcatagggaaaatatgcacagagatgggggcaatatttagcgtgctgtgcgtgtgtgagagcagcttctctgggaccttacatcaagaagagagaaagccctgtgttgcaactgtgggaggtagttagggagggacacaacctattgaattctgaaggactttaagtaccaaagactaattacgtataaatatttattgaaatgtgatatagtatacatttctgctaaactgttccttagagtacttaatttgtttttgtttgtttgtttgtttgttttttgtgttttgttttttgagatggagtttcgcccttgttgcccaggctggagtgcagtggtgcgatctcagctcagtgcaatctctgcctccctggttcaagcaattctcctgcctcagcctcccgagtagctgggattgcaggtgcatgccaccacgaccggctaattttgtgtttttagtagagacgggtttctccatgtttgtcaggctggtctcaaactcttgacctcagataatccgcccacctcagcctcccaaagtgctgggattacaggcgtgagccaccgagcccggccagagtactcagttcttacctctgttgccataaaatgaatgagactgtaatgattctgtaaaatgctgaacagaataatgcagagacaaatagcacagaagtctgctttagaaaatatccactaaccccaaagcaatgttataagtcttaaaatgattatttaatgattgtactgttactcatttataacctgacattattaggcaagtatttacagataaatcaattataagtgaacccatgagaaaatgtaattagtaaacacataagccaatataaaaatacttaggtcagatcactaagtaatattctgtatatatgggtttatgtgtgtacttgcatgtatctgcatataatatttattgattaacttatttttcctgctcagacataaacgaagaaagcttaactatagctcaggcaccgtggcttacacctgtaatcccagcactttgagaggctgaggcaggtagatcatttgaggtcaggagtttgagaccagcctggccaacatggtgaaaccccatctctactaaatatacaaaaattagccaggcatggtggcaggcacctgtaatcccagctactcaggaggctaaggcaggagaattgcttgaacccgggaggcggaggttgccgtgagctgggatggcgccattgcactccagcctgggcgacagagcaaaactctgtctcaaaaaaaaaaaaaaaagaaagaaagcttaactatatagctgacattttatcctgaaggcatgttgaggaagtatgagctaggacagaatgtcaggacagagagagccaactaattctcatttagtcaatagatccagtactataatatcaaagtgatgtatgaaaatagtttttcccgccaggcacagtggctcacgcctataatcccaacactttgggaggctgaggtgggcagatcacttgaggtcaggagttccagaccagcctggccaacatgatgaaacaacatctctactatttttaccagtggcaaaaaccgcaatcacttttgcaccaacctaataaaaatacaaaaattagtttggtgtggtggcacttgcctgtagtcccagctactcaggaagctgaggcacgagaatcacttgaacctgagaggcggaggttgcagtgagccgagatggcaccactgcactccagtctgggcagcagaggaatactttgtctcaaaaacaaaacaaaacaaaacaaaacaaaacaaaacaaaacaaaagttttccttgtgtagtagcccatggaatcatgtaggtatgtgagtctcattattatgtgatgagattgctcagcttttctgttttatggctgttggtgcattttgagtttcagaattacttacagaggcacagaaaagtggcagaccattgtgacaaactaatgctgaaagacaaaatagttgatctaaaaaaaaaaaaaaaagtcaggcttcggaaagggaaatagttacccttagccagaccaaaaaaaaagtccccttctgtcacaaccaagtgattatttgaaattatatggtaggggaaaattctgaaaagtcccttgtcaggatttatattattgactaaatgtgatcaattttagagatgtgaaatcagctggtctcagaaaacttctagaaatgtatccctatacacatatatgtaactttatatgtatgtgtgtgtgtgtgtgtgtgtgtgtgtatatatatatgtatgtgtgcatatatatatatatatatatatatatatatatatatatatatttatatgcttttctttttcttattgtcagctttgtgagacctgaaaatgatttgcaggtttctgttactataccagagatttgcaaagtactacatagtaaatattttaggcttttcaggttatactgtctctgttgcagatactcaactctgccattctagagaaaaaacagccatagacaatatgtaaacaaataagtctggctgtgttcaaataaatctttattttaaaaaacaggtggcatgctgaatttgacctaggagctgtatgtagttggccaaacccttctgtagattatttttataatcttcacagttgagaagttgcctgtgtcccatatctgaaatatccttgtgaaaactgagtcatttatttttaaatatttttcatgcttatatttatagtgtttaattcactttgtatgtgagtgtaactaacacacacatacacacatacccatagacagagtgacatacatgtagaggttctgactgcataaaaaagaacactccagaggttctttctccgattgctgtggttctgtgatttaagcattctatggacagtggaagcctgctcataaattagaattgactaaccaattgacagagcaggcacatgttcattcagtggattcaggataggaatgaatcaagtatgaaccaggtgtgtggatgaatcgagtagaatagagggagaagtgggggaaatggaggcagaagtcattgaaatgagacagatctaggcatccaggtcggagggcaaacaaagaaccctagctgggggcaaaggtagtcttctgcttccttctgatacacaacttgggaaacactgtgtattagagttgagctctaaagcagtggttctcaagttgtagtgcatcaaattccgggaccccgaccccagagactctgagaatatctggagtagggcctgcaattgctttttaccgtatatcctggatatttttattcaagttgtctgcagaccacagtttcaaaaaaagctgctccagacttttcaccttctcagcttccttccctatttgtctgataggctgatcatctgatccagagacagcctcttctcatttccttcccttcctttttttgtgctttccactttcctggtaccaacctaagctgattgttactaatttcgtttctgttaactccgcttctcagaaattaaagacattaacctctgccacttatacacatgaaaatatatgttgaaaaatagcttgcaccaaaacaaacgaataaaaaccacaacactctcctccatgggcgtgcacttcttgtccccgtaaggccatgtgagaatctggagtctcttactgctttatatgcaaagtccctaatgaccaaacaataagaaatggccagaatagctagggtgccataagacagaggaccagaggtgagacacaggatggaggcagggtcggatcaggaggacatgcagatcttgctaagggttttggcctgtatcccaggggcagggagaatccatcaccactgccctttcctaagtccaagaaccacttcatctgtagctgattgaatgtctgggaatgccataagttgagagaaaatgaagtgagagtcttggatggttctaggtatagagttggctagttggcagatgatggtgcatttcaaaagactggagatagaggaggcttgtggtgaaatggaaagaggagcagcttagttctagactgttggtagttaaggaactgatgggacactgggttggaggtgtacaacaggcagttgatactatgtccttgattctcagaagggagagctaggcttggagcatagatgtacggagacattggtatatagatgctgtttgaaattgcagatgtagatgagatttcctgggaaaatcaattggaatgagaggagtaaaagttcaagagttgaatcctgagaaatggcaaactttaacagaaagaaggaggaattgaaacccacagaaaattgagggaatgtgatataaaagcaagagaggagagagattcacaaaagagggtggggccaaaggccctcaagaactcaataaacgaggtgcagctgtaaaccagacccatggctttggcccccagcaggtcaccagcagccttccaagaacaatctattgatggaggggaagtaagagacacaaactggactgcagtgaacagagaacgctgtgggatttactacctgcaaagcagacacacgccagaatgcacagtagagtcagaatagcaatgactcaaagcagctcagccatctctatcttaagcagaatgagggcaaaatatcagttctaaaacctggagaagaggggagaatgagagaaacactggtggcattacagcacagattgtcttgctgtcactgagcaagtgtgttatttgttccctaaatatatgcaattgctcttcagcagaagtgtgtgtacatttaaaatgtccaccctcctagatttcctgaggctcctcatatttgtatgtgtttccccttagcacagcagcattacctaaaagcagtaccaggaaaggactgataggaaatattcacagggtccagtttgcaaaagcagctctttatctaccagactaggaatttagcttgtgttgtgcccactctgtgcggtgctttgtagttctcatcggggaaggcccgctatgggatcacagcaactgtgctaattaaatgtcagtggggtcgggagctgtggcgaggccttcacgctcagctcaccaagacccaagcaagaaggagaggcacatcagccttcctgaagctcattaggtaggaagtactcggattcagacagcttcagtgttcagatcctaaatggatgctgcaagtgggctcacaaatgagctccaaaaggaataaacaaactcatgtctttgtagttttaacagaaaacaatttttatttgggcaagttttccttgaaaatgttcccctccgtcacccctcattttattaactgtatcattgattctagaagtgtctcgtgtttatcttgtttttatcgttgatgacgccctcgtgtttaacattgacacaaagtaagggagaacaaagtaataaacacacatatcaagaaaatatcagtgctttgggtgcaggtggtgacaggcagccaggccctttctggcttcccctggaaggccctggtattttcctttcttgattgttccgatctgagtgtgctatgttgcagggaaactgagtcttgatgtcgtcagcagcctctccttaaaataactcagagccccttttctccatgagtggcacagttctctaagcggctaccaactagaagtggcattcacctgggcccccgtaccgccctcacctggacagcctggcagagctgctcactcctctccactcatactgccagtttcttcctgctgccatcttcattttgtgcctggacagctgcagtagcctcctgtctccatctctggttaagtcccttttcaattcactttccacagggaagctaaaatgattaattatactgaaaggtcagctgatcctgtctgtctcctcaccaaacatttccatagcttctgataaagcagtatgtacgtgctcaccaacatgctcaggtgacccttagtgagcatgctcctggttactcttatttttttctgttattttagttcatatttattgagcacaatacgtacttactttgtatcggtgctgtgtctcatctaaatatcacagtaactctctgaggtaaatattcataaagtacccttaggagcctcacttgcagaaggagaaagtgaagcttagagaagctaagtgatttgcctgtggctgttcagttaacaaggaggatataatgcagttgaacccaggtctgtccagagtccgtgatgctaaccactgtacagtcccaccctctagccacgtctgtgactgccctcttcattgcaccgtatgttacagaatctgcccacatccttcaataccacctggtccaaaccagcaccatctttcacctggattatttgcagtaggcttctgactcttcgtgcttctgttcatccacgcgttctgtagagtgttctctaacacagtagcaacaatgaacccttaaaaatataacacagattatgtcacctctctgctcaacaccttctaatacttccagtttcacagcaaaagtcaactctcctgttggcttcacaagtctcccaatatgacctggccttcttccccatctcccctctctctggccactttcgtctttacttattctgctcaagccacactggcctcctggctgtgccttggagtcaagaacctactttgtgtctataagtttctgtttcataatcctgctttgtatctaaaagtttctgttaaaatggtctctaaccatttgatttaaaatggcaacctccatcccccagtgctcattgcttccgtcctccgctttattttctccttagcacttgcacattttgatagatgatatatttgtttatgtctcctccaccaacagaaagtcagctctaggagggcaggagctttggtctgttttgttcactattataaccccaaagcctagagcattatttggtatacatcagaggttcattaacaattatagaattgttactagaggctgggatggtggctcgcacctgtaatcccagcactttgggaggccgaggcaggcagatcatgatgtcaggagtttgagaccagcctggccaacaaggtgaaaccctgtctctagtaaaaaatacaaaaattagccgggcgtgatggcaagtgcctgtaatcccagctactcgagaggctgaggcaagagaatcgcttgaacccgggtggtggaggttgcagtgagcggagatcatgccattgcactccagcctgggtgacagagtgagactctgtcttaaaagaaaaaaaattgttactagaaaggggtcctgatccagaccccattagagggttcttggacctcatgcaagaaagaatttggggcaagtccatagagtaaagtggaagcaagtttattaagaaagtaatggaataaagaatggctactccataaacagagcagcaccgagggcagctggttggctgtttttatggttatttcttgattatatgctaaacaaagggtggattatttgtgagttttctagaaaagggctgggcaattcctggaagtgaaggttcctcccctttttagaccacatagggtaagttcctgacattgccctggcatgtgtaaactgtcatggcgctgctaggagtgtctttaagcatgccaatgcaatataattagtgtataatgagcagtaaggacaaccagaggtcactttcattgccatcttggttttggtgggttttggccagcttctttactgcagcctgttttatcagcaaggtctttgtgacctgtaccttgtgccaacctcctatctcatcctgtgactaagaatgcctaatctcctgggaatgtagcccagtagatctcagtctcattttatccagcccccatttaagatggagttactctggttcaaatgcctctgaaagaatgaacatacaaggcatatattaattattgtatttagctcatgatggcttaggtcataggagaattctgtcttagtattgaataagagaagtgggtctttatgttatgttaatattgcatataaagcacttcatgtatctgaaactattaataacattgttttacttatagataattcatgacctcattatataatccccaagacacttacattgcaggcagtaactttgttcatatacctatatgtttatgttcaataccttgatctttaaatggcttctttaccagtaggttatatatttcttaagaaaggacaataagtttttccaaatgagtttttctttaaattttctctttcttcccttcctctccttacttttcatgccctctctttgtcttttcatttgcaacctgggttatttaacttctgaatgactagataacatttaaaagggtgttggatgtcacagaatgaacaagtaacaaaatatatctgctcaaagttctttgtctcttttcagtttaattcaacagatctgaatccctacttagacttgaaattcaccttgccacctcatttccttctttattaggtttgcctttgaaacacagttcatttgagcagtaattctctcacttttaagaaccactctatctcacaaaagctgaccttttttttttttttttttttttttagcagctgttgattagacagttaaacagagagacagcaatggcatatttcttagtctgatgtaactcagaaatagaaagctgaagaaacctgaagttgaaatgctttcaagcaatcgagcttaaagttcctgaaaattatctcgtagtgcttcttctcaactcttcatattccacccccgattttacatctggctaatttgcgcacttcagattggattcctgagcacacactggcagtgtgagaactgttgcggaactcatcattataatttcaagcctctaattaacccactttaaagtggctttgtcaagactatgagaaacagaaaagcaattgactcattcttggaataggtatatcatagagaaaagtagaatagtaagattgtgctcttcactcagcctcattggttcaggaacttaaggagcattaggagcacagatcctgcagtaattctctttggtatattattgcagatgttgttatttcacagttaggtaaattagacataaaaaggtcaaatgacttgaacgtgctaccataaaaggtcagtgataaagccagaagtcatttctcagtgtccatcataagccacccccacccccgcagcaattactttgagaacaagagctctctaagttttcccagtcaaccacaggtactattttaacatggtccaacatctcaaaaagatgactttcttcaccttttgatgtttgccttaaaaaaaaaatcaccagaaacagtgaaagaatcagaatgcttttaaaagaaaagtgttgctatcattcccatttttcttgttgtatataaatgattaggaattaaaacatttctggcccggcatggtggcttacgcctgtaatcccagcactttgggaggccgaggtgggcagatcacaaggtcaagagatctcgagaccatcctggccaatatggtgaaaccccatctctactaaaaatacaaaaaattagctggtcatggtggtgcgtgcctgtagtctcagctactcaggaggctgaggcaggagactcgcttgaacccgggaggcagaggttgccatcagctgagattgcgccactgcactccaccttggtgacagagcaagactctgtctcaaaaaacaaacaaacaagcaaacaaacaaaaaacaccacatttctcatatttacatataatattgtaattcatcattttctaaaaactcaatttatttcagaaaattaaacacatatgccattaaaattgaactaataaataagcaaaaaatactgtatgccatccatccatccatccgtccatccatccatccatccatccattcacccatccatctatccatccaaaaaatatttattaagcaactcttgtgtgccagacactgttctagatgatgaatacaacagtaaacaaaacaaaatccctgtccttctggaaactacattctagatggaggacatattaaaatcaagtgaagaatatttcatactcacatattatctgaattatcatggagaaagattcttctgttctgctagtttttcccaaaccacacttgaaatatgtgggaggggacgtggatgggaaatatccagcaaattcatttctggatgctggaagaagcaactcaagtaatattacctggtcatctctggatctgaggaaaacatattatttcttgtgtgggaatagtgagacccagaaatttcaaagacttgcgtttagttacatcaaaaagaaataaggtcaaagagatgtctgttttccatcagttctatataacgaaagcaaaaactcctagtgtacatcatttcagggtttcccagaaatcagtttctatgtttttcttattaatgtctatctgtgttttagataaccccaccacacatgtagaattagtttcttttcttgcttcctcaccctgaaatgttttaactcttttgactaggacactacaataatgattactttagaatatttttggtgaaatactgatttcagataagatgatctacatagatagtatttagtttcatttcattttagtcgctcagaaaatattgatgtatattcttacatggatagcaaaaccaattaagattatacctcagtaaatttcacatgaaaaatacaaaatagcaagcattttccgttaaagtaatgaattctttataaaatcttaaataagtatcttctgaagtattgaagtagaagtaggagaaggtataacctgttttagttgaaaatggaactaaagaatcaatttgtcttaaataattgtagggaaaaagcttgttttagaagataattttttatctcttttcatgaaaataaacatataaattaattcataaactaatatatttgttatatattacatataattatacaaacctcctgggattaaagtagtttttactcttttagtacatgacttagtctattttctgttgctgtaagagagtacccgagactgggtaattaataaagacaagagatttatctagtgtctgggaagtccaagattaggcatctgcatttggtcgccttctggtgagggcatcgtgctgcatcatcacatggtggagaaaggaaaaggaagcaggcgtgtgctaccatggcaaagcccgaagcagccttcctgcataacaacctgctctcaagataccaaatccggttccttgagagtgagaatgcactcacttcctctgaaaattaacccagtcccctcaggagcagcattaatccctcttaatgacctaatcacttcccaaaggccctacctcccaacaccaccacactggggacaaaatttccaacacatgcattatgggtgacacactccatgcaaagcagtatagaaattcatgagcctagaaattagaagctatgagtgacaaataaccaattgtttaaaattaagtggagcatattttatatttctgatcctaatctcatttttttgaaaatgtgttcagtaaatgtactgttattaagagtatctacatgttaacatttctcttgtatgcttttaaaggaaaaaaaaattctttaaaaacacttcattcttttatgtttaattttggtttaaaaaaaaaaactggtggattttcagaagggaatccaaattgcttatggtgataacatctactatctattagaacagtggtttacaaatgttggcaggattgaaatcacttggagggcttgttaaaacagatggtggggtgcagggggagaggggtgtactccttcatagtttctgatttgggaggcttgaggtcgggccagagaacttgcatttctaacatgcttccaggcgatgctatatagctgtcccagaaaccccattttgagaagcattctattaggatgagtgttagcaatctgtaggaaagttagcttcatcaatcgtcacaacactttgcaatgcttgatgataaaatcgtagtacaaagatagcatgcttactaaaaactgccctaagtcattttaaagtgcattttttgtgggctgttttcttcctttttttctctcctgctttgccctgcttcaagggttgagctgtcatgaatcatttgtttattataatcagtagggtcttttatcaattttactatagtttaagacagaccctaatgagtaggagtctagatcatttgaaattaggagaagtttgtttcattttttaattctggcaaatttcttgttattttgtacctatctttgtcttagtttggctaccattataaaggaaataataaactgatctctaagaaccatagtggatttttaaaaagataatagataaatataacttacaatatttttagaactccttgggtgaagtttgtatagtgcagagtgatgctggtggcattctagggtcgctccttcagtactgctggggagggaaggcatcagttccttactttccgtgtgtgtgtgtgtgtgtgtgtgtgtgtgtgtgtgtgtgtgtgatatgagagaaagctgtcttgagatctcatgatttcccttaggtctgtggtcctttggtctggttgtccatgaatcctccagagctgtcttgcagggtactcaagagtctgtgttgtctcttccccaggtttgtctgtattctttggaatgatcacccctgttctcctttctgtccactgccacattttcctcttggctgtgctttctttaaggctttctctttagattctcaaaaacctattttgaaagttcagaaacatgaacattgcttctttctttttccattccagttatataccaaaatctgctcaagataatatggacaactctgtttgactagggaacaagggtgtcttggaaagaaagaaggacaagaattaactttccaagaaacacagatttgttagcttttctaactaatccattccactgtactatttggtggggtataagggctttcatctgcttcccatggcccatctcatactctttcccattttccctcctgactttcccctccccctccactctaaggttctcaacccctctggaaacaactatctcctctttgagaaaagagtgcgtacagcccttcacgtgtcttctggattgtttagcttgagacttatgctggatattcctggtggttctggctgcctcagttctgctgactaaagtggggaaaatgtgcttctccctactaggaattcctgaagctgatcttcttctaaagtggtctaagtaccaaatattcacctgccgtagtgagtattttctggctgagaccacacagttgagtctcatgtgggaaagccttttcttctttctcacaggactctgaccctactaacagggtagtaattctggcatcagtatttgggaagaccagttatttcttctttggtctgtgttctttatgaaggacctcacagtactgcaaggaaccctggacagatggcaccatgcccaaatggatcctgtcttatccccaaattccttttttaagagaagggaagaaagagatgaatagaatctgagtttatcttgccacagtcaagagaaaagttccttggtggatttgtgttaacttcctagggctgccataacaaatgtccacaacttggaagttcacaatgacagacatttcttgtcccacggttctggaagccgaaagtcctaagccaaggtgttagcagggccatgctctctctgaaggccctggaggaggatccttccttgcctcttttcagtgtctggtgtttgtcagcagttcttggcatatgttggcttatatcacccagtctctcctgtgtcattacatggcattctccttgtctgtctgattgtgcctgtatttccctgttcttgtacggactctagtcataggattaaggcccaccctaatccagtgtgacctcatttaacttcatcacatctgcaaattcctgtttctgaataagatcacattcataggtaccaggagataagatttgaacatgtatatctttttggcttgatttggacacaattcagcccaccacagtattctgtatttgaactcctcacactggcatttagtgtggctcccaattaccttctagtcctcttctcattgcacatcctccatggcttggctcatgggatccctctctctatgcagaatcacttcctcatgccatcctttcttcctcctttctacctggacatttcatccattctttaaaacctttatcagatgcacttcttacatggttcctttcctagtgccaccaaatctaatgtgattccttgtaattctgccctcatttttccttgtattaattacatgtctatcattgttttaattcctccaactagaaagtaggttgcttgaaagaagaaaataagtcttgctcatctctatcatcccacagtagctaaaaccgtgctttgcactttgcagggtcacagaatcagagaaaaaagtagatgttttgaaaataggaggcttccatattttgcacattagaatacgtaaagccttagtttttgcccccttctgctgatttctctctgcttcaaataggagtagtgtttgacatgaaggcattgtattgtaatacaattgcctaaatatacaaggcagttattctgacttcaggctccagctcactttgcgatcttgggaaagccaattgctatgtcacagttttaccaattaataaaattggaactcacattaaaaaaatacagatgaaaagtactagggaataattattattgaatgtcattgaaatatagtttcttgatttttttttctccatccttacttggactcaaactgaaatgaagattaaaatcctagtgataagaagataaatgtgaaatggataataaagggtgccactaaaaatgaaaagcccaactctgtcatctttattccctaatcttggtttcaaaaaatgcatggtgttgctcaaagaccctgctgcaggttatatatgtttatgtataaggtttgcacttatgtgctgtctatattttatgaatatatacatatacatgttcttattcctatttagtgatgcatctgtatttaaattacaagtgtgtcatgattgataatgatatgcatgattttccttttgtcttcaacatataatgaatctcttggtagtctttcctgtggggatgtctttattctttcttaagactgactatccaccaatgctttggatcccctcctcactaatctgtatgcttgcactgtatctacccatgtattcattgcattgttatgagactttaatattatgatatgtaataaattatctcaggcctagtttttctatttgcaataatgacctaataagtgttccttgttgctaaaattcttttgaaactgcatactaactgggtaggcatcatttgcacaccatatataaaacaattgctgctattttggctcatattgttgtggaatacaagtatttctaagacccagagatttcccccccatggcatttcccccttttaacattcaatgcagttgcccaaattcagactctcattatcattaatattgattgttggttagttttctggaacacgtttgtatagtgacatcagctgatttcaagtcctgttgggagcatctttgtcaatagtaaagttggatatcgtaagacggctgtccttgaatatcttcattagcagtttttcagtttttaattagtatctaaattagatttcttattgttacaactcaccacagatgtgccatacttgtgcagaaacttaccaggtatttttacctttggtttccaaagcacataatactaaatggtgtgattgctgctttggatgctgggtttttttttttttaaaaaaaagtcatgtaaaagggtacatggcatataaaactgtggagtagataaatgtggctagagtccatcactaagacaatcgaatatctttggttggcagtgcattcattctatagaatattttaaatcagattgcatttataggggactaaaccctttaaaaactattaagtatatgttaattggtctctaagacattgtattgtgcttttagtaaactgttaatttggaccaggaaagcactgtattgatatcagtcatttttatgcatttcacaatcattgagatattccttaatccttttgcattttgtctatataataggaatgctatccttgctttatcatccagtgttcctttcaacattgactgggtacccaataaaagtgaaactcacattaaaaaaacacagatgaaaaatacgaagaaataattattattgaatgtcatcaaagcatatttcttgatttttttttttactctgtccttacttggacccatactgaagtgaacattaaaatctcagctgtaaaaagataaatgtgaaatggataataaaggatgccactaaaaatggttatttccttcctcctaatagcttacaatctatcagaatacatatgagtacataaataactatcaaacaagaaaaaatattaaaatattttctttctacaaatactggaatttgtaccatcatctgatttctaatcagatttatttgcccttcttctttacagaggatgaaacagagagataattcattgaggcttaagagttgttgtccacttaaacgcataaatatatgttattaactagcccatttcttcattgatttcaacaaatatttattgagtctattttatgtatcaaattctgtttttggtgctgagaacaaagagatgagtaagaccaggccctttatttgaggatgtcacagaccactggagagaaataatagttactcagatacaatatgagaaatttcgtaatatagatatgtgcagggcactatcagaacacagaacagggaggagaaaataagcctcatgagtcaagaccctctattacaaagaatatgaaagatttccaggtagaaaaaaacagtgaagttatctctgttttgtttttattgttctttttcaattatatatttcaaattttcaaagatatgtatagatggcttatctaatcatgaatgaaaatattgttctaatactttgaacatgtgaagggaggcctaggtgggtgtttttttttttttttttgagtcccttttagaatgcctcttctctgcagtaaaactagacaaatgcagaatcatgtcattaagtcaatgggagggagaaaggcctgcaaatgtttctgtgtttctgttaagctgtatatattaactgaaaatgatttgtataggtttgttcactattaattatgtcacattaaataacattattggtttcttaaaataactgtagcaatttttgaccctataaagtgatcataaagaagtaaaagctttttaataaataaacttaggagaaattattcaaattactgtctcaccttgggagactatcagttatgtaagatttaaagagttccagtatttaagtatctcttttgtgtgtgttgttgaccttacccaacaaaactacgtatctcattatttacaactctctactccatgcgtatacccatacagctgaatactgctggagaaaaacacacaaatatggttcctggcctccctttgaccataacataagggagacccttaaggcttcctggcagtactactatatttcccaagtccgtgtactttccctagctattttatagctgcttttcatcagttatccaacacctcctctctcgtcctcattatcagcttcctacttcactgagaaaaaaagtaaccagaaaagaacttgtcagtgttcccatcatcacaaccacccaacctcctgaatctgtgcccatattccctgctgtctctaagggtgaattttttcctatctaaggcaaacccctctacaaatgttctagatcattccactctcacctagtcaagatgttgctctagtgaatagtccctttcaaaaccaaacaaacactatgttctattttccgtatttaaaaaatccacctttatccctgcccttttgtctagctgccatctatttcttgggtctcccttacacctgcagtcctcaagagctgcctctactcacactccttgtttatacttcctcgcctcccattcttttttaaactcactacaattaagctttggtatccaccacttcctaaaacggctgctgtgaagctttttggtaatttctgagttgctaaaccaaatgacatttctctgtcctcatttgattggacttacctgctacatttgatgcagataatcaatccctccttcttgaaattatttcttcacttggctgcaagacacctggctgcgtggggttttgttcctacctttcttaaccaactttctcagtctaatttgctgatgtcttttctcttcctaacctatattggagttccatggagctcttttctctgtttaagctcacttttaggtgatctcactaaggctcatgattttaaatatcagtcatatactgacgtcccctccatgcacagctccagcactgacctctgcccagaattcctgacagacaaatccaacagcccgctcctcgtctaaagcttcatatgtccaaaaccaaagtcctgattttatcctgctaaatgtactcctcctacattttttcttagtaaatgacgtttctaaactattagtcgctcaggtcaataactttggaatcatccttaattctctttctttcatgccccagatccagtcagcaaacaaatcatgccagttttgccttcaagaactggccacttcttaaaacatgctaaggtacctaaagattacagtaattttatgctttcaaactgattgagatttttagaaacccctgtaagtcacaacaagtttcatgactgtggtttgtaataaaaatgtgtataattcaaatttagttaaaaaaatgtaaatagaaaataggaaatagttttcttgagtgattgattagtgacccaggaaaccaattctgaaataacagttttcaaaatgatttgctctagagcagcatcaatgtaatgaacatttaacttaccaaattatcacttataaggataatgttcatttggtcttctagtttctgaattattatttaaaattcatctccatgattataataataattggtattaagatctcatgaataataggaaaacttattgctccgtaatgtcgataaaatactggctctaccattttctagctatgttatcacaaacaagttccttacactctctgtgcttcagtttcctcatctgtcaatggcaataataagagtgcttaccactggatttcttagtagattcaaataagatcatgtacttgaagtgcttagaattagtgcctggcatggagttggaggcaggcattgtgctgggagtgaaagagttctgtggtagagtctctgttagtagaagccctcagggaatttaagcattaataagatatttgataagtgaaagacattgcaaggtttcaggaattgctcgagacaaccataaaagagacatctgaaggcaacatgtattactaatctacaaagtgagagaactagccaacacatgctgtagacattcaaatgggagagaaagatcacttccactacaagcagtttaaaataatttatggtgaaatttttgcttttttaaatgcctgatttcaatgacaataaaatcaagatctatacccagaaagcactcattttggcttacaaacatgaagcaacataggactttataccaactactaatgtagagcttagattacatgctataagagaaactcttctgaaatacagatacctatttatgtgtgtataggaaaaacacacatttatattgttcccaccactcactgatttattgcactgttgatcactttgtttttatttgcatgtagtttaaatttactatagacagtgtcaattatgtatcactgggaacatttcttcttcctggtacaatcgtacatttattgaagacataaatttaatcaacaaatattaatggctgatcattgtgatttcattatctctgcctttcaaatacagacatgctttcctgaagtgtaactaattgtccttaaccctaggactctgaagctatgtgtacaagtagacaaagatattgcaaagtttgaccctaggaaaggggaaaaaaagacctaaaacctttattttttccctactctagttggcccgccacaataaactgttgcagcagatgctcaaaccaggatcggatccagatgaaggagatgaagccttaaagtattatgccaaccacactgcacagattgaggtaaccatctattatttattgaaagagaccaactgtgaaaagttatgcttacttcctattttagaccattttcatatttttttctagagcaatgatgcagaagtgagtggtttaaactgaaaaatgtatagcaaaaggatgagtgaggagtgatttataggaaactgaggtgtacatctttcaaagttgtctttttttactaaaactatatgtaaaatttttttttgtaattaatagatgttttttaactgtagaagcaatcaatcattgcagagcaatagcgtttgagagatgggattattataatagaagccatcattcaggaaaaggtttcttttttaaaattgtggaaagcttattaaaatagagatctccagcaattcacaagtggagtaaacatgaaagaaactaatacagttttcatattgatagcatagccttggaaaggtttaacagtttccattttcagtatgcagcacttgacccccccaccaccctcataaatgagacattatttaatggttggtggcagtccaggaggtgtgggtcaaaatggacttaccattatgtgttctgagacccatctggctgtcatttactagctatggtatcattttgacactggctggcagagctaatcaggcagaagtgagcagagtagttgacgcttgtcactcctataatttacatttatacattcattcattttggcagatattttttacttttcagcagagtgcatgatgggcatcactgtattcactctcaagatatataacccctacactgtattgtttactattgtcaaacctttgtgtcacagaaacggataccttgctcacatttgtaaacattaatagtaccatagctttggtgttggacttgacttagtggaacccatgagctggactagcagcaaaaacatttctatacaaatagaaataggtcatcaaaccatgaaggtcttgaggaagatcccagaagtcaaagtacaaagctaggagatcagaagagaccagggaatagcaaatagagtgagcaggccatgggagaagtttggttaatgcgggtgagagatgggagctgttgtttgatgttgttttattgattccagtagtgaggagagatttagctataaatacacacattcagtacatgtttactgagcacttactctctaccaattcacacatatagaagataattctatgttataagtatataaacaaagggccaaggaaatgtagagaaaataataattagtggtgcctgagcgatttcaggatagatttcactgagaaggttgcctttaagaatgtattaaagattgagtacgagtttctccttcaggatggggatttcagaaaggagaaagtaagtgaagggaaggtattaaaaaacatgggaaggagatgactattttcaaaagatcaatctggttgccgtttggagacaggactggaaaagagagtgggatagaaaacacatagaacagataggaagatattataatggcaaaagtgagagatgatatcgaagatggctggactggaaaatacatagatacatagatgcagatacatacatacatatagatctctatatagttatatatatattataaatacacacatatacatatacatactgacagggctttgaagttgaagttgaattgcacatgttaggaaaatggtgtggaaaaggatgtcctctgggctactggtttgaataaatgagcagaagttggtgccatgtatgagaatgctaggagagagtgaagtttggcagctaaaaggtagaagaagattatttgttcattattggatagattgaatttgaggtgactttgagtcatccatggagttggatatacaagtccaggtttcaaaggagtggtccaggctgatgaactcgttgatcagctcttgcactcatctgaagccagctcacatgacctactcagagagtccttcctcccttctccaggctttcattaatttcatctcactgtgtatgcttccacagcagtttggttattctgttagtttaatatttatcacattggaatattgttagcttcatgtatgtcacttctcctttacttgaggcagggactggtcttggtcatctttgtatttccaaaactgaaccctgtgccttgaacataaccacaacaattcatgttattgagaataatagtttgtctgcaagttatagacttaaagaccctgggaaataggaagagccttgtgtctaatcacccatctaagaaggaattgccctctaatgatctgcttctgctttaaattcttcctgcgatagagttctcactacatcaggaagaaactgatccgattttgaatgactagtaattagaaactttttttaaaatgaagagttaacattagcccattttaatgtttacattcagaacatttttttctccctcaacatgatagcttgactctaacatctgaagagccatcatgattactaaactacaagctcttacctgttggggttcatgttgtttttttctccaacatgcctcacctaaagacggaataagcatttgttgaataaacgtattgaaaaattatccatctctggctttttgcggttaacacacctccatttccttcagtaatccctccagtttgtccatgctgcttgtaaaatgtgacaaccataatcaaacataacatttcataaaaggactgaagagcttggcttataataatctagacatgatttctttgatgcaccctgagattttttttaaatatttgacactattgaatcaagtaaaccttttttccctatatggttgcctgtcatatcaaatatgtccaattattttgtacaattgatttttgtaacctatatgcaagaatttttatttaccctactaaatttcatgtagtttgctttatgacagtattctagtatgtaattgaatatatcacatatcatttaggataccttcagttacaagattaatagaataccacagtgacaattgtttaaacagtaaaattttatcttatgggaagtctggagtaccagtagttctgtaattgattcagtgattcagtgatgtcttaaaatatgcagactcttcacatctttatactaggttccttatcatgctgacactatctcacctcatggttgcaaaatggctgctagcattctaagcatcatgcccttagacccttttgttctaagcaagaagaaagagggtacaggcaaaccaaaacaacaacaacaacaaaaaacttttgttttcgtgtatttggttgttgttgttgttgttgttgttttgtgtgtctcttatggctctctgcctttaccaagaagcaaaatctctcctggaagccctttcaggatatttctctttatgcctcactttccagaggtacagtccatgaccaccaccacaccagtcagtggcaaagggaagcagaattactcgtttgggttaagccaatccttattcattcctgagaactgggcactgtacataaatatgaaccttgaaatttaggctacataagcccttgttacatagtaaagctgtatgaaaatattcagcctttttttagtctaaagttaaacagtcacaaataacaaataagggaggctaaaaatgatgagtatttaaatgtgggtatatgtttacatggatgttgtagctacaaaaatatgttttaccatgaataagagaacattttaatgatataaagcgcttttctctgtagagttcagacacataatgctgaatatgtcatttgttacctggcagccccttttaggatgaagaggctaagaacaagatacaaataacataagcgctatgtttaaggctacccagccaatcactttctaattaagactgtcttagttttaggatgtacttcacaaaaataaaaatgggtggcagaagtgtaatgctaacccagaaagaataaaaggttttagtttttgttattttaagcaaagtatagtgttcatgatatattagtcaattaatttctcttttttaaagagaaaaatacaaagtagtatagtaaaaagggttctttcagatacttcaagttggcacattttttcacaactgaattcataaaacattctcagtaaactcatgttaaaaacaaaagcaagtctaagactgaggtgtccgaaaggctaaaaacaatgcaaattaatgttttcagattgtccggcatgataggaccatggaacaaatagtttttcctgtccccaatatatgtgaatacctcactcgagaatccaagtgccgtgtgttcaatacaactgaaagggatgaacaaggaagtaaagtgaatgactttttccagcaaacagaagatctctacaatgaaatgaagtggcagaagaaaatcaggagtaagtacagtaaactgaaatggttagttttgtgcatagtggtagataatttggtactttgggacacatgatgcagctcatttaaattgtttttttaatttcttgctggtctgatattactgaaatcacttgcagtcttaagagtgtccgcttagtctaccgctggagccgagacacccgcagcttaaggaaaacagaaagccctaactaattacatcgactcttcatgatgatcctatttttaaataaatgttatgaaatgcagggttgaagctgtacatttcaaatgttgaacagccacaggtttgaagtccgtgaatgggccctgactggcctatcagtgaataggattgagagacatcagctcctgcgcactcttcctctgttgtcctgtgattgaggggattgtttcatgttttgctgagagtaattctttctttgaacatatctttacctccccaaatcaaacaagttatacatatgataacacttgtatttaaacagagcaatgttataatattccagttaaaaatcagcttagtacagttcccatgacctatctcttaggtcccacgtctattaggaaacactgacttttaaaatttaaaattttagaatttttaaataaactttattttccaaaataagggatctcatgagtttttcacgaaagtcaatgggggaaactcttgagtaggtctttttcagtctcttggagttttctagacaaacaggatatgttctcaatacttctattcaacagtatttcattatggtagttttcagcaactttagtgggtatgatttatgaatttgagtggtgcttgagaaatatcatctttagatataggggtgtggtatgcattttcaggcttttaaaacagaatgcttttaaaaaaatcaaaattattctcccttagcattttaccatgtagagccttatggaattcagtgaaaattttgggtgtctaaaatacatatgaagacacaattttatttggagcatttaaaaaacatatattttctggccaggcgtggtggctcatgcctgtaatccctgcactttgggaggccgaggcaggcagatcatgaggtcaggagatcgagaccatcctggctaacgcagtgaaaccctgtctctaccaaaaatacaaaaaattagccgggcgtggtggcaggcacctgtagtcccagctactcgggaggctgaggcaggagaatcacttgaacccaggaggcagaggttgcagtgagccgaggttgcaacactgcactccagcctgggcgacagagtgagacaccatctcaataaaacaaacaaacaaaaaccaaaacaaaacaaaaaaacatatattttctccttgacaataaattgaatactgaactagtgctttggggaggtctgtgcttttaaaaaaataagtattttatcatttaccaaaaattaaatcttaaataattttcaatgtacattttactttaaaatttggaagcagcttattatgaggctataggcagagtctaattcatttggtggattcaatagtgagaatttgttattacaaatacatgcatcaacatcttctaattttgtcttaatagtctacctttaaaaatgaggactcctaattcaggaatgatggagatgcagatgtttatagtttatgatacattagtcaattgaatggcatagctgatcatagcatatttcggcattggaatgttcccttccaagagaaggaaaacaagatgtactaaagagaagtacagtttgtaagtaggcaataggcactaggttgaaattcacaggatatatctacaaagttaatcatttccatttgaaaatcgatgtgcctttcccccttgattaacttcaattttttaatcctggtgttaagtttttaaaagttagagaatggacaaggcctataggagccatgtgagtgcccagggcaggctagtagatttggctgtcattcaaacttacatgcattaccaatccgttcagttatttaacagaggtggaaagaactgatttttggttaatgtaaactgtattcgattgatgtatttactaattcatttgtgataacagacacagagtcctttgttgaatatatgcagcaaagcgtgttccacttattaacagtttttattatagtgctcattttcttctgctgtttcaaacccaacaagttcttaggaagatttaaggtttaaaatgtagataatattataaatcactagttccccatcaggaatactatgtcacatgattaggtttcatactttcaggtaactgtgactgtcataggaattttcattagaaatatatctgtgctatgggtttggagtttttttatttgactttaaggcatgggaatgggaccaatttatcaatattaccaaattatacaatgaagtatatcatttcattaaaagggaccccaggcaactgctaaactgctctgcagatagattacagagagttattacagaatcaccttttctgaccacctttagcaattgcaaaattcctcacccttctacagtagtttaggcctaaactggctgaaggatgaaagaagaaatcaaatttcactcctttatggttctgattgtttttaataaacttactcaagtcaaatatttatttaaataggtttttataatagtttacaaaaatgatgcatttagtaaaatattgttttggtaagcttcatgtgttgaaaccaaaatgtattttcctgttcagttcctttacatttctcacttcctagataaccctgcactgttctggttctcgaggcacatctctctctgggggagcatttccttcaacctggctgtgttcatcaatttagctgttgctctcttctacccatttggggatgatggagatgaaggcaagtgctcgtttttccttaaaatataaatattttaaagttcccacttaactatttaaagcttcaaaataagaataatttcattcctgttaaatggatttttctatacttgttggaagtagagtatgatagtaaatagaacaggcagaaaagtgtggtcaacagaactgttattttttaaaaagctcatatacacaattgttattagagctatattatatcttggcaaataaagcaatgaaaagatttgtcatttctacctaattattatgaccccatttttatactgtatcatctaaattatgcaaatgacagttctgtgcccaatattaattgttgttacctaaatactggcgtttatattttactctctttgttttctgtcttgtctaaggtttctatagtgagcatacatgtaatctagaaataatttttaattctatactaaagtcagggattcttaagataattaaatgtttatcatctgaggtttcaaaagtgaacagcataagacaatataataataggaaataaaggatactgaatatgaaactattattaaactaataatacaaaagcaaaaatgagaaattataccattttaggtggaaatgagaaatataggagaaatatactgaatcgtgagatttttgggaagtaagttttgtataagtttggtggagagcatgggaagtatgttacaggcttgggctacaatctggtaaataactttggaatgggcatggaaagaatggcttgaaagaaaagatggagaaatcagctaataataaccatgcagtgcttttgcatctcatcatttcatgggattactgtgagaatttaatgagatactataggtaaagcatttagaatagtacctgataaaccttcaataaagttcaatggtggtggttgctgtttaaaaggtacatatttgtactacataaggaagcgtagtggaaagagagtatgataagagcaacaggtatttcagcctatttcagatgaactgggggtgggcagaaaaggaaatgggagtccaagggtcatttgctattttacaggttcattacaggtaacatagatatcaaagttctaaactttagctgtaatctgagtagtcatgaataaccactgtttttggaaggcatacccgtaataaaagaagaatattaagcaatggagtggatgtatgagttaaatagcagtgaaaatgtagcaaatatttggccatccattatagagcaactgcaaatacaccaggaagtaaaaacggcattctcttcattgtgtttggtctcctttggtgataaactcttagcatagaggaatataactcttgggaggaaagaagtccagcatgaatgataaatcaatatcatcttcacacagaatgctgagaagattatagagtcccagttattagaagcataaagtcttagaaatggaagcaattctggaaatcatctaatatcaaacactcatttgacagatgaacagatggaagcccagaaagcctaaaaaatgacatatcttagagtagaaggctaacccttttgtttccaatctaggacccttctccgtggattggaagcatgtcaataacaagaagcatgtcccttcttcatacaagacctaatttcccttgagttccattccatgatatccctttcttgaccaccagagccaatgtatgtaggctctgctgccacctattgtacatgaaatgtagtgatgggaaatgccacccctctgggcagttgctctttactcattcaggagaagcagaatacatggtatttgtaatacttgcctggccaataatagttataatagtaatactgataataataacagcagcggatgttgttcaccacttagattgggtcaggcaaaatgctaagcacttcacatacatttcacttaatcttcctgacaaatctgtattcttatggaggaagaatatccttatggatgaagaaactgaggctgaagatttgccttgtaattagagtccaaaaatatgtattttttaataagctcaccaggtattgctggtgcaactggtcgttaaaaaaggacttgaaataacggatttttcaaagccattctttacccattaatggtgggaagggaggagcattttctctccttaatactttatatatgtatccattttctataataagcatgatattattttaataatacaaatgttttttaatttaccctatatatttttaaatcttagaaagtatgaagtttatcttttataaaagaaaattcagaaagcaaaattgcaaacttcaatccagttcacataatgaagctctgctatctacctcatgcagactctatagtttcctgtacagaacatgctgcttcttacttccctgtttctctccatccctctgcctcccaagtagcctcatgagatctttctgtttcctctacctcagtccagctaaatagatacccactcagaattccctgggtcgtctttactattgtgccttattcatttcttggtcccttaactggactgtgaactctctgaggacaaggacaagtttactaatctttgtattttttaaaatacaaagattgtaaaatctttatatttaacagtgcggcactccatcaacagttaagttgaaggaattgaaatcaccatgaagaactcattttctttaacacaaagcacttgatggaaaaaaacaattacactacaaattttaatataatttttaaaaatcacatactatcttggtataagacattcccatggcatcaattttctcctagttatgggaggtataagtttgttagtcccagaaataggactaacgaacacaaggctggaagacatggtgcactatcatcaggtgcagatgcagactttacttctgggaaaggactggatagcagttaacagtagtaaccaatgtagaggctcagcttaggatatccaagtggatggggtgcttagagggaagggaaggcatgagctgccattttggcaatatcaaaccccaaggttatgtctgggtcatctggttatagttctggatgagttatttaattatagccccatgaataaggttaacattttggtcaggattagcttagtcttaatctgttgcacactgcatagctaggaatgctgaggaaacagagctaagactgttacacatacttggccatcagaattgtctggagaaggaaagctctgtgctggtggtgaaggttctctgatgctggatttggtcaaacaggctgaacgactgtatgctagggccactgtgaagtgatttagaggtgggtaagattaaagatggatgaaaattccttcaagaagtgcttaaaaatgatggagacatgtcagaaaacccaggatccaacttgaaaggtctccagatggtcaaatatgagaaaatttagagaaaaagattattgacagtgacacatcatctcctatagaataaaataagaatccaggagttcatgttgatagtgggaagataaagctcttttttagtaattgtattccaattaataaaatgtagacagaatgatggaaataaatgtcaccatttggcaaacatcacagtagtaaaaattatccatggctgctaaaattaatgggtgactatatgatgaaaagtatataacctatatataatgtacaattctgtccccacagtatacttaattatgaaaggaaaaataataactttaaagtgatcactttagctaagtgatcagtattaatggcacctgtaatgagacccagcaacatcacatgcctcctgatacaatcaccgacaaggacataacatcattttccaaaaataaattaactgataaaatttcagacaaaccccaaatgagggatatactacaacataattggccagtactcttcaaggtgtcaagcttatgaaagacaaagaaagactgagcaactatccaaattaaaagatactaaagagacgtgacaaccgaatcccatgtgtgaccctggttcagaagaaggacataaattgggaaattgactaactttgactagatagatggtaaaagtggtctatcaatgttaatttcctgatattgatcattttcatgtagttatatgaggtgttgacatttggggaatctaggtaaaggataaagttaaaaagaaaaaaaaataataaatgtaaggagtctgtccaaccctgaagttccttgactcggtatagaagctgattatgaaatcacctggtaagtcttggaccacaaaaagagctctggttaaaatatgccaccttccaaccccagatcctaatacatgctggtaccaatgtggtggtgagaacagagggactggcagagggaatgagccgtgtatgcttcctccaattatatttcccagtctgaacacctggactactaggagtttcttgtgctcaaatatttggttcacacttgggttatgatattaactgagagagtagttgccctcttcaaccaggtagtggggtacaatgactaaatggagacatttaagggagagggaattctcagaggaccagcctgttgggcactcttcaccctctactgcagatagagaatctcctttaattgccaggctttgaagagtttggtttcaatttgttcaggagtacagggctgatgttttatggctaaacgttttggttgggtttctttgtttggctgattggtttttgtggctgtttgtttgtttaaggtatgcttctctaaaaaagaaacatgccaatgttgaggaatgaggctacactggttgtggctgaagcagcagctgctgatgctgggaatagcctggaagtccactcagaagctgacagctgccacgccagatatccctacccaggatttcatttggcaaaggcagactagttagtggagaaaattgatgccatgagaatgtcttataccaagatagtatgtgattttaaaaaattatattagaatttgtagtgtaattctttttttccatcaagtgctttgtgttaaagaaaatgagttcttcatggtgatttcaattccttcaatttaactgttggtggagcgccgctatgtgctaggcactgttaaatataaaagattttacaatctttgtattttaaaaaatacaaagattagtaaacttgtccttgtcctcagagagttcacagtccagttaagggaccaagaaatgaataaggcacaatagtaaagaccacccagggatttctgagtggatgtctactttagctggactgaggcagaggaaacagaaagatctcatgaggctacttgggaggcagagggatggagagaaacagggaagtaagaagcagcatgttctgtacaggaaactatagagtctgcatgaggtagatagcagagctccattatgtgaactggattgaagtttgcaattttgctttctgaattttcttttacaaaagataaacttcatactttctaagatttaaaaatgtatagggtaaattataaaactttttgtattattaaaataatatcatgtttattatagaaaatggatacatatataaagtattaaggagagaaaatgctcctcccttcccaccattaatgggtaaagaatggctttgaaaatctgtactgtcagctcagcgaggtggctcatgcccgtaatcccagcactttgggaggccaaggcaggtggatcacctgaggtcaggagttcgagaccagcctggccaacagggtgaaacctagactctactgacaatacaaaatttagccagacgtggtggcaggcacctgtactgacagctactcgggaggctgaggcaggagaatcacttgaacctgggaggcagaggttgcagtgagccgagatcacgccactgcactccagcctgggtgacagagcaagactcaaagaaaatctgtactgtcttctctagagtttgtcagagagacttcagttcttttttagcattgaatcttcagatagaaaccaatatgatcattcttagagaagttaattataaacattggcaatagctgttttaaataacttttgagtttattccacaaatatatatttagtatgaacctatgtgcaagctactatactagacactctttgagttcttttcacaaagggatcaaacacccaattttaagtgcctgactataatttctgtttgatcaaggggatatctcagcaaaccagatatggtcttggaaagaatagtgaagaggtgaatagtttatcagaaattagtgacaatgcacaatgtgactatctatgccaaattattctagaataagagtgtcaccaagacattgcttatgaattatgctgaaaagtcaaataactggctgacagctgtaaatgtgccttgaagatattgtcagttttagtgaacttaaaagctaagctgtatgacttggggagttgataactggagacttagttatttattcaaaacaaactcacagaatatatttttgtttatttactcaatcaacaaatttttatttgttgttgtgtaacaggcatggcgataggtctggagatggccctcatccttttagattgtacatcctggtggagtctcaagtcccagtaagaaagagagaaaattgaagacattatttactctatggctctttgagatctgtgaggtcagggcagttggtggtcagcctgtattttggtagatgtggagtgcttacaagccaacatcatcataaacacgagtagggtacctgtatgttagcattgccagaggacaagaattgaaggtaactttcagagcagtttaccctttttctttccccatctccaaattaatcttatcagattataaatttggtgagggagaatatcacatctgtcttcccaagctcctttcatcattgtttgctttcagagacagcatgataagaacaaaccttgcaaaagtaaacatgtctaaatgaatgctgttcattatctgattttttgtttgtcttttaacagttgacaggatcttcctgcctatttctgagatgttagcacacactatgaactaagagtttatacagaattcattaaaggagtcagataatcccagggttttgatgacagtacaaaagctatgcatatcaagcccttgaggtgttttgcatgcggtagcaaattttataaataaagataagaggtgtggccaaaagattaagactgttattgaatatttaccagtggaaagtctccattttgttgtttcctttctatgtcagcctatagacatgcatttgaggccccagagctgatccaatcagcccaagaatgttgcctcttaatttacttctgcaaatgcagcaccacatgaccttcagggaaagattccttgaatgcacatgtcagtgcaaatgtcaatgaattgtactacttattaaagaaaaaatatttttgaacctctcttttggggagttcctaagaaatcttatgtgtaacagagttcgttttttaagacatttggaatgtgaattttctgatgagtaaatagctaaaaattttatttagcagtagagttggccttcaaatacacacactcatgcacgtactcatacacatatctatgtatgtgtatttagcagttaaagcatgtgtctattttataaaggttattctactagattcttcagaggaatctagactatggaaacttgatactgataggacaagacaaggtatgaattcaattttttaatgatttagctatatatctaatggtcattaatcataaattttggattaaggttcccgagagagatgtctatcaaaagtatttagcaaatcaccctcatatgacagaaagatgaacaattgtcagacttaataaaaggaacattaactagtgagtatttaagtagcttgaaagtaatcacaaattttctggaaatgtaataatgagtaatgctttcaaagacatttccttgaaatataaagaacgtagatggggtcattttgaaatttactggattatggctttgacttaatgataccatataaagtagagcagcaaatattttagcattttttagttttattcttagtagcaataaatttcttccacattttacaggtacactttctccattgttctcggttcttctttggatagcagttgcgatctgcacatctatgctgtttttcttctccaagcctgtgggtattcggccgtttcttgtatcaataatgctcagatcaatatatacaataggtcttgggcctacattaatacttcttggtgcagctaatgtaagtactttacttagctttgtactgttacagaattagtttaaaagtgtatgaaatataaaaatataactataagcttttaattcatgtatgcatggtgaattctaatttattataaatctaaattaaccagagcataatttgtacttttttaatttaattttgagtgaaagaaaaaatgataggtaaaagattgctatatttaagaagtaacatttggggaatgacccagttctgccatcaatttaatccaatccaattttaatgcattctgcatcctatacccacagctattgacaaaaatgactgagccattgttaatattccaaagtgacatcgtaaatcatccaaaaaagattaaattatgttcaatagaattttgaaagtgggcacctttcatcaaatgacctaagaaaaaggatttctatatgagaaaatattaaattgggttctttttatgtgaacaaattttataaactgatgaaagtcatagataggattaattttttgaccgaattttgaaatattagaataaggaagcacagagtagtagtatttcaaaaagcaagtgatacatttatagaaataattttacccgagaaatacaattttaaagggactagccaacgttatgcatggcacagccatacagagatattaaaaggtaaaaccatcaggctaatgaaataacaaatggccaggtaagaaaataagtattgctgatctatgtgttgaatacctagacactttcgatcttttcctgggtttctaacataatgtcctacattctggtatctgtaattaggactagtctcccctactacattttactatgcttaaggattgatcattcagtatcaagaacattataggtactcagtaaatatttcctaaataaataaattaataagtgagtgaatgaatgagtgaacaattatctttgtattcttatatatttacaggggcttgcacataaaatatatagcaaatatttatttagtaataaatatttaatatttagcaaatatgtaataataactaatatttaacaaatatttacttaataaataaaatgtatttattttatttatttattaaaatgaattaataaaatagtcaaccaaactttcaagaattataaagctgagctaatatggccaattctgtatttctgtgtttctgacctctattttattacaattcttcgaaaattagacatgatgtatttgacagctcccaattagctagaacattcaggcaaccaaattaccaattatcctcaatcattgtcaataaagggaagtgtactatacctacaaagaagtctatcagtaaagaattttgtaaaataccaaatatattattctgtaagtttcttgagggcagaagttgtcacatttataaatttagccctacctgcctcactccttcccagctccatgtttctctactttaacagctggcattgaaacattcagaaaatgtttacatgaactgaatgtgtactttcaatgccttggaaataagctgattttacagtattaccaaccaagcaaattagaaaatcttcatgaatttgtctaaatttttctaagcctatgtgtttgactttttttctttaaaaacataaattgcatattgaactatattatttgaagaagcaaataatatttataaactggtaactggccctcaagaagacatgaatccaagtgaaaaaaaaatccaagtctgacaaagtgaaataatagctagagatgggccaaaaataataatcatttactgggcctctgttatataatagacactaaaaataccaagacgataaaggaaatggttcttgccatccagaagctgatgtgtcacactcaccgatttgcatttcctttgtttttggaccaagaatatataaagagataaggaataacattctaatgtctactgggggaaaccaaagacatttggagcattttttcccctcatgggagaggataagaagatagcttttgcctggtttggtgaaaataattccactatagcaaatgactcttcatagaagaggcaagttttatatttcactttctttatgagaaagaatatacatgtagatatgcaacatctctcctttattaactgtagaaatctgtggggactgtaattgctttcacagcatagaacatctgtttgtacagtcaaatgatacattgtggtctaccagctcagagcgttttttttttttttcttttttagacagggtctcactctgtcgcccactggagtgcagtggcgtgatctcggctcactgcaacctccacctcccaggttcaagcggttttcctgcctcaggtcctgagtagctggggctatgggcgcgtgccaccatgcctggctaattttttgtatttttagtggagatgaggtttcaccatgttggccaggatggtctcgatctcctggcctcatgatccgcccatcttggcctcccaaagtgctgggattacaggcgtcagcctgtgcccggccggaataccatagaatatgatttttaaaaaatgtttacctgcacagttcgatatgcttatgcatgcataaaaatttctagaagaaaaaacctgggccctgacaatattcagtcaagttctctagattaatcacctgttaacagtggttttctctggggagtaaacctagtaaaagggtaagcagggaaggaaacatgttttatattttaatttagtatttatttctattaatttattatttaacgtgtttatttgaatttatatctaccatttattcttcttaagacaactttaaaagtagtattttctatactgatcccacactcctaccagtaaactgttcaatcagatactatctaatgtattatacaccctatannnnnnnnnnnnnnnnnnnnctggggctatgggcgcgtgccaccatgcctggctaattttttgtatttttagtggagatgaggtttcaccatgttagccagggatggtcttgatctcctgacctcatgatccacccgccttggcctcccaaagtgctgggattacatgcgtgagccactgcgcctggccgctcagagcattttgaccaaaaaaaaatcaactttaatttgggacaaacacattcagtggaataattgtcattttgatattgtagatattgacaaaaaattttatctataattttaataatatgtggattaataaacatgttttaggttggatgctatgtcatgcctgtaatcccaatactttgggaggctgaggcaggatgattgcttgaggacaggagtttgaggccagtctggtcaacatagtgagacctcatctctacaaaaaataaaaaaaaatattttagcgaatatcatctaccttcatttttaacataacaagttcactgctgggtgcagtgactgatgcctgtaatcccagcactttgagaggctgaggtgggcggatcacactagatcaggagtttgtgaccagcctggtcaacatggtgaaaaccctgtctctactaaaaatataaaaattagtatggcatgatggtgcgtacctgtagtcccagctactccagaggctgaggccagagaatcgcttgaacccaggaggtagaggttgcactgagctgacatcaggccactgcactactgcctgggtgacaaaatgggattctgtttcaaaaacaaaacaaaacaaaaattagctggtcatggtggctcgtgcctgtaatcccagctactcaggaggctgaggcaggagaatcgcttcaacccaggaggtggaggttgcagtgagccgagatcgtgccactgcactccagcctgggtgacagagcgagactccatctcaaaaaaaaaaaaaaaaaaaaaacacaaaatgaaaacaaaaaccaaaaaacaagttcactacaaagctatctatggtttatcattacccaggaggtaggaaataaatacatgaaaatatcaattagtcatatcttgtaccttaagttttagtacatttattaacttaatttacacttaaaagtttgcattgtgtaagaggtgaaactataagtgctaaaactataggtatcagaaataagaaaaacaaaagaagacatctacctgacaattttgccttaatgaccatcagagttctacactttaggcaaatcaacaagactttgaatttcattcttctcattagtgaaaggaagatactaaagcctgatctgtcttcgctaggatagttgaaaagatttagaaaagattaataatggtgataatgataggatagtaacaatggcagctgtttaccaactatctgtaataatacatgaagcaccctttaattgtaaaacattctttttatggttgtaaaaatatttgtgttttggttcttggggagttgtttctggactctgtttttcacaatgttaagccactgcagaaagtcttatttttggaaaaggaatcaagtgggaggaacagcctcaacctgtgttataacaacttagtactggtttctgtttactatggtgcttcttttttattgtctttattcatttctaaaactaggagttggtctagatttcaactagtttgccttgtcacagaagtgatcgcaatatttgagatatttcaaaaaattcaagtgtttttttctcattataaagcacatcttataacccagtctagttttcttccctctgcaatgcactgttagtttgcattggtaatagaaattaatatattattctgacaaatataagcacatattttataaatttggggtcacttaatattctttcataccattaaaattatttgtaaacctcattttaataactgtattatttccagtcatatgggcgttataaccactccattaacttttgttgttcagatttttaaataaataacaatgtagtaaaatattacaaaaagatcttttaaacttcttacctacaatgatttttcctttctaatagtacctggaaatgtgtaattcatttaataagttggtctcaccatttgcagagagaaggagcaaatggagtttagcagatagctagtctactaacaatgagccactgtgttcaaatttaatagggtaatgtccctagttacttacttgtagatagctttctgggaggtcttatgttactgctaattcgtaaggtcgagttccaccatatgttcatttaacatacacaaattcagtgatatatttggagtaaacaactttcattttctctctctctctctccacacacacagacctaccctttttcatataatgtggtcactgaatgctcctaactacttctagttgcagaaacagaaaactgctccaacgctggggttaaagtatgatgagatgaatttagtaagagacactaccatttacatgacctgtgcttactgttctgttttgtcagcaatttaagagatttccagggtgattttgactgcatgcaaattttgccttacacattgatcttagaaccttgtcctgctgtagatgtaatgcccctgaaatggagatttttgaatcaaaccatctcatgtttagtaagaagtttaacttacatggttgatgaaaatatggtaatggagttgaaaatcacaaattccattttacttttcaataaataagtagacagtctttttttctttatacaatttattcctgtaaaataggtcatgttttcccataggaacaatgtaagatggggatagaattcttgatcaggaacagagtaccaaataagatgaaatgaataatgtaaagacaaagataaagcagctataaatgtctgtgatcaaataaaattgtaacatttaaaggtatcacacagaattctacagctatgagggagcttaaggattgttcacttctaggcatttcattttatatgtgagaaaacaaagtcctgtagacaccaggagggtttaccaaagcaagaaattagtagcatagccaagattgaaaccagatgacccgccttctaattcagtgtctttctgctacactgtactgttaaatgtcctgcaaagacagatcaataactataaagtatatatgaaaacactactttcttaaataacttatttaactaataaattatctaattaaatagttaaattattcaataaagtattattattattcaataataattattcaataattcaataataattattggttaaataattaagtagtattttcatatatacttcatagtttaactaattagttaaattatttactagttatttactaaattattaactaataaattaaatatattaattaatcatttagtaaataattagtaaataatttagttatttagtaattagtaataatttcataaataattagcaaatagataatttaattaaataaacttaagtaaatgtaatgaactttagtatacactaattaacaaacaaacattaattttgcttttttttttagaagacctattggtaaatcatttggatggtgtattatcattttttaaagactgtcccaaagcttgcactgatgctgtttcaattccatccctttccccactgtcacacagttcacctcatccccaacaaaaactgtatcagggatggctttgaataatagacagagtaagaaaaaaatatataggacagttatggtccttgaaattgaaatttgtgtgttgacttgaggaaccccttagcaccagctcagaagagccttgtgaccatcttgcccagtttcctgggcacaccatccactttttgtcacccacatggacccttgctataatggcactgacaaatgaaggactggttagacgatgtcaacttttttatgacatgaaaagggagactgttttagcaacttgctcattcttggcataaatattccaaactttcatggaaaatgctatatgaaaacaatttgtaagtttcatgaagaaaggagaattcacagctcaacttctttcccacccgaatcatttattcttgcacatatttccccttcatatgaacactttaaaacaaaagcacaccaagttccctgttttttatctcaacagaaataggtagacgccactgtcagttatcaactccactccacgtcaagacttagtgaagagaacaggaatctattcatcaagctctagatcaaggttcaaaaatgaaacaaaaaccaaaacctgaaaacaaagaaggcaaatctttatttttcaagtgaaaatggcggagtctcttttaggaagaaatgtggccttgtttttgcattatttgagaaattaaatgtattattctttttgagaatttaaattcagtgtattttttttcctcagtatatggagcttataaatagtttttctgcgtaatttttatgatttcatttggagaattagaaatcatataaacaatgtgtcttaaacatatcattcgtctttctgaaaactcacgactccaattatttattttatttttatacaacttatttctaattcatattgatgaactctggtggatgaatcaaggtaaatagtacacatttaaataatggcattcaaaacaatttaaataattactgaatatgacttctggacactctctttttcaccatttttaggggtgtttattgttaaatatgtcatatagattagtattcttatatatttcctgggtttttaaataataatttcttacaatattaaacctgctcttgggcagaaaatataaatacattcattatgctacagctatacttaataatagcataagatattgatgatgaaacactaaacagtgaaataagacatgaatgaagtgataacattgattattgagaggatacttaatcagcaggggagaaatttaggaaaggtttggcctttttagttgctatgttgttaatttggttggctcttcaaaacatgtaatagtaacccatttctcacttcatctgtattgatttgaacttcagaaattgaaaggaaaaggttttccaatccctccaattttacatctacttcaaagtgttatggtccttcttatgttatttaaaaatcattcaataatttgttaatatatattgaacaaatcaacaatgttgcaaagagcaacctgtttttacaaagttaagattggacatttaaggacaaatatggttccagtagataacctaaagaactcggaacaattaggaagagcaaactgtaaacccttgaaatctgtaattctttccttgatgactaagacacaaaattggctctttggtttgtaattactgcagtgattctagaactaaatagatggtgctaagtttataaatcagtgcacacacatcgttattattgccaaaggatctcagtataaatttctacattccaaaattatgccacaaaaggcagtatgaaatgtgggttgaatataaatactgtacatagtcagaagcataataaacactccaaaatgtttactgaattattatcacacatagggcttagaaaatacatacatacattatatttattttaactcaggtatataagtacatttatattttctatgtatataaaataaattaaatgcaaaaataattttaatcacttacttgtttaaaatagtactcagtagacaaagtccatgataaaaacacaaaatcaagaacagatctctggacatttcctgaaaagatattttctgttatatttacagcataataaaaacattttacatatttactataaaaaatataataaaagtaatatttttaggagtcattgtattaaggacttcatatgtattatatcatttaatcctctgaggggttctatgagatggaaattcttttattccggtttttcagaataaaccatcaaggccctcagctgcatgaactaggtcacacaacagtaatggaagagccaagatttaaatccagacctgtcttgattgcatagtctcttaccattctctctcttcctggaactgcaaaggatgcaagttttgcatgtattatgtttacgtgccagtttgtaagcaatgctgaagacctacaaaatgagaaattatgaaaaaagtcatgaactttatgaataatagttttcatccatgtcaaaaagtcatagattttaatgaataattgtttcatccatgtcaaaaagtcatggactatgaatagtagttttcatccatgtgggtttcaggataaataagacagtaatctgtaaccctttcctccctttagctttgtaataaaattgtttttctggtgagttttgttggaaatcgtggcacgttcacccgtgggtaccgagcagtcatcctggatatggcctttctctatcacgtggcgtatgtcctggtttgcatgctgggcctttttgtccatgaattcttctatagcttcctggtgagtacatctctatgtggacaatcactgctgaaaaagtacacaatgctgctgcttcttatgcctcttcctttgatttttttttttaagcaaagcctgacatttaggacaaattatgttatttttagaatttcctaggaaaagcgtgaattattatcatttgtaatcttttttctttgggaaaccacacaggtggtggagttctttatttcctctttgagaagcaaccagtcaccccacctcttgacccaggcttcacatgacaagggctgcttttgctttcagccaactaatatttccctttacatttaaagattctctacagtgtgggagacaaaataggggtatattttcttaggtactgaaatcattgtattttatttataatatcaaaaattatgtgtacctttagaatagcatataagtaaaatgagggggatttaaaaaaaccatcatagcaaagagacagttgttttaagaacagtcttatagtttttggtttaatatgtccttgctgttaaacttatctacatatatttaactcattaagtggctctttcaaatttttttctaaaggttactttttaaaaaaattctgatttaccttcctatatatgtactggtttatagccataaaccaggagaggagtcaatataaatatgtgataatgttttgaagcttaaaaagcactaccaggttaccatcatgatgccataggaacaatttatttatctttccagttcatagttggcatgcagtggagagcattgtccaataagatgatccctgaaaacaagttaaacatctaaaaacattttgttgaggaatttgcctgagtcatgagggacaaatccagcacctcctgcctccctattatctagcacaccgatttgagaagactgaaatgaggccaattttccatataccctcaaacatttgaaagagccacagtgaagagtagatttgtctattatgttttcatataaacttataggcagttaagttagattattcagcaacagatattttttccgttctaacaatctaaatgaattctttttgccctgattcaccagaaaaagttcattttttaaccagtcagtgatacataaagtcctattatacccagcacttttacctgactgacatgtaatattctataatttttaaaccactttactgaagtatagctgacatacagaaagctatacccatttaatgtatgcaatttgatgagtttataatacttttgtgctcaactttcttgtttataaaatggataggaatatcaagatccattaaacagatgtgttagtccgttctcacactgctatgaatatactacctgagactgagtaatttataaacaaaagaggtttaattgattcacagttccacatggctggggaggcctaaggaaacttacaatcatggtggaaggtgaaggggaaacaaggcatgtcttacatggtggcagaagagagagaggagagcacgggggaaactgccacttttaaaaccatcagatctccagagaactccctcaccgtctcaagaacagcatgagggaaaccacccccatgatccaatcacctcccaccaggtccttcccttgacacatggcgattacaattcgagatgaaatttgggtggagacacagagccaaaccatatcagataatatgaaaaacatgtgaaatgatgtacacatgtttatgtttttattaaccccattttctaattgtattttcctctggtcttttatctttcaaatcttacaatattgatggtagtttgtttttagtgggttggttctgaaaaggatatagtccattttgatgtttagaggactagaagaaaattgtggtatacataatatcaaaaatcgtatgtaagtatatttttaaaagattttttatatttgaaaaaatatttgaatattccctgttgtacccacaattgtcagtcttttatccagaataataaaaaccacactctagattttgttttcagaaataaatggaaagaacaatcagcttgcccaatgtcaacagcttttgtaagattctgattccatgggcctagaatggaacccaggcatatgcatttttagcaagcatcccaggagctcctgaaagctgtaaacgttctctagagctgacctacagcacattgccagatttttttttctttaaacctcagccgagttgacttaaagaaaaatctcgactatgtcaacttactgcttaaataaatttaataagccacagtgttgacaatttggaagttgaatgtgcattagttaatttgtctgtactgaagaatattgacttcatttctaaagctggctgctccttccaggaggtaaatagattgcaaaatagacttttaaaaaatttaaccatcgtaaaatagcagtttccataggtgagcaaacaagttaatatctagacagcaattatttgcaagactacaattaaattggacagtaactgtataaccctcagtactcagaaaaaaaatagacaaggtcctgaaagggtatatgacacataattgatcatttcagccagttcagaaactctaattactgcccacagatagaagacaaacctcaattattccaattttaaaaatactattcatttccaaacagatatttatacctttctaaaagtgaatgtgattttattgcatttaaccagattttaataataaaacacatactttctaatgtataatttcaactttataatgtagcaataaataaaattgtccttagtgtctacacagattgcaaacacatagcttgactagtgcatagattttctactactgaagacaaaataggtagtaacctattagagaaaatcaattagcaatgtacatattatatttttgtttatacttccatttccaaaagtatatactaaagtaataggtttttttcctcattataccctgttactaaggaaggatgtttgcatttcccaaatagttttaaatttcatacttttccggctgcatcagactcatgaaactgttcttacaatttcacctctaatcccttgattaagtaatacatttaatgaatttgtcaattgttcatcactcaggaggacctaattcagcattctcacttaagccattttacatattccagaagtaactgcagaatatcagtaagaccaaaaataaagaataagtgaataagtagctaagctggtaaagtacaatgtaacttttctgaattcaaatgtaaaactaagctatttctgtaatgttttagtaaattgatattatgttggttttgaaaccaacagatgcacattatatgttgtgctagatgtatctttatagaaaaacaatttattaatatattccagctggagaagaaataaatactttggttcattttaaggtggtttaagttatttctttatatataaactagaatggcttgcatttgtatttgtaattatatttttgtttgttcaccttttcctccaatgcctattagtgttttctttatctttgtagctttttgatttggtgtacagggaagagactttgctgaatgtcataaaaagtgtcacacgaaatggccgctctattattctaactgcagtcctggctctcatcctcgtctacctgttttccattattgggttcctttttttgaaggatgacttcactatggaagttgataggctgaaaaaccgaactcctgttacaggtattgctattaccactaaatgaggtttctctgatggcagatatgacttgtgtgtagcttgttaacaggatcatagataaacacgaatagaggaaatgttttcttttattcctttgagaatatgttttgtttactactaagagtcaggaatgtgaagtactcttaggctgtatattagctgtcaatgtgtatagggaaatacttacatgagaaacaccatcccagctcagtctcggtaagaaagtttcaataaagctgactatattccaaaagatagtcaacaacttcagtgcaggataataactttaaaaatcttttcctcctctttttccctgtctccccaaaaataacagctagcatcattcacaatcattattccatacatgtttgatcatagtgtatcatattatacttaaataactgaaaatgataaatgctttgatttgaaaccaccagatcataagaaatttgctcaaaatattgagcaaaagaaggaagacatgctcaaaatattgggattaatggaccaaatctatcagtgtgtgactttcagaatttctatactctatttttgtcgtgactggttaggcaccgtccatttataatcagtgtgattcctgtggtgttaggctttattctctccatgttattttgatttttttatttattaagctttctaaagtgtttttctccctttcctaccttgtgttgttttggttaagcttctgaagtttattattctttttcctcctcccctgctttgctgggtagaaatcatagttctgcactttgctaatggtttctctgggtgattctgccgactatgggttgtagagaatggaaaccaaaatatgacactctttctcctcaaaccgttaaatgtaaaactaggatttaattagtgatgccttgcaaatggtattctgtcttgcctttaacaaacatttcttaattactaaattgacgatatatggtagtacttagattatggcacttaagtctattagtaagtctcagtcatcaaagcacagaatggaaacatcatatatgtggactggaagttattaaacttgagactgtcctgaattttatacctaggtattagtctttattcacaggaacatagagtattttctgttactgtctttcttgttcttcttccttaaatgttacttttcccagagttttacaggtataaatatggggacttgtgtttgtgtgtgtgtgtgtgtgtgtgtgtgtgtgtgtgtgtgtgtacatatatacatgtagactatctgcttcccaaaacctccacattaattacttactagatttgaggcatgatgacactgagtaactcagtacagattgagtctaaagctgaatcgtaatttatgaattcaaaatgtgtgcagtagttattgtcttacaaatcaagtggtaaatattttgtgctatttaaaaagtaacttggttatcattgtgttatgaacataaatattttctttggaaaaatgccttttttctttttttgttttttacaaaatgggcagcagtagaccagaagtttcaagctctttacttaaaaatatttatacacattcatatagaatgctgttcaataaagcttttataaatactatgaaaacccagcatatggggacagttaacaaagttaaacccttgattattcatatattaagagtgtttgtttcatagactgagattatacatgacatgatgccctaggaaaaacacccttgttttcataatatttcaaatttcatttctaatgccgcatattgtctctattgatacatagtgctaagtttattctttcatgtattggacactatttacttgcaaagttgactatgtatattgagtgacattattgaggacacccctgggtagccagtgaaatttggagtgcagagaaatatgcaactctgtagcgaatgagaagaaaagatcagaaaatcagttggtgggagcaatgaggggaggttgagttctaaagctgaatggtaaagccatcacagggccctgtgagaatagaggacgggtaattggcaaatgccattgcaaacgcagatcctgcctgcaggaccagaggaatctgggttgatagatgaagtagctgccacttgagcaatgttcagaaaattggtgtcttagaaaagtctgtgaacttagagagaaggatctgttgagaagtggaggtgacagtttctctcacccacacctgtccctcttccccattttcagcgccatcctcctgtttctcacccttctgtttctcaccttcatttccactcacccagaattctgctggagccacctatgtggcttccccacctatagcctctcttctgcctgcccaaattactcattccaaccatagctctcactgtctctcattggttcacagcctttagatctgcactggatgtggggttcttggtttaaagtagtggctggtagctctggtcactctggctggtccatgccttcattgacctctgcgccttttgtcagacaaattgtacctggaatcaccccctttgctccctgccttaccttgatgaatctaagtcctatgactcctttagatggacccttttccaaaaagctttctgggtttttttccccctcctagaattcacttcttcctcctctaatgtattacattaaaaaagaaatctgtacttcactctctccagtcaattataattgtgtctatatctctctatgtcctctagctaactgttgttcttccaggcctcagctctgggcctggggggcctagcaggatgcttcagtaagtattaagtaagggaatggccacagggcacactcttctctcactttctgaccccccacacccacacaccctcaactcaggattaatggggatgtgcccaccctcaggggatggaggtaaatctgtgtctggggaggacactagctctctcagctccagtgtttgtgtggctggcaaccccagcctcactctgcctcctcctcctcatgtttccttcaaactccagctttcctttgccatttctaccccatctcagctgattagtcacagtcagggtaatcatggtgtggcattgctgggaaatgcacttcaatactgctacagcctttgtagctacaactggacctacccttgtctctccatcatgaagacttccctcgatggctctatgggaaaaataggtttgagaggaacctctttacttcatgtgtgttactaacaaaaacaacatttaaaaaaataaaacgttgtttcatacaaataggagggtgactattttctattctattctgtgtcagggaaataggtggtgagccaggaagcagatggattcctggggactatggaagaatagaagatcctgaacacagatctggcagaagatttttgctccccaaggcatatgatgcccttagttccctagagcctgtacctgactgttagaaccactaccagcagcagtccctgcctcagttgtagggacgagtggcttagggctcagggactgccaactgcactgaggggaatatgttcctggcatcccaagtcagaaccctgaatgagtttgcccatggaaacattattacacatggatgtaaaggtctacagtattaatactttatctcaaccacttaaaaaaggtataaaaggcttttagtgggttggcctatgaagctattctccatttataaaattgcttcaataggcaaaactgtgttcagaattccatactaacttcctaggactttaggaacacagctaagttggagtatgaatgcctttaatttacatatctttagaactgtaggttcagttttcatcatgtgcatatttgactctatattatatactactttgtattttcttaggcagtcatcaagtgcctactatgactttaactaccatgatggaagcatgtgccaaggagaactgttcacccacaattccagcttcaaatacaggtttgtagaaaggactctgggtcagtatgaacttgatatctttgaagttttatttagtaaatattattacctcttagggaattgctctacaaatttcatgatggattgaaatagaagaatagagagtaaaagaaccaagatgatttgaacaggagaaaggattcccacattggtcattttgtacccctctcctgttcgttatattgtttctattcaggaggatttagcacatttaccctgtggtatgtgctgctgaagattctattaccatattgcaaaccacactaagtgagtcccttttagctgtgtagcctttcacacaggatcgggaagagtatgggcttataattcaaaagacttggtaataatcctggacttgacagtctctagctctatgtcttggacaagttatgcaaatttcctggactttgttcagatgacttgcctgcctatctctctctctctagagagagaatgagaatgaaactttccctgcctccacaggatcaaatggaaccatacatataaaaataataattctttaaactctgaattgatctcataggatgtggcaggctggaaactatggcatgtgtcatatataaggaactgtagaagaaattagtgacctgtttcctgaagcagcaaagatttagggagtgtatgtcttcaaatatcttaagggttgtcatatacaaaaaggagcagatttagtaggagttgatgtgttgtatctacagagggcaaagttagacttaggacagataagggaagaaagagttaagcatagtgtaggtgcggagttccccagtttccatctgggaccacactgtttgtctggtcataatgatagcgctttctttcctaaacggccttttccttgagatgttggactattgcttgaggaataatgaatagacccttctactgactaaatattttatgcttcttgacctaaagagagaattaagcacatgaatacattccatccagtgtcccagcagccataggcactgtgggcagccgtcaccagcacttctctcccctgccgcctgctctcccagtcaaggctcacaataagaaccagctcattcttgactcgtatagcattattgtgctctgcagtttctaaaatcctgctatttgcatcctccaatctaaacacctccgatttcttcagctttcctcacatactataacagtgagtactgccatgacactccagggcaagcagttgaaaagtgctgtcttgttctggatactggagtttagaaccacatcacactcttgatccatatttggctgactcttggctaaaatgccattcttcactggttcagctgtcatgtcataaacagccaccctgttctcatataattaggagtttgggatttcaaatagaagcccatgcattttttttctacatatttctgccagcccataatcccaggtcgtcgcaatttgaccagtgaatagacaggaggtctttgcccggaagatctctcggtttcaggtcccttccagttctaatgtgccatgagcctcatggtgtccgtatggatcctgattctgtcaagcaatatatttattctccttcatgtcctcaagtttgatacacccttgaacagagggtggcaaactatgtcccatgggaaaatatgacttgctctagttttatacagccgttgagctaagaatgattgtaaattttttttttcaagaaaaacatgtgatggaaactgtatgtaagcctaagatagttggcatctggctacagaaattttttttttgccaacctctgttctagaagatttccattaagggtgccagaaatgcataggacagcaatgcagtgctaagcactagaacatgctctcacatggacatggttgcattttgtgcaattcttcagttgcatagaaatctctcttaaagaaactgttaacatcattccgcccatgttcctctatcttttttcaaaggatatcatgagactttttatcaaagactttttgccaaagcccagatacatgatgtctgctacttttctaatttgaggttagtctgaacgtgtactgaatgcactgatagtgtgggttagtcctaactcacactgtctctttagtgatccactttagtatcttgtcttggtgtcaaacagcatttttcagcagcttgcagagtctgtcacagtctcaaattcaggtctacaggtgtccctcattttccatcattatccatgactttttaaaaaatcactttttaaaaagagacattttgaaaacttgaacatagttgaaatagctgggtaaaattaaatgactcctgggatctctttggccacctcaaagttcagattattgtcatcagtatttatttctcttttaattcaacatttccccccttaacagagtatgaaaaataatatgttaaaaagtttattattaacacaaatattttattgtaacaacatggttccaagtatcagtggccctatgcttgcattggtcttctatctctgaatatttctttaatattgtttcctttattttaaagcaaatatactttaactgtggtttgatttcaagacaaaatattgctttgctagtgaaccagcaacaaagctagtacttgttgttccagagtatacaaagagggctgactcagtgggcccagaagaggatctgagtctcacccacagcgtggtagccagggctcccaaggcacagagagagagaactgccagggccactctcctagaatgaggtcttccaggtcattcatagtgtgagactctcccaggatggttggctgcccagctctgtgtaatcctgtaaatgttaggctttatacaactccccaggcatgattgttgatgctcaaccaaatggtctattgtaattatttcatacgttattactattgtgacattttgatcttaaaatttaaaaagtaaatatttttagaaaacgggagagtagttaagtctattcagtacaaaccttgatgatgaggatgataatataataaaagccttgtgtattcattccttcattcattttttcacatagttatatttgttgagcctctactctgggccagtcaccatgctagctgttgaggacacagtgttgaataaacaaacatgattctggcctttatagaacttacagtaagggaaacataaaaagttataagataaggtgagtattactaacagtggtatgactgatcatcacaatagagattggctgttgggagattagacagagagacctttctaagaggaattacttaagttgagacttggaggatgagaaggagctagtcaggccgagaggagggagaagtgtgttctggccacatggaacatctgagagtgaacgccctgagacatgttcaaggacctggagaaggcttactcatttcaggtactgtgctgagcgcattgtgtgcattatgtcacttaattatcacaacaaccctgtgagatagatagatactactagttatccttacattttcggtagggaccctaaggaaagaggcattaaataagttgccaagatcacagctagtcagtcaatgtatatcaacatagatttcaaagcttatattccaaccttctgtcttattgcctcctaattaaaagatcactataaattatttcttccctaaccaaaatttgagatcatttcatttcactgagtatgtttggatagatttttttaagcctttctttatacctactaaagacaatttcttgaatataaatattctctgttacgtatttatgaactggagttgattttgtccccacccctaccccaaccccccagggacatctgacaatgtctagagacatgtctgttgtcacaactgggatggggtgctactagcatctagtgggtagaggacagggatgctactaagcatcccacattgcacaggacagtccacaacaaagaatcatctagcccaaaatattaataatgttaagcttgataaactgttctgtttggatgttattcatgaccctgaatacaaactcttataaaaggcttcccaggaaaacctctataacctgcacttcacctaatatattacacaaagaacatcatttctccttcctatgaacaaatggtgatttgttcctcccaggcacattgggggaaagtctccatcttttaggctgcagcagagctaggagttgggggaagaggtggagatgattttgtaaggatagctgccagagtagggaggaaagcgaggattccatctggagagtggaggagtttcatctctggagatgtgtcacagatactgctggaagccagagatggtggcaatagcttttcacaattagggagtattcctacattagtaataaaaatacaggaatgcctgtattaatctactgtttcttccatacactttttgtatttgacattgtaagtgataaaattcatctgtttgaaaatgttatggatttgatctgctagcgtttggcacttttaaattttgactgcatgtagttaactgcaaaagtagagtgaaagctagaacctggggtttgttgtgcagcatgtgtcacttaaatttaaaaataacttctatgtctaagaccaggattaaattttaacttgcaaaccctagtgtgcatccatgacagccttagtttgttaccttgtggacagcaggtccatgttacaaaaggtacagacatacacagtagcttaataacaagcctcacggtgactaggaggcagagtggccagctccctcagagggctcctgtggatgcagggaaggtcattgtcccagcgccagaaaattcacgcagtaactggcaaccaactgtgtttaaaaaaaaaaaaaaaaaaaaaaaaaccttcatatttcatttgctgcagacctccctggttcctgaacaaaaatattcaccttaaaaaaagcaaggcctttttgcaacaatttacaaaatacaattacaattattttataagtaaaaatcattcgaatgtacagaaaaaaggacaaagttcacagacacttaacatttatgaataattcaaatttaatatgtttggatattttactttaatagaaaagattgatgaataccagaaaccagtcagccttaatgcattctacattttggcttcccactgggtccccagtgttttaaattttttttctcgttaaaatttttatttcttattatttatttatttttccagcagtactgacattttggatatagttgaaatttttaaaatcagcatttccaccaatgaattgattataattaaagcttaagactgacaggcaagaggtttttttgttttgttttttcttttttgtgatggagtcttgctctgtcatccaggctggagtgcaatggcgcaatctcagctcattgcaacctgcacttcccaggttcaagtgattctcctgccttagcctcctgagtatctgggattacaggcatgcaccaccacgcctggctagtttttgtatttttagtagagaaggtgtttcaccatgttggccaggctggtcttgagctcctgacctcaggtgttccacccacaagaggtgttcatttgcactcatactttcaaacgtgtctcagtgacaatcccttgttttctaagaaaccataacaaacactgaatttaattattaaagcagaaaaatggcattattaaataccgttattcaagcatggccaatattttttaaaatttatagattaacacctcagattagagggaactatttcagagccactaaaatatgtttgtattccttccctcatataaaacattttatttgcattataaattaagaaaaaatactgtattttactagtcaactgagaatgaggattatttaacctcatagaattcaagattagaatttgtttattgttttaaaaccaaaacttttcatgagatttaaccactatctctcagtaatgataattatgatagctagaatgtattgagtcctaactatacgccaagcactgttctaagttcttcataggtatatatttagttcttttaaatgtctccacattaaaagtctattttcactaattctttacttttgtttataagcaacatgttctctccctcctcctcctccttctttcttcttcttcttctttttttttttttgagacagagttttgctcttgttgcccaggctagagtgcaatggcacggtcttggctcactgcaacctctgcctcctgggttcaagtgattctcctgcctcagcctcctgagtagctgggattacaggcttgtgccaccatgctcagctaatttttgaatttttagtagagacagtgtttcaccatgttggccaggctgatcttgaactcctgacctcaggtagtctgcccacctcagcctcccaaagtgctgggattacaggcataagccaccgcacctggccctctcccttcttttataactacccctgtgtttatcattacttcctggccaccatcagctggaccattgttcttacatctgaaatcttttccttgtcatcatctgttctctctctttcttcctacacacatcttaggtcccaattcaaccttcctctgggttttcttattccctgaaactcccaggaaactactagtctccttccttcagtaccaaatttccctataaaacagttgaccgaccctctctcctttaatttctgcactgctttttctctaccatttgccttcttcctactgtttcctgatgaccctattgtttaatccagtgactatttttttgcttctcattgcctttgactattctgcaattttgacatctttaaaattattgtcttccttaatttggatcacagtatcctctgaactctcttgtcctctctgacttttaaaaatgttttattgtcttctcattctataaacatacaaatcatctgagatgctttgcttgccttcatcaaaacaccctacaaccagttcttccttctaaatggtctatttctatggtctaatgggacgatccttttcctaagtcacccatggctgggaggcctcagagttgtatttaatgctgccttcccccttctgcctacagttctgtcagcttcctttcattcatcctttgcctcttctctcccattaccctggttgaggctcatagaacatcatgcctgaattattgcaactgcctcctaagtggtctttccacctccagtcattctttcctcttcaattcacccagtatatcaccactagactatttgtcagaaatcgctgccttgaatatttcctcccctaccccaactcaggctttccatgatgctccatttcccgcccaataaaatccaaactccctacagcttcacagagagctcccagtttatcgctccagcttcgtcttccactcctctcacccatacttactggtttatttgctgttcatcgtacaagcatacatttttctacctctggggctttctgtccctggcacttgagatgcctttctactcaagtcttagtacattgatgagtcaaggcaaactcgattctactacttaatatagagtctacattaattagagggactcccctctatctgtgtacagtttatctccctatttctgtctctttgcatcactgctacttctgcattgttgtttgtttgcttgttttttttagagacagagtctctctgtcacccaggctggagtgcagtggtgtgattatagctcactgcagtctccaacttttgggctcacatgacattcccccttcagcctcctgagtagcggggcctacacacgtgtatcaccatgcctggcttccacttctgtgtcttttaccacatgctaatttgtcttctacatgttttatcttgtactatttcaccaactggctggatagccaacttaccctgttgaaagtcttccagtgcctccccctaatttcaagattaagtttaaattcttcagcttgatgtgtgagtctccttatgacctggtaccctcttgcgtttcttctctcacctcccacacccttctgtgtttaccaaagtctaaatcattcccatcttcctgagtttcccaaaacaccccgcatgcttttgtgcctgtttgcctttgctcatcctgtgttatctgcctggaatgtcttccctcattggttttactggccaatcatgaccctctttcaaaatccaactcaggtgatacccccttcaggatactgaagccctcatctgtgagatacgcatctgttttgcctccgcagcatcctgtgatactgcactgcccttgttcagctgctgacccacctttcctagggaccataaattttctacagatgggacacttccatccttctctcatatattcctagcacctcgtccagcggctgttggagtagtgaaaggaggcaggtgtggcatgggcaaggccagctgattacacaggtaaccacaaggtggcatttactagatgaatttaccatgactcagagcctgactttcaggctggatgcctgggaacttggcttaccatattgagagtggctgcatctcacgaaggtagaaccttattaactgagggcatagaggcttctgtataaaatcagcatgcatgtgtactgattatcttgagcaggatgattgctggcattgacctgaccagggtgttctcctcccatttacatgacactcagaaaaccaattctctcattatagatttttcagccaattcgttttattccacaacagctaatcacatgaattgtgtgtggattttactgagctcacctgttagagaacaaacaatcttatttctaaattctcggagagaggtagaagccctctcctgtagcgtttatgtgctgattaatcagcatttactaagcctttaacaaacacctgtgacatgaccaggtagttcctgaatgaataaatgaatgcagatcgtgacgctagatagacggtagtgatgggaagtccagttgtggcaaagtagcatgtagacatgctccacatgacctgattattggaaaatgatttttccccttaaaagccccttttgctctcttacacatttctgactgtttttcctcatattcttctcagccatcatgttggcatctactgccatgtatggggggacctcactagcacattccagactgagcttcccccacccttggtctggcttccttgtctgcactgctgctctgattgctctcaccacaggccctacctcttccctatttctccttcctccaaaggagttctagttctcctactttttaaatcagaatgtgccttggactcagcgctaaggtaagtgaccaagcacagattctgccaatgtctttgatgctgcattttgcacttgcaccttcatctctgacttcagccctcctctcaaggtgtatcccagcatgttttaaaaggaaacagctccaaagaaagtaaaaatatcaggatcccttatccatagaatgttaaaataaagtcggctcagaagaggaaaattagccttttcttaacgaagtatcaaaggcactgtaggcatgaagcacgtagataaagttggactgaattgttcttcttgtttttatacgcatgccttgacgggcatattgtggctgcataatcccaaaatttatcacccctgtggttctttaaccttgtagtgagaaaaatacatttctggtcatttgccagtgttaggaatttctgattctaatatccaacttagtattaatttttcactactttaaatggctaagaaattatgtttcaagttggatcccaatacctttaaacaaaataagaataggaatttttctgtcacattatgtctttttctctttcctcctttatccctaaatagaatttttcacataaatacattgtgcttcttatcaagagctccaggttggtcctcgagaaagcttagacacttaaccgcagtaatgaaataatatctgccccaatttttaagcaactattgtgtgtatgccaatctctgtgcaaagtataatattttacataccctaaatgtattttttttttttaaagacagagtcttgctctgttacccaggctggaatgcagtggtgtgatcttggctcactgcaatctctacctcctgagttcaagtgattctcctgcctcagcttccctagtagctaggattacaggcacacaccaccatgcctggctaatttttgatttttagtagagatagggtttctccatgttggccaggctggtctcaaactcctgacctcaagtgatccacccgcctcggcttcccaaagtgctgggattacaggcattagctactgccccaggacggctaaaggtaattcttaaacaaccctctgaagagtgtaacccccaaacggccctccccattttacagatgaggatcctaaggttcagcaacttgcctgagtcccagtgtgggaacggagcagaattggaagccaggcaagcttccttgttcacgctctctcccctgcagtccttttgcctcctgggtaacgtggctgtgtttccaggttttgccacaatctcttcctaccataacaagcacaacgaatgtgagccttatgttttgtgctttttgtcctgttattttctacctatagaagaaacaaaatatttgaggacattacatatgtggcttcatcattatgtgtcagtcatgtgctgccacatatggaacagatgctgtgtgacttccaaaagttgtgtcacggcacaattagaaatagccctttggaaggaggtaatggtatttttttaaaacgtaagtttgctacactttttaatattatattcatatacatttgtatgtatcttttattttatgtatatttaggtatatttatttattgtatgtatatttacatatgtgtataaatttacatacttatgtatatgtatgtatatttattgtatgtatatttcattttatgtgtattttattttatatatttttacataattttatatcatatatttgtatgtgtttttatagctgatgaagagtatgaagatggaattgaaaggacgtgtgacactctccttatgtgcattgtcaccgtgctgaaccagggcctcaggaatggcggtggtgtgggggatgtgctaagaaggccatcgaaagatgtaagccagagtaaaagtattttttcaaggagcacatcttttttttaaacctttcttcacagcatttataatttagttttggttttcaggaaaatatattgtaccatttgctttaaaagtataaccatggctgttaaagccaattaattgtttgctaggattacatagctaatgtactacaactctttgtgtgttcgtagagtggtgaaatgtttccaagttaatctgtgtattgtattacagcaatgaaatcatgactgcgaactttatataggagttgattgttacacaaataacataaacgaggttgcctcttgcctatcaggtttcttgagcatgaagatttactctttgcttctgcataggaatagcctccatcatttatctatgataaatataacatttgagcaaattctaacaggatttcatatattaaaatggcaaagtggaaacatttctcactagctgcaaaatctcaagtgccaggctgggagcttgaagaatcttagctctgctccggccagttgtatcatattgtcaaatcatctaacctcttaacctcaggttcctcttctgttaaaaaactggattgcctggtctctaatttgcattttaacactgttcatcaggaagaaataagaaggagctatatatacttgaccctgtatggccaagaataaagcctactccagaaattgacaagtcattaggtcctccttagctccccaatcactgacttttggaattgacatttaactaccttttctgtaatgtctgggataggagaccactgtgccaaaatgcatttagcagaatggcataataaagtcctttctaaagaaagtgaagtcccaccattgtgggaaagacatgtgtcagtcctagagaaatgtaagtggttctggaaataggctaggaagtttttcttacaacacttaaagtagagatggaaagtgagccttatttttccaacttgggatactatttatattcatttcacaaacatttattgaatatactctctatgctagacagtgtgctcaatcactatgcctagtgtgatttttttaaatatttttatttcaggagcccttgtttgctgcccgagtggtttatgaccttcttttttatttcattgttatcattattgttctgaacttgatttttggtgttatcatcgatacttttgctgatctcagaagcgaaaaacagaaaaaagaagaaattctaaagacaacttgtttcatctgtggtaagtgttcggcagatgctaaaataatagatgaatagactgtttgcaggaaagaggggctagagggatttttatttttcatgctttcggaaaaattatttcaaaatgaaggttggataaaattcagattatgtaactgagcattagactggaattctctgcttctataaatagagagaggaattataccccaaagctatcctgtcattatttctgtgatttacatgattctctgactatagaaatgtgatgcaaaatgccaaaaggtttcaccaactggcaaacagatttttaatcacagtaacatatttattatgcaacagaatcacatttaattttgttagaatatgaatccaaatatgatttttcagcatcttgaacttctactcactgacatcactatgttttggattctgaactgagccttctctctgtttgtttgtttgttattttgagatggagtctcgctctgttacccaggctggagtgcagtggcacgatctcagctcagtgcaacctctgcctcccgggttcaagtgattcttctgcctcagcctccctagtagctgggactgcaggcatgtaccaccacacctggctaatttttgtattttcagtagagccggggttttgccatgttggccaggctggtctcgaactcctgacctcaggtgatccacccgccttggcctcccaaagtgctgggattgcaggtgtaagccaccgcacccggcccttctctcagtttttaatttctctctctctctctgtctctcttacacacacacacacacacacacacacacacacacacacaccactcccctccccttctcctgtcatcatctctcctagtgcacacagccttctccttccttctcattgccctcatcatccccctcagctctgccctcttctctgtacccatcacctctttctggcttcagttgtctttgtagctggtctctcggcaccctagaatctatcctcttctttgggtgatcacccactctaggtttcattcaccctccttgttgccacattaggctgaaaaaaatcttttggtgatagtcacaaaacaagcctaagggttcactacaacgttactgtatgtaacaaattgggtcctcaatacatttcattctctccttgcttcaacttttgttgagtgtttcgttcacctcaatgtctctccaaaccttttctaccttcctccaacagttgtaggtgtaccaggtaataatgtgtaatattatgctatattcagtggaaacaaatagaaagcagtcattccctgttttggggtgttcacgatctattttgggatacaaacacaataaatagccttgatatctcatgcattgaaggaaatggtagagaagtttacaggaagctgcaggtacccagaggagggatacctctccagcatggggtagggagtgagaaagaagagtcaggaaagcctttagaagagatggtgactgagctggtggtaaaagatgaaagggagaggttgccagatcaaagtgagtacaagcagaaaggccaggataagcaaagtcatggaggtggaagaacagtacaagggtcttcacttactctaaagcagctcagtgttgctgacgtaaagttcagagcagggcgtgctaagagatgaggttggccagaccacgcatggccttttatattaggcagtttggactttatcatctggacttacagtggaagatgaaccattaaagaattttaagtagaacactgcagggtctattttttttttttgctttagagcaccatggcagctttgggaggtcattcatcaggaaacagtaccagaagcagagtcatcaggtaggaggtcattaccacagtccaagtgaaaggtaacgaaagcaggagagttagtggtggcagtattaaggatagaaggcagagtcaagaaatatttaggagataaaatctttaaatcttgatgcttaggaaaggatatgaaagatagctgggatgcccaagtggatggtaatactaacaagtgattgagcttgagaatagatgaaaaaaacaatttaggtaggaatatgctgagtttaactttgagaatcctgaaattgagtgtgtactgacccaccccagtgggatacagcacagatcaattcatgagtctgagcctcagagattgagtcttcgctggagactataactggggaatcctcagcctatgtgtgatagtgaaatctggagtgtggaggagggtgtccgagtgagaagagaagcagagagactacaagtggaaagccccagctttgaagacttaggagagaaagaggagcacacaccaacaactcagagtaccaagtcagaatggtgtgaggagaagcaggaaggggtggcctgtggaagagaggggagaaaacagctttggaaagaaatgaattcgttatcaactctgcccaagcagagaaggccagtaacatgacctaaaaagcctactggtttctcatttaggaggctttggtgaatttaggtagagtggattgtgcagtgctgagtagagatttgctagaaggaaactgagagagatcaggaagaggctgagaggacactccatcaaccttggaagataaatatacctcctcctacctttatagaaaaataacccacaccctgtatttttttttctatttttctctttatgtgacagctatcaccacctccatttcttcacaatagatgtatgtgtgtctcctttcttttcttctcagcagatccttcaggctttccaaggatgattctttcttcccttgggtcacctcacctggagctctgtcctctttcagccttatcataaaaaaatttttaaatgattatttattgaatacttactacatgtctggcttttcacttaggtatttcttttcattttattcttaaaaaatgaatactatgtatgatgtatattaccactcctttacaaacatggaaacagagacttggctcccgtcaacatccagttagtaagcagaagagccaagatttgagcggaggactacctaactcaaaagtccactcagctatcctattctaaaatgacaaagtgacaggttctcattcaagcataaccaagcctgagaacagatcctggtggaagggtatagcgttatggggccaagctgttgtttagaagggtgagtcccatacaggagaatgatgctgccctcagaaacctctctgtgtatctcgtggtctttcttttgcactgcttcttcctccatgccctttttttcacggtcataatcatcatcatgttggtacactacctctgaaagagatgctctttggaagaatggaccagaggctggaagcctcattctaagacatgatattgtctcctatattttaaccaaaaacatgaacagcaacgtaagcccattgcttacccaagattcctgctcctctaagctttcccttctcggtcagaattctctttggcttttcacagttattaaaaagccagtcacctataaattcctttaaacatcacaataactgtcatcaacaaattgaagtgttcttgaatctcactgttaacttcccgctgaccttttattctccctctgcttgctttctctgggtcacagggtcctattccgtctcccaaaaccccttaatagaaggttttgattttgcccttgactccttgtctcctctctgtcctcctctttgacatcacttttatgtagattattgccaagtatgcatgctcagctccaacctttccccaggctttcccctctgttttcagtcactcactggacagttagacaggcatgtcttcccggcagccaaaccggccatgtctgaagccagtccatcatccctttctgtctccctcctctagcctagctctttttcctgacatccatattgctattagtaatatcccacagtgccttcagttatctgagggaaccacaccatcatgtttagcatctccttttttctcttccaggtgccctagctaccatgcgctaatgaacccaccttcacaatctcacccacatccttccacacattcccacagccacatcttagtttttcaggctaacccgggctcacaaccccaaatggtctgctcggtgttgccagactaatttttccactctgaattaatcatttccttactcaaaaagccatcaataacattgcacagtctataactctgtaacttgaattttcctggcatctaagctacccccacaatctggccccttctttttttgcctaccttctcccctgttgttctcccatttatagctcaagttccagggcaactacattacttacctttaacttcccagactctccatgtattcttagttgtgggagaacaatttcatttggaatgccccaattcctacgctgttgaactcctgccctctctctgaggcccagctctaatgccattgttctagaagtcttctccgatctcacacatcggaccctaaattcctcacatcacacttagctatatagcactgtacatatttctgttgtctgatcacctctgctggatgccatgcattctcatatcaaagaaaatgcatgaactttatagacaagtagtcataggtctacactggttctgcatccttgctatgtgatcttggccaagtttctaatcatcctgagctattgttccctcacctggaaaatgaggaatataatgccacggtttggtgttgtgatgagtataaatgagatcatgtatatcaaaatctctagcacgaggcttaactgagggtctgccctcaacacatgttaatttctcttctttaagagaaccagatccatgtcttatccatttttttttgctttcataatgtgcattggtgaatatccataaatatttgcttaatgaatgactatccaataagtcagcctcaggctgatattgtctctatacttgtctgacttataatctacaaaaggcagataaaatattgagattgtatatactgcagacaacaggtgtgctgattccaggttgctccagattttgttacatgcagggtattgtttctgtggagtgctgcccacaggaatgtagggtgacattgcaggatgcacaaagagatgtaagatcaatattgtctgttttctagaagcttcatgtttattcagaaatctgaggaaacacttaagtaatttaaactaagtgtaaatttaaatagtatttttatattagaacaaatagaatattgtaaaatagaacaaattcagcgtgaatatttaaaataaaatagaaacttttttaaaaaatgaataattggcttcaggtactttttgctgctactttctgtaacctcagtaacagaaaggtatacattttctgctcccttcccttaaaggaccttgagcagaaacacataagaagcattatgataatgtatatctagatatgcattcattcccagaagctccaaccacacaaatgatataattcatctcatatatgttaggagaacttagttacaagaatgatttaaatggttgggatatttgggggttgtgctagtaggctataaaatagtgactggtctagacatggttcctggtaaagttggatgtgaagttgtgatccaaagaaggacatagtaccaaataacaaaggagagaatctccatagtaagagagaactggctccaggtgtgtgccaagggacacccagagtaggacaagaggatgtagattctgtgacaggcaatggacctagttggaactttcccagccttgaagacaatgtccagatgtttggaagtgaaacatgactcagaaaacaatagctagtgatccagaaggtggccctggagggtgaggattagcagatgacagagctgagcaggaagcagagacacagattagctcttgcatccatattaattatgaacattgagttactagaggctgaagatccagtaagaaagagatgtcgaaagaccaggtgtgacaaaacaacagaatggagaaaggatttgatgataggtcagaattcctattctaaggatagggtatcttgctgtggcgatattatcataaactcagtcattcaagtatcataaactcaagttattcaagtcagaaaattcagagtcattactgatttctccttcttctaaatctatatctctaattggacatcaagcccgttcaagttttcattccaaaatgcctcttcagtctctcttattcatttatttaattattctgtcaaatttagttgcatgcctactgttctccagacactgccaggtgctggtaatgcaaaaatgagtcagacagtaaaatggtagaggctaagatggaaacaggcacattttcatagtgaagtgttgtgggcccagaagatcaaacagctggttgtgtctgtgggagtcggtggtggaagtggggaagcttgaagaaggaatacttggaaggcagaaaagagagtagatgaaggtgtcttggtgtatttggcgaatgatgagaaagtcagcatgactacaagaactgtgctgagtggaatgtcagtgcatgagtctaagaatgacttcaagttccctggtcaacaaggacttcattaacagagacgaagaagagggctcaagaaacacatttttgacgagttaagtttgacatccccacaagctatccaggtggatatatacagcaggcagctggaaaaaggagtggaaattgagaagaaaggtcagtactggggataaagattgagaaaacatcagcaagatgatggtaaaaccgtgagaatggatgatgaagcttagagagcaagaacttacgaagatgaaagacaaccagtttccctcttttacatttccccctccactgccctggtgcctgggtcttgcatccttagtctcttatcccaatcttcccctgaatcctgccacaggaacgacttgaagtatagctctgaatacactagtttctactcagaagctttcagaataggccgggcacggtggctcatgcctgtaatctcagcaactttgggaggccgaggcgagcatataagctgaagtcaggagtttaagaccagcctggccaacatggtgaaaccccatctctactaaaaatacaaaaattaattgggcgtggtggcacattcctgtaaccccagctactcgggaggctgaggcaggagaatcgcttaaacctggaaggtcgaggttgcagtgagctgagatcgcaccactgcgctccagcctgggtgacagagcaagactctgtcaaaaaaaaaaaaaaaaaaaaaaagaaaagaagaagaagaagaagaagctttcagaataaaatacagatgccttagctttgagtttaaagcttgccgttgtttctgccagatgtaccatttcatctgcatctccaaatgttccctttctgccacaccagagtaactgacattccctaaacaggtcatgtaccttcatctctggcttttccatgccatttttcctgcccagatggcaaaagaacatgggctttagagtcagaaatatttttatttaaatactaattgactcttccgctaaatagggatattaacttgagcaatttattgaatcattctgaatctatttcctcacatgctaaaaggtcagattggattattgtaattataatagcatatttagacatctttatagttgtcagcatcaatagatgctcaataaaaattaagtaccttttattaccattcacttcttctccacttaccataatcatgtactgaggctggatttttcaagctttgcacctcttggaaaccttttaaaatgaccctcatcagagttcattttgcccttctttatgctcccttggcagtttatacctcttcagaatataacgcaacgtgcctgtttcctctaccgtattacagattaattgatagtaagaacctaatttttatagccccattaccttgcaactggtagatgtttgaattgaattctgggaaaatctactttaacattttctctcttttgtttgttttgtttagtttgtttttctctcttttgttttttagtgttttgttgttgttgttgttaatagctctattgagatataattcacacatcatataattcacccatttaatatgtacaattcagtggtttttagtatattcagagttgtgcatccatcaccataattgattttagaacattttcattgtcccagaaagaaaccccataccctttagccatcatctgatccctaaccttccatctctgcctcggctctactttttgcctctgtggatttgcctatattggacattttatataaatgggatcataatatgtgggcttttgcacctagcttctttcacttagtaggatgttttaaaggttcatgttgtagcaggtatcagtacttcgttcctttttattgtaaaaaattatcctgtcatatggatataccatattttatcctttcatcaattaattgacattggggttgtttccacttttagctattatgaataatgctgctatgaacatgtacaagtttttatgtgaacatacattttcagttctcttgaatatatacccaggagtgggttatgcttagttatatggtaactctctgtttaaccatttgaggaattgccaaactgttttccaaagtagctgctgcaccattttacatttctgttagcagtgcatgaggattctaatttctctacatcttcaccaacacttattattatctggttttggttataggcattctagtggaacaatattttagtagtgaaatattattaattcaatcaatcagtatttaattgagtgccaactatgtgccaaatatcattccgagctattgggaccgttggtgaagaaaagaaatatatctgcccaggtggctcttatactctagtgggaggacaaacacaatacataataaatgtaataaatttttatccaagttgctggatgaaataacatttctttctcctttgctgagtatcagacaggctttttcttacacaatcattttacctctttatcttagagatataatccaatttaatttaataacttcgatttggctatattcagtctataaggaggtggtaagcactataagaaaaagagaggaaaagggaaaaggtgatcaagaaggtcagcagaagggttatatttttaaacaggatgatcaggttaaaccacattgagatggtgagatttcagcaaaaatttgaaggtgaatgagttacttaaagagatgtcagtgagaagagttttgtaaccagaggaaacaaccgttccaaaggtcctgaagtccaaaggccctgtgttccaaaaaaaaaaaaaagcaaagaggccagtgtggttgcatgggaggtagcaagggagagaacagtgagaggtaaggttagtgtggctgtgaggccaagtcacataggatttagcaaatacatattgcatgggactcatactaaagaattatttattatttatctgaaattcaaacataactgaccatgctgttgcttatctagcaactctacttgtaggtccttgtaaggactttgacctttatcttgaggaggtggaggagccattgttgggtttacaacagaagagagacaccatttctcttaggtttttaaaggattgctctggctgctgtgttgagaatgggctgtggagagtaaagatggaaacaggggggcctgggagtctattgcagtaatccacatgagggatgacaatggcccagaccagagtgtagcagcagagcgggtgagaagtggtcagattctggatatgttttgaaggtagagccaaaagcatttcaacatggattggatgtgctgtgtgagaggcggagaggattcaagaatgacgtccaggcttttggcttgaacaactagaacagagctgccatcgaataaaaggggaggactgtgggtgaagcaggtttagggaagaaaattgtagtttatttgggcatgctgagctgattataggtcaaataagatgaggcctagccatcagccagcagaatcttatagtattttccatacagatatccaataatgtaagtaaaaagtcaccccttcaatggggacagattttttacttattgtgctttatatcttattatttaaaaaaggtcttcaggctgggcaacattgtgaagctccatctctacagagaaaaaaaaaaagatacaaaaattagccgggcatggtggtgcatgcctgtagtcccaggtacttaggaggctgaagtaggaggatcaattgaacctgggaggttgagtctgcattgagccactgcactccagcctgggaaacagagtgagactctgtctcaaaaaaataaataaataaaagggtcttctacatccctgagtgaacttacaaaaaatgcttagagaaagaatagccagggttggatttcagtttcctggtttcttcttcagtatctgagctgtaacaacctaactgaatcccaacatcccacttcacttggcactcaaattcatgtttccatagatgtttttcttcatctctattcatttcttttcatctattctctaactttgagagaaaagaattttattatctaggtgctttctttactgtacttccaaaggcttaaaaatgtgccctggaaatggaacagatcaccccctgcccaaaatgcctggaacacggtaccctagagggctggcatagtctgagcacttgctgtcctcagcgtgtggacggccatcttctttgtgttcctttcactgattccaagtggttttgaacagatgactgtctcaattctttccctcttttaatccaagtttctgggtaaaatgacattttttttttctgtcctgattagcaagcataccttttcctgcatgatcatttttacctctttttctcagacttgtggtacagtttaatttgaaaattttgatatggctgtatttaaaattatctgcaactttttcatctattacaggactgtgcatttccaaggatccatggggaaaaataaatgttagttgggaaaaaatctataaacgatggcctcttttctggaggtcttgtgtactgtgttgtttttaatcatagcattttaaattggcacactcttactgaaagcatttttttcacaataattattgtgttttgtttttatgctaagaagcaagtactgattaaatgacgaattacatatattgtgttgcctgtgtttttcaggacttgagagagacaagtttgataataaaacggtttcatttgaggagcacattaagtcagaacacaatatgtggcattatttgtacttcatagtcctggtgaaagttaaagacccaacagaatacactggacctgaaagttatgtggctcaaatgattgtggtgagtgaccagaaggttttaatttgtgactatattgtatcttttaggctttcatcttctctaccctaccatcctcccaaaatatgaagattgtagcaatcattttttgttaacatttaaataggcctgtcaatcactgaagaacatctacactgactaagtcattggttcccagtagactccttggttattcaaaccaaatttgagtctccagtgcacagatgatatttcctggattctctttgcaatgactagcaccatctcagttatgttcatcaccttctgacatcataccttttatcattgctgatgtcccacttcctgaaatctggaactttcccattgttaaatatgaacagaagattcataccttaaggaatcccttgaatttcaaaaatcaagagtttaagaaattgaattgtgtttggggatagtatgatgttcagtcctaatgggagagcactgattttccatcaacacatactttggattgatttaccaatgttgctgatgaatttgcactgatcctgccacatctagttgcttataactcctcagcaagattaggacagaggatgtggttgtccatgatttgaagtttcttctgtctcatagaaaattaaaacaaattggcccgaaagggaaattaaagttacaacttcagtgtatatgtgtacacatttagtgagtatcgttacatctgatataaatgtttgcatttttataattaaatatagctatagattggatattccccccaccccccaaaaaaatctgacaaaattgtgttcaccatttgagaaagaggccttagatgactcatgatcctccttgctacttggtcctaaggaaaacacttaataagcaccaatatttgcaccaatgctgaaatgtcagcaaacttatcatctgcttaggaagagactgtagttagggagcaaccaaagaacatttttggaggataacatattaataattataagttcatatagtcatagtttaccttacctgtcaatatttacatgtcacaaaagagctacatgtaaattggatttatatatttcagcatttttcatgctttgttattaatgacttgcattctactctaagttgttttctctgcattcttcattggacaatggacagaacctaacattgtttgtcttctccacttttgcctttctgcctcctcctccttttaaatcagaggaaaaaggtaatcattttaaggatatatattcatggtcatcatttatactttcttgatctcacttgtgaaaaacattttgtttctgcttgctgagggtaaaaacatgtaaaacattatatttaaaatgggacctcacattgctgtcttttttcaaagtttgagtaagtttcatcaatatacatttattagactcctgttatatgccttggatgaatagatgtttgggtatactatacactaaagagtatgatatatttcccctctgccaaggaacatagagcttagtaagaggaaggggggaataacaaacccaaagtagaatatgccaggttctacaagagaagtccaaatgaaaacctgcgaaggcttcaagatggagagtggcatccaatgagagcaggtgaaaggaattgatggggggtggggtggcaatatgcccgagagaggaggatttctgtagatggggagtgtctgtctataagagggagtagcctgaataaaagcataaacatgagacacttggacactcaggggatcgtgagttgcccagtttcactggcacatggtccacttatagggaaactctgagagatctgacaggaactgtagattggaactttgaataaaaaaggtagaggcatttggatgttatttcatcaacgaggggaaacctctaaaggttataactaagggaataatgtgacctaggcaaaaaggcaggcagcagtgtgcaggctggtttggagaggagaaaggaagttaaagatggaatttggcagcagatgagattaggggtgaggatatgtgaggagcaggggaagtcaaagagagcaagatgagcctgagatgccagccagtgtgtgcctggtcattgggagaaaggcggtgggtcatttcagaaggtatctttgttagggaggcaagctggtcagagaagaattcttgttgattttgaggtgagactggaggccaggagtcatgggtaggaggagcagtgttggggcaacagcttgagccttggagccaggagtatcaaaccagtgctctgtctcttatctgctgggtggtcttggatttcatggatgagtcttgaaacctgcctgagcttctgcctcctcatctaaagggaggaactgctgcattgcccacaggagggttgtgcactcagtgagatgatgtgtagaaagtgcctcatagagtgcagagatcctctctgtaaatgatggttctcactgtgacagttcacatagaatgaccatagaagctgtcagattagagaatggtggggaaagggaaagagtataaagacagaagagaaaacttgagacagaacccaggggatcccccattcaggaaaaagaagaaagacaagtaaagaagcaagaaaggagacaataaagaaggcataaggagagccaggaacaggagtatatctaaagccaagagttgaggatttcagtgtcagagtccaacagcatcaattgctgcaaagaggccagaaagaagaaacaggtcaaagcctttggattttatgacctagaaatcaccgggtgacttttttaccttaagagaagactgctgtgaaaatgttgacccatctctggccttaacattaaaagcagcattttaccaggcacttgtacttgaatttttaagtatccaagtacttatccatgtttctccccagcctcttctgtcagagctttctccagagccatgacaagagggataagaactcccaagcttattccaacatgaaacgtttcattttcatccaagcagtgcacatccaagagaacaagctccattcctgaattttaatggccaggagaaggaagagtgatattaactcaggtctgatggaaatgaaaagttgtttgcatggaaggttacttatggaaatagcctctttggaaaacatctaaaaatctgtagctaaaaaacccatttcagaaaatctgttactccaagctctgtggaaatgatggccttctgactatcctcctagagagagagaagattttgtagcacgtggaaagttgaagcacatctacagttcagttcaaagactgttctttctcttctctttctctgctcctgaggtagctactcttcaaactttggtaggaaatcttccagacattttctgccactcttatttttgttctttaaaaataggttcacttaacaagttgatttaggtgcttatcaatagggctttggaagaagtttcaaattctttataattgatgttgcttttacattcatggatttatgcaaaggaaaatgtgaaaagtccttcctcatattagttcacaaaacaactcatctgaatcctgctacactgtttatgtaaatctgatttgtaccttgggacccttagaaaatgcctcctacctttcagagaaatgggaaaaacaagaatagaggttgggtgtggtggctcacgcctgtaatcccagcactttgggagactgaggcgggaagatcatgaggtcaggagattgagaccatcctggctaatgcggtgaaaccccatctctattaaaaataccaaaaaaaaaaaaaaaaaattagccaggcgtggtggtgggcacatgtagtcccagctactcgggaggctgaggcaggagaatggtgagaacctgggaggtggagcttgtagtaagccgagatcacgccactgccctccagcctgggcaacagagcaagactccatctcaaaaaaacaaacaaacaaacaaacaaacaaaaaaaaaaacatagaataagttctgggaatgttcctccctctgtatattttttcacctccaatgcttcagctttgttaccatgtcagtaaggaatatttatactaatatccattaaagcactgtgttagtctgttttgcattgctgtaaaggaatacctaaggctgggtaatttacaaagaaaagaggtttatttggctcacagttctgcaggctgtacaaacatggaactggcatctgctcagcttctggtgaggcctcaggaagctttcactcatggcagaaggtgaagtgggagtaggtgtgtcacatgcaagagagagaacgagagagaggggagggaagtctttaacaactaagtccagagtgaactaatagagtgagaaatcactccttactgtagggagggtaccaaacaattcataaaagatctgcccccatgacccaaaagcctcccactaagccccacctccaacaccagggatcaaatttcaacatgaggtttggaggagacaaaccatatccaagccatagcacctcagtttcttcatttgtaaaattcagataatagagaatattgtatctattgatgacattttaatatgaagtttggaggggacagatatccatactatatcaaacatacattgtaaataaagtaatacattgcttctaagggttagaatcgcaggaaacacatatgtgtctttgtatccatccaataataggatcggggtctgaaatattaatcaaaacttaaaactttcttacctctgttttcaaattctttttttttgtgtgtgtgtgtgtgacaaattcttgctcttttgctcaggctggagtgcagtggcacaatcttggctcactgcaacctctgcctcccaggttcaagagatcctcctgccttagcctcccaagtagctgggactacagtcatgcaccaccacaccttgctaatttttgtatttttagtggagacagggtttcaccacattggccaggctggtctcaaactcctgacctcaagtgatccacctgcttcgatctcccaaagtgctaggattacaggtgtgagccacagcacctagccttaccttcaaattctaaaccaagctatttaaatagccactgtttgattatttgaattaacatggagcatcttctgggatattgttcagggaaatatgagtagatcaaggtattttggggatgtaaaccctcatgtttgataaaataaatgatattttgagctagtgtttgctgggaacagaaagtaagaagggaaaaggagcgaccatacaggaaagtaaaaataataaaagaaaatttagaaaactagaggaaaaggtatgaaaggataaatcctccatcccatactgataatggcctttgagcatcactaagcccctttgcttctcccattaagcaaaggatgatgactgaggaggaacaaacaaaaatagacatcattagaaaaaatacccaagacttttagatgtttctctaacattttggggtcattttcagattaccagtgttcatttgctgaggtatattaacggatatttgtacttaatttgaaaaatagcaggatccaaaccagaggtctgtataagagcaggcggcatgcgtgtctggagagctgctgcctccacaagtattctgacagcactgggctgctagtgagacctggatggccaccctccccatgtcatggccatgggttttcgggaaccgtttcctccttttactgcatcacagttgcaaactcgtctatttatttttctcttgattaacaactgcactctgacattgcagcagtgttgatgaagacaatttaactcatgtttttgttaacataataattgtctgtcgtaactaaaatataagtttcttgaaagctataatcaggtatagagaaaatctttgttatgcacaataccagggcaggtaatatctgtaatatgtattaacagcaattcactaaacattgaatgtctctgtatgctggcacctgtgctaaagatttgctgtataaagataaataggaaattgcctcttctcccacgaaactcaaaacatttattgaatgaataaataataggtgaattaataaataaatgaatggtttctttttagccctctgggagttggacataatttacagaaagatataccaagatagatgtgagacattgcaacacaaatttctcattagtcaaatgctatctgtcccttcttttgaaaactgaaggataaaaatacagcaggaagggttatgtcccttgacccaaatcagagggctgatttgaaagatgaggctgtaggcacattaatccatctgtggcctctctcatcgtgtctctccaacccagcctctccctcccacaggagtaggccttcccctgctctcctagcagaggggtggggatgcacactggtggggttttcagcataactcacccttaagaatgaattcctccttgccatgatctgttaagaccttaaaaagaaaggtcatactttaatgagataggaaataaatctacccatctagtcacccagtactttagccacataaggaggggaaagaactagcaatttcccaaatgttgttttctgagtctggaaatcaaaatcagtcttgtttagttaaaacatatttttgagcagtaactgttggaggggagatgtttgggctcatgaaagccatcgagtcttctaagatttctatgcacccctcctgctttagcaccactggccaacttaatttctgcattattgttatgtgtcataattatgaaattatatgttctgttctattacttctagtttacactaattttgtaattggatctcattaagccaattatgtaactgcttaatctttaactaaacactattttaaagacttcagaacttaattttaaatgtttacatttcaaggaaagccaagggggtctttgcagctcagaatgcacaattaaaaagtaaatttgagcgttcagggagataccaccctcacttcccacatgttaagtccagacatgtgtctgtaatttaagatggatcttttaaaatgcccctctctggatttttattgtcactatgggatctgtcccctatgttattctcattttctctttagtattcatgtgtaagaccatgaattacctcatttttgcacagatgttaacatctttctattcctcttattagtttgtgaaacagagacagaagtaataggtacttaacagtgtggctgaatgctgttaagatgaagatgaagaagaagacttcatcttaaggattctggtccagtgcttaggttgttagactttggtgctggaagtgaggataaaaggatttggaccaactagtgtttaaatgattttcatgggtagaattgccatggagaataagaatgagggaaggcaggtaagacactgaacctgagatgttctaggttacttcctgaattgatcagaaactgtagatctgctagtgttcgggtgattggccacagagttacagaacccaagtggcttttgttagcttttctaatcagtgtttaaggagaagttccgtgtgaaggaacaaacctgagcatatgaatctgaagtttgatttcttaggatttccatttacaagattagtgactttacttatctcctctgtacttcaatgtacccattgataaaatatgtataatgggccagttagaactcaaaatagaagccaactgaagtgagctaggactctggaggcctctggctgtatcaggcattaacccttcagttgttggatcatgcagaggaggcgtggtggggatcccagaggcagactagggcagataaatctgcaggggtatagggggagggcgtatttggagggcttatgagaggggcttacttgacaatcaggagatattgcagtacagccatatctttgcataccagctaaatattggtactgggtataactgcactttttttgcagagctgctatgaggattcaataaaatcatgccactaacaacactacaactaacataactgacatggataagtattgactgtggataatagccactaatcatgccactaacaacactaccactaatataactgacatgggtaagtgttgactacttatccagctgacattagataagtgcctgtgctatgctaagtgctttacatgcatgatctcctttaaagcctcgtgacaactctaggaggcagatcctattgttcttattatccccattgtacacatgaggaaactgaggctccgagaggattggtagcttgcccaaagtggcacagcttgcacaaacggatgccatgcccataatgtgccaggtgcatgcaagtggtcaataaatgtctattagtattcgatcccatacaatgtgtaaagctagaagttgtgattcctttgggaacaagcaaggccagctgtacccaaccctctcggcagcgcacatggcactttacagaaggactataaaaattcagtccacagggcagggagtagacctggctaggagacaggaagtcagatgacaatcctacaatggcaggaaggcctgagaggaattcaaataggaaaaaaagagaactcgttcagagctggttggcaactgcatacttcctacaaagattagaagtattacaattacaattattacaattgcaggcgagaaagaaaaagaggctgcaggatgtttcaatttaatttgacgagtatttactgaggagaactatgcatgaggcactgataagaataagaataaaatatcattgccctcccaggaccacactataactagaaggacagctttattcaccagaaatgactgtgcaaatcagaacgaactctggtacagacattcagcggccagagaaaccttaagtcaaatcacaccactgcacccctgcttaaaacctgtccatggcacttagattaaaatccagaatccttcacagactgcttatatagtctggccccattctatattaccagtctcatttcatcccacgtcccttagccaacaacagtcagccacattggcccttcttttctcaaaaatgccatgcttttccctgatgggagcctcggcccacgtgtgccttctgcttgtggtcatggtcctctggctctttgcagtcatggtcctctggctctttgcatgtctgtgccttccctgacatccccattcccgttacttcctagcccaccaccctttatttcctttagctttatattgatctgaccttaaattgtttttatatttattggagtgtttattcttcatcagtaccatatgcaccccattaaggcatttacacttctgctttgttctcttctgtattcccagcacctaaattaatgcccagtatatagtaggcactcagcataaattcgttgaacaaaataaataagatatagagccactggagcacagaggacaggttctttctggtcgaaggcactaaggacagtttcaccgagaagattttgaggagagtcgagctaaaaatgaggaggattttgatagaaggatggaggggaatatgttccaggcaaagtgtgtatcttaaaagaaaagtgtgagaacaagaaaggaaacgaattaaggatatgatatgtgttagcaactttgcgtgttatcttatttatacccattttatgtgaattgaggctcagaaaaatgttagtcatcccaggtgctctgtaaataagtacttgaactaggatgcaaatccagattttcctgggaccgatgtctatgattttacctttagctatgccttcttctagtgaataatcaggtaaaatttgacaaaggctaaatatatgtaaatcaagtattggagaacaggtagggaaaacctcaaaaccaaaagccaaaagacatcctttagaaggaagaaagctgtttctgtttctccaatatttttaggagttagaatttttaatctctaagctgcattcgtggaggtgtgatctaaaatgccttgaaaatgcaggacaatgaatcattttttattttttaaagatgtgtttattcaacaaatgcagattgagtgttattgtgttcgaggtgctaggcttggtttagagatgcagagttgaggcagattctctaacttcccttgggaagctttggtaaaataaaggaaatagataaaggagtgatgataacacacggcagcagtggagtctgccagagcctagggcttgggaagggaggcttcatggaggtcatgcctggatgcttgaggctgatcgggtaaatgaagatggaacacgtagagggagcaggtaggtatgtctagaaaaacagtgaggacatttgggagggcaggaggctaaagtagtaaccaggagccaggttgcaaagggccttgtgtgcttacaaatttttactttatcctgggccgggcatggtggctcatgcctgtaatcccagcactttgggaggctgggacaggtggatcacctgaggtcaggagttggagaccaacctgatcaacatggtgaaaccctgtctctattaaaaatacaaaaattagctgggcatggttgcacactcctgtagtcccagctactaaggaggctgaggcaggaggattgcctgagaacaggaagtggaggttgcagtcagccactgtactcaggcctgcgtgaccaagtgagacttagtcaagaaaaagaaagaaagagagagaaagagaaagaaaggaaagaaagaaagaaagaaaaaaaaagaaagaattgatttactttatcctgaaagttaagggaagccctgcagagatattaaaccaaagagacaggagcagatttacattttagaaagcatgctctatagcagtatacgaaatggattcaagggagccatcctggaagaaaaaaaaataaacaggcagaaagattttattacccagcaacaataatgagatctggtactaaggaaatgccactggaaattgaaaagaaatgatggctatgaaaaaattaaggtagaagttttaatgaaggtaaggggaagactgtttaggtccctgacctcagagagtcaggggagggagggttgagcactggggagagggaaagggttccacaggaataagttgaggagatgtgatcatctcagtttggcttatagtgcctaagtgcatatgtggacttggacattttcaaggcattttcattttcgagatattttagatgatacctccacaattgtaagttagaaattaagaattctaatacaaaactgagtatataggtctgtaattcggatgagaaatctaaaatggacaatctactaaaaaaggttaattaccacaaggataagattttagtgtcttttttgagaccgggtctcgcccttttgctcagacatgatcctggctcactgcagcatcggcctcccaaggctcaggtgatcctcctgcctcagtgcccccaagtagctgggactacaggcacacgccaccatgcctggctaatttttctatttttagttgaggcggggtttttccatgttgcccaggctggtctcgagctcctgagctcaagtgatctgcccacattggccttccaaagtgctgccagattttattttatgcactagggcatcccaggagaatagaaaagtgcctggtatatattagatactcagtaaagatttcttaaatgatcacaaagatttgtaagttgctggagtatacttgatagctgaaatcacagatttaggtaaggctatgcaaaggaaactatatagactgagaaattcagaaaaagcatgccctcagacttggaatagcacagacctatccctgttatttaataataatgatgataataatgtcaaaagtctactactcagattttactcatcaaaaagtagaaccaggagaaaaacagttttcatggtggggctctgaaagaggatgttgacttttcattagccagtgaacctagaggtggtgtggtcagtttgtggatatcatgtgatctgacattgattacattttagtatgaaattatgctgcaaacccaaatgtttagagcaaagtaacttggacatgttcagtatatggaagcttttttgaaatgataacccatcctaagtcatttattttagacttatgaagggatgttcacttctctgattctcataaccttaataaaaagatttcctcctgctgtgctgaagaaaattcttgtttcccagttctagtcattacggtaagatcttgttcaattctcagttggctttctggaataataatgtccacattgttaggactgatacattttacttagaaactctggctttcttccagggagtaacagatgccatcaaaatgtaagttgtgggaataagaactatatactgtaaagccacacgaattctgtctaatggtttttaataggctagcatagcccatgccatattgtaagtaattagttaagatggcaattaagctgaaatactactcttgttttagataaggttatcaggcaaccgcatgtccataggatttgggactaattttatctaagggaatttctgaaaaataattgctgaattttacaaaagtgattcagcacttggatttcagagattagtcatttaatatcaggttagtggagtcagctactttgatgggatttagagatcaagatgttttggaaataatagcatctgaggtaagttaccgcagctctctgagtctgtttcctcctctgtactcccctttactaggattcctgtgtggattaaacacaatcacatctatcctagcacctaacatggtgtctggctcacagttactgttcaacaaatgtttaatctcccacatctacttaaaatatttggctaaataaataatatggctaactttaaatactattttgtggattcaaaacattcttaaaccattcaatgttcaaagtcttcactgattctacatagtgtttcttttataggttaggcaaaggtcaacttccatatgttcaataaatacatagcacctataatgtcctagatgctgcgcccacatctggaaagggacgcagaggagataaagacagccatggcctgttgcacagttacctgtttagagctgaaggcagatcctagacaagtcaccacaggttttacatagctaaatagtgagtattaccatcaagcgaaggtcaggcagaggggcttcctatattgttgtctgacacaaacctgtttggcatttgttcctttgtctaaccaaaagttgggagcttccataaatatttgcattgctggaaccattgaatccatttgagtttacaagtgatgttaagacagatcttaccacaaagaggtgtggtatgacaccatccggagtgccgcagagaggacatgaggacagacatactgtgaacaggagtggtaggagctaattctgagtcagaacccaaattacataagaagaaatgtcatctagtttacttctatccttaccctgggaggctaggggcaagctctgcctgcttctaggttatatcatgaaagcaacaaaggatgtttatttcattttccaaagaatacattttgggctccttcaagtgaagaacttgaggcatttttcacacatgtaatcagctttttcattttttccaacatttgaaaaagttccagtataaagcacatattttttgctttagaaataatattctggtctgtgtccataccactctgaatgcaaccgatctcctctgatctcagaagctaagcagagttgggcctggttagtacttggagaaataatattccggccctccaagtttccttctgaattggggttctactgtgattgttaactcttaagaaagatttcaagtgtttttgccattgtgtgaggttattgataagcattccaaatacaaatgacataaaaagcaccagttcaccagaacctgaaattcaaaaatggccaaattcagaggtggtttatttgcaaaggtacctgtaacttttcagaggtaattactcagggatttcttttgactctcttggcaacaggttgtgatataaaggccctgggtcctggatgcactaggtaggcctatgactttgagaagagacttgattgccacagatgtggattcttcattcataatgagaatccaagtgacttccattatctcttctgtcctggttctaaaattctgataactctaaaatatttaaaatatttctttacatgaagttgtgggtatattaatgtttattttatcttacaaaccagaagcaactgggacaggagttttagagtggtccagatttgactatttccattgtattccttggggggatcatatgtggatcagctttccccggctgttgtctggctgttaagttctgatgttatgcagtccacatgattacacccttgtgctgcggccttttcagtaggacaacactgattatggacagacagtgaattttcttcgaagacatggatccagaccctctaagagaaaattaaatggtgattctggctggggtcggggggcagtgggaggcgcgaggaatttccactgtctcaggctacacctatgctgaagggcctgtgagaatttctgtttcccaagcttaggacccagtaccatttggaagcactaaacccagtttgaaaatgctgttttagaaaacaaagacatactgccaacagatatataataagataacccattttattggggtgataaaagttattcttacttgagagtatcacagttgcctcactttattttctgatgtataactcacttgtgtccaagaataaatgaaataagagtctggattgtagaaagagcgttaatggaaggggtgctgttgtgtgttagacacagtgcgatgtggtggtttagacagactcagggactttggaagccttgggcaggcatttaacctccctgtacctcagtatcttcatctgtaaaatgcgtaaacatccctacattcagcgtttcctaaggattaaacaatttaatgtttttgcattatctaacagacagtacattttaaattaaactgtaaaatatgtatgagtgttagaatagcatttcagggctcaataaattattatttattcaacaacttttgcttagtgcctaccatgatctagggcaatggataagatcctgcaggagagcacaaataaaggatgaataaattccctgcttcaggaatcttgggcctaatgagaaataataatatatggtcataaagatgagttaataacaggcagcaatatttgatgagctaagatgaggagctgtcctctagcatgggaagaggaccttgtgtataaaggaaaataggcagatctgaataattgaagctcagagagtaggtgaacccacctggattaggttggagctaaagggaaacaggaattaattctcagggtaaggagttcctgtttgatccttcaaacacaggagaggcattgatgacttttatgtagaggaattatgtgatttttttaaaaatccgattttaaggaagtatcaaagagtctatagcaggatttcatgaaggggcaagagtctggcagaaggaaaatcagtgaccatcacactgatgaaaaatgtgatagaaggaactggaaataggaagggatgggtgtggtggaaagaagatttgaccaagagtgacaatccataaaccaagagggctcggttcccgtacacccaaccccgtacctgcctctctcactaggctcagccttcctgatcttctttatgaggctttcaattctgccaaccttggcttctgctgttcccttcacctggaatgcttatcttcagaaaataaaatcttccttttgtggccaatccacctaaagacctcaggccctctataagagcacttcgtcatagtctatccaaagcgtttaccactatctcaaattacttgcctgtggagttgttacctgtttttcactgtctttgtttccttgtgaactggactcttgatgtcttggtaactgtttccccagtacctagaactatttctgaaacccaaagggtcttaataaatatttattgagtaaatgaatgaaataattgatctctaaggtcctttctagcaccagttttctgacttcctgactttaggtgaaagagaacttaagaaaactgcttgctgacagagtatttaggagaaagggaaaaagaagactaaggttttgagtttgggtgacttgaagaatacttttaatgactgaaatatcagtttttatcctctctcctcaaacattcaggcacactgattttggttgccagctcattccatgtatggtgtcaatgggccatccagagggcaatgatatcctggtccctggagacaacaaaactgggatgtttcaggagagaaaacagaatgaaattgaagatgggagttttggaaatcatacataagactcgtgtttggccggacgcagtggctcacgcctgtaatcccagcactttgggaggccgaggcaggcggatcacggggtcaggagttcgagaccagcttagctaacatggtgaaaccctgtctctactaaaaacacaaaaattagccggtggtggtggcaggcgcctgtaatcccagctactggggaggctgaggcaggagaatcacttgaacctgggaggcagaggttgcagtgagccaagatcacaccactgcacttcagcctgggcaacagagcaagactccatcaaaacaaacaaacaaacaacaaacaacaacaacaacaaaaataaattcgtgtttgccaactagtagtaacagactgatttatttgaaactgttagtggagctagttatattttagtgaaaattccgcatgggggaaaataacccaaaagaaaatggtaagagattttagcaggtaagtccattttatcatgtaatatttacatggatttgctcattgtttaggagagagtggcagtggaactaaaacactcccttctcattaggacctggctgtggataaaaatttctccccaggtccatcccatcttatgcagtgacaatgacctgtaatgctatcctgacaccaactggtaacatactgcagtataattcccgggctaaccacccagagtcagcacagaccacacaagttccagggcatagtcctcaaaaagatgcccttacttcatacgccaactgctttttgggtgaccccaggccactcatactttggaccaaataggtacaaattcaggggttaccatcatcccttcagtttgataattcactagaatgactcacagaattcacaggagcacagtacttgccattacagttttattataaaggacacagatcagcaacagccaaatgaagagacacatggggcaagatctgagtgggttttgaacgcagggcttctgtgccctgtctttgtggaatctgggtacatcacccttctggtacggtgatgtgtttaccaaccaggaagctccactgagcttcaatgtccaaagttttcacaggggtttcattacgtaggcatgattgacctaatcatctgccgtataattgagctcagtctcagcccccttgtactctccagagccgggctgactcaaagctctctaatcatgcagttggtctttctggtgaccagcctctctcctgctgagtcatcccatctcttagcctaaactcagatgtgatccaagggctcatgaataacacagaaacttctgtcatttgggaaactccaggggttttagaatctccctcccaagaatcagggacaaaactagtataagtctttattatacatcaggtgtactgcatttttctgcacattcatttgttgctttttaatttaagcacttaattggaaagaaattttaaatcttaactgaaagttagcccttctcattcctctatccctcttatacacgatgtacattcattccatcaaaatatctcttcacattatttaataaaactgatattaatccactactttctaaaacttccatcattctaattcagatagccttcaactgtcacctagaccatgacaggtgccactaaactggtcttttttcttccatacttgcccctctactgactatgcctcaaagaaaaaaatgaaaaaaatctaaaacataaatcagaatatgtcacctgccacctgctccaaaccttccactggctttctactctacatagaataaacccgaaccttcttgtccagtcctacaagctctggcacctgctatgctctgccctttcctcccattcataggctccagctacatggactttgctgtttccataatatgccaagcttgtttctacctaagggcctttgcaaatgttcttctttcagcctgcagcactctacttgttcctttacatcctgcacatctctccttaaatgtcatcaactcagagaggctttctctggtcaccttttctaaagaggtcccatctccccactatgtcattctttatcctcttaccctgatttttcatttccccaaaacagctatcataatctgacatcatgttgcatatttgttttttattgtatgtctccttcatttgaatgtaacctgcattagggcaacaactttgtttttttcattgttgtattatcgggacttagagcagtggctggcacatagtgggcgcttagtaaatatttgctgaatgaataaatgactgaataaacaaatgaatgaacaagaaataagtaatgatatatctttagtgacttagcctagattcttaataatgcaagtgatagctagagtaaaaatgtatggcagctgaaagcacaggtattagtctgtctcagttcacatgccagcttggctacttcctagctgtgtgaccttggggaatttgcttaacctctctgagccttattttgtctctttaaaaaaagaaaatgtagtaatattatctacctttacatttaaaactgtattcagagaccttttataaaaaggaatatactctctcccaatacctataattcttcaatctacacatattcaatggaacctgtgattaaaggatccaacagatctaagatagaccttttatatatacaagactagattagaaactaagaaatataaaagagtttggccaagttactgcttcttgcttccttttttgaaaaacaaggatgttgaattaaatctatccaaagactctttgagtgctgatattttgtggtgttgtaattaaaaccacaagtctggacaaacttggaagccagagaatgatagggaaatcatataccaagctcgaagaaaagcagtgggctctcttctttattataaggttctgctcatttaaatagtccccaaagagtcttccaatgtcaaataaactactttgcagaacataatcagaagagcatggttcagttggctgtgattaggttgccagctctggtctgcaggggaaaatcacaaagaaaatgtagtcgaggctcgagttggatttagtcaacaacccatgtcagccatctctttctccaatgaagtactatctaagaaggactagaaatttgttgatatcattagtgaaatatagtgcactgtgtaagaagaactagaaacaaacagtggtagaaacatgggctaatacacatgaatacaatttctctatctggcaacccatgcaaattatttgatcttttcaaatcgtaataacacagaaagtcttcccagaagaaataatttgttcctactgcccattcttatttgttctaagtttgtgtattagtttggctgtattgccagattacttctcttcatataacttcatttttcatttagtttccctatctgcgttaaaggttttttcagatttttatatttgattgctaacctgctttgtgaaatcttatcctttactatcttcatcttgcatctctggtttttttttcctcagtgatttggtggatgtgaaaatgatagaagctaagattacatcatctttaataaagaaaaaaatatagggtatgtggaatgcaggtgagccatggagaaagaaatcaatcaggttggcaaattgcatcaatgggacaaggtgcaaaatgcttgtttcatgcagtatttattgaacaagcttgttgaaatatagttaaaatgtatatggaaaagtaaggagccattttgttcaatttaaatgacattgatatatttttttacatcataaagtctttcaatatttccaacaacaatctttggcacagtactttatacaattttctcaaaggcccttcagagataaaagtatatatctaaggttataaattgggtatatccaatctacatataatggaagccactacagtcactctgtagaattcaatagatcaagaattatattcaggtattacatagataaagtattcttgagaatttgggagaagttgaggttttgaataatcctcaaagccctcagttgactgtcattttttttaatcgctcccagttctaatggcatctggatgattttttgtaggaccaagtaatcagctcatgctctcttctcttcactgtggaaaggaagtcttaatgttgtttttagagaaccagaaaaatgtattcttccaaaattggcagaaagggaaaaatgacttttctttttttatggttttggaactaccaaataggcatcctttcgagaagtgactgctctacaggttgcttttattgctgtttctcaaaagggaacatttgcttaaagtacaccctcccagatcaagggggtccttccctcctgtggcagaggtaaataggggtttacaacgggaagaggagtattctctttaaaacttacattctctttagtcttcccatcctaaaagaaatcataaaacaacagtggcgaagaacttggtagattgtatttgagttatttcaacaaaaagaaaatgtattttattttgaagatagaggagaaataggaccacagttgggtgattcttggtaaagacgtccctgaaaaatacaaacacaatctgaagctactttctggaaaacagataactatacacatcaaaatatcaaactaaaattagcagaaagaattgttggcaaaggttttgtaaaagaacagttgcacagggcatgaaattgtagtgaaagttcacatagcctttcattacttatttgtcatttagttggattttcttatttgtccctcctgttgctatcattagccattaagctagcagaaacaacattttccacatcacatgggcaatgtctttagagtttgcaaagagaacaaggaaagcaggctacactgtttcatgaaaagaccaaccgatgtaggaaaataagaatatttgttgtataatcactgaaaacctgtcagcaagcagaagaggtttaactggtaattactttaaaatagatttctcttctggtgcctttttaaagatattctacgtgttatttttattttgtagtttaaaataatttatagttttcatggtaaatttgacagtgtgcaagaataatactgaaataaataatattcaaaaagaaatggtttctaagcaggcagcagctgtgggatcagtgtttgtgtaagacttttcctttgcacgctcattggcttttgtgtttaaacacgttggctgccctcttcattgacattgtcttagtcagatagaattgttttaaacaagcattctatttaaactccttaagtgatagatttgccttttaattaaaacattattcctttagctagtatgcaagtattatccacagtttattttccaaagaaaacaccttctctttcctacttcctaacttctagaataaatgcacagatgagcaaatttatttcaggatttaaaatggtaaacttacttatataatggtaaacaagcatgaacaatttaacatttctagggtgtcatgtgtacttaatgaaaattctgatctattacttctgaactcctgtgtcatgagtctggggatacagtacgccaaggagaaaaaaatacagtttcaggaaaaagaaaaaaagagtcatgtaattaaagttgcaggagccatttcttgaatcctggaatgtttgggaaatatacaatgccctactcttacgttaaaaattttgttaggtacccaggtttcaggaatcactaagcttcaaattacattttcattctttgtagtgacaccgttcattttcctttcctcaggtcctctgtgttcaggcatgaaaactgtctgacttgcctagagtttccagtttaaccttgctagtaaaccctaaaataaaactatgactcccttctgtgttctacctgggccagtgtgataccaatgagtctcgcttcgcaattcatgttcattatcgttattccctgattataccagataactgtagtcagaatactgctttgcttaaaatagaacgcagtgatattgggttaccacatggggaggccgacctgaagatcatcagatggtctctcaggacagtgctccagacagtctctctcttaggggacaaaggtccaggcccagtgctaacctttacagactcatcctagaggccgtcagggtacacagaacaaattgggggtagtaacacactaaccggagtcaaaagacagaaatgtggataaatcagaatacctatgcattgatttaacaagataaattgattttcaagcaggacagacacacatgatggcaggtcagtgtatttttccctgagacgccagattataatgagaaggttggttgctgaatgagcagaggttgggagcaaagggagttagttggttttatgatttgaatagttgaccagaccgagataaacagatgtaacctcattgctgcatccagctggagactagagtttagacaagggcttgcttaaatcctgtgtgtgagtcctggctttcccacttaccagctctgtgaccttgggaaacactgactagtatctaccttagggttattgtgaatgttcattcatttattcatttatactatgtataaagcacttattttgtgccaggaattattttaggcccatatcccagaatggcagtgaacaaaacagataaaaatccctaccttcatgatgtttacattctaacacacaagccatcaatacgattgataaataatatagtctgcctgatggtaatgggtgctacagagaaaaataaagcagaggagggaaaatccccaggacaggtggattcactgttaaataaaatcaaatcttaaatgtaaagatgatggtatctgacccaccattttttttattctagtgtggtgttattattatgactttcattttatcttctctgaggaacaggcagagcctagccaaatatccacgggagagtgccagacacataagctagttcagcctcattccaccccatttgttccaagctcagtgcagtcttcctaattgccagtgttgcctttagatttgtaaattccattgattagttaacagttgggtctttctttgttttagaagacattttatacataaaggtgtcattatacacttttcatttcctttatcatgagtcgagattttaggtctaacttcaagcattttagaagtatctccatacttagtgcaatttgtaggactcttttttttttcttttaagttctgggatacatgtgctgggatacatgtgcaggtttgttacataggtacctgtgtgccatggtggtttgctgcacctatcaatccgtcatctaggttttaagccccaccttttctaagatcagatcacgaaaatggtatcagtgcattgtgatctggagagaaagtcttagagtctggaaatcaaaaatctgtattctagttttgctttctcattatctagatcagcagtccccaacctttttggcaccagtgaccagtttcatggaagacaatttttccaggcactgggatcgggggtgagggggtggaggtgggaatggtttggggatgattcaagtgcattacatttattgtgcacactttatttgttattacattgtagcatataatgaaatattatacaactcactataatgtacaatcagtgggagccatgtgcttattttcctgcaactagacagtcccatctgggggtgatgggagacagtgacagatcagcaggcattagattcttaaaaggagcatataacctagatccctcaaatgcacagttcacaataggaggttcacacttctatgagaatctaataccaccgttgctgtgaccggaggtggagctcaggcggtaatgcaggcgatggggtaaatacagatgaagcttcactcactcatctaccactcacttcctgctatgcagcccagttcctaacaggccacagactggtactggtccatggcccagggtttgggggccctgatctacgtgactcgtgatgctgccataactgtgtagcttagtttttcttcctgtgtcttggggagcattggggctgcctttcatagggttcatgagagaataaaataagacttgcccaagatcacccatcagtaggttccccatcttttattccccagttatgctttctttcagctacactaggaagaggtgatgagggagtgtgaaggttctaggataggagagaaaatacctgtgaatagtttgggtaactcgataatggttgggctctaatgttattattgcaagagaccaagaacgtcagatttgataggttagaaaatggtggtgtttgagcagaagagcagtttatgaggatggtgttaaaggagtcccagcagtactgtattagagaaaagggatctgatttgagagtcataagaaaaatatgactgtaagtaatcagtgactaactgaaagtagcagtgaggaagagatagacagtaaaagtctatccgtattcttgcatgtatgcatctacctccacatatttgagcacttgctgggcttgtgggctaggcactaagagaaaaatctgagtggccctcagatgcatgtgacccagggaatggtggaaagatgttttctaaaatgttctgctggtgcttaggtctcagaaggcctatggaagttttaattttggtaagaaacatccttgctagttctgggtttgaccttaagctcaggctggaagtaaattgctagtgcccacctctgaggaagtgcaggttgaactagggcaggtgacacactgccttgtggaatgtcaatctgcaagtgattccatcctgcttaacggagctttagcactttgaccccagcttgaagcctgggaatacagcaccctccagcccctgaaccacaagccacttgcaagctgggcatatcacaaaattactttgatccagtcatcataagtgtatttattgcaatgggattctacacaataaggtggtgttattgtgaattagagaataacagaagacttatgtattcaaagtgggatttggtgggtagaaaatttacaccatacattgcatcagctactatcattctacaaaatttgactgtgcaataaaatgatagtcagtataaataagatctttctaaattgctgcctaaactgatagtgcacatggaaataatttcaacctcacgttatacattaggcatgttattgaaatgttgcttataaatgtattttgtgttgaaagtttaaatcacgttttcaatgttcctttggaaaattgttagttaaagaaatctggtgattattcctttaggagagaatcctttggaaattaatagtagataatctgtttttcatggattttgtaaacttcatttttatatatcacgttaccctaaagccacctgtatcttaggttaaaataattaggttacctttattcttgaagtggttggtaattgtgcacagtctaaaccaatacaagctggattgtataattgtattgccaaatcttcacccatttttttagcaaattaaaaaagaattatgatgcaatggggtggggtggagggtgaacaaagattactctgagcaacaggaatgagaggatattgtgataaatcttatatgatatataaaccatgaccagggattaaatcatagctagaccacataaataatgctgtgtagatcttgctatgatttcaatagataacataattcaaaacccaacttccagcacaattaaacatgaagctattggtaacattttttttttttttggagttttgctcttgttgcccaggctggagtgcagtggtgccatctcggctcactgcaacctccgcctcctgggttcaagtgattctcctgccccagcctcccgagtagctgggattacaggcgctcgctaccatgcccagctaattttttgtatttttagtagagatggggtttcactatgttggccaggctggtctcaaactcctgacctcaggtgatccactgccctcggcgtcccaaagttttgggattacaggcgtgagccatggcgcctggctgctaacattgttgttagttctcaataagtaccccaattgcagaaaaaaaaaattggtaaacttagaggtggtgattacaatgtatttttaaaatacttataatgaccatgcaaagatgtcatcaaactacattaacatcttagtgatagaaaggaaaaaagaaattttttggtgaaatttacaggaagtaacagaacatctattgaagagctagggataaatttgagttcaacaagaccttggaaatcttggctactaacgttggcaagaccatccattttccatttctggtgataaattttaaatccaaataaattctgtttgttagggcactaaaaagccttgtcagctctgaagttaagtaggcatgtattcactggcagtatgtggaagccacaaactgggccaagctgtagacacctcctgtaatctaattttcaagcacaaagtatggcaaagccaaaaacggctctcagggcaaggcttcctgggctcaattcatgaccatgggctttgggaccaggggaagctaaagatcatcatcacttctgcaaaacagcggacctcgaagacgggaaacaacaaggccagaataggagcgagaagagatgaacttccctctcgaagtggttctctgagccccccggtaagagaaataatgaaggaggaagcgagagaggattcgtggtgtgtttagtaaaacaaggaagggctacagatacgctggaacaaagcctcagagcttgctttccaagtagcagtccagatacacaaatgggtcagctctgactgtgtaggcatcaccccttaggaaacctgaccacagaatgcccttgcaaagaaacggagacaaaaatagagtccttccatcctgcagtggcctccttcttctctttgtgtgtcagtgattttcaatcagtagattgcgagagccatggcaacttgaggaatttacattttaaattttaaaaagtgggcacgtagaggcgaaagtggtatttgggatacagaacagaagaatgggttcctcattcccacaaggttaccaagcagtagggtggggcagagtggatggaaactcccaaattgcaattgacatgggaaggtttgaaaactcacatccgggtgacgccatgtgcttgtccctgaaaatgtgttaactctggggatgtcatcatcccatgaggccaatcacagatcattcctcccactctccttttgctttgccccaaaccatatgttccctcatgacacacctacgcttccccaccctgaccccctgccatctcctcccaccaaaagcatgttctaaatattagctttttttttccccacaagagaaaagcattgcactagtttctctacatcattttatgaaacccttacagaaatcctaaaagataggcattcttatccctattttcagaagaagaaactttaatactaatctgatcacatgcataatgagaggtgaggctgggattcagactgagattgccctgcctccaaaacctctgacttttaaatcatagcctgctttcttggttccctgtatatctgagcatcctctcatttggatgatgccaagactggtttcatcctagttagcattaatatggtgcacagacctttccagcacgggacaggtcactttaccttgtacctgaatatttctcacctccagaccttggaaaaaatgaagtagcagtggcgggacactttcttccattttgacctctgtatttcttcacttattcagctagcatttaaagaaagcctgctatgcgcctgacactgttctaggctctagaaacaaaggaagtaaagccctgccctcctagaacttgcattctactattggagacaaatgactatatgatgtaggcaatgtcagctaatgatggaaagcaaagcaagttgaaggagcagaaagggatgaaagtgtgctgggtagggttgtcaatggtagcctctctgaggaggaacattggggcagagccctctatggagtaagtgagtgaaccatggagaggtctaggaatcagcaggagccaacccctggtgggaacagattggacatggcagaaaaccagcaggacagctcatgtggccagagtcagtgagggtggcaggtggcagccacagatgggggaggggagggggacagagactggatcacttaaggccccctgggctaggaaaggagttaagaatttatgccaggaaaatattaaaaacatatcagtgccttttttttttgttctgagatgtgcccaacatcatcaattatttgtaatacacagaattcactcctgacaaggaaatgggtagaacatatgagaataagtagtttaatccacaaaacacagccgggatgatggatttcaaattgttgccagctcttcaggcagaatgggtaagaaataaagagagaatgtatgtaagatcacagtccagcagcacacttttcatgctcaaggctcaagggaaaacaagaacgactttattctttatccatagaccccagataaatcttttctgccttgcatgatcatatcctaaatatgtacatagctgcaggtttctgggtgtattctagcttctgtagctctctttgtaatagttcaaccaaatgtccactatttataggtctctgagcagcaacagttagcaaatgtaaacccagcaacccgagctagccgccctgcagcttcctcacctttgccaccaaggtcacccttcccctctggccatgggcagcagctgatggccacatgggccacaaccagaggtggtgtgtagggtgggtgcctggtctgacaccagctatttagtttcattcccaactgggtgcactgcaactcaattttggcactgcccactcaggcttagtgcagaccgcacaagttagaaagcatgatctccaacaatactgccctatgtccgatgccagccacactttgggagtccccaggctacagcatttatgacaggctggatataaatctggcggttcccgcaaccctctttggtcaataatttgctataacagaacacagaagtcagaaaaacactaatgatgacagttttattattatataaagcatacaaatcaagagaatctgccaaatgaagtgacacaaggggtgaggtctgagagggaacatggagtttctatggcctctccacatggagccagggcagatcaccctccctacacattagtgtgtccaccaacaaaattcaaccaagccccagtatccagaggtttttttagggcttcattacataggcctgattgattgaatcattggccatgtgaatgaactcgatctccagcatccttccttccctttccagaggtggggctgacttgaaaccccaaccctgcaatcatgtgtgcttggtctctctggtaaccaacccccttcccccaacgccataacctcccaacactatgtaggggcccaccaagagtcacctcattagcataaacccaggtgcgctctggcagcccatgaataaaaaagacactctgtcactcgggaaataccaagtgatatgattggccaatcataaaacattatgttatttcatcagactggcttcatcatgtattagaaacaagttttacatgtaggaattgcttcaatatctatttcagtatcttaaagtctttttctatcagattgataccccataaaaacaaataatcagtgaaatgtttcaaaaatagaaaaaatgtataaaatgagctgggcacagtggctcacacctgtaatcctagaactttgggaagccaaagcaagaggatcacttgaggccaggagttggagaccagcctgggcaatgtagcaagaccccaccctacaatcaatcaatcaatgagaaaaatgtataaagttcatataacctaaatagcctcagtttaaaacatggggaatttattcatgaaattgcacaaaaaattagaaatgcagcacctactgcatgatcaacagttgtttccacactccatttgtgtaaaactgatctatggctcatggctgtaattcctgttcaccaacaccttgtgccttttgtgtctacgcatcttataattatgatcagacagagccattatttgaaaagagccaggatcctctggaattagagcataccgtattctttcggtctcacttgtctcctgggaattccatggctgggcttcatcattttaagtttcttatgctcaccctacttggcattacttcatttcttctcaccatgtaacatctgcttggcagagcaggtgaagacctatggctgccaagtaaaggtggaggtgaaggtgtgtgcaggaccacgtggtctgggacccatctagccagctgtcaattcattggtggtgacagtgaaatgcctttccagctgtgcaccaccctgtactgggtccagttcccagagtcagcaagacagttgtcattgctatattctgcaaagctataatctaacttagagttgaatgccattttgacatcacaccgtgtttgcctcacctcccagaataacatattggtctgtactcaattcagatttttaaattcaccatccctcatgccacatgatgccctgtttgaaaaatctagtgaagaatgtttaggtctctgatgctaatgggaaagtttagtctgaatgcaaggtctcttcagtgcaacctggcacatcaccttcatccaactttgaattttttgttaggcctctgtgttgtgctgacccccaaaagccattcaagatctttaacctgagtgtgccccagcctgttggcagtggatttttggaaagctcagagaccagtagagagaccagggatgaaagactgaggggaaaaaatagggattttctagaaaaaggtatttggaatcaaagaggaatttcaagggagtattagcatctgtctattttataagagttaaaggagagaatgggtaataatgaaatgggagtggccagtacggaccactctcacaaaagaaatatgttaaaacccattgttataggcattttttgagtgaccagaatgcttatgacttcccagtagataatatctcaaagtcatgctctcacaattttacacatgtaaatgggactttctaatctagagaagctgcccaaatactgtcacagaattatttcattcttacttagttggtccagatccaataaatgatagtctaggttttaatggaacccagagaggaaccatagttttgactggagcagtctttcacctaatgtcctcgtctctacataattattagtagcactccttttatgctccaatgtgtacctatttagccaataaattgtttgattaccaaatcagcatgtacgatgagtatggttaagaattttctttatagttcatccaatgagtagtgatgttaggaaatcattggttagaccttaagttatctacagtggtcattctcaaactttagcatgcatcacaaccacctagaggtctcattaaaacaccaattactgggccttcaaccccggagtttctgattctgtagatctggagtaaggcctaagaatttgtatttctaaccatttcccaggtgatctagggaagacagactttgagaaccaccaacttgccaggtacggtggctcacacctgtaatcccagcactttgggaggccaaagcaggcagatcgtctgaggtcaggagttcgagaccaacatggagaaaccctgtctctactaaaaatacaaaaattagctgggcgtgttagatggcatgtgtctgtcatcccagctacttgggaggctgaggcaggagaatcacttgaacccgggaggcagaggttgcagtgagctgagaccccaccattgcactccagcctgggcaacaagagcaaaactccatctcaaaaacaaacaaacaaaaaagagaaccaccaactctcttcctcttgctgggtagaattttgaagacaatggaaaagacttaaagagagacttcacagtttaaagaacaactaaataaaatggcaatgtcagggactagtgaaagaacattagctggtgagctggccggctgcaaacacagtacaatcagatgacagcaggtaacgctctgtgactatgaccatgtggtggacccttccttgagctactctgtaattttaaggtttcatcatcacttgttaaatatttttttttcaaaaggagcagtagacttttagcagatttacccatttatttgtgtgagacaaacctaaaaatatactatcaaaaggtaacagatgcatttaccaaaacggattttattatttatttttttgagggagtctggctctgttgcccaggctggagtgcagtggcgcaatctcggctcactgcaacctccacctcccgggttcaagagattctcctgcctcagtctcctgagtagctgggattacagacacctgccaccatgcctggctaatttttgtatttttagtagagacggggtttcaccatgttggccgggctggtcttgaactcctgacctcaggtgatccacctgcctcggcctcccaaagtgctaggattacatgcatgagccactgcacctggcccaaaacagtttttaattctatttttgcatttttgttgttgcatttggttatggtgctaaacaatttctggggatggtttttctttaggttctcaggtatagtattttctgtatagtcattgtatatagaggtgtgtgtgtgtgtgtatagttttccttgagttctgcatatgagtacttattcctaattctccctctaataagtcatctacagtgaaaataaatataatgatcatatctgaggaatttcagtgacatcctgtcaaagtattaggcaagactgacagaaaagctattttgatttacattttaggaagaaatttattgagttgtggattaactgaaacaattatggagccaaattattattgtttatgactaaagcacaaaatggttgtattatttgaacctcagcataactggaaaatcctgaatcctgtcttcaggttgctcttaaaagatgagcagaggagagatactcagactgtcatggaaaatttgggcagacccctctgtaagagtctacctaaaagactcagatctagtctttctgtaggccaccttgagtctggtgccatcactggctattcagcattttctgagtagtatttgaaaaataaactgcctttttgttttgttttgttgttgacctttttggattttaaggagcaagatgatcttgatgtaacaggcttttcattatcatgatcgaggactttgatcaccaaaatacacttgtaaatacaaaataactgaaagactcagaaagacaatgactgaaccatgagcccagtaaactaaaaattccaatggtaacatgttcaaaggtaaagaggcttttaaggtcagaagcatctttgttgtattaggagaccttcattgtcctggttctgctatgatcttctgatgtgtaactttgggtcagtcatttaatttaacctatcctttatggtctcctccatctccgctagtaagggacattgttcagtggtgtgctagttggtgtttaacaaccaatttgagtaagcctcaattatagcatctgcctatgtccatggtgcaaatactcccaccagggttgatttcaaactgccaacacagtgtcactggatgcagaggtggaaagagatgtgcaccattggtccttacaaatggcgcaacccagttctcttctctgagagaacagctgtgggattttggcctaataatccactttaggggctgaattatccagtctgtctgttcacattaatcatgctaaccaactattttgagctctgtgaatgcgttcttatcctccaggggaaaactgttgtctgtcaagtgtgcattttcaagcacccagtttttgacttcaaagcccccttggcagacattactgtggtatcacctccctgtgtcccactcttgccaccccttctgaagccaccgtcagtgcccacatggactcctgcagtggttctatattgcaaacaacagcaactgactctcgttatcttagggagagaatgaatttgtggaaaggattacaacattcagaggaaagcagaaaccagactcagtatgagcagattccaagagaaaatccaagagctggccagaggtcccacctggggacagcctggttagaggaagagtgccattgctgagtgctggaagctggctccagcacagagggcatcaccacggccagaagccacctctccaactaccgtgaatggaaagaattctgtactgttttgcttcttggcatctcttgttccatatgaaaatctcaggcaagagcatctgatgggtcgccctttggtcatatgactgagctctagctgccacagggagggcagacagagtatcagccttttcagcttctgtcacagaagactggacccaaccttccatcaggaccccacagtaatgatttcctcagatacaggaaggagcttcagattgtgggcagccacacattggacgaatgcccccttgagtattcaataccctattccaaatgttttcccttaatctcaccatgaagaaatctctagtttttgtctatctcagcgagatttgcaaatgtttctacttcatattatttgcagaagaaataaacatttatgttcttttcaaaggaggacaggagatgataactcagattaaaatatggaaattaataagtaataagattaagaaaggcttaaagtcccaaggagattcagtagaattcagaattgacaggaaaagaaaaacacaggaaaaagcaggaagagacatgactggccctgaggaagtccattggtaggaccttgggttgctggtgtccccaacagtctcttccttttttgagacagggtctcaccgtgtcacccaggctggagtatagtggcacaatcacagctcagtgcagcattgacctcccagagctcaagcagtcctcctacctcaatctcctgagtagctggtactacatgtgtgtgctgccactcctggctgatttgtctcttctgatgccaaagctttacctaattatgtttcctttatgggcagaatgtttcccgcttgacatttctgtaggaaaaacagcaatagggatctgggagaatgctgggcaggccccttgctcagaccagcttccccatcatttcatcatcaaatgcatctccagattcctagagacctttgacagattgggccccagtccctgagtctgatgccactacagcatctaggaatcagctggctgatggctgagagcagttctgggagctggactccacctcccctctctgagtgtttctcaccctcatgttgggtcagcattgggaccagtgcccgtccccagagcctcccagcaagtcactcatcagagctggtcactcatcctagagtcctgcttcttcatgttcccggttactgccctagcagtgctgctaaagttattgataagaggccttgtagcttgccagccgtctaagctgccactggatctgagccttcttagacctccccagtcctgggtcactccctcttctctctgtggctctatccctcggtgccctgttggctgggaatgggcaggaccccaccatgagcagatgtagctgatgcattctgtagacagctaaggcttatggttggctggattgaggatgagaagtctgggaccaaaagagaagacacaagtaattgcacttctttatgcagcctctgccctcctgctcatgggggtcagaaagtttctaagagggagagttgggaaggaggaaggaggaggaatgggccaggtgggttctcgggggctgtggtctctattcatagtccaggctgttgtctggggggtgagacccaccacttgccaccacaggaacaaagctaagctcaagggtcctcatcacacttggtatccacacctgttttcccaagtcactgcccagagccctgctttcagacttggtgctatttcaggccacctgggagaggtaggtcttgaagatcacagctctctcaatgccctcaagcaattaagagccaccatctggcatgcagcccatcccagaggatgatttgcagatgagggctagtacatacagtgcctctcgcccccaggatgcccgctgcagaagtttttactgccatctgtctttacccataccaactcccccgctggtctggaaacagtctaaggatggaaattctgacccatgagtctttgaaactccagagcccagtgttcttcctgacaccttttagcattttttgaaatgttggttgaactattttgatcctttttttggcagagggggtcctcacttacctgcttccctccgcctccctaaagtcaggaagccagtagggataggggccttcaggctcacacctacagaagcttagagcccgcaggaccatccataacatggtagtggacagtcctgtcctcctgcaagccctgtgctgggcatgggtcacaccccctcccatcatggctgtgctgcctataaagccaggggttatagaatcagcccatctctcagtaccttccagctgtagcttttttattgtatacctgggccctgctgagattaggagtcccgtgaagtcattttcatcccagaactctcctccttcatgggcactttcatggagactctttttccctctgccattgggagcaatgactagattaaataggctcgtccctggaaggctcctaggccaggatccccttcccaccagcacactgaaagtggtgccatgaaaaaggggccaggcaggaacacggcagtgacaccagcctttgctgggtgccatgcacgtctctaaggcgtgggcttcagccactctgcatatggcctcagctaaccaaggatgctttctgtttgtcatattgctttataattttgtaaaaattcacaaatttataatatgtgagtatataatgtaaatctgatatttgagcatttagatttgagcaatatttcaaggtatgatgataatactctgaagggatttgttgctttgcaaaatctttcaatcctgttttgctttgtgtaactaacacatttcaaatttctcaatccacacaaatttggtactgcaccacatttacaggaatctaacagttcacaaggaagatccagggagatccagacagaatagacagggagacacagaaagaaggatctggttaatacaagcttgaaaatgaatcttcaagtcctgtcacgtgtttttctaatggagcaaaattcactcttactcttcttccctaaccctaaccctgtttttagaatgaattgtcaaggttttcatttatttgtcagtccaagaatagtttttgttgttgttgttttagagacagggtctctgtgtgttgcccagactggagtgcagtggcatgatcatagctcactacagtctctaccttctaggctcgaatgatccttccacctcagcctcccaagtagcttggactataggtgtgcgccaccacacacagttaattgtttaatttttagtagagatgaggtcttgctctgttgaccaagatggactataggtgtacaccaccacacccagttaatttttaaatttttagtagcgatgaggtcttgctatgttgaccaagatggactataggtgtgcaccaccacacccagttaattttttaatttttagtagagatgaggtcttgctatgttgaccaagatggtctcaaactcccaggctcaagcagtcctcccaccttggctcccaaagttctgggattataggcatgcaccatcatgcctagccttagtgttttaatttcaaagaacacaactgtatcctttctctgtcacctgcagtccctgacacttgtcaaacaagactgtgttttctagcccatccttcctccctcatgaatgcaaggcccacatctgagcctctgtgagaaccagttgttttgttgcccaccttgagcagtagttgtatataggtgggtgttcactagaaactggatgaggaatcccaatgccaatgtcatgggtatctcctaattttttgagataatgcctaatctgccctcaaggccaccatgttggtgcaaaggtgagaaactcatcatgcccttactgaaatcgagcagaggtgctggggtacatgagacacgcccccataaccacgccccataaccaaataattaattcttgttccagattattttctaagtctaaagttctaggaaagaagaaatgctgtctttccctgagggatcttccagtaagtaggcagtagcagcgtgacttgtgtggcttttgagagccatttctgctgatgtcttcagacaaaaagtgcaaagagaggaatgcaataggtcatgctgaggctctgggggaaatgcttaatgctcctcagcctagaaggctttgtgaatgaattttagaatggaaaatgcagtataaacataaagctcaggaaaggatggtaaccaagaaaaaccttaggaaatggtcttgtgatagcacattctaagcatagccatcaagtctgtatgcacaggtgaaggtacatattaaatggtttaccaatactccattacaagacatagtatatttcatgggttgttctttattagcagtgtttcagagcattctacaaaatcacagtgaatgtcaactgttgctgcatttctatcagtacctgcacttgcatccgtgataccatacctagagggtttgtgtttctgatttttaataaatcaatcgttagcataccccagaagaagaaatcaagggggcccaaggtatagtagcttctgtttggagattcactgtagtctttgttttccttagcaagttcagaagctaagcatagatatctccattagacatgcagagtgatctggtgcagtgacagaatacaagcttttcaatcaaacagggtggaggtcaaagcctggtttagccactaacaccacctatatgaccttgggcaagtaactaatccccttgcctcagtattgtcatctgcaaaatgggatggaaatagtccctaccttatggaattgtgggtatcggtcatagcatgattaaaaagtgcctgccatttggtaggcagcccacaagtaggatacattactatgatgtagaaccacagttcttgctttttatagcttacccacagtcaacttttaatatgtacctaatagagctaaaaagaccaagacaatttctccaatgttcgcctaacataagccaatcacattatttcttaatctcattctgttatggagaaaaattattacattctttatattttcttgagccagtggacaattaagtaagaatagggatagattatataagagctattccactatgtaatatggaagaacttgcccagaagtggaagtcaggtgcagggacatttgctgctattgtgccttgagacctcaaggaaacctaaactttctaggtttcaggctgggcatttgcagtatactgggtgtgggctgtatggttttgaggctgcttctagccaaaatgccgtgtttctgtttgctcacttggcaagctcaatcttctctcaacaatttgtttttttaagctgtctttacatcatagctcacagaatgacgagctggaagagacacagacaccacctagggtaacattctgattttacagataaggaaactgggactcagagaataaggctttcttcctccttatatcttatagctagttttttgctaagctaaaacaagaaccggggtgtcctgactcatagattggtgctctttccgttatactcccattttccttttcccacagatcagatatcacatttaagaactaaatatgaaaacatagcacagctgattttttttttttttgagaaagtctttactcttgtagcccaggctgcagtgctgtgttaatgatctcagctcactgcaacctccacctcctgggttcaagcgattctcctgcctcagcttctcgagtagctgggattacaggtgcccgctaccacacctggctaatttttgtaattttagcagaggcagggtttcaccatgatggccaggctggtctcgaactcctgacctcaggtgatctgcccacctcggcctcccaaagtgctgggattataggcatgagccaccgtgcctggcccagcgcagctgacttttgacacttgcaacctaatcattttattgaatgactacaaggtttctacacttctatctaatggtcttttaattgcccagagaaatagataactgttagaatttagggataaaagggtatggttgacatggtgtgtgagccctaaagggacttctcagggacatgatggttcatcttggagttttgcattttagaatctttgagaagctctggatttccactcacccacttactaggaccatacattatagcctcagaatctaacagttaatctacatcttccctgactttatactaccctgtggtcaaatatgtttattcctggtgaagtaaggagattatttcattttgaccaaagtcatcctgggaatctaataatcatatgcatgatcgcaagatgtacatagcatgcatgagtaaaccaagaaataacaaactaaatcaaactgctttgttagatggcatacatattacaagtcgacatggagaggaagtggtgtcctgttaactagtatcttctctgtgtgtctgtcctgtggttctggcttaggttaaagtctggggtttaccttcctcttcccctgctcagattgagccttctgtggaagccataagagcagagagagaaacctctgagtatttaattggcagctactttcaatggaaaagcatattcactgtgtaagaatgctgctatattggagttaattttcatgaaaagaatgtacagtaatcccccttctccatggctttgttttctgtgcttccagttacccacagtcaactacagtccaaaaatggtaagatattttgagagagagaaacagaagccacttttatcacagtatattgtcttaattgtactatttcgttattagttattgttaatctcttactgtgcctaatttataaattatccttcatcatagatatgtatatataggaaaaaatgtagtatatctaggattcagtactctccacagtttcagacatccactaggggttttgaaatgtatccacttcaaataagggggactactgtactttctgcagtaattttgaagaaaaatcagttgtggaactgatttttacaagactgctttcttcaaaaaagagaacagaaagcaatcaatttaagttgttttttttttccattgcagtgagaaatgtaaagcattcaactcaggtctcttaaaaattaagaaaaggaaccctaaaatattcaatattaaaatgatttttagttgtacattatatatttgtctcagattaagaccagcagatacacaagggaagggaggagtggaacaagaagcagaaaggtaggagagaaaaggctgagaaacaaacaaaccaaaacacagacagatacaaggagtgaaagaaagattagaaaaaccagaagagggttggaagacagaataatatttaggaacgaagagaaaagatgacaggactgtgtagcttttgcacttaagcacagcttctcattacttttgtcatcctttgtttgaagtcttactctccacctatgaactatatgttccataagcacgagaattgtgctggattttgcttactattgttttcccagtgcctaacagagacatagtaaacacaagcaaggattattaagtgaatggatgaacaaagaaacaaatgaaaaaagagagtgtagggaaagggagttctgtggctcaaatggcaccagctatggtccactgagagctgccattgtttcctcaaaagcaagaggccatggacttggctgatcctggcccctgagatgcttgcaatagtgtttctttggaggcaactttacaaatgctcacacactatctgtgagagttgcagtctactgttagaacaaggttttgcatctgtttcttttggaacctttttgcaggttgatgttttcaccatccctcacattcctggtaccttcttaccccaagcccagtctgtgatgctcccaaatccccctgccccaacaacccctctggaatccttgtgctgttatatgttgaaaaaatctctcccagaatgctgctttcttggctctcccaagaggagccctgtcttagtctgttttgtgttgctgtaacagaatacgtgagactgggtggtttataatgaacagaaatttattggctcacagttctggaggctgagaagtctgttttcaaggtgcccacgtctggtgagggccttcttgctgcatcatcataggatggaaagtgagagggtgagagagagcaagaaaggaccaaacttgcccttttgttacagcaccaatccccacccccatgaggtggaagcctcatagtctaatcacatcttaaaggtcgcacatcttaatactgttacaacgccaattaaatttaaaaattaaattgaattttggaggggacaagcattcaaaccatggtgacccccttctcctttagccccttggtggcagctgcctattttctcaccctgtctgtattaagagccctagaaaagggtcagcactctgggctcctcatcaccaagaaatcaacacacctcaaacctcccataaaaatgcacttttctaatccttcccatcctatcctttaatacctcctggtcacttttgttcattcatacagattttggcccttggccacccacagcctcctcatctaccccaactactgacttgcaggatgacttcaggagtttagtgcacaattcatctaaaagattagcctctgcaaattctgtgattttttttaaatggtggtaaaatatatataacacaaaacttaccattttaccattaaagtgtatagttttgtggcgtgaagcacattcacattgttctgcaaccatcactaatctatctccagaaatttctcatcttctccagctaatagtctgcatccattaaacactaacttcccaagttcagtgatatttacttttaccagacttaaggcactctcaccccaaaattttcatttcctgaagttcttctaccttcggaattttaaattttgttattctattttctgtccacaatctcctgtcttgccaacagactttgatgcagacagatctgagttgggatcccagctaatccagttactagcttcatttcttaatctattttgtgttgctgtgaaggaatacctgggactgggtaatttataaagaaaagaaagttatttaggtcatggttctgaaggctacacaagaagcgtggcaccagcatctgcttggtttctggtgagggcttttgtgctgcgtcaaaatatggcagagaaaggccaaaggggaagtgggcatgtgcaaaaagacaccaaaccaagcatcctggcttataacatcgcactctcatgggaactaatccactcccccgagaacccatccaggctcctaagagtgagaactcaccggacgtggtggctcacgcctgtaatcccagaactttgggaagccgaggcaggcggatcacttgaggtcaggagttcaagactagcctgaccaacatgaagaaaccccatctctactaaaaattcaaaatcagccgggcatggtggcgcacacctataatcccagctactcgggaggctgaggcgggagaatcacttgaatccagggggcggaggttgtggtgagctgagattgtgccattgcacttcagcctggacaacaacaagagtgaaactcagtcttaaaaacaaacaaacaaacaaaaaacaaaaacaaacaaacaaaaaagaatgatagctcacttactactgtgagaatggcaccaagccaattcctgagggatctgacccccgccccccccccccccccaccgccgtgacccaaacacctcccattcggtccacttccaacactggagatcaaatttcaacaggaggtttggagaacgcagacaaaccatatctaaaccatggcacctcactttcttcatttgtaaaattcagataatacgtaatataaatactggatagataacagaacctaagttcacagaattgttgaaaggaataagtgcttaaagagcatttagcacaggtctgttctcctccctccttcctaccagttcacacattaacatgcatcacatcaaccaccactctattgatcttcccagctcccttaaaccttgatcttcctgatgctcatcccagagagacacagcatgctgtgtcagtccagctttctgcctcatctgcacatccacttgggctgtgtgtgagcagctggcccagccacactaccgtgcaagcatttcatgggcccctgttaggtttcctctgctcttcccccacatgcctatttcagatctttcccttttgctctgtctccctacccagccactgtcttctctgtttctgtaaaccagagtccttaacactttaatgatattagaaccacacacattccctgaggtcctgatttggtaagaggtggtggggtgggaatctgcagttttaacaagcaaccaggggattttgatacacacagtgtgcagcccactctttgtggagggctgtcctgagccataagctccttgagagcagacacacagtcttatctgactttcacccctaaatacctaacaatagatgctgaaggattgactgaatgaatgaatctgtcactctgcactttagagtaagttactgttcacctttgaaatgctaattagctacagctgtttaaatgcagtttaaaactcttcaatatattttatctttagttctttatcatcccttttcactgccattgggggtagggaactataaagaacttgttattctctgatgcaacaacaacaaaaagccaacccaagggccaggtaagattgagcctgcagtctagagatacacaaattgggccttgccactgtcacttagggaagaacactccaatgactctcattctagggatcccacaggcagaggttgttgtagccatttcagtggacttctctggaatggaaagagtttcaagcatgatgctcactgctagggatgttgggagaaggtgatttagagaaataggtgagtagacagagacaaagactggcacaccccatcaatgctgcagaggcttcaaatcccagctttgccatttactagcttgtgacaagagtaatgaaacttagagcctcttgtttccttatctgtaaaatggggaccacatgatttaccttgcagagctttggggaggatggaaaaatgtcatataagtaatgcatagtgattctatgatgttagacaatcgagcagagtcttgaagaaagcatctgtcagtctgccacgattggaggaaaaacacacacacacacaaaacacctacatacacccaggctgcctacaaaaacagaagtggaaccagctattgccctgtggggaagtctaactctcacccattgcaataaaatctttccaaagggagcagacagagtaacctcaggccatgccctcccacttccctcttcctcaagtggagctctgagggaggcagagctggtggggagcctttacagaggaagtgggaggtaaagtagtgtgggtggctgaggctgaaacatttcttttaccactttcctataccatccccccacttctcttgtgtgccagggggaaagagaaacagtgcatgcctatgctgtacccacacacacttggatctgctcccccagcctccagaccccacctcatcattcaccatcattcactgaatgcctgcagccttcacggtgctttctaaatgtctcagccggaacctccctggaagcccgtataaagtttgcttcaatatttggggtcttcccccagcccgtgaagaccagtgtctaagccctacttcagcccctccctatgccaggttttctctctccaatttgagtgctaagagactttggtttaaatgttagtaataataaacagctatagacattctccccttccatacttattcccttgttcgcacacatttatttgctttcaggagaagaatttggattggtttcctcggatgcgagccatgtccctcgttagcaatgaaggcgacagtgagcaaaatgaaattcggagccttcaggagaagttggaatcgaccatgagtctggtcaaacagctgtcgggtcagctggcggagctcaaggagcaggtgggtgcattcagggagatggggctgggtgggataaagtcattcaccacttccggtgaggggagacagagggtccagggagccaggtcattatccacagagaattgcaaactccgagaaagaaacctcacgttgtactgtagaaccacatcccagcaaacggggacttctacttatcccatctccctgagcctcacacgacacttctccttctatggaagggggaaaggataaaatgccaaaatacaagcacctctttgcatttaaaaaaaaatcattttctgccatgatagtaattactaagcccatgggaaaggcaaatcctcattagtatctgccatttcaatgctataatgaacccctttatcatataaaattgttagtaaaaatatcaacagtaaccatggtagctattaaaatgactgtggtgatggtgacagctatgtgacaggcaagatctgttttctaaaatggctcctgcttcctaaccacacagaggggtttgctctttttctctgtttatggaaattcacttttaaaaaaatcccttttttgataaatatattctatatgatgctggacagtaggtagttggggaatattaactcaaaacggttgtggcccaccagcactgggtaagagtgagaaaatccgctgaacacacactctctcttttcccccagatgacagaacaaaggaagaataagcagagactgggcttcctcggatcaaacacaccccatgtgaatcatcacatgccaccacactgataccatggggggaagccgtgactagcctttcatcagtgtcctgcctgatcactgaataaagaactgagatggaggggagtgaacagtgcctattgttgaaaagttaaaaacaaccaagtgccaagatgttgagtgggttagctccgagaacaatttataactgtgttttcatggttgcgaagacctaacctcaaatgcatctgctagaaagcgtacatcacacattcgcaatgcatcaggaagaaaaggcttgcccaaaaggctggagagggcagggagcggcaggatggaaggagacacggggcagggagaactctcttctgctaaatcgataggagtcagttttgtcttaaatgctgactacagccactgacatggttggctggaatttctttcttttaattgtggcatataggtttgtgacacaagaagtcatactttggtggctaagttttactaaggaaaataactgaaaagattaaaagtgagagttgaaaagagaaatgataatgcttccaaactgtagctgtcacagggcaatttctttatttataacatgaagcacaatggatttacagctctaggaacttagtactttggagcttttgcctctcacactgacaacataacaggatgtgattgccttctctgggattcagacaggctctgtcaatgtggagcacaaaaggagattttcatataacttgttaaaaacatgttctaagtcatgtataggctaagattttaagaagatctgggggaataaaaagccaacagtaagccccaggaaagggttttttgagaccatatgtatgctattaaaatatattgagattaatacatgaaaatgcttaaaagtgataggaattattgagaaacttatgatggtggcattgccttttataaacatggagtgaaagccatttgactcaacgtttgctgtgcttaaagaattgcttcaggacccgagcgtttttatgtatgctgttcctgcagttaggaaaaaaaaatccaagaaatgtattgaatactcaagaaaatgccacatttcaattacatatttaaaactgtatctgtaagggcttttcaaaatgtagcaagataaaaatctcttattcaaattgtttttgtattaaatcatgcactcagaatttgtcgagggagagaataacctggtgtgttcaggttattcttagagactacacatttggaatagcagagcaaaatatggataatgaaagtgttgggaaaaaagtgatgtgacagggagtgaagacacttgataccagactctgggagatactctgcaagttgacctggcctctcccccacaggaacaaaacactgcctccagagtctttaaattctcagttatcaacgccaaggtttaaggtctagatagggtttgctatagggtttgctctgacaatttttaaagcttttggattgttctaacatagcttaagctattggttcctaaaaatcccaaatcaagatctatgtagaatataaaggaagcctgaaccaatccttccacatactgttaagatgtagacttggaacaaagctgttgggacccagagcaatgaatttttgaactgaagctactggtactccccagcaccacctcatactaagaattcctcactctgacatgacagtattttttctgaccaggagctgaaagaccctgacattcatgatccaaagatataagaaattttgatatgtctgcatgcagcacagaactttgaacctaggaggcagtcaataaatacatgagaaattcagctgtcattcagttactcttaattctttataaaactttaaatgataccacatatttgtttgtttaaaatggctttcccaaaatcaaagtagactaaagcagccatctttaaaatccaggatcatcaatgctattaacagtatcaggtaaaaagtacactttaaaatattttaatcaggcagagttttatggatagagaatagaagagaaaggtagtaaatattgaacatattccaatataggaacctatctctgttttagtacaaaatatttctgacatctgaactagaggtcaagagaataaattcatttgtatacatctgagcaacctgtctttcagatgataaagtatctagccttttctgacaccataatagttcattttgtagggaataagccattaggtgtatataattgctttctagaaatgacctaatgtccccaaccactgtgtagtggcagatcactgtttcacagcatattttctcccaaggaaagtattcaaaagagactgcaactaacaagactcttatttcatcaaaatttaaatatttctgagttgtatttttaatgcctctttcttttctgcctaaatgcttagaaattataaagcaaaaaaaaaaaaaaaaacagcaacaaaaaatcgaagcagacaaaaaaggcacttttcagaacatcaaattcctaatgaagaagaggagaagataatggggaaatttgacatttgatataaatttatatttgttatgtgtatgtttgttaatgcaactggaatatttgacttaggtgagtatcagttaacatccttgtatttatatagtgacatcaaaataaatgcaatcatcttgaactttgatgttaagggagattttgaaaaaatatttagttatttcaaattcatattggttcaaaagtatcagtttctgctgaataatatttttaatttcaaaagggttttgttccctctgtgctccattctgaggctcaagagcttaatgcaagtatgttttctgagttaaaataacacttttagatgagaaaatgcttgtatcatacagggctataatataaataaataaattgtatgtatgcaaaatttatcatattttctaccccttaaaaaattaagttagaaataagcttattttcttgcacatcaatatttttctgttggtaaagaggacacaatttctagtagattgttaataacatcaggaagatatttctttcgtcagaactaattgtgtgcttattcccatattctcagctcataactccctgttttggctgctctctttattttacaattgtttcattgcaaacagcaaggcagtatagcccacactcagccactagcccccagtccccaggactgagaatgagtggggaggctggggagttggtgagagaaggtggagatagggatttctgcttcccagtactctatcattagagaaaaggaggggtaaatattagctaagaagaagaaaaaagcttattcttcagggacccagtagattggacgtaagcaagtaaatattgcacaggcatcatgatgtaatagttgatggaccccagagatacccctcacccatgcagagaacaaagctgtgtggaagagcaactaccataagatggtgtgttccttccagcggctgttaaagccatcctgaataacaaatcagctattcctacctacagacccattccaatatgctgtgatacacgacacggtgcaccgcagaggagacagacatcttcagcacaaacacagatgcctgcaggagcttggcaagtcactaaattgcatgaaattgtgaggtgcacaccaaatgcagggatgggggaggccgtgggaagctctgtattctcaaaatttgacagctaattccggtttttagaaaatgcctgaggccagtagaggccctctagtcactcactgctgctgtttctgatataattattgagaaagctatctcacttaatagaagaaaacacgcactatcaaaaccagatagcctaacgtgcatgtgaaaatcgagaaagctgaaaacaaatccaggtacccttctctgaactggagtgtttccacagacttgaataatttatgaaattatcacaccagtatttctcatatcaccaagaagactttctctcctgcagtagaggattgttatatttgcctaaaaaacacgattccaatatatgacaagggcagataatttataagtgaatgttaataaaattggatgtgtataacttttttgtttgcaatactttaaagtgctttattcatttcttgccatgtttctaagtaatatctgcattggtatgaaaaggcattatgattgctattttacatagcaagacatgaggtataaaaaatttggtgacttgaaccacaccgatgagctaatccagatggactagtgtgcctaaggcttattgggatttggtcaattccccaatgtaccaactagtactggtgcatcacatggtgtctgatgccctgcttgagctcagtgggcacagaccattgggtggcttaggatttcctgattcttaacacgcacagctttaaatgatagttcccctcagaaaagaactgagtgtgcaacagctgaagtcaacatgggtggcacgaatcacatgcaatctggaaatagaattctttgttcatctgggtattttccagtgtgccacagttccttgaagtagtgtggaaacatttgtttgttttgtttgtaatcagaggaaaggttgggggagggcaattggatagggagttcctcttccggtgagagtaattggcacgaagagcgggcagtagtgtgcatgtgggggcagtgtggtggaagtccacaagtcacccttcctttgcctggacaactggggtgctttgaggaagccctaggaaggcctaatgttcagagaacaactccaagccagaatgtgtgtacttcagcctcacctatgttcctcgcccacatcagaggtgctggcacctcacacagagccgcatggcaaacaaaaacagttaccaaatgtgatgctgggagaaaatgtatagaaacagagataagttgttaaactccgtttgactctgtttcccagaaaatgatggcttttactgcttcagtgtggatttccccccagattagccttttcccctttaactctggtccttggggcaagatcagctccaggtagagtggccctactcacagctgtggaaatgtggccacaggcatggatttcctctacgatccccaccccagcacatccttgcaaagctcccctcccctcaggtctacttgcataggacagagctgctttgaaggctgctccctgctctaatgactgtgctttctggtttttttggtaataattatcttcactttggacaattgtatcctcctttctctataccataactcactccctcttccccttcaacgtgggtcaggtgtatctttgtgatcttggacttctaagcactaaattcgaataaaaagtctgtaaccacaataccttaaaattaggccctgcaaactatctgatctttgacaaacctgacaaaaacaagaaatggggaaaggattccctatttaacaagtggtgctgggaaaactggctagccatatgtagaaagctgaaactggatcccttccttacaccttatacaaaaattaattcaagttggcttaaagacttaaatgttagaccaaaaaccataaaaaccctagaagaaaaccaaggcgataccattcaggacataggcatgggcaaggacttcaggtctaaaacaccaaaagcaatggcaacaaaagccaaaattgacaaatgggctctaattaaactaaagagcttctgcacagcaaaagaaactaccatcagagtgaacaagcaacctacagaatggcagaaaatttttgcaatctactcatctggcaaagagctaatatccagaatctacaaagaactcaaacaaatttacaagaaaaaaacaaccccatcaaaaagtgggtgaaagaatagtgaacagacacttctcaaaagaagtcatttatgcaaccaacagacacatgaaaaaatgctcaccatcactggccatcagagaaatgcaaatcaaaaccacaatgagatatcatctcacaccagttagaatggtgatcattaaaaagtcaggaaacaacaggtgctggagaggatgtggagaaataggaacacttttacactgttggtgggactgtaaactagttcaaccattgtggaagacagtgcggcgattcctcagggatgtataactagaaataccatttgacccagccatcccattactgggtatatacccaaaggaatataaatcgtgctactataaagacacatgcacatgtatgtttattgcggcactgctcacaagacttggaaccaactcaaatgtccaacaatgatagactggattaagaaaatgtggcacatatataccatggaatactatgcagccttaaaaaaaatgatgagttcatgtcctttgtaggaacatggatgaagctggaaaccatcattctcagcaaactatcgcaaggacaaaaaaccaaacatcacatgttctcactcataggtgggaattgaacaatgagaaaacttggacacaggaagggggatatcacacaccagggcctgttgtggggtgggcgggggggggatagcattaggagatatacctaatgtaaatgacgacttaatgggtgcagcacaccaacatggcacatgtatacatatgtaacaaacctgcacgttgtgcacatgtaccctagaacttaaagtataataaaaatatatatatattaaaaattaggccctatggtgttaaaaatatgaatgtacaactatcaattagggtctatcagggaaacaaaatcagtatgggtatcctgggctgaaaattttattttaggcattagataccatgcagttatggtaaagacctctccggaaagctaatgcttctgtgtctggtggtaggccttaagtcactgtgagtcagttgggctggcagtcaggaaggaaagctgggtatgaagcgggagagagcgaagacaagccggactcatgaagacaagctggactcatgaagactcatgaagacaaaccaaaatttgcatctagctctcaccacctccaaactccatagtgtgggtgacctaaaaacaaagctggcacccttcctcatggcattgcatgtgcatctgacccaggactcagatgagctgaaggaagagatctcatgggagctggaggactgtgggctagctactgcccacaccaacagagtgagccaggagatgaggctgggagctgcagcggcacctgttgcctgctccttctgagcttagtgactgtgcatcacttccactttccaaatctcgtgaaaatatctcctgtggtcatatctaatgtgtaactctatgagtaagggaattctaagaaattctgtagttccgggttagctagttatatagttcagaacctctccactggagtagacctcagtagtgatacccctttgcctagtttatgcacagaagtcacgcttctcagcacccattgcaactgagtggcaacacatggctacttctcaccaatggattgtgaggccagctgacaatctgaggcttcaaaagcccctatacagctctcagttcttttcctgccacatcaatcatggaggccaagacggaaccaccctaaatccctgagatttaaatctctgaatctttgaagggaactaccctggagaaccttgagacccacagcagaattggtgagaaataaacttttatgtgttaagccattaaaatttaaggatttttatttctttttggtgttgttaaataaatgtatgtgataacttgttactgcaacataacccagccacctgactaacacagacatatgtattaggcatcaggatgttactagtggaagagatctgagttaccccgagttactggtagccaatctgtacagatctgcagcaacctcaactcttgccttcttggaagaaataattcaactgaggggcataaagcataaaaagagactgaggcaagtttcagagcaggagtgaaaaagctttagaacagcaaggaaaggaaggaaaggaaagaagggaagtataacttgaagagggccaagtgaatgacttgagaaaccaagtgcgtagcttgacctcttgactcgggcctacttccaggatttgccttacttcccccaactcctgagatcttactgggaagctgctgatcagtttcaggtgttttctgcctgttgggaaactgcctttctctggtgccagctgtgaccaattactactttagagaaacagttaacaaatgcctgaccatcacctgatggtcgcccaatgctcttggtgtgtgtgtcaggctgggggtcctctcctgccctgctcatacatgactagctacctactgtcatgagaaaattgactcaaatacctaacttctgggatttatccaagaaaaatataaactaagaaaaagatctgtacagttgtaccttggtatttggggagtactggttccaggacctcccccacccacagatattgatattgaattccacagattttcaagtccctgatataaaatgacatagtatttttatataaccaacaaacctccttctgtgtactttaaatcatctctaagttacttacaacacctaatacaatgtaaatgctatataagttgctattatgctgtattgtttaggagataatgacaagaaaaaaagtctgtacatgttcagtacagatgtaaacattaatttcttttcccaaatatcttttatctgcagttgattgactccacagatgcaggacctacagatacagagggccagctgtgtatacaaaatactcatcatattattatttataatttaaaaattgaacatagtccaaatgtccagcgacttgggtgtgtttaaaattttataattgagacataggttggaatgttatgaaacctatgagaagtatatacattgaggcaatactggtaaataggcagaataaatgttttaaatggctacaaaattgtatatacactattatcttcacgatataaaaaagccaacttctccaaaaaacttgaacagaatatagtacaatgatattcattgtaaaatagctgtagggtatacattattttcctttttctttactttctaaactttttatcattttaaaagttgcttttatagtgtaataataacatttttaaaaagaaatgaagatcctaatgactaaaatccagcaagtatttcctaagaacaagttcttccaaactcatttgcattttgataggatcactagaattgtagattaagtgaacaccatagccacagtttaaattgatttcaacaagacatttaagaaaagtttccatgatgttcctgttgacaagatagagaaatttgtcctggatgagaatggagcttaccaatttgcatgcaagtgaacaatttcacttaatatgagactagagtaaaatatccttggcctgctgttagatctctgtccttggcttttcccaaccaacatttatttaaatgtctggaagaaagaaataacaaaattataaaatgtggaaatgacataaagttggaaagtagatttaacatgattgatgacagagtaacaataatatcagaaaactggaacaatgaacaaagctattttgaataactttaactgaaaaatgcaaagtttagctccaaaaagctcagtttcataaatataggatagaacagatagccattcatgtgaaaaacaaacaaatattgagatttttgaatagcctctacctccatgcctatatatttatttgtctcaacaaatatttatttagtacttgttatatttaaggaatttttcagtggtccaggcaagacaggatagtggttttatcttaaggagtcggctctagggacagaaaaaggagttggttacaaaaagtattcaaaatgatgagcttatccttgaatatgtgagttttagttattttagagacacccaggaagaaatatttgtttgaccattggatatataggtctagactctgaaaaaaagctagggctagaaataaaagatgacagagtcatcgggacatacatggtaatgagatcaaaggaacgaatgaatgctgaaagagagagtagatattaagaagagaagtttgaggacacagccccgaagaaaatctagcaaaaaatattaaaataagaaagaaaaccagtgagctagtgagagaacaaaaagaaatgaagaaatgatgtttcagaagttaagagaagagtttcaaaaagatgtagaacttccaggcaagtatgcaggtagaccatcagagcctgattagctcttccgaactctgtattcacaagcatagagaaaccagaaaggaaaccatacctcatagtacaacataaaaacaaaatatcttaatcattcgttgactaaataacataataccattactgaagctaagaaaagtctgttaaggaacttttctaactgtgtcttgtacaacacactagacattccattctgagaattagttcatggatagctgaaagaaagaaattaggagaaaactttgactgattcccacaatttgtcactgatttcaggacatgggccacactcatctggataggtggccatcccatttatttatttatttatttatttatttatttatttatttatttttaatttttgtttttttgagacagcatcttgctatgtcacccaggctgtagtgcagtggcaagatcttggctcactgcagccaccgcctcccgggctcaaacaattctcctgcgtcagcctcctgagtagctgggattacagatgtgtgccaccacgcctggctaatttttgtatttttagtagagatgggattcaccatgttagccaggctgatctcaaactcctgacctcgtgacccacccgccttggcctcccaaagtgctgagattacaggccaccacctcccgaccagccatcccttttaacacgagaactatttctgagttcttcagttccagtgtcaacttcccctttctctcttgcatttccatcagatcttctcattccacctctaaagataaacttcctgtgcttgacactacaggaagtagaacaggctaggagagaagctaagtgcatcttggcatatttaatcaatgaaggaaagtgttaggagcctgggtaggaagatttctgggactagtacttgctgcggcactgtaggtctgtgtatatatattagtggaaaataatgcactgcctctgactttaagagaagctagaatcagtgtgggaggatgcactttggctctctaagggttgcttattgggcactgcaatttgggctgccagccatgcctatcaacctgcctcaagcaagaagagcaaagaggaagtgaggaaaatgttctactaaaaggaactctgcattcttcttccttcagcattgctgattgagagcacctggaaaggtggtgcagaattgcttcagtgtagcaggagatgccctagagaagccagccttgccaaactttcaagtcagccttcacacagtagggatgccactgaatatcgaactaaaggaagtggtggcagaagagccttctctgcatttcaattttttaatacccctctaaatttgattacaggaaaaactataaatagtatgattgatagaagattttaagtgagaagcacattactattagttcaaactcacctgtaataggctccaatgttctggcttcaagatacacagcaggtggcaatttgcctgtgctactcaacaatttcaacatagttctactgcttcgatacatacattgtagcatgtccctttcttggcttaaaataacgcagcagggctgtgtgtgggcatgcacacagataaacacaagtaataaatgcactatattacaaagtattgagactgattttgtttgcacccttcacgatctcattattctttaacccccgggctggctcagtgaatgaactatgaaggcagccaacacacacagcatgatggtcaattctgggagggccatgcccctccctgcttggccagactccactgtctcctatctgatttgaattgtccattattcattagtcactttttaaaatttaatataattgtggaagaattgggtataaagtgggtaaatggctttagaagacactctattgaaaaagcactgttgggaggagagtgatgactgtgatagcctgtcacttttccattagatcatattggctaatagtcgatgatgtacccctaaatgtggtaatttgttgagtgccaactctgtgcctatatcttctaggggagagtggcaggcagggagtgaatcaaaataaaaagatatggcatgtcttaaaatgacttaacagctactgagaagtacaggtgcacagacaattttgaagccaggtggcaggtgagataagagaggtagactgtgggacccagaggaaggcgcttggaggagaggagagagaggatcacagatggagaattcacattcttgtaaaactagtaacagctaacattccctgtatgcgtcctcagggtcaggtcctcttctaagtttgaacttatttaatgctcatacaactccatgaaataagtatataattatctctagtttaaagatgaggaaactgaggcatggggtggttgagcaatttgccaaaagtttcacaacaggtaagtggtgatgagaatagaggcagtgtcattccagaatccatccttttagcctacattctgtgccctaaagacaaatagagatgcgggatgaataaggttcaaggaggaatgggactgtagctattaagactgcatgttcttggccctacacaccaaattcatatgctgaaatcctaacctgcagtatgatggtattaggagaagggtcctttgaggagtaattaagtagaggcctcatgtgtggaatgagtgcctttaccagaggaacccacagagctctctctctttccatcctgtgatgatacagtgagaagtcatcagcctgcaacccagaagaggaccttcaccaggaaccgtatcagctgacaccgtgatcttggacttctcagcctccagaactgtgagatataaatttctgttgtttaagccatccagtatacggtattctgttatggcagcccaaacaactaagaccaccgcagtgttttttaatatttaaagtaaggtaaaagcaggaggaaagctaggcaactcttggaacaggaacattcaggataaacacctgaaagaagcgaagtaatgaagccaagctctacctcttcctacctttattaacaaacatccatcaggcccaggatcatcccaggcactgagcaaggcactggggatacaaagataaataaaacaagcattgttttgggggagctcacatttcaaggatgtgataagccaaaaatagattttaatacaatgtagtaaatctattggcagggtatagaaggtgctgtgggcgctcaaaagaagaagttgctacgtccaaagtgttgagagagactgtgaagaattgaatgggaatttagaagtggccaaggaaagggctcagggagagggacactgaagtcgcaggaagcgtgaaagcaaactgagagagcggagagaaagaaacaggcttcatggaacagccagtcaaaagggcctttgtgtcatggagaggtagctgtgaaattgttctagattattatcccaaggaataatgggggaagccccaaagcttttatacaggaagcagaacccaatcatgtttagttttagggatatgactggaggaagaaggaaggaaggatggtgtattagggttctctaaagggacagaacaaataggatattcattaggatatatatacatatacatattagtatatatgtatatatgtatgtatatatgtatgtatataaaggggagtttattaagtattaaatcacatgatcacacggtctcacaataggctgtctgcaaactgagaagcaaggaaagccagttcaagtcccaaaactgaagaacttggagtccgatgttcgagggcaggagggatacagcatgggagaaagatgtaggccaagctagccttttcacatttttctgtctgctttatattc

SEQ ID NO: 126 - DNA, 12850 bp, Homo sapiens
acgcgcccgctcccccgccggggtcccccgccgcccctccagcgccgcccagcgtcgcgtccccgcgcgggccggtgcggcggcagcagaggcttcccgggtggcccggcctcccgagggtcgccccgccccggcccagctccgcccccggccgctgctccctgattggccgcccccccacctctccagggctcctctcctcctcctcgcccaatgggcaccggcacctggtccaaaaattcccctgaggggaccgagggggctcggccacttccagctcccgccgggcggctgtgacggccgcagcgggtcgcagagcagggagtggacacggagtggggagcggagagggaaggaggaggaggaggagcaaaggtgttggagagaaaacttcagaaaggaacaggaaacctgccggggaggcggcggcggctgcggcttctctgggcgcctgggctgcgctcttcgcggggtgtccgcagctgcggcttggccccggtctggcttccccggcgcgcacgcacggctgagccgcgacgctcagtggctcgggccgtgccctccgccgcggctcttggccgctgtagtcccgcgatccgatccgcttctgccgcggcggctccctggagagagggcggcgagggcgcagggaagaagagggacgtccactgtggaacatgaagcagcatgactgagaaaatgtccagcttcctctacataggggacatcgtgtccctgtacgcggagggctcggtcaacggcttcatcagcaccttggggttagtggatgacagatgtgtggtgcacccagaggccggggaccttgccaaccctcccaagaagttcagagtcacagactgccttttcaaggtgtgccctatgaacagatattctgcccagaagcaatattggaaagcaaagcaagccaaacaagggaaccacaccgaggcagccttgctgaagaaactacagcacgctgcagaactggaacaaaaacaaaatgaatcggagaataagaaactgttgggagaaattgtaaaatacagtaatgttatacaactactgcatataaaaagcaacaaatatcttactgtcaacaagagattacctgctttactggagaagaatgccatgcgtgtgtccttggatgctgcaggaaatgaagggtcttggttttatattcatccgttctggaaactgagaagcgagggtgacaatattgttgtaggagataaagttgttttgatgcctgtgaatgcagggcagccactacatgccagcaacatagagcttcttgataacccagggtgtaaagaggtgaatgctgtcaattgcaacaccagctggaaaatcactttattcatgaaatatagttcctatcgagaggatgtattaaaaggaggggacgttgttagattatttcatgcggaacaagagaagtttttgacttgtgatgaatatgagaaaaaacagcacattttccttcgtacgaccttgcgccaatcagctacttctgctactagttctaaagcactctgggaaatagaggtggttcatcatgacccatgccgtgggggtgcaggacagtggaacagcttgttcagatttaagcatcttgcaactggaaactatttagctgcagagcttaatcctgattatcgagatgcccaaaatgaaggaaaaaatgtgagagatggagtccctccaacttcaaagaaaaaacgccaggcaggggagaagatcatgtatactttggtttcagtcccgcatggcaatgacattgcatccctttttgaactagatgccacaactcttcagagagctgactgcctggttccaaggaactcatatgttcggttaaggcatttatgcaccaacacatgggtaaccagtactagtatccccatagacacagatgaagagaggcctgttatgttaaagattggaacctgccaaaccaaagaagataaagaagcgttcgcaatcgtgtctgttccactgtctgaagttcgagacttagactttgccaatgatgccaataaagtactagcgaccacagttaaaaagctagaaaacggcacaataactcagaatgaaaggaggtttgtaaccaaattattggaagatctcatattctttgttgctgatgtgcctaataatggacaagaagttctggatgtggttatcactaagccaaaccgagagcgtcaaaaattgatgagggaacaaaacatactggcacaggtatttggaattcttaaagcaccctttaaagagaaagcaggagaaggctcgatgctgagacttgaagatctgggggatcaaagatatgcaccctacaagtacatgctgcggctctgttaccgcgtcctgagacactcgcagcaggattaccggaaaaatcaggaatatattgctaagaatttctgtgtcatgcagtcccagattggctatgatattttggcagaagatactatcacagctttgttgcacaacaacagaaaactactagagaaacatatcacagcaaaagaaatagaaacatttgtcagtttactcaggagaaatcgggagccaaggtttttggattatttgtcagatctgtgtgtgtctaataccactgctatccctgtaactcaagaactcatctgtaaatttatgttgagtccaggcaatgcagacattctcattcaaactaaggtggtctcaatgcaagcagacaaccccatggagagctccatcctttcagatgacattgatgatgaagaagtttggctctattggattgacagcaacaaggaacctcatggcaaagctatcaggcaccttgctcaagaggcaaaagaaggcaccaaagctgacttagaagttcttacctattacaggtaccagctaaacctctttgcaaggatgtgcttggatcgccagtatctggccataaaccagatttctacacagctgtctgtagacctgatcctgcggtgtgtgtcggatgagagcctgccgttcgacctccgagcgtccttctgtcgcctcatgctccacatgcacgttgaccgggatccccaggagtccgtggtgcctgttcgctatgccaggctctggacagaaatccccacaaagatcacaattcatgaatatgattctataacagactcttccagaaatgatatgaagaggaaatttgccctgacaatggaatttgttgaagaatatttgaaagaagttgtaaaccagccctttccttttggggataaagaaaaaaataaactgacatttgaggtggtccacttggctcggaatcttatatactttggattttatagtttcagtgagttattaaggctaacaagaacacttctggctattttagacattgtacaggcccccatgtcatcatactttgaaagattaagcaaatttcaagatggaggaaacaatgtgatgagaaccattcatggggtgggagagatgatgacccagatggtactcagtagaggctccatcttccccatgagcgtgccggatgtgccacccagcatccacccgagcaagcaagggagccccaccgagcatgaggatgtgactgtgatggacaccaagctgaagatcattgagattttgcagtttatcctgagtgtcagactggattataggatctcatatatgctgtcaatatataagaaggagtttggagaggacaatgacaatgcggagacatctgccagtggatctccagacactttactaccatcagctattgttcctgatatagatgaaattgcagctcaggcagaaactatgtttgcgggaagaaaagaaaaaaatccagttcaacttgacgatgaaggaggcaggacgtttttacgggtcctcattcatctgatcatgcacgactacccgcctttgctgtctggagccctgcagctgttgtttaagcacttcagccagagggcagaggttttacaggcatttaagcaggtgcaattactggtgtctaatcaagacgtagataactacaagcaaatcaaggcagatctagaccagcttcgactgacagtagaaaagtctgagctatgggtggagaagagcagcaactatgagaatggagaaataggggaaagtcaagtgaaaggtggtgaagagccaattgaggaatcaaacattttaagtccagtgcaggatggaacaaagaaacctcagattgacagcaacaagagcaataactaccggattgtaaaggagattttgatcaggctaagtaaactctgtgtgcagaataaaaagtgtcggaatcaacatcaacgattactgaaaaatatgggggcgcattcggtggtgttggatcttctgcagataccctatgaaaagaatgatgaaaagatgaatgaagtaatgaatctagcccatacatttctgcagaatttctgtcgaggaaatccacagaatcaagttcttcttcataaacatctgaatttgtttttaactccaggtctccttgaagcagaaaccatgcggcacatcttcatgaacaattaccatctgtgcaacgaaattagcgagagagttgtacaacactttgtgcactgcattgagacacatggccgccacgtggagtacctgaggtttttgcaaacaattgtaaaagcagatggtaaatatgtgaagaaatgccaggatatggtaatgacagagttgataaatgggggtgaagacgtgctgatattttacaatgatagagcatcatttccaatccttctccatatgatgtgttcagagagagaccgaggggatgagagtggccccttagcctaccacatcaccctggtggagttgctggcagcatgcacagaggggaaaaatgtctacactgaaatcaagtgtaattcccttctcccgctggacgacatagtgagggtggtgacccatgacgactgcatccctgaggttaaaattgcttatgtgaactttgttaatcactgttatgttgacactgaagtggaaatgaaagaaatctatacaagtaaccacatttggaaattatttgagaacttcttggtggatatggcaagggtttgcaacacaactacagacaggaaacatgcagacatctttttggaaaagtgtgttactgagtcaataatgaatattgtgagcggcttctttaattctcccttttcagacaatagtaccagcctccagacacatcagccagtttttattcagctactgcaatctgccttcagaatttacaattgcacctggccaaacccagcgcagaaagcctcagtggaatcctgtatcagaactttggctgaagtggcaaaaaatcgtggaattgccattccagtggatttggacagccaagttaatactcttttcatgaagagccattcaaatatggtgcagagagcagcaatgggttggagactatcagctcgctctgggccacgctttaaggaagctcttggagggcctgcttgggattacagaaatattattgaaaagttacaggatgtagtggcctccttggagcaccagttcagcccaatgatgcaggctgaattctcagtgttggttgatgtattgtacagtccagaactgctgttccctgagggaagcgatgcaagaataagatgtggcgctttcatgtcgaagttgattaatcatacaaagaaactaatggagaaagaagaaaaactgtgcattaaaattcttcagacattacgagaaatgttagagaagaaagacagctttgtggaagagggtaacacattaagaaagatacttctgaatcgatactttaaaggtgattatagtattggtgtgaatggacacctatcaggagcctactccaaaactgcacaggtgggaggaagcttttctggacaagattcagataagatggggatatcaatgtcagacattcagtgtctgctggataaagaaggtgcatcagaacttgtcatcgatgttatagtgaacaccaaaaatgacagaattttttcagaaggcattttcctcggcattgccttgcttgaaggaggaaatacacaaacacagtattctttctaccagcagttgcatgaacaaaaaaagtcagaaaaattctttaaagttctctatgatcgaatgaaggctgctcagaaagaaataagatcaacagtgacagttaataccatagatttaggtaacaaaaaaagggacgatgacaatgaattgatgacatctggtccacgaatgagagtaagagattcaacactacatttaaaagagggaatgaaagggcaattaacagaagcttcttcagcaacatccaaagcatattgtgtatacagaagagaaatggatccagaaatagacattatgtgcacaggaccagaagcgggaaacactgaggaaaaatccgcagaggaagtaacaatgagtcccgcaattgccatcatgcagccaatactgagatttcttcagttactgtgtgagaatcacaaccgggaattgcagaacttcttgaggaatcaaaacaacaaaacaaattacaacctagtctgtgagacccttcagtttctggactgcatttgtggaagtacaaccggtggcctgggcctgttgggtctctacatcaatgagaagaatgtagcgctggtcaaccagaacctggagagcttgactgagtattgccagggcccttgccatgaaaatcagacctgtatcgctacacatgagtctaatgggattgatatcatcattgctttgattctgaatgacataaaccctcttggtaaataccgaatggacctggtgctccagctaaagaacaatgcatctaaacttttgctggccattatggaaagcagacatgacagtgagaatgcagaaagaattctttttaacatgagacccagagaactggtggatgtgatgaagaatgcctataaccaaggattggaatgtgaccatggggatgatgagggtggagatgatggtgtttctccaaaagatgttggacacaatatctatattctggcccatcagttggcccgccacaataaactgttgcagcagatgctcaaaccaggatcggatccagatgaaggagatgaagccttaaagtattatgccaaccacactgcacagattgagattgtccggcatgataggaccatggaacaaatagtttttcctgtccccaatatatgtgaatacctcactcgagaatccaagtgccgtgtgttcaatacaactgaaagggatgaacaaggaagtaaagtgaatgactttttccagcaaacagaagatctctacaatgaaatgaagtggcagaagaaaatcaggaataaccctgcactgttctggttctcgaggcacatctctctctgggggagcatttccttcaacctggctgtgttcatcaatttagctgttgctctcttctacccatttggggatgatggagatgaaggtacactttctccattgttctcggttcttctttggatagcagttgcgatctgcacatctatgctgtttttcttctccaagcctgtgggtattcggccgtttcttgtatcaataatgctcagatcaatatatacaataggtcttgggcctacattaatacttcttggtgcagctaatctttgtaataaaattgtttttctggtgagttttgttggaaatcgtggcacgttcacccgtgggtaccgagcagtcatcctggatatggcctttctctatcacgtggcgtatgtcctggtttgcatgctgggcctttttgtccatgaattcttctatagcttcctgctttttgatttggtgtacagggaagagactttgctgaatgtcataaaaagtgtcacacgaaatggccgctctattattctaactgcagtcctggctctcatcctcgtctacctgttttccattattgggttcctttttttgaaggatgacttcactatggaagttgataggctgaaaaaccgaactcctgttacaggcagtcatcaagtgcctactatgactttaactaccatgatggaagcatgtgccaaggagaactgttcacccacaattccagcttcaaatacagctgatgaagagtatgaagatggaattgaaaggacgtgtgacactctccttatgtgcattgtcaccgtgctgaaccagggcctcaggaatggcggtggtgtgggggatgtgctaagaaggccatcgaaagatcccttgtttgctgcccgagtggtttatgaccttcttttttatttcattgttatcattattgttctgaacttgatttttggtgttatcatcgatacttttgctgatctcagaagcgaaaaacagaaaaaagaagaaattctaaagacaacttgtttcatctgtggacttgagagagacaagtttgataataaaacggtttcatttgaggagcacattaagtcagaacacaatatgtggcattatttgtacttcatagtcctggtgaaagttaaagacccaacagaatacactggacctgaaagttatgtggctcaaatgattgtggagaagaatttggattggtttcctcggatgcgagccatgtccctcgttagcaatgaaggcgacagtgagcaaaatgaaattcggagccttcaggagaagttggaatcgaccatgagtctggtcaaacagctgtcgggtcagctggcggagctcaaggagcagatgacagaacaaaggaagaataagcagagactgggcttcctcggatcaaacacaccccatgtgaatcatcacatgccaccacactgataccatggggggaagccgtgactagcctttcatcagtgtcctgcctgatcactgaataaagaactgagatggaggggagtgaacagtgcctattgttgaaaagttaaaaacaaccaagtgccaagatgttgagtgggttagctccgagaacaatttataactgtgttttcatggttgcgaagacctaacctcaaatgcatctgctagaaagcgtacatcacacattcgcaatgcatcaggaagaaaaggcttgcccaaaaggctggagagggcagggagcggcaggatggaaggagacacggggcagggagaactctcttctgctaaatcgataggagtcagttttgtcttaaatgctgactacagccactgacatggttggctggaatttctttcttttaattgtggcatataggtttgtgacacaagaagtcatactttggtggctaagttttactaaggaaaataactgaaaagattaaaagtgagagttgaaaagagaaatgataatgcttccaaactgtagctgtcacagggcaatttctttatttataacatgaagcacaatggatttacagctctaggaacttagtactttggagcttttgcctctcacactgacaacataacaggatgtgattgccttctctgggattcagacaggctctgtcaatgtggagcacaaaaggagattttcatataacttgttaaaaacatgttctaagtcatgtataggctaagattttaagaagatctgggggaataaaaagccaacagtaagccccaggaaagggttttttgagaccatatgtatgctattaaaatatattgagattaatacatgaaaatgcttaaaagtgataggaattattgagaaacttatgatggtggcattgccttttataaacatggagtgaaagccatttgactcaacgtttgctgtgcttaaagaattgcttcaggacccgagcgtttttatgtatgctgttcctgcagttaggaaaaaaaaatccaagaaatgtattgaatactcaagaaaatgccacatttcaattacatatttaaaactgtatctgtaagggcttttcaaaatgtagcaagataaaaatctcttattcaaattgtttttgtattaaatcatgcactcagaatttgtcgagggagagaataacctggtgtgttcaggttattcttagagactacacatttggaatagcagagcaaaatatggataatgaaagtgttgggaaaaaagtgatgtgacagggagtgaagacacttgataccagactctgggagatactctgcaagttgacctggcctctcccccacaggaacaaaacactgcctccagagtctttaaattctcagttatcaacgccaaggtttaaggtctagatagggtttgctatagggtttgctctgacaatttttaaagcttttggattgttctaacatagcttaagctattggttcctaaaaatcccaaatcaagatctatgtagaatataaaggaagcctgaaccaatccttccacatactgttaagatgtagacttggaacaaagctgttgggacccagagcaatgaatttttgaactgaagctactggtactccccagcaccacctcatactaagaattcctcactctgacatgacagtattttttctgaccaggagctgaaagaccctgacattcatgatccaaagatataagaaattttgatatgtctgcatgcagcacagaactttgaacctaggaggcagtcaataaatacatgagaaattcagctgtcattcagttactcttaattctttataaaactttaaatgataccacatatttgtttgtttaaaatggctttcccaaaatcaaagtagactaaagcagccatctttaaaatccaggatcatcaatgctattaacagtatcaggtaaaaagtacactttaaaatattttaatcaggcagagttttatggatagagaatagaagagaaaggtagtaaatattgaacatattccaatataggaacctatctctgttttagtacaaaatatttctgacatctgaactagaggtcaagagaataaattcatttgtatacatctgagcaacctgtctttcagatgataaagtatctagccttttctgacaccataatagttcattttgtagggaataagccattaggtgtatataattgctttctagaaatgacctaatgtccccaaccactgtgtagtggcagatcactgtttcacagcatattttctcccaaggaaagtattcaaaagagactgcaactaacaagactcttatttcatcaaaatttaaatatttctgagttgtatttttaatgcctctttcttttctgcctaaatgcttagaaattataaagcaaaaaaaaaaaaaaaaacagcaacaaaaaatcgaagcagacaaaaaaggcacttttcagaacatcaaattcctaatgaagaagaggagaagataatggggaaatttgacatttgatataaatttatatttgttatgtgtatgtttgttaatgcaactggaatatttgacttaggtgagtatcagttaacatccttgtatttatatagtgacatcaaaataaatgcaatcatcttgaactttgatgttaagggagattttgaaaaaatatttagttatttcaaattcatattggttcaaaagtatcagtttctgctgaataatatttttaatttcaaaagggttttgttccctctgtgctccattctgaggctcaagagcttaatgcaagtatgttttctgagttaaaataacacttttagatgagaaaatgcttgtatcatacagggctataatataaataaataaattgtatgtatgcaaaatttatcatattttctaccccttaaaaaattaagttagaaataagcttattttcttgcacatcaatatttttctgttggtaaagaggacacaatttctagtagattgttaataacatcaggaagatatttctttcgtcagaactaattgtgtgcttattcccatattctcagctcataactccctgttttggctgctctctttattttacaattgtttcattgcaaacagcaaggcagtatagcccacactcagccactagcccccagtccccaggactgagaatgagtggggaggctggggagttggtgagagaaggtggagatagggatttctgcttcccagtactctatcattagagaaaaggaggggtaaatattagctaagaagaagaaaaaagcttattcttcagggacccagtagattggacgtaagcaagtaaatattgcacaggcatcatgatgtaatagttgatggaccccagagatacccctcacccatgcagagaacaaagctgtgtggaagagcaactaccataagatggtgtgttccttccagcggctgttaaagccatcctgaataacaaatcagctattcctacctacagacccattccaatatgctgtgatacacgacacggtgcaccgcagaggagacagacatcttcagcacaaacacagatgcctgcaggagcttggcaagtcactaaattgcatgaaattgtgaggtgcacaccaaatgcagggatgggggaggccgtgggaagctctgtattctcaaaatttgacagctaattccggtttttagaaaatgcctgaggccagtagaggccctctagtcactcactgctgctgtttctgatataattattgagaaagctatctcacttaatagaagaaaacacgcactatcaaaaccagatagcctaacgtgcatgtgaaaatcgagaaagctgaaaacaaatccaggtacccttctctgaactggagtgtttccacagacttgaataatttatgaaattatcacaccagtatttctcatatcaccaagaagactttctctcctgcagtagaggattgttatatttgcctaaaaaacacgattccaatatatgacaagggcagataatttataagtgaatgttaataaaattggatgtgtataacttttt

SEQ ID NO: 127 - protein, 2684 aa, Homo sapiens
MTEKMSSFLYIGDIVSLYAEGSVNGFISTLGLVDDRCVVHPEAGDLANPPKKFRVTDCLFKVCPMNRYSAQKQYWKAKQAKQGNHTEAALLKKLQHAAELEQKQNESENKKLLGEIVKYSNVIQLLHIKSNKYLTVNKRLPALLEKNAMRVSLDAAGNEGSWFYIHPFWKLRSEGDNIVVGDKVVLMPVNAGQPLHNIELLDNPGCKEVNAVNCNTSWKITLFMKYSSYREDVLKGGDVVRLFHAEQEKFLTCDEYEKKQHIFLRTTLRQSATSATSSKALWEIEVVHHDPCRGGAGQWNSLFRFKHLATGNYLAAELNPDYRDAQNEGKNVRDGVPPTSKKKRQAGEKIMYTLVSVPHGNDIASLFELDATTLQRADCLVPRNSYVRLRHLCTNTWVTSTSIPIDTDEERPVMLKIGTCQTKEDKEAFAIVSVPLSEVRDLDFANDANKVLATTVKKLENGTITQNERRFVTKLLEDLIFFVADVPNNGQEVLDVVITKPNRERQKLMREQNILAQVFGILKAPFKEKAGEGSMLRLEDLGDQRYAPYKYMLRLCYRVLRHSQQDYRKNQEYIAKNFCVMQSQIGYDILAEDTITALLHNNRKLLEKHITAKEIETFVSLLRRNREPRFLDYLSDLCVSNTTAIPVTQELICKFMLSPGNADILIQTKVVSMQADNPMESSILSDDIDDEEVWLYWIDSNKEPHGKAIRHLAQEAKEGTKADLEVLTYYRYQLNLFARMCLDRQYLAINQISTQLSVDLILRCVSDESLPFDLRASFCRLMLHMHVDRDPQESVVPVRYARLWTEIPTKITIHEYDSITDSSRNDMKRKFALTMEFVEEYLKEVVNQPFPFGDKEKNKLTFEVVHLARNLIYFGFYSFSELLRLTRTLLAILDIVQAPMSSYFERLSKFQDGGNNVMRTIHGVGEMMTQMVLSRGSIFPMSVPDVPPSIHPSKQGSPTEHEDVTVMDTKLKIIEILQFILSVRLDYRISYMLSIYKKEFGEDNDNAETSASGSPDTLLPSAIVPDIDEIAAQAETMFAGRKEKNPVQLDDEGGRTFLRVLIHLIMHDYPPLLSGALQLLFKHFSQRAEVLQAFKQVQLLVSNQDVDNYKQIKADLDQLRLTVEKSELWVEKSSNYENGEIGESQVKGGEEPIEESNILSPVQDGTKKPQIDSNKSNNYRIVKEILIRLSKLCVQNKKCRNQHQRLLKNMGAHSVVLDLLQIPYEKNDEKMNEVMNLAHTFLQNFCRGNPQNQVLLHKHLNLFLTPGLLEAETMRHIFMNNYHLCNEISVVQHFVHCIETHGRHVEYLRFLQTIVKADGKYVKKCQDMVMTELINGGEDVLIFYNDRASFPILLHMMCSDRGDESGPLAYHITLVELLAACTEGKNVYTEIKCNSLLPLDDIVRVVTHDDCIPEVKIAYVNFVNHCYVDTEVEMKEIYTSNHIWKLFENFLVDMARVCNTTTDRKHADIFLEKCVTESIMNIVSGFFNSPFSDNSTSLQTHQPVFIQLLQSAFRIYNCTWPNPAQKASVESCIRTLAEVAKNRGIAIPVDLDSQVNTLFMKSHSNMVQRAAMGWRLSARSGPRFKEALGGPAWDYRNIIEKLQDVVASLEHQFSPMMQAEFSVLVDVKPELLFPEGSDARIRCGAFMSKLINHTKKLMEKEEKLCIKILQTLREMLEKKDSFVEEGNTLRKILLNRYFKGDYSIGVNGHLSGAYSKTAQVGGSFSGQDSDKMGISMSDIQCLLDKEGASELVIDVIVNTKNDRIFSEGIFLGIALLEGGNTQTQYSFYQQLHEQKKSEKFFKVLYDRMKAAQKEIRSTVTVNTIDLGNKKRDDDNELMTSGPRMRVRDSTLHLKEGMKGQLTEASSATSKAYCVYRREMDPEIDIMCTGPEAGNTEEKSAEEVTMSPAIAIMQPILRFLQLLCENHNRELQNFLRNQNNKTNYNLVCETLQFLDCICGSTTGGLGLLGINEKNVVNQNLESLTEYCQGPCHENQTCIATHESNGIDIIIALILNDINPLGKYRMDLVLQLKNNASKLLLAIMESRHDSENAERILFNMRPRELVDVMKNAYNQGLECDHGDDEGGDDGVSPKDVGHNIYILAHQLARHNKLLQQMLKPGSDPDEGDEALKYYANHTAQIEIVRHDRTMEQIVFPVPNICEYLTRESKCRVFNTTERDEQGSKVNDFFQQTEDLYNEMKWQKKIRNNPALFWFSRHLWGSISFNLAVFINLAVFYPFGDDGDEGTLSPLFSVLLWIAVAICTSMLFFFSKPVGIRPFLVSIMLRSIYTIGLGPTLILLGAANLCNKIVFLVSFVGNRGTFTRGYRAVILDMAFLYHVAYVLVCMLGLFVHEFFYSFLLFDLVYREETLLNVIKSVTRNGRSIILTAVLALILVYLFSIIGFLFLKDDFTMEVDRLKNRTPVTGSHQVPTMTLTTMMEACAKENCSPTIPNTADEEYEDGIERTCDTLLMCIVTVLNQGLRNGGGVGDVLRRPSKDPLFAARVVYDLLFYFIVIIIVLNLIFGVIIDTFADLRSEKQKKEEILKTTCFICGLERDKFDNKTVSFEEHIKSEHNMWHYLYFIVLVKVKDPTEYTGPESYVAQMIVEKNLDWFPRMRAMSLVSNEGDSEQNEIRSLQEKLESTMSLVKQLSGQLAELKEQMTEQRKNKQRLGFLGSNTPHVNHHMPPH

SEQ ID NO: 128 - DNA, 30304 bp, Mus musculus
  misc_feature (1)...(30304): n = A,T,C or G
tcttagtcacttagtgtgatgacctctttcacctggtgtggctttctgagtacatgtcctggctgggctctgtggagtaaaatgtttggatgtctcctgagatacagtggtcccctaaccctctatcctcgcccgtgatcaaaacctttaggggacagagtaataaaggttctggattagcaagtgggtgagggttttagaaaggccgagcaaggaaaagaattcctagtttccttgtcctgcaatggaccccagggactccttgccttttccataacaactacaacaaaacgcccctctgctgcctctggaatcggtcagtaacttcagagaggaagctggggtagaaaaggctccagacagtgcccaaaggatggagaagggggagccgtgttcacagaacagccatgtaaggcggggctggtgtggggctgtgatactgttcatcctaattaggtttcaattgttgtgataaaacgtcagggtccaaaataatcgagggtataactacaaatttacagtcaatagctcaccaggaaaggaagctgggacaagagctgaagaagactcagaaaaacactgcttcctggcttgttcctcatgtcctgctcatatttgcctgtctacaccccaggactacccgccaaagggtggcacagcccacagaaggatggactgtttcacatctatcaccagtcacgaaaatggccccatagagttgacaatctgatggatgcaaagtctcggccggggttctctcttcccagcttggttcaaactgacaaacctaacagcacactggtgttttctctgggaagaccagcaattcccactgactccagcaccacctcttctcttatggccccgctagttcttgtcagggcctgttggacctgtctttaggcatttttctacctgagaactgtctacagtacacatcgtgctcacacataccgcataaaatacacacatacacaacgatctttaaaaatagaaatgaaccaagcagtggtgacacacgcctttaatcccagcacttgggaggcagaggcaggcagttttctgagttcgagaccagcctgatctaggacagccagggctgtatatagaaaccctatctcaaaaataaataaataaatgaatatctaaataaataatagaaatgagccaaaatgtgggataaaataacacatacatagtaaatgcattgaatattcttaatgctaccaaactagggggaaaatagttgagcatttttaaaactgatacttcaattacttcatgccctgtgttttccctctgagggaaattcccatgttcacataaaaagctgtctgtgtttacaacgactttatgaattaacccttatattttacaaaaactcaaatatccctgagctcatgacaaagtaaaccaactttacacagcactggggaaaatgagtgaaaagggaaaacggggtcttcatgcctgcacctgcccattacttctgctggctaaatgtccgcagctttctgctcacagaggtccctaaactacaacccgctggtcatcttaagtttcccttaaagcacctttctgcccaaacagtttcccttgggctagcaaaatggccctgtgaggaaagcttcaagcctggcgacctgagttcactccccggaacctacacaaaagtggaaggagagaaccagatacatatagttgtcctctcacctctaaatgtgggccgtggcatgtgtaacccccccacacaccccccaccatcaccatcatcatcaccatcatcaccacccaaaacaaaaacaacacaaaaccccacccccttgcactattttagttagagaatctgaccacagagcagcggttttctgctgggaaattctaacggccagcatcctgttctcattctgctctcactttacccaccagtttcctgttagtttttcctggcctgtttgcaacactgtctttcttttagggtgtgagatgcatcctgtgtaatcccagctcacgcctcacatctctcctgccctggaatcgtctgctgtatccagctgtgttggtgtgtgacacacagctgtggagtgcactgtgcgtggctctcagatgcattgctactgcagggatccagcccatggtgttcttaaaaagcaagtgtgtaagagcagaaagagaagggtgccatgggctgggctacacagggaaggagtgtctacagaaggacatgaggtactggggtggggtctgggtttataccttgattgtgatggagagtctatgattatatatgttctcaaaattcatggaaatgttcaacaaatgaatgaattatgatatatatatgtatgtatatattcagtacttatatatgtatacacatatattcaatatatatatatatatattcagtatatatatgtatgtatacacacacatatacacaacaaggagcctcggcttaaagtaaggaagagctgagacaggtctggatgcttaagctgcctaggacgggagaaacaactggatcaagccgatttagaagcagaggctccaaaggtggacagttcctgttctccttgaaataggaaatgtcgttggatctgtaatggccagagttcagagacaccagcaggaactctggtttctcctaagtgagctccctgcctgcatgcagtgcacaaggtgtgacagacactaagggggctgctgaacagctttaacactggatccctagagtttcttttctcttttcctttttaccccctgttactgaaaatagattctttgatcagacaataaatcctcttccctctgttcctctccatttccccattcctcctctcccatccagatccactccctctctgtctctccttagaaaagaactgtcttcttgtacaagataacaacaaaacacaacaaaaacaaaataaaataaatatattaggacaaaacaaaaaccatcacatcagatttgcacaaggaaaccaacagaaggaatagagccccaaagcaggcataagagtcagagatccactcactcacacactcaggtgttgtgggttgccctggtgctgtttgtattttgatgctaattctgcttcctcaagaggggctgccccagtgaggagtggatcactcaggtgattccatgtgagccttctccccattttaagtggtcaaataaaggctggagcctatgactgggcagtggaagagaaaggtggggctggaaatgttggagagggagagagaggaaggaggagagagaaactaggagacagaggagagagaggaaggtgaaggaagaggaagtggaaggaagatggagcagaaccacgtggcctggaagagccacaagtagcaagggatctcccagctggggaatggagtagtgtagtggtgtatatattcaatctcggcacacagcttataaatacaataactgagttgtatgttctttgcacaggcttattggggttggagatttaccacaacactcaggaatcccataaaaatactaatctgaaagctaaaatctgtgtgcagaggatctagggtagagccacgcagacctgtgcttgttgctgcaggctctgtgaattcatagagctttgctcagttgatttacagggccgtgttctgctgctgacctccatgtttctagctcttacactctttccatctcctctcccatgggattctctgagcgctgtagggaggaatttgctgaagacatttagaactgcctgttccaaggcccctcccctctgcataatgtcaatttgtgggtctcagttgtccccatctgctgtgagaggaagcttctctgatgatggcttagtaaggcactggtctatgaatattagagaatatcatcaggagtcatttatttgtccctattttttgggggggggggtttgggagactctaatgatgactgattctattcatgggggctatagatctgtttaacttgcttatctgatcttgatttaagttttataagtggtacctactgagaaaatcattcatttcttttatattttccagttgatggagtacaggtttttgaagtaggtccttatgattctctggatttcctccatgtctgttgttatttcccccttttttgtttctgatttccaatacactctctgccttttaattaatttggataagggtttgccaaatcttactggttctcaaagaaccaactctctattatatgtttctttgtgtttgtttgcttctattttattgatttcagccaggagtttgataatttctgctgcctactcctcttggatatgattttatctttttgttccagagcgttcacatgggctcttatctccactctgttcccacatgcagggttccactgcagggcacagctcctctccttgttgatttatcacaggttgagaagtcaggcggtcggtcgtttcctcttgttctccctggggttgagcactaatggctgcactgtacttacctagaaatgtgtgggaagtgctgtttgtttgttttttcaagacagggtttctctgtgtagccctggctgtcctggaattcaatctataaatgtggctggtttcaaagttactgacccacctaaggcatgctctaccactcctggcttttgagagcacttttgatatactatgcaaaagtggtcagagggattgactggatggaaaggggagaaagaagagacgcttgccaagcctgttgttggtgaacttgaagctggtatacagccagtgggaatgcaaaatggctgagctgttgtgaagacagtagggcccatgactaaagaagcaaagaaacaaatgaatcattgaatatccaatcagtcaatgacagactgactgacggactgagtcaatgatagagagcaccaaaggatccagcaatgtgcatatctgaaggatgagggacagggttcatagtcactgcagtaggattcacaacagcccaaaaggaagcagcagataagcttgcttcaccagggacagatagacagcaagggttgagtgtatagatcatattcttcagctttaagaaagaatggcaagttatgggccctatgtaggatgtgggaaaggtggtatatgccctatgtaggatgtggggcaggttgtatatgccctatgcaggatgtggggcaggaggtatatgctctatgtaagatgtgggccaggtggtatatgtcctatgtaggatgtggggcaggaggtatattccctatgtaagatgtgggccaggtggtatatgtcctatgtaggatgtggggcaggaggtatattccctatgtaggatgtggggcagtgtagggcagcgtgggggaataaagggagtgggagaaaacctgcatcctgccagagttccaatgctctgggtgggcagacgccagaggattgctgcatgctttccacatggccccagatgcgtgtctggctgtgggaaggtatgaactcagccctcaggaggtggacaaggggcagtccaaggtctctgggcctcacggaggccagagataacaggttctccgtctcgggcatcccagacacagctggacacctcggaagagctgagaacaaaatgggggcccccaggggtcgctcggtcatccccagggccgaagggaggagagggcagggagagagagggctctgggtggttcccatgtgggcgagagtccttggtccagtccatggttagagtgccttgggggtggggggaaggttagacacagcactttaggggaaagagccatcgttcaagcacagggggacttgactctcagagacagtctatggttttagagctttattggagaaagacagggagaaagagagaagatagagagaggccggccatggccacaagcgaaaacttctataataccagtatggctctatgaggagaagggagccagacacaggaccatcttcagaagatcctgatcctctcagtctggctactgaggcataaaaaacaaacaaaacagttacaaacaaggtaggaaggtgagaggattcatgcccacaattgtcctcttacctccactctgattgtagactttggcttccagaactctgagaatataaattcctgttgtttcagctgcccagactgtggtactctatgcaaatcctagaaaatccaatacagtaagtactccacatctgctccacagtgcaaataggaatcacagtacaaacacagcaaatatgtcacgtgttcacttcgatattttcccatgtcatcgcgaatagaagtggggagggcagaccctccagttttagagaaaatgttttcagttttacatcatggagtatgatgttagtcactggcttttagattttaaaatgttttaacacattgatcaagtgattgactgactagttgtctttgttgagcaagcatgacacacatgagtcccttagtgtgtttgtggaggtcagagcacagaggacagctgtggaagcatccctctccatcatgtgggtcttgacaattgatctcagatcatcaggtgtggtgggaggagcctcttcacatagagccatctacagagatgcagtctacttctgtcctcacagatgggctttccctctgatttaataaactcctcagcaggagtggtgtgtaatcttgtcaagtgctgcttcacctctgcattcactgaggtgaccaaataacaaatacaaaatgtcttcctttttgcttttatttatattgttaaataattgtgtccgttcatcatttcctgcctcccattagtgctttctctggggatctgttagctcactgagcatgtttaggacaattttttttttttaattctgtcaagcagctcacacatctgtgatatcttagtctatgaagcatcatttcaatggggccatctttccctgtttctttggatctgtgtacaatattttctccatttgttattttgctggtttatttttatgttatagttattgttgtttcttaagacaaggtccctttacatagtcctggctgctctggaactcactctgcagaccaagctgccctgtagatccacctgcccgtgcctcccgaatgctaggatcaaaggcttacaccactgtgctcagttctcatgatggcttcagcatttgccaaccaattcaactgctccaggctttacaaatgctcttcacccaagcgaactcttcaccaatcatcccaaataaagacactcctctaatagctcccatgtctcactctccctagaacctgcctgggaactgcacttggaacatgctgtttcctttatgttctgtgggctccaaaactgtgatttggcagggcagggtcgctactctctgtgttcttcttcccgttgttgccacattgaagacgtaagtttcccttttctgatcccctgccccatacacacactattggcttctcgaggatgggtggctgaagctgccttcttgggctacagactgaaatggaagtggtgacattccctcccatccacaatccaagtaagatggctggatgagttccccaagtatgaactctcagagggttttatgggctttcccctgtgtagtagttatgcaggtattcggcctgtgtagtagttatgcaggtattcggcctgtgtagtagttatgcaggtattcggcctgtgtagtagttatgcaggtattcggcctgtgtagtagttatgcaggtattcggcctgtgtagtagttatgcaggtattcggcctgtgtagtggttatgcaggtattcggcctgtgtagtagttatgcaggtattcggcctgtgtagtggttatgcaggtattctgtgctgttctctagattctgtgtcaagcacagtgacctcagctggctgtgcccacagacacatgagactctgggcacttctggtcacttcacaccgtagccagcgcctgttaaagagaacatcacacctcagaactgtgacttttcacaaggccactgtggattcctagaagccatagacaccttcagaactcagtaaaacctctatgtcctcaaagcaccatttgaatcttctgctaagagcatcagccttctccttcctgacctttctaacgcatctccacagttttcattggtttccaggttattaggtggttataagccacctaaatatttgcagagtttattcacacactccccacctaaggctcctgttatcttggcaaaggaaagggattatgggcagaaacaagcatcactaataagcatttgggtgtgttctttatatactaaggcttgaggttcttatatatgctgaaatcttttatgtactaaaagttgaatccattttcatggattctctatatttgactgtaaaatatcatgactaaagatgaaaaatattgtgtgattgctaaaatcttcggtctaggcaaagcatgaagcatcaggaacatagttgggcaattgagtgcttgcctcaaattcacgaggactgaaaaaaaaatagatggagcatggtgcagaaccctatgctcagccttgtgttgagtaaaatggctgtcatcagagacagctgaggaggccccactgagtcttaagtgagctgtgaggccctcagatataattccccctgcttccttcttcagtgatcttgtggcatatgctatgagtgtgcaccttctgtctcctggaactctcagccagctgacacctgcactgtcatttagtgatgagtgcctggtacaattccattctgaccacagaaggagactttaaggaagtccttgcttttctttatcacttataatgtgtgaatgtgtgacttggcattagtagtccttgctctaagactctaggcctggaaacccttggaggagttatcacatcccatagacccaagtcctccactccctgagctctgacagatgaagtcctttcactcaggtgaatgaagttacatccccatggaccttcaggacagggcagatccagagcagcaagtggagctccgccctcagtgtttttcctgttgtgtcagtcatgaattcttcccacagtcatgacatgtccacatctcacagcttccttcacagcatgactgtttcaggaggatcttagagcttcagctcatgtcacgtataactgtggacttgcacatattactatttatttttacaacatagcataatatattgtatcttgattgctggtaaattggtaaaaatcagtcacttaaatttgaattgaggaagaatgttgcatttcactgaccctcggctgcattcaccttgagagaataactcaaaacaaatggttaccagagtcagaacaaaagaagaccacatgttacaccttccttccttaagacaataacatgtaatgggagcagatgcagagacccacagccaaacattaggcagagctccggagccccatgaaagtggcagaggaaggattgtgggagccagaggcatggaggataccaggagaacatggcccacagaatcatctaagcagggctcatagggactcacagagcctgaagcagcagtcatgaagcctgcatgggtctgcactaggccctctgtatatatgttatggctgtcagcttggtgtttttctggaattcctaacagttggagttcaggtatctctgactcttttccctgctcatgggaatcttttcctcctgctggactgtcttatccagccctggtaagagggtttgtgcccaatcttattgcatcttgttatcctatattcagttgatgtcctgggagacctgctcttttctgaagggaaacaaaggagcaatagatcaggggagtggagaggaaggggaactgggaggaaaggaaggagagaaggctgtggtcagagtgttttgcatgggagaagaataaagaaaaggaaaaaagacagtagtgtgtaagctgtgtgggcaggacagacagcaaggtcagtcggtaaccatggagaaaccctcagaatcaggagtcagtgggtgtgggcacagagcagagcattcacagaggacttccttttgttcacttcaccccaaaggccttggagtttgcccctgctcaccagttcagtgttgcatctcctatgcacaatggacacagcaagggtctactttggtttaaagccacccaggactccaggggcttggcatgagtcacccctatctcttcctccaggtcagtcactttatttttccttgtagcattagaatattttccagagttatgattttcttacagttttaagttattgctatgaaagtgagcaaccatctaccagcgctgaagagtgtagacggctacaactttggattaataaaaagctcatcggttccatctttaatcagtcagtcagtgtgaaacttgggcaggcattccttttggctttagctacgggccctgaagaaaggatattttacatctacaaggagaaagtaaggcagactcactataaagcatcttgcctggtccaacttctctacagaacacaaacaccacgactcctctccatgccattctagcactgagcactggaggagttgagggatgtggcaccctgtctgccagaaatgtggaagactgataggagacgtttatgaagggtaccatgacttagggatggatgaaaagagacagacacagaggccgaaagtatgtctacagtggtcatggtatggtatggagttctgtgacataactgagtttccttatctaaaacttcagtgcttaaaatctaacctgtctacactgtgtgacacaatgtgagcccacaactctttaaggctgtttgtcagaaactagttttaaaaaatagtttggaaaaagtacaaagaaaaaagtcaccaaaactgcgttataaactttacattgtttctgggaaagtggaggggtttgttgaccagagggggatttgagggagccagttatgtgtggtaggtgcaggcaagtgcttgttttccctgtttatgactgcaaacatggagaagggacttgagaagctaaaggttggggttctgttttcccactgagtctagtcagctctgccagtgtgtgcatggttttcgggtcatgccctggagcacaggtggcctcttaggaactgtatcctagaacaaaactgactctcccaatcctagcagccatcagctgtcaatgactccccagatgacattggaactccatgcccaactccccccaccatgctggaccattgcctgacttgagcttttgaaggtcttgtgcaggctattacaaatggcgtgagttcatatgtgcaactgccctgctgtgtctgaaagacagtgtttcattacagttgtccaccatctctgactctgcagttattctgtcccctctgctgtgatgatggcagagccttggttagggatgggatgagatgcagatgtgccacttagggctgggtacttcatagtctcttattctctacttgttctggttggtgcacacttataattccatcacttgggaggcagaggcaggagaatccggagctcaaagtcatcttcagccacacagaggtttagcagtcagcctggactaaggggtaaccctgtcttagaaacagaacagagcacaacaaaaagaaaatttgaaagtactctatttaaggaaggaacactgtgaaagctacagccagactgtatttagtgtatgcttagtgtatgtgtgtgtgtgtatgtgtgtgtgtgtgtgtgtgtgtagcagtgtacatagagtctggtgctaaccacagtttcagttcatctaaccattagggtgtttggaactcagccaataaggagggactaacacaagtgaaatactgaaatactgtctggaatcacaagatgcttccccttggatgccacacctttgatccaaaatggagatcatggtagacagcagtgaagcagactcagtgttcaggaatagaatcatatgatcatatgtcattagcactgaaagtcatccttaccccaaaactgagcatcacaaacatctcttttttttttcctctctactggaatccaactgtccttgttagtcaaaaccacctttaactgttattccagatgttctgtactggcttaaatgagttacaaggttcttaacttcgcagatgcctgtcggtgcccacgttcacacaggttggctctgaagctcagctgtgctgggctcatcctccttgtcctgaccctgattgggatgagtgtcttaggtaagtgaggccagggcttgtgcttcacaatccttcctctgcttccgtcataaatatcggtgcctcttcacatgattgggtcccttgggcctggaggagggtcaatgacgtgagtaggaacaggacagtatcccatatccagtgagaaatttcacattgccttcatgcttccaaattcctctgaaacccattaggggctgttacacacaaagggctctctaacaggcctgagcatggcaaagatggcaccagcagattttgtccccttcccccagcccccgttcctctcccttgctaaagtccccaaggtctattcccttagttagccactcccttctgcctgattccttcctgaggttgatcactgaggtccagcatcaagatccagttatcaaaatccaatatttggctcccctgactaacatgccaatcaggacttcccaactcaccttagcacagacttcccccttgttctccataaaaatctgctctttcaaaatcacctgctgctgtctttgcctgatccagcggcaaccagtctcacaatccctccagggtaataaatatcctttgtgctgagaacttgctgtctgagtgtgttctgagctgactccaagtccccagaccccaacacacatgtacacagagcataaaaatataaatcatattgtgacaaaaacataacaaggctaactaaaaggctctggtgttggtttattaagcatctattaaactaaactccagcagcactaagctgtcttctgtggagggggtgcttatactcattctgaagatgaggattcaggcagtgagggtgggtaagttaagtctctgtgacaccattggataataggtcacactaaacagaggtgggaatccacgtgttctgtgtttttcttctttgtttgtatattgtctccacactcctccctcagcccagttttctaatattttattctcagtccagaagttcaggtttgttgaaataacttgatttcctggagtgagaaatggagcacacctgttccaccattcattttggcgttaatccctctctgtgtgttttctcatttatcagtgcgagtcctaatacaaaaaccatcaagagaaaaatgctgtgtgcttattcaagagaacctgaataaaacaacaggtaattttttgtgccttgtattttgcaagaataatagctgatgtttgctatttaccaggggctacttacagtcagccaaggcttacaacagccttctctgaagatgctatatcaccatatctcatgttagaggaaattgctgcatagaaacttgttgagggtgtcatgattggtagttgataaggctggtaacttctttgaaactatgtgacctggaagcctgagatctcaaccacttggcctagggatgctagtacacttgatcattaacttaagaaaatgccgtgtcctaaggtcaaatctaagtggatcaaggaacttcacataaaaccagagacactgaaacttatagaggagaaagtggggaaaagccttgaagatatgggcacaggggaaaaattcctgaacagaacagcaatggcttgtgctgtaagatcgagaatcgacaaatgggacctaatgaaactccaaagtttctgcaaggcaaaagacaccgtcaataagacaaaaagaccaccaacagattgggaaaggatctttacctatcctaaatcagataggggactaatatccaacatatataaagaactcaagaaggtggacttcagaaaatcaaataaccccattaaaaaatggggctcagaactgaacaaagaattctcacctgaggaataccgaatggcagagaagcacttgaaaaaatgttcaacatccttaatcatcagggaaatgcaaatcaaaacaaccctgagattccacctcacaccagtcagaatggctaagatcaaaaattcaggtgacagcagatgctggcgaggatgtggagaaagaggaacactcctccattgttggtgggagtgcaggcttgtacaaccactctggaaatcagtctggcggttcctcagaaaactggacatagtactaccggaggatccagcaatacctctcctgggcatatatccagaagatgccccaacaggtaagaaggacacatgctccactatgttcatagcagccttatttataatagccagaagctggaaagaacctagatgcccctcaacagaggaatggatacagaaaatgtggtacatctacacaatggagtactactcagctattaaaaagaatgaatttatgaaattcctagccaaatggatggacctggagggcatcatcctgagtgaggtaacacattcacaaagaaactcacacaatatgtattcactgataagtggatattagccccaaacctaggatacccaagatataagatataatttgctaaacacatgaaactcaaggagaatgaagactgaagtgtggacactatgcccctccttagatttgggaacaaaacacccatggaaggagttacagagacggagtttggagctgagatgaaaggatggaccatgtagagactgccatagccagggatccaccccataatcagcatccaaacgctgacaccattgcatacactagcaagattttattgaaaggacgcagatgtagctgtctcttgtgagactatgccggggcccagcaaacacagaagtggatgctcacagtcagctaatggatggatcatagggctcccaatggaggagctagagaaagtagccaaggagctaaagggatctgcaaccctataggtggaacaacattatgagctaaccagtaccccggagctcttgactctagctgcatatatatcaaaagatggcctagtcggccatcactggaaagagaggcccattggacttgcaaactttatatgccccagtacaggggaataccagggccaaaaagggggagtgggtgggcaggggagtgggggtgggtggatatgggggacttttggtatagcattggaaatgtaaatgagttaaatacctaataaaaaatggaaaaaaaataaaataaaataaatatcagtgaggagaaaaaaaaaaaaaagaaaatgccgtgtcaaacagttaactttgtttaaagtatattaatagaaaaaagtatattccttgttatttatatttctttgatgtgccataacagtaatcgtgttcctgcacatgttaataaaagtgtgtgttagtaaagcaactactgtgtgtaaccagctgtggtgcagcaagaacagggtagaaatacaccatgtcttctcgcttcagacagtccagctaagcaggagtgcccacaacactggctttcacaccgagataagtgctttcacatttctcaagtttccaacacttgggaggaaggtcaagctgacagtggtagaaaagaagccactttgctgctcattcaagaccaagaagaactggtaagatgtccaatacaatagagacattagcatgttcttctaagaaagtggagactttacattatggaagctcatagtctgaaaaactaattggacatgtgagccaaaaactacatgtgtaaggtgagtgtcctttggatcataaatatggggcacagatttcacaaaggaggaagaattaactgttggggactcaggatggatacaggtttcaggaggctggtagaatgtgagtcaccaatacacagagtcagggttaagtcctctgctctgttttgattgtagagattcctactggactcaataaaggaaaattacaattcattttggattggactaaggtacacattgccagacatgaactggaagtggataaatggcacaactttcaattctgatgtgtgagtactagaagagctagtttgaatattcatttctgttgcaggggcttttggggattccccttggggctaattgtaaagacatggagaatctgtgtagtataagcctgttagcctttctgccggggacagtccctgagcagccagctactccacctgcctcccctgccccctgggtcttcattgcagggccctctgctctgcttcctgctgctccactttcttcctctggctcaggcctccagctctgtttcatccaaagccttctcctttctgataaaaaaaaaaaaaagttaattagtaacactgacatcaaagattaaagaagttcagaatagactaaaaatatgaatgcaaaggtggtcaaaaacttttacatataaaagataccagcctggcctcttcctgggaggctcacttcattcagctggaaactcagtgagttaatccattggcagaattggtgtcctcatgatgcaatcacccatgagtagcatcaccagctggacacaggggtttcaatatgtgcccagttaggacacacatggttcataagccataactgaatgtggatcacaaagcagccattagctatttgctctttgttgtctcattttcttattgtgtgatattcttgcaacaaccatgaatacaatgggagagctgatgcttcatagttaaattatatattttagcagaactcataattattggtataatgaggaacaatgtatcacagctccagagacagtaggacctaggagaacagagtcaataaataagatggactaaagtctcatgcaatcatcaactttattcagagcagcagacaacttatactgaggactgagaaagttcatgagttcaagctgtatacaatagcaaagataagttgagcatcacaaatgtggttttttttttttccagagaagcagaggacagtttaaatatcagttatctatagtaagtagtaataagcaatctgaagtaaacccacccttttctgttgcacttggaggaacacaaaaacacattctaagaacatttcatgttttaaagaaacagactcataagactctattcctgttttcttggagtgttctcacaagcactcagacttctacaactatattcctgggctctgccatgacaacagcatatgtctgtttccattcatggtcactttcaggagcttgttgttaagacttgtgagttgtttacttactgacttttaaggagcttccctttagaactttatgattatttattggtattattattattattattatttattttgttgttgttttgttttccaaaacagggtttttctgtgtaaccctggcggttctggaatttaannnnnnnnnnnnnnnnnnnncaccacccagcaaattttctgaatcttaatgagcctccctccaggatggaacatttcagatcagaagaaactgctaggcagtggtggctcatgcctttaatcccaggacttgggaggcagaggcaggcggatctctgagttcgaggccagccttggtctacagagtgagctccaggacagccaggactacacagagaaaccctgtctggaaaaaccaaaggggggggaaaaaaaaaagaaaaggaaagaaaagaaaagaagttgctacacaacagtgtgtgtgaccctttgagtttaatcctgattactaacttgaatacagtagggggctatccatgggagcatagtctaattaatgggtaaaatcactgaagaaagtaacatctcctcacctagcaactattaactgcccataacctcaaggaagtctggggtctcaagagctccctttctacctgggatggaatgttggccgtccagtcccaatcttgtgcaggtcatcacaatggcaatgagttcatgagtaaccgaccgagtcaagcctggaagacattttcatggcactcctcgtgtcctctggctgttacagtctttccatcctcttctccatgatgttgcctgtgacaggtggtaggggtgatggagtaactggcctacttagggctgagcgttcacctatcacttattctcagaactgtgaccacttgtaaatctctgcattaactacttcccactacacagagaaggttctgtgcctaagaactgtgtgttccatagtccttagaagtctagaggagaagatggccaactcaggagaattatagaaaatcctaaacactaagggcagttattttcttcctcctcagactaaaaatcattggtgtcactgaaaatggcagctgtgccaccatctcaggagacaaagtgacttctgagagctgttctacagacaaccgttggatctgccaaaaggaactaaaccatgaaaccccaagtaatgactcctgactgcgaatcccatctcaattactttaccatcagcaccagatctctgcacctaacctgtctctgctgtctgcctcccagtgcagttagtggcacagcacatggactctaaaagcactgggcctcttacagattcttgattgtgtaaatgtcagtgtacacagacacagttgtgccattctaagagaagagttctatgcaaagaagccctggtagctgaggggcactggtttctaatccttgtgtctgtgtgacatttgctggtctctgtgcctgagctcctctgccaacagccatggaagactggatctaatttcttagaaagataggtcacaggctgctttcatggcccccaaagtttgagtcaggacccctttggctattcctttccattcgttgactcatcgacctacaagtgaaatggttttgtgatgtctggtagccccaaattgggagctgacagtagggcctgctttattttatcaaaggccttttgatgatcttgagtctaagcaaagtctttgccctctctggtggccttatataaaggtttgactatttcagtgaaacctggggtccataatctgcaaaagcctgtggaccccaagaattctcttacctgtcttgtgcttatgaagttggtatgctgaagacagtctcttttcttgctgtggaacgctactgctggccctcagtcttgtagagctgtgcctttttggcagacgctcaatatcccaggtctcccagaacatgtaggagattctggatacccttgcattctttggtttctgctgcaactaaaagatcatctacatactgaacaagagttatatctggattattaactgtgtactcacccaggtcttcatgcaaagcttcatcaaaaatagtaggtgaattcttgtaatcttgaggcaggcaggtccaggtgagttgtccattaatgccactttcagaatcatgccactcaaatgcaaagtatttctggcttttggaagccaaaggtaagctgaagaaagcattctttagatccaaaacagaataccatttccgatctgaaggtagagagctcaacagggtataagggttaggcacttttgggtgtatgtacatcaccctgcagttaacttccagtagatcctagacagggtggttgtcattggactttggctttttcacagacaataatggggtgtttcagactgactgacatggcctaaggactcccaaggccaacagtttcttgatatggggagtgatccccttccatgtttcctggggcatgacccatactgggtctgctcttggcttgagctctacaaatacaggaggttgatgttttaccagcctcatatctccagtctctgcccatgcctggggaaactctgccagccaggcatccaggtcttgttcggggctggctggtgactcgtatagtctatactcagtctcagaggccaggtcaagtgtcagcacctggattggattgctgtttccgtttgtcagctggactttcccagggtcaaaatgaatctgaactcccattttggctagtaaatctctccccaacaaggggtatgggcattcaaggaggtaggaatatgactttttctggtgtactgtcctgtaggataggatagaaaagctttaaaggcttggagtcttcccatttttgttcttttgacatcagagcaggcatggtttctggggggcaaagtagtgttagtcagggataataaaaaggatttcacccaaggtggtgggttgacaataaaatctttccagactacaatgtaggggacttgttttgatgcctgtgtgccttctggaacactttgttttcaaccacttgcaccgtaggaagatgaaaagttccctctgctggccatcccactctgaaagtgggccattctgagctacagtacaaatgcgttttcttcttgctcatgtccactgagagattgtgtgcactggtcttcacttccttaaagtgagccaagatgatgttaaggggatgggaaggaagagagtgatagtctgttccattgtgtcagtcactgtctagtataacacaaggctaactctgacaaaaccacatgcacgataaccacgttgtgactggaaacaaaaataaatccaaacactaggacttacagactcttgcctcggaaagtggaggcgaggtggatatgacagcagattgtgccagggctgcttctcaagcacttccaactgatggtcaggaatattaaccaccctgaactccagctcaggaatgtcttcctgccttttatgaccgtaactgtttagtgtgtccagtatggttacttctggccacagatacatatatactgctacctcaaggcttttcccaatgccaagatatggccagaaagaacagatgtgaacagtgaacaatgaaacactgacactcaccacacttgctcacctgtcttagactctctggactgcagattccagagatctgctggggaatcccagacgagcccccaaatgttgtgccccaacttttcaggaaacccaggagagctcaagaactgtggagtctgctgcaatcatgcatacaagtcttttattttcaagtcagactcatattgcaaacctttccacatgcaggacaggagtgcaaccatgagcttggatggcttggcacttatatacagcatagatagaaattctttcagtgcttagggtgatagggggaggcagatgaagtaagctataattcagacatgataccatttggtagggtggaattgtgctgctgagagggggttcttctgacctaaggaatatctttaaggggctaccaggaactagttttatgactggccataactgtctatgacctctgatcacttctcttccatgatataaacatggtaccctaatctcctttttccaaggacaggcaccagctgcacctaggaagtgctcagccagtcatcagggagagtactaacttcagggccactgaagctatggaggctgtctcactcaagctggcacctgtggctcctcaagttctcttggagcagccagggagggggacaaatccccaaatttgctgcagggaggagcaggggttagggaaagccaagaggcaagctgcctgtgcatcccactgtgcttgctgtgggagagagcctggggtaggggaagggggcatctgcaggagagcacagaagcaagctgcctgtgcacttcagactaaagcctttgctctcaaatgataccagaagcccagggttaaggaatttgggagagagactgacagaggtttaaatagcacctacaaaatcctgggtaaactgagctctggtcatgtgatgcctctaactgggatccaccagccaacccttggctaatgctggcaccatggtgctaggcttctcagctctaaaagtggcagagatgaaattcttttctttgaaaggtttcattttacatgacagaaaagcaaactaagataacttagctcttcctgctgctccacggtccttttcactctagtttgctcagcatttcttctttccatggcttgaggaaaattaagctttaaaaagatacatcttttgaatatccctctttcttaaaatttatcaaatttgccatgaaaatgaaaggagtaagaatattgaatttactttatgtggagacctaaaatttccttttaaatgggcttctacaaaatctaaccaccaattgcaaattgaattacttaaactgaagtatatattatcatgattcaaataaattctcaactcctatttgccaggaacaaagggttttaatatttgattgtcacggcactctggtggagtcagcttgacaaagcgaaagctgggaagctggttcatgaagcaaagagtttcaaggaaactcccttcccggggggcctggcattttctccctaatctatataacccataaaattaattttccaaatccacattagtctagtgtatagattcacgtgcactctatatagtattgccttatagtaaatgccttttaagattgtattctaacataactaaagcctttttccagtgttcttagattccagatagcagcaaggagcttaacctattcagtaactaattaagccctaccataaaacaataaagcacctgctatttactccattgtctgtagatagagactaaaagtctcactgagatagaaatcttttactacaggctacattccatgtcaaatataagttgatatactaccctgataagggggaactctccagacaggataagttttactagacctaagaatttagagctctgtgataacgcattactcttaaggcctgtcaagagttaacaaccccctgatgcttttaaccttaaagtgtgaaattcttgcctggcattaggctgatcctaggcagggcttgttatccctaatgtaaacatttaattagtccctgcaaattcctttctgctgtaactggtgaatttcagtgtatcttgtctttttgtgatttgtatcctctgataattcgttgtaatataagtctgaagctcaaccagaacattacattcagatccaacacctttcttgtgtgtttgactgattgtcattttcatcctaatctctgcccatctactctagagactcttttctacgcaggcacaggggaccatagggtctgcggcatttgataataatgactttcatacagacactcaaagaataattcattttgtgaaaattcctagaaatcaatttacctaggaaaaacttcagagaatagcagcgctaaaaatcaattgttaacaacagtggtgttttaggagcctataactgttaagtgcacgcagctaagcagatacgagaaggagggatcccatgtaagaaagtaagacagcaggggactttccccgtgaccacacattgctaccaatgaatatgctgatgagaaggcacagttgtggggacatcttggtcctgaatcaatgtcagcagagtagataaatgaagctatctcccaaaggcaggaacttgacattgacataggagagaggaaaccaaaagacactttttaaaaatccaccatctagagcctcgagggctgccacccacctccagaccagcctgctccagtattcttctggagtttgctttaaattcttttgctatgctaaataaacataggcactaacagtgtcttagctgaactctttcctgtggaagacaaaaagaaagaagaaatctttatctggtgtatcagtgtaactttttgccaacctgacacaaggcagggtcatttgagaggagtggacctcaattaagaaaacaactccacaaaactagcatgtaagctagcctgtctggcattttctcaattaataattgatatggcaggatcccctctgtggatggtgccacccctgagaaggtgatcctggataatataagaaagcaaaatgaacaagccaggaggagtgagtcagtaagcagccctcctccatcgcctctccttcagctcctgcctccaggttcctgctctgagttcttcacctaactttccttagaagatttactgtaaactataacctgaaacaaaccctttccttcccaagttgcttttggtcatggtgttaatcatagcaacaaaagtctgactaaaatacctggtaatgaaatgatccaaaagagattggtactgacaagcttgctaattaatccaattaaaggttttgagtcctttgttaatgcccagatcaagaatgggcttgtgcctccagaaagtttcttagcacctgtcttagttacggtttcattgctgtgaagagacaccatgaccaagataactcttataaaggcaaacatttcattggggctggattacagtttcagaggttcagttcattatcatcatgacaggaagcatggcagcgagcaggtagacatggtactggaagagaaactgagaattctacatcttgatctggaggcatccaggagagtgctgtcctccaggcagctaggaggagggtctcaaagcccacctccacagcgacacacttcctccaaaaaggccacacctactcctacaaggctacaccttttaacagtcctactccctgagccaagaatattcaaccaccacagaacctgagctcaggggtacagcattttgaaagacaaaaccataattataaaagtgccagggtggggaacattagtgagagatttagagttgcctagcaacatctgcattctttacaaggctcagaggcatcttccagatactacatactatgtgtgagccatggtcaaggtcatggacagttctaaaagcatagccaagatggacgtggctgttggagttggagggctgagaagtgaacaggcaaactcattgggacaggatggtgtcccctcagtcttttcagtaacacagtggcaccatcagagcacacatctgaagggaatattcccatcaatgatcatgtgcacgcttgcctcctgggatggtattgtgaaagacctccggcggggatacccccacccaagccacgagctagcgtgcacccaaagaatcacaagagactgtcttgatgcaaacacacgaggtagtttaatgacggagctccaggcctacacgtatttcacacaggagacagaggtgtcgaccccgaggctcaaaagttaggggtttatataggaaaagagtgggggtaggggaggaattggcgcagcttcacacaattgtacagtttaaacatcagcaaattgtacgtgcagagagaggtaagagcaattctgagggtcaggggcttgtgactcagctgagatagtccggacatccctgctgagatagtccggatgtctttgcaggtcttctcctatctttatggctagctggttcctggaatgatttaacagcaatagcctttgttctttgctctaggccccaaaagccctcctaactagcaagccacatgagtcatggaccttggattttaattttctttcaattgctaacaactttataacactatttgagatttgctgagtcctgcctgatggctcatggtgcaccctacacaggaatgtaacgtatgaaatcaagtaacccaaaagaccacattcagtggaaatgtttctcatgactcccaagagttagaaggtctgtctctgtctcttctttagcatcaaatcactattgtggaggattccattgggatcatctctggaactctagctatgaaggtgaaattctaccaggaaggcttgtgacatatcaggtgatcaccacctcacctgacagactcagtgtttattgacataaactaaccgcaactctaagccacatcccaagtgtggtgttccagccttgtttcccaacaattaaaaacaaaagaggagatggatggtcatgaggatatggaggaaagataaagtgccacccgggtaggaatgaagtctgacatggccgttctgaaaaacagcaagggacatctacttactatccagcaatcctactctacgcctatggcatgataaaagaaaaaaaaaatgaaatgatttagtgaaagagataagggaatataatcagtagatattagtaaaaaccaacaaaagaccttcctcctttcaggtacatatgttacaaccttaacttagaactgatgctcgacaggcatgaccaggcactgcctctccctatgagttagaaactttactcataatgaatctaaatagtcactcttactctcttgtttctctcttgccctcttgggctcttcccttcccccctctcaccccactcccctccacctctccacatgttcacgaccagcctgtttctctctctctctctctctctctctctctctctctctctctctctctctctctcctctctctctgcctttctctgcctctaccctcttgactcccctccacatgcctctatactaataaataaacaattaaaataaataaataaatctaaataatccagcaacagcaagggccttcccaatggacttcccctgagtccctaaactgtgcccacttcctcttttccctgcctgttatgcacaggcaaagtgaattcagcatttacagcctctgctttccttcccaagtgtttattattaaaatgattttgatgcagggcctggagacccatgccaaagataacaacatcgagggaggaggctcaagagttcaagcccaggctgggctacatagctagagcttgtctccggaagctaagacccaataaaaccaatgctttgaggatgagttttatttagcttgaactgatttccaagccctccagccttgatggtggaaaatgtgatatttgtccatgaccttgtctttttcttgctagtatcaaaagcaggtcaacaaatccttttatttaagggaaacttgatcccaataattctattttaacaatatgtgagggataaagtcagtactttacacagatacatgcaaggctattttcatattgcagactctccatagagccaagatatggaagccacctaatcaagcaccagtggttgattgaataataacaatgcacaggtgacttttagtttcctcagttgcccatcatagtcttatgtcttagtaacattacaaaattaatcagcaagggagtcaggtcttggactcagaactctttctgatcgctgcttcagtctttagtcagctttccactactttagtttgttttgttttgttttgttttgttttgttttgctttgctttgctttgctttgctttgctttgctttgctttgttttgttttgttttgttttgtttggagacagggtcctgaagctctgtgtggagttgaaggatggcccttaaatcatcttgccttgttgcctagggagtgctgggattaaaggcggttgagattaagcccagccctaccacaccaatttggacattaactactgttgtgtgaatcctcccagggctcccttcctgccttctgaagcatctctacacatttctcttcctagacccagcaagagaagatgttatctttggaagtttttactttcacagcatgagtgttagctcatagattcaaaggggaatctgtcgctatacgacagattatataccgcaccactgaaactttaaaagcaaattgccactggggagaaatttcacatttgccacctggtgaagtcttggcagggcctatgctgtgatagataaccacaaaggagtttcagtctagcacatcttggagggatttgttcagcagtccatagagagtactttttaatacaacggataatcagaacagcattatttgcttgctccttcggctccaagttcagcctctggggctaactttaatgatgcgtcagcatcacaagttatttttatttacataaaaacaaatttagagaacgctttggtcttaagcagccagcccaaagttaataaaaaaacagttataacacctgtttcctctcatgactacatcctcagtgaaatcatgtgtcccgatgctgaagtgaacaatggtgtggctgccattaccagcaccgaatcatttcttatacttaattcttttttttttttttttttgatacagtttctcttcatagccctggctgcccaaaactcactcttgtactccaggctggccttgatctcagagatctgccttcctttgtctccctaatgctggaatcaaaggtgtccgttgttaggacccccaggggcccaaatgttgagaaggagacccccagaaacacagcttgacaatagatcgctgcaatggcaagaggtttttatctgacgcgtgtggggttgctgagcctcgcagggagagtcaaccccaaattgctaacagtacagtttttttatactatttgtgtgtgtgtgtgtgggggcgggggggtttcacaactttattattgttggctagcaaagtaacagttatgttttttacttttggtggtcagctagcgatgtgtcagaaactttgtcagcaaggtcggattatcttagaattcacactgaggccggggtcccagggattgttattattgttatggctaatttttgagaacagctagtcttgctctggcagctgtggtcattttgaccgttagtcaggcccctcagatggggaaggggctgggcagtcttgagcttgtttacactggcagggaaaggctggtttatattagcaggaaaggggcaaacagcagggggaagggaaaggcttctgcaaacagctttgacctacatacatttagccaggctaaaactgtatttcttcactgtctccatgaccagcttatatttaatttattctgactttgaaaatgaggcagaatctgtgaagattagacataagcaaagactccagaggcatacagtgtgtttgtgcgtgtgcgcgcgtgtgcgtgtgcgtgtgcgtgtgcgtgtgtgtgtgtgtgtgtgtgtgtgtgtgtgtatacacaatgaaaaaacagctgctgtggaactcatttgtcttcctgaatgggctgatctcagaataattcaatctaatatgtaattgaatatctttgaaattcaactctcttcctccctctccctcctcccctcctccccaccttctcacactctctctgtggtttatttttttgagacagggtttcacagtatagccttaggctgtcttgtaacttactctgtagaccaggctgctgctggcttcaatctcagagttccacctgcctctgcctccaaagtgatgggattaaaggtgtgcaccaccactgccctgataacttttctcattgttaataaaaatattaagcacagtgataatctctctgacaaaggtctggctataactcctgcatttagatatacaacactgtgaatatttcttattaaacttttaggattaatgttattttatgtgtatgtgtgttttgtgtgcatgaatatcttcatatcacttcaatgccactgacccatctgtccaactccaatattatttattataaatactccttccagttgaacagtcacgtagaaaagtgatttttttcttctgtaaaaagataaacttcttagaatgttttatatgaattctaaaataatgatgcaatgctaaagactgttttaagaaatatacatatatatatatttcttgagatggagaatgcaaatagctcacaagactgctcatttatttgtatcataatctattattcactaatgctacttcagtggagtgaatctagcaaacatagatgtctttttatgacttgtttctgtaagttttacgtatattaaaacatttcactttttatttattaaagagcaagatagatttattcactgaagaaatactgataaagtgttaatggttaggattataattatctatttatttatttggacatgggatacatcactgtacaaagcaggcaaagatccaggtccttgtacagtttacattctctgttggtcagactgacaataaataataaaaataagaaaatatataaaagtaaaaagcccatgaaagtaataaaaggaaatcaactttctggtggagggtttgacgtcagtggttagtatttttctccttacatgcatgtagccccgagatctattcccatatatgcaatattataaaataaataaaatctttaaatagaaaagaaaaatccattttctgaaatattaaagcagcatttctcaactgttcttgatattattcccttctttccatttaaaagacattttgttgta

SEQ ID NO: 129 - DNA, 777 bp, Mus musculus
gtcagtgggtgtgggcacagagcagagcattcacagaggacttccttttgttcacttcaccccaaaggccttggagtttgcccctgctcaccagttcagtgttgcatctcctatgcacaatggacacagcaagggtctactttggtttaaagccacccaggactccaggggcttggcatgagtcacccctatctcttcctccagatgcctgtcggtgcccacgttcacacaggttggctctgaagctcagctgtgctgggctcatcctccttgtcctgaccctgattgggatgagtgtcttagtgcgagtcctaatacaaaaaccatcaagagaaaaatgctgtgtgcttattcaagagaacctgaataaaacaacagacagtccagctaagcaggagtgcccacaacactggctttcacaccgagataagtgctttcacatttctcaagtttccaacacttgggaggaaggtcaagctgacagtggtagaaaagaagccactttgctgctcattcaagaccaagaagaactgagattcctactggactcaataaaggaaaattacaattcattttggattggactaaggtacacattgccagacatgaactggaagtggataaatggcacaactttcaattctgatgtactaaaaatcattggtgtcactgaaaatggcagctgtgccaccatctcaggagacaaagtgacttctgagagctgttctacagacaaccgttggatctgccaaaaggaactaaaccatgaaaccccaa

SEQ ID NO: 130 - protein, 257 aa, Mus musculus
  VARIANT (1)...(257): Xaa = Any Amino Acid
QWVWAQSRAFTEDFLLFTSPQRPWSLPLLTSSVLHLLCTMDTARVYFGLKPPRTPGAWHESPLSLPPDACRCPRSHRLALKLSCAGLILLVLTLIGMSVLVRVLIQKPSREKCCVLIQENLNKTTDSPAKQECPQHWLSHRDKCFHQVSNTWEEGQADSGRKEATLLLIQDQEELRFLLDSIKENYNSFWIGLRYTLPDMNWKWINGTTFNSDVLKIIGVTENGSCATISGDKVTSESCSTDNRWICQKELNHETPX

SEQ ID NO: 131 - DNA, 2550 bp, Mus musculus
gcagagcattcacagaggacttccttttgttcacttcaccccaaaggccttggagtttgcccctgctcaccagttcagtgttgcatctcctatgcacaatggacacagcaagggtctactttggtttaaagccacccaggactccaggggcttggcatgagtcacccctatctcttcctccagatgcctgtcggtgcccacgttcacacaggttggctctgaagctcagctgtgctgggctcatcctccttgtcctgaccctgattgggatgagtgtcttagtgcgagtcctaatacaaaaaccatcaagagaaaaatgctgtgtgcttattcaagagaacctgaataaaacaacaggtaattttttgagtgcccacaacactggctttcacaccgagataagtgctttcacatttctcaagtttccaacacttgggaggaaggtcaagctgacagtggtagaaaagaagccactttgctgctcattcaagaccaagaagaactgagattcctactggactcaataaaggaaaattacaattcattttggattggactaaggtacacattgccagacatgaactggaagtggataaatggcacaactttcaattctgatgtactaaaaatcattggtgtcactgaaaatggcagctgtgccaccatctcaggagacaaagtgacttctgagagctgttctacagacaaccgttggatctgccaaaaggaactaaaccatgaaaccccaagtaatgactcctgactgcgaatcccatctcaattactttaccatcagcaccagatctctgcacctaacctgtctctgctgtctgcctcccagtgcagttagtggcacagcacatggactctaaaagcactgggcctcttacagattcttgattgtgtaaatgtcagtgtacacagacacagttgtgccattctaagagaagagttctatgcaaagaagccctggtagctgaggggcactggtttctaatccttgtgtctgtgtgacatttgctggtctctgtgcctgagctcctctgccaacagccatggaagactggatctaatttcttagaaagataggtcacaggctgctttcatggcccccaaagtttgagtcaggacccctttggctattcctttccattcgttgactcatcgacctacaagtgaaatggttttgtgatgtctggtagccccaaattgggagctgacagtagggcctgctttattttatcaaaggccttttgatgatcttgagtctaagcaaagtctttgccctctctggtggccttatataaaggtttgactatttcagtgaaacctggggtccataatctgcaaaagcctgtggaccccaagaattctcttacctgtcttgtgcttatgaagttggtatgctgaagacagtctcttttcttgctgtggaacgctactgctggccctcagtcttgtagagctgtgcctttttggcagacgctcaatatcccaggtctcccagaacatgtaggagattctggatacccttgcattctttggtttctgctgcaactaaaagatcatctacatactgaacaagagttatatctggattattaactgtgtactcacccaggtcttcatgcaaagcttcatcaaaaatagtaggtgaattcttgtaatcttgaggcaggcaggtccaggtgagttgtccattaatgccactttcagaatcatgccactcaaatgcaaagtatttctggcttttggaagccaaaggtaagctgaagaaagcattctttagatccaaaacagaataccatttccgatctgaaggtagagagctcaacagggtataagggttaggcacttttgggtgtatgtacatcaccctgcagttaacttccagtagatcctagacagggtggttgtcattggactttggctttttcacagacaataatggggtgtttcagactgactgacatggcctaaggactcccaaggccaacagtttcttgatatggggagtgatccccttccatgtttcctggggcatgacccatactgggtctgctcttggcttgagctctacaaatacaggaggttgatgttttaccagcctcatatctccagtctctgcccatgcctggggaaactctgccagccaggcatccaggtcttgttcggggctggctggtgactcgtatagtctatactcagtctcagaggccaggtcaagtgtcagcacctggattggattgctgtttccgtttgtcagctggactttcccagggtcaaaatgaatctgaactcccattttggctagtaaatctctccccaacaaggggtatgggcattcaaggaggtaggaatatgactttttctggtgtactgtcctgtaggataggatagaaaagctttaaaggcttggagtcttcccatttttgttcttttgacatcagagcaggcatggtttctggggggcaaagtagtgttagtcagggataataaaaaggatttcacccaaggtggtgggttgacaataaaatctttccagactac

SEQ ID NO: 132 - protein, 167 aa, Mus musculus
RAFTEDFLLFTSPQRPWSLPLLTSSVLHLLCTMDTARVYFGLKPPRTPGAWHESPLSLPPDACRCPRSHRLALKLSCAGLILLVLTLIGMSVLVRVLIQKPSREKCCVLIQENLNKTTGNFLSAHNTGFHTEISAFTFLKFPTLGRKVKLTVVEKKPLCCSFKTKKN

SEQ ID NO: 133 - DNA, 32677 bp, Homo sapiens
tctgtttcataacaatgtcaataacttaacattagtgaactctacacttagaaacgattatgctggcacattttatgttgtgtgttttttttaaccatagtaaaaaaatacacaagaaaagttgtgtcattgggggagctctagtgttcagtgatgacaaataagagaagcatattctctgagaagactgagaatgtaaggacagtgttttcaatgaaatatcctctctccctccatccacagaattggaagatggtcaatcatatcggaagagtgcagtaagacaatgaagatgggagagtgagtgaaagcctctaaggattaaagactgtggctctatcactccatttatcttctgcctcatctgttatttaccgcctgtgtgcaccgtaattagcccattcaaattcagaattataaacaaaatgtttcctgctaaatttaaacagttaaaaagtgcttattgccgcctaagaaaaatattaacaagattaggcgtgatttctgagttaagacagatgtgttctaaccatggaagggactcaccgtttggctgtggcttttctatttgcttggacttctcactcatcagagtccagatgtaccagttaagcttcatttaagtctcagttcttctttctttcttctgtgttcctatagattttacatataaatacatttataatgtatttgcaatgtggtaatataaatgtatgtctatttttgctaggaaatgaaaattttcccttgaactgtgactttttgtaatgccggagaacaacgacacaaatgtatattgaaggaagaatggatatgtggtgtatttattgtgcttatcctatgcttcctatttgtgctggagtgtagctctggaaaacctcctatatttgttttctagggcttccataatgaaatgccacagactgggtggcttaaataaaaataattaaataaaaaataattttttttcagagttctagagtctagaaatctgagatcagggtgttggttgagttaatttcttttcttttcttttttttttttttttgatggagtctctctctgtcacccatgctggagtgcagtggcacaatctcggctcacagcaacctccgcctcacaggttcaagtgactctgcctcagcctcccaaatagctgggactatacaagcgtgtgccaccacgcccggctaatttttgtatttttagtagagacagggtttcaccatgttggccaggcttgtcttgaactcccaaactcatgatccacccacctcggcctcccaaagtgctgggattacaggcatgagccaggagttgatttcttttaaggcctctctgcttggcttgcagatggtcatcttctctctttgtcttcacctggtcttacctctgtatgtatctatgtcttaatctcttcttaagaggagtccagccatatttgattagggctcacctttaacttatttacctctttaaggactccatcttctaagggttaagatgtcaatatatgaattctggggagaagagtaggaacacaattcagcccataacacctcctaacaaattttccacatttaatctaggagattggtaatatttgtcctcaaaagataattttgtgtgtgtgtggttgggcattataactgaatttaccgttactaatgcaagaaaatcatacagcaaaatatatgattttaaagtaccaactgaacctactgatcaagacttgaaatacaaactctttccaataataaatgtactttctataacctgttcaataatacattatactagtattcagaacattgtcaaaattgtgatgaaaaaagatattgtatgaaagtttttgatgttcaaagttcagaaatttccactgcaaacaaaattaggtcagttgcacaggaaatatttaccacaaaagtctctacagaaagatacttttataaactgtcatcaatcagcatgtcagctatcagtggagctataagcataagcctgaagtccattcactaagatggggatacatattgttaaagctcaattttgtaatctaagaattgtgtttatttttagaatagcacagttctcccatcattttcgtgttatcaaatacaaatacaaaggttagggatgggggataaagcagctgctggaagtcaaattctcagagtataaagtaacatgatctccttattatgagagtcatgtgagactctaattcagtcattcagttactgttcagaaaacatctactatgttacgctccacattatttgttgggagggttataccaaaatgttaaatataaaatacaaatgcataatagaaacctagcaacgacaaaggtaagatacaagctgtgtcttcagaaaaaaaggaagtggtaaattcttgctgattttgcaaagatggttgtggtgttccggatggtggtaaaagtaagagagtttctctgaagcaaataacattctaaaacaagtggtcaaggagcttggattttgaatgccatgaaaagaaaaaaattacatgaaataggtctcatctagcaataaatatttataataaaagcagacagaacatgcctgcaaatactctgcactaacttcagattagatgttacctctggtaaaaagtaaagggaaaaatgccattagttgtgtctgtaaattttatttgttcattttttaacctgatatgaagaaaaggtgggcaaaagtgatagtaaaaaccacttattcatccacagctttgttcttttgccttaggactgtcttggcaatgagggctcttttttggtaccagtaccatgttattttggttactggagtcttgtagtacagtttgaagtcgggtagcgtgatgcctccagcttcattcttttggcttaggattgacttggcaatgtgggctcttttttggttccatatgaactttaaagtagttttttccaattttgtgaagaaagtcattggtagcttgatggggatggcactgaatctgtaaattaccttggtcagtatggccattttcacaatattgattattcctatccatgagcatggaatgttcttccatttgtttgtgtcctcttttatttcgttgagcagtggtttgtagttctccttgaagaggtccttcacattccttgtaggttagattcctaggtattttattctctttgaagtaattgtgaatgggagttcactcatgatttggctctctgtttgtctgttattggtgtataggaatgcttgtgatttttgcacattgattttgtatgctgagactttgctgaagttgcttatcagcttaaggagattttgggctgagacaatgggcttttctaaatatacaatcatgtcatctgcaaaccagtacaatttgacttcctcttttcctaattgaataccttttatttctttctcctgcctgattgccctggccagaacttccaacactatgttaaataggagtggtgagagagggcatccctgtcttgtgccagttttcaaagggaatgcttccagtttttgcccattcagtatgatattggctgtgggtttgtcatagatagctcttattattttgaggtacgtcccatcaatacctagtttattgagagtttttagcatgaagggctgttgaattttgtcaaaggccttttctgcatctattgagataatcatgtggtttttgtctttggttctgtttctatgatggattacgtttatcgatttgtgtatgttggaccagccttgcatcccagggatgaggccaacttgatcatggtggataagctttttgatgtgctgctggatttggtgtgccagtattttatagagaatttttgcatcgatgttcatcagggatattggtctaaaattctctttttttgttgtgtctctgccaggctttggtatcaggatgatgctggcctcctgaaatgagttagggaggattctctctttttctattgattggaatagttccaggaggaatggtaccagctcctctttgtacctctggtagaatgtgactgtgaatctgtctggtcctggacttttttcggttggtaggctattaattattgcctcaattttagagcctgttattggtctattcatggattcaacttctttctggtttagtcttgggagggtgtatgtgtccaggaatttatccatttcttctagattttctagtttatttgcatagaggtgtttatagtattctctgatggtagtttgtatttctgtgggctcagtggtgatatcccctttatcattttttattgagtctatttgattcttctctcttttcttctttattagtcttgctagctgtctatcaattttgttgatcttttcaaaaaaccagctcctggattcattgattttttgaagggttttgttgtgtctctatctccttcagttctgctctgatcttagttatttcttgccttctgctagcttttgaatgtgtttgctcttgcttctctagttcttctaattgtgatgttagggtgtcggttttagatctttcctgctttctcttgtgggcatttagtgctataaatttccctctacacattgctttaaatgtgtcccagagattccggtatgttgtgtctttgttctccttggtttcaaagaacatctttatttctgccttcatttcgttgtgtacccagtagtcattcaggagcaggtcgttcagtttccatgtagttgagcgagtttcttaatcctgagttctagtttgccctgtggtctgagagacagtttgttataatttctgttcttttacatttgctaaagagtgctttacttccaactatgtggtcaattttggaataagtgcgatgtggtgctgagaagaatgtatattctgtttatttgaggcggagagttctgtagatgtctattagttctgcttggtgcagagctgagttcaattcctggatatccttgttaactttctgtctcattgatctgtctaatgttgacagtggggtgttaaagtctcccattattattgtgtgggagtctaagtctctttgtaggtctctaagggcttgctttatgaatctgggtgctcctgtttttgggtgcatatatatttatgatagttagctcttcttgttgaattgatcgctttaccattatgtaatggccttctttgtctcttttgatctttgttggtttaaagtctgttttatcagagactaggattgcaacccttgcttttttctgttttccatttgattggtagatcttcctccatccctttattttgagcctatgtgtgtctctgcaggtaaatggatctcctgaacacagcacaatgatgggtcttgactctttatccaatttgccagtctgtgtcttttaattggagcatttagcccatttacatttaaggttaatactgttatgtgtgaatttgatcctgtcattatgatgttagctggttattttgctcattagttgatgcagtttcttcctagcattaacggtctttacaacttggcatgtttttgcagtggctggtcctggttgttcctttccatgtttacggcttccttcaggagctcttgtaaggcaggcctggtggtgacaaaatctttcagcatttgtttgtctgtaaaggattttatttctccttcactaatgaagcttagtttggctggatatgaaattcagggttgatatgaaattcttttctttaagaatgttgaatattggcccccactctcttctggcttgtagagtttctgccgagagatccgctgttagtctgatgggcttccctttgtgggtaacctgacctttctctctggctgcccttaacattttttccttcatttcaactttgatgaatctgaaaattatgtgtcttagagttgctcttcttgacgattatctttgtggtattctctgtatttcctgaatttgaatgttggcctgccttgctatgttggggaagttctggataatatcctgaagagtgttttccaacttggttccattcttcccatcactttcaggtacaccagtcagacatagatttggtcttttcacatagtcccacatttcttggaggcttcattcatttctttttactcttttttctctaaacttctcttctggcttcatttcattcatttgatcttcaatccctgacaccctttcttccacttgatcaaattggctactgaatcttgtgcatgcatcatgtagttctcgtgccatggttttcagctccatcaggtcgtttaaggtcttctctacactgtttattctagttagccatttgtctaatcttttttcaaggtttttagcttctttgcgatgggttcgaactcctcctttagctcggagaagtttgttattaccaatcgcctgaagccatcttctctcaactcatcaaagtcattctccatgcagctttgttctgttgctggtgaggagctgcattccttttgaggagaagaggcactctgatttttagaatttttggcttttctgctctggtttctccccatctttgtgattttatctaccattggtctttgatgatggtgacacacagatggtgttttggtttggatgtcctttctgtttgttcgttttccttcttacagtcaggaccctcagctgcaggtctgctggaggctgctggaggtgcactccagtccctgtttgcctgggtatcaccagtggagactgcagaacagcaaatattgcagtacggcaaatgttgctgcctgatccttcctctggaagcttcatctcagagggacacctggctgtatgaggtgtcagtcagctcctactgggaggtgtctcccagttaggctactcgggctcagggacccactagaggaggcagtctgtctgttctcagatctcaaactccatgctcagagaaccactactctctcccacgctgtcagacagggatgtttaagtctgcagaagtttcttctgcattttgttcagctatgccctgccctcagaggtggagtcgacagaggcaggcaggcctccttgagctgcagtgggctccacccagtttgagcttcctggcagctttgtttacctgctcaagcctcagcaatggtggatgcccctcccgtagcctcgctgccaccttgcagtttgatctcagactgatgtgctagcagtgagcaaggctctgtgggcatgggaccctccgagccaggcatgggatataatctcctggtgtgccatttgctaagaccattggaaaagtgcagtattagggtgggagtgtcctgattttccaggtaccgtctgtcatagcttcccttggctaggaaagggaattccccaatcccttgcgcttccttggtgaggcaatgccccaccctgcaccatgggctgtccccactgtctgccaagccccagtgagatgaacccagtacctcagttggaaatgcagaaatcaccaatcttctgtgtcgctcacgctgggagctatagactggagctgttcctatttggccatcttggaacccaatccacctaaggtcttgctctaaggttctatgcctgaaaatctttgaaagaggtgaaggacctcttcaaggagaaatacaaaccactgctcaatgaaataaaagaggacacaaataaatggaagatcattctacgcttacggataggaagaatcagtattgtgaatatggccatactgcccaaggtaatttatagattcaatgccatccccatcaagctaccaatgactttcttcacagaattggaaaaaactactttaaagttcatatggaaccaaaaaaggtcccacattgccaagacaaacctaagtcaaaagaacaaagctggaggcatcacgctacctgacttcaaactatactccaaggcaacagcaaccaaaacaacatggtactggtaccaaaacagagatatagaccaatggaacagaacagagcccccggaaataataccacatatctacaaccatctgatctttgacaaatctgacaaaaacgagaaatggggaaaggattccctatttaataaatggtgctgggaaaactggctagccatatatagaaagctgaaactggatcccttccttacaccttataaaaaattaattcaagatggattaaaaacttaaatgttagatctaaaaccataaaaaccctagaagaaaacctaggcaataccattcaggcaacaggcatgggaaggacttcatgactaaaacaccaataacaatggcaacaaaagccaaaattgaccaatgggatctaactaaattaaagagcttctgcacagcaaaagaaactaccatcagagtgaacagacaacctacagaatgggagaaaatttttacaatctacccatctgacaaacggctaatatccagaatctacaaagaacttacataaatttacaagaaaaaatcaaccaaccccatcaaaaaatgggcaaaggatatgaacagacacttctcaaaagaaaacatttatgcaggcaacagacacatgaaaaaatgctcatcatcactggccatcagagaaatgcaaatctaaaccacaatgagataccatctcacaccagttagaatgacagtcattaaaaagtcaggaaaaaacaggtgctggagaggatgtggagaaataggaacacttttacactgttggtgggactctaaactagttcaaccattgtggaagacagtgtggcgattcctcgagggactagaactagaatttgacccagccatctcattactgggtatatacccaaaggattataaatcacgctgctataaagacacatgcacacatatgtttattgtggcactattcacaatagcaaagactcgtgaaccatcccaaatgtctatcaatgatagactggattaagaatatatggcacatatgcaccatggaatagtatgcagccataaaaaaggatgagttcatgtcctttgtagggacatggatgaagctggaaaccatcattctgagcaaactattgcaaggacagaaaaccaaacaccgcatgttctcactcataggttggaattgaacaatgagaatatttggacacagggaggggaacaccacacaccggggcctgtcgtggggtggggggaggggggagggatagcattaggagatatacctaatgtaaatgacaagttaacgggtgcagcacaccaacatggcacatgtatacatatgtaacaaacctgtacattgtgaacttaaagtataataataataaaaaaaggtaaaaaaaaaaaaagtagacacatactataatcaccttgaaaaaaaaagaaagtctttcaaagagataaaaaattccatatactccacttcctacaattctggcagtttccaaatacttttacttatgtgaaaatgctatcatatccaagagtgcctttagagctaagctaacagtaggctactgatctttagcacattgctttttctgttgtgttattcagggggctttctcacatttatgtttccatttttcacatttcacaactttctttggagcacagatatttcaggaagattttagagcctttgaatagcattatggacttttttgcattaatttttacttttacaaaattgtgctaaatattatttctgttaattagtgagttttgttgggggccccttaaattggaaccccaggctatgcctcatttgcttcactctggtcctggccctgagagaggaacacaaaagggatggttagaaaaacaagaacaaatgagcctcccagaattttctcaaacaacaggccagttaattaaggaaagtagatattacatagctaggtataatgaacatgcagtcagtggattgtctcagtaatttatggagataaccaccaacaaaaagtgtatgtgggtggggacaaaagagagacaacaaagtactgcaggcagaaagcttccttttgctgattttgcctcacagaattgagagtttgttcttacacacaagtttaatgccaccttcctctgtctgccatggaccaacaagcaatatatgctgagttaaacttacccacagactcaggcccagaaagttcttcaccttcatctcttcctcggggtaagtggctttaattttcctttcggcatttgtatgtcttccagaattagatcttcctgttacatttatggctttaaatcattgctttaaagatgagcagtagttttatattaatgtttaacgggtgttgcatggcttgcctgtagataatcacaactttgggaaaaaaaatttaaacctcatacatttatttttttcaatcaagttagcatgaaaagcaaacatcacttgtcttactgagccttggttaaaagactctgaacactttaggctaccctgggcacactgcctattggttacccctgctctacagggatggaaaaaaggaagaaagaaagacaaaagaaaagaaaagaaagaaagaaagaaagaaagaaagaaagaaagaaagaaagaaagaaagaaagaaagaaagaaagaaagaaaggaaggaaggaaggaaggaaggaaagaaagagaaagaaaagaagaaagagagagaaagaaaggagagaaagaaaaagaaagagagaaaggaaaggaaagaaagaaaaagaaagaaagaaaaagagaaggaggaaggaaggaaggatggaaggaaggaaggaaaaatattttacatgtatgaactaaggaatatttaagacacattgcaaacttgctgtaataacaacctacgttattccaaattcctctacaaaatatcaatactatgattaagtcccagtgcattttcatccataatattcctttcagaatacaacgtgtaggccagttgcagtggctcatgcctgtaatcccaacactttggtaggctaaggtgatttgcttgagttcaggagtttaaggccagcctgggcaatgtggcaaaacctcatctctacaaacaatacaaaaaaatagccaagtgtggggcacgtgcctgtggtcctagctactcgggaggctgaggtgagaggattgcttgagcccaagagatcaaggctgcagtgagctgtaattgtgccactgtactccagcctgggtgacacagcaagactatctcaaaaaaaaaaaaaaaatatatatatatatatatatatatatactttttatacatatattttatatattttatatatatatatatatactttttatacatatattttatatattttatatatatatatataaagtgtaggcttaatgagtaacatacttcactctctcaagagaggggaacactttctggaaaaaaaatcatattcaagatcaaagatttgaatatcattactacctgatagtttctagtttgaaaagtatcacagcttagaaagagacaagccacaaaaatactcgagcatatcagtaacgaacctacttaccatttgttgaaactggcactttcctgtgtctctgaagagttagcattctgagtgaaagaagcggggaacaccaatgtgaggtaacacatgatggatagcatggcctgtggatggatgggaagaaactagaaactgaggcagaaaatcagcatgaaattattatgacacattattattttctgatatctaactgaatttactatcattgataatattacaattgtttaccaatctgatattcattccatgtcatgccaagcatttgacttgtgctgttttaagactgtttaagttttaaactattgaattctcaaagttttaagtcaagaagaaagtcttagagccgtcaattaagtttcagtataattttcacataagagtagaggaaatcagagggttctaataactatagggaggatttggttgagtaacatttttttttaaagaaaagactaagtctttcttttcctctattcatatctagcaaaaggtggaaagtgggcttttgtcagaaaatgaatatagaggtagtgagactcttcccaaatgttgctatgatcccaaaccaatggatgcagaaattttttctacttggattgtaataattatcctataaaatgtcattctgagagtaaacctgaagaaaaaataagagtagaataaagccagagcaaaatatgtgactgtagaacactggtctgatattgaatgatagtaaaaccactattggtctctggctaaactgctgaggctgtggtcactctgtagcaagcacggtgattgtgtctaaggcagtcaacaaaaccagaaggagagatgtgagtgataaccgatcttgcttatggccaaatggccaagggtttggtctgttagaaaagtggataaggtgtttgcaaaaatgcccctagagtttattcattcattaaaaaataatctcctactctgcaccaggcatgctgtgaatacagcagtgaacaaaatagagaaaattattttccttcatagagtttatagtaaaatagaggcacacttgtggaagacagtatggcgattccttaaggatctagagctagaaatacaatttgacccagtgatcccactactgggtatatactcaaaggataataaatcatgctgctataaagacacatgcacacgtatgtttattgcggcagcattcacaatagcaaagacttggaaccaacccaaatgtccatcattgatagactggattgagaaaatgtggcacatatacaccatggaatactgtgcagccataaaaaaggatgatttcatgtcctttgtagggacatggatgaggctggaaaccatcattctgagcaaactatcacaaggacagaaaaccaaacaccgcatattctcactcatagtgggaattgaacaatgagaacacatggacacagggcagggaacatcacacaccagggcctgttgtggggtgggggtagggagaagggatagcactaggagaaatacctaatgtaaatgacgagttaacgggtgcaacaaaccaacatggcacatgtatacatatgtaacaaacctgcacattgtgcccatgtaccctagaacttaaagtataataaaaaataaaaattaaaaaaatggaggcacaccatcaataaaataaacaaataactaagtcagtataaaagatgagacggtgttaatgttattgagaaagatttgaatataggatttaactttcggggagggtagcatatcaaacagaataatcaaggaaggcctccctgagaagatgacattgagtcaaaacctgacagaagtgagggacaaagacataagcccctgagagagaagccttctaggaaggtgaccaacaagtgcaaacacatcgaaatgaaaacacgcctgtggtattgtaggaggcatctgcgtggagagtgagcgtatggaggccagatggggtgagggcaaaatgtgaaaccactattggactctggctaaactgttgaggctgtggtcactctgtagcatggtgattgtgtctaaggcagtcaacaaaaccagagagatgtgagtgataacatccaacagaagtgggcgccagcttaaatagggacatatgagccattctacagactcagatttgcctgatgaaaagccattggaaggtttagaataatgaaatgagatgatttcacatactttttaaactcaaatggagaacagccataggtaggtatttccagatagctaacgtccgccggacccctgtagtgattcattgtaacttcattaattctaatgtcacgtggtgccacagaaacacagtacaggagtacattcctcccagacacagtacactccactcaactccttacattttagcatgaatgaataacgatttttaaaagtcaccaagttgccttttacctatagttaaaaaaaaaaaacaacttttagaaaaaaagaactgctgttcattgaacagttaccatgtgccagacactgtgcccagcatttagaagaattgtttcatataatcctctccaaaatattatgacatagataatattccacatttcacagatgaggaaatctgtgggttatgaaggttgaacgtattttccaaaataacatgttcacattcagatttgctagatcggaaagactgttcttaatcaatgttagcctttagtaatgaaaattactaaattcatgttagtaatagaattaggctgggtgcggtggctcacgtatgtaatcccagcactttgggaggctgaggcgggtggatcacctgaggttgggagttcgagaccagcctgaccaacatggagaaacccgtctctactaaaaaaaaaaaaaaaaatacaaaattagccgggcgtggtggcgcatgcctgtaatcccagctactcgggaggttgaggcaagagaattgcttgaacctgggaggcggaggttgcggtgagctgagattgcaccatgagcctgggcaacaagagtgaaactccgtctcaaaaataaataaataaataaatagaattaagttaacacttaaaatagtgactatacagagctttctccactagacaaacaaacttagagtttcaaggaagaaaacggtggggaagagaagagacagaaaggtgaaataacgtacatatataaaactggaaggaaagccatgccagtgctgtcttgggcttattgactgcatgtagacattcttgtatcacaccagctctcattagaagttctaggccaatattaccaagcttggtttcctcacattcagatatatccctggggccttggagtctcctctaggtatctactcctccctgcccccctccactgatacagcatgtcctaaatagtaccagacgataatccatatgttacaaccctgaccccagtgtattatggttcctcccataatctttgatcacatctaacgctactaaattctatctcctcagggccgttttagagagagctgattcacttatatcagtgtgagcatcctaatgtgagagattatcaggtctgcaaactggactgcacaacttaatcctcaaggatactgtaccattaaaagtagaaatggcttcatggccgttctgaaacatataaagagactaaaggataatattatagtatatctgatgctaaattttttaacatgtaactcatagcaagtaatcacttacatggaataatattagaaaaaataaaaaggaatagacaatacaaataaatcaatagcttcagataaattagaaagcctttattcataaaagctcctagctctaataatagaatttataaagtaatttataattataatatatctaatatgttaaaaaccaaatgagagcagagggagacttacaattaaatcagagataggggagctatttaggcacaacttctagcagtgtaactgagcaatatactaccagaataattccttatcagagttgatttaattttggaagctatatcccagtgtttctccaaaatatttttataaatctctctttattttttttctattaattcatgttttcaaagatacagagcaaaatacattgataaagttgcgattaatttataacatttcatcaatataatcataacttttgaagaacatgggagattcattatatagtaattgatgtgattacagagaaaagcagagatatctgacacttggtttagactatgcgatgttgtagacataagcgcatgttatgttatactagtgataatattgaaaaaggtatgcagtcacaaaaccttatcccttgatggcttgggatcccaagttggcttagacccaacttggagatgattgttctagacaacagcaaagcagaggattccatgtccaagaatagaatttctgtataccaccagcacctaacatggtacttggcacaaaatagagagagcctcaaaaaatatcttgactaaatgaaggtcttccttcttggacaaaatgctttgacttacttcatacattaagacatgcacttaatttttgtatagcacttggcaattttcaaaacatctttctatctatctcatttggttcttacaccaatcctttgtatacacacatgcataagcgttcatattttatcaatgagcaaactctgttggatctgagaacccatcttgcaggactctacttttagaatgatggatagaggttgttccctgcccccatcccccaagctgaatctaattgtccctatgttatcccaagtacatttttgtgccagatgtactccactgagttaaccaaggttttttgtttcgtttgtttgtttgtttgtttttgtgtttttctttttaacttttcagatgtctgtcagggttcaccttggcatcaatttgccctgaaacttagctgtgctgggattattctccttgtcttggttgttactgggttgagtgtttcaggtaagtggggcaccatcatctgtttcataatacttactctacttccattacgtatcttagagcatctctgtaggggtgggttgcccctacacacctgtgggtgtttctcgtaaggtgggacgagagatttggaaaagaaaaagacacagagacaaagtatagagaaagaaataaggggacccggggaaccagcgttcagcatatggaggatcccgccagcctctgagttcccttagtatttattgatcatttgtgggtgtttctcgagagggggatgtgtcagggtcacaagacaattgtggggagagggtcagcagacaaacacgtgaacaaaggtctttgcatcatagacaatgtaaaggattaagtgctgtgcttttagatatgcatacacataaacatctcaatgctttacaaagcagtattgctgcccgcaggtcccacctccagccctaaggcagtttttccctatctcagtagatggagcatacaatcgggttttataccgagacattccattgcccagggacaggcaggagacagatgccttcctcttgtctcaactgaaagaggcattccttcctcttttactaatcctcctcagcacagaacctttacgggtgtcgggctgggggacggtcaggtctttcccttcccacgaggccatatttcagactatcacatggggagaaaccttggacaatacctggctttcctaggcagaggtccctgcggccttccgcagtttttgtgtccctgggtacttcagattagggagtggtgatgactcttaaggagcatgctgccttcaagcatctgtttaacaaagcacatcttgcaccgcccttaatccattcaactcttgagttgacacagcacatgtttcagagagcaaggggttgggggtaaggttatagattaacagaatctcaaggcagaagaatttttcttagtacataacaaaaaggagtctcctatgtctacttctttctacacagacacagtaacaatctgatctctcttgcttttccccacaatctcaacataatttggctaccccaatcttagtgtaaaatcaatgaataaaaagtcatgaaacaatgtttctaacagtcagtccatatccactttggataccagcctttcatatttgtcttcctaactgccctgagagtcatcacggggtattatatatgtggcccaagaacttttgaaaaaaatcacaattgatgataacaaagaaaagaaaaatttccagttatttatggtttataatgtacttactaaaattccagattgcagtagacaatctctcccttggaacaggcacaattagactcattttgaagatgataaagttcaggtgagactgtaggcaatttaagagcttaagtaatccccttagattgacttacctagtagatacaggcaacctaatgcctgtgtgagtccacctgttttgttttttcttatttgtttctgtatgcttcctgtaggtgagatcttttttttttttttaccacttcgctaatacttttattttctgtccatattcaagcgtgttgagattatctagtttcctaaagtaacaaatataatatatccactccaccacacatttcagcatttaatactcttgtttttccttatgtactagtgacatccttaatacagaaatcatcaatagaaaaatgcagtgtggacattcaacagagcaggaataaaacaacaggtaattgtgtggcttcaatttcctaagaataactgttaatatttggtagatttcatgtgttaccttaggcacaattcataacaatccatatgttaagatattcttatcattctgcttttctggattagaaaattgagacataaaaagattcaacaacttgctgagggtcacataagcaccaagtgatgaggctgggaattatatgtaagtggtctgacttatgagcctaaggttttaaccagcaaggcatgctgcctcatgaggagcctctgctaggatactccactgttgataggaaatatgtgaaatatctgattattttagtgagctgttaagtttggtctgaagttaattgatagaacttaaacatagaatgaattctttactatttattatatttcctcaccatgcagccacattagtcttgttccagtgtgtgttaataaaaaaaggtgactactgttgagtgactatagtggaatatgatctgtgtgcacattctcacagaatggaagttttaagaaaacctgaaagtccttctggaaaattctatccaatagatcacattaagtaggtaaatacatcgtttagcaattggaaattttcttataattttttctccatggtatttcttattaatttagtgaaaataattatttgctatgcattttgtgcatcatttaaagtcagtactttttacatgagttttatattgttgcctgtgcagtgaaacaggcactggtgatgaatttaaggaaactgagaagtagtgggaaatatttcatctgactggctggacttaagttattctgtctctcactgtcttaaaatgtaagatgtggcagtttaaattattctgatggtgttttcctattttaatattttatgattccatttatgctcaagataactggtcactaattcccaattcttggtactagaatgaacagtaggtctcaaaaatctcaactttataacaaattcattgttctcacagtgataatcaaaaactttgagcatttataatgacctgtgtgtgtgtgattggttgtggtgtgtcagggataggttagaaatataacatttatttcttatttctgttttttactttagagagaccgggtctcttaaactgcccaatatattggcagcaactccgagagaaatgcttgttattttctcacactgtcaacccttggaataacagtctagctgattgttccaccaaagaatccagcctgctgcttattcgagataaggatgaattggtaaatcattaaataaaataccttaataaaacttaacactttctttaaaccatattaatatgtctgtgcattagcccaggggttttatgcaatggaagtgatgactttgacttcacaatttgaatgactacgtggatatgtaaacaaataattaaatataaggtgatgaatacaataatagaaataaaaacatagacagaaatatcacaaagaaggaataattaatgctgacgacgagttaggaaagacttcagagatgaggtgatgcttgaactaggttttaggggatcaaaccaggaatagataagcagattcaatatttttctgttccatttatagatacacacacagaacctgatacgtgacaaagcaattctgttttggattggattaaatttttcattatcagaaaagaactggaagtggataaacggctcttttttaaattctaatgagtgagtattagatgagctaactttaatattcaatttatatcaggtttacactgcaaggtagtaacactgaagattgagttttgtagttttaatttggtttaaaaactcaagaagttctgaataggctaagaacatggatgatttcaaagttggttggaaagttctatatatgaaaagatatcagctctttatgagaaaatatatttttatctgcaatggagttttaggggacaggaaatagactaacttatttgaaacgggcacattaaattaaaaatagtgattatctggagaccactggcacacagaatgtcttacgttgtatttttcaaactgtgggaaaatatacattagtaggtaaagagaccaatttagtgggtcacagctggcattaaaagaaaagaaaaaatagtaaatatcagagtgtggaacccagacacccacgttgtgacaaaaattgcagtatatttgaaccactggtgtgaaagacagaggtacttgagacgatgtgatgaaaacatgtctaacccacaaaagagctatttgctgttttctcttcagtgtgacatgcttttgtcttgtgtaagatggtcaaaattaccatcaacgtactatgagggttgatgcgacacaggcaaatttcatgttttagcagaattcatggataattttgcagaaaaaggcagggtgttttcttccctcacaagcgaaaatgtataggccttcaaccacatttctgtaaagaacttttaatgagtttttcaaaagagataatataaacagttatatttaatgagtctgtaaatgatttagtcaaattggcagaatttacatttaaaatgtattttccgtcactcaaaaaacaagaggttaaaatctaaaacataggagaatgttttaagtttgtctacattatactaagataatttattaagtatggaaagtattaaacactgaaaggaatgttggctcaatcagcaaagttttgacattatatgagccacattctaaaatattttataaagtgtaagattttaaaataaagatgatttaaaataagtgttctggactagaataaatttatgaaaagccaaacatacacattatgtttaaaaacatctctcttgatttttatattgctttctgggggttattttcaatattttatttacaaataaatgaaagtaggtttgctattaatttatttttatctttccacacatggtattggtgaattagcatttattaagtatagtttgtgtgtgtgtttcttaatggggtcataatgcaaaatgtttattttattgtggttcacagtaaaaaataaaatttgaaaacattgaaatgtgaacataaatatgtgtaaagtggatggaggaaattcagttgaacttttcattttattctgaggagaaagatgatgctttaagataatagtgatcaggtaaacctggaaggtatcacgttatagtagaaaaagcaccagttagactctgcttttatttgcaaggcaaggaaagaaagggaagaatcataatttttttacaggattattttgggggctacaggagacaatgttcaagagctagccagatgtctcatcaaggaaggcctgtaaaaccactgagggccttttggaaaaggaattgttgacttggccagattggcatttaaaaaaattaccctgataattgaagaaacaattaaaagggtggaagagataaaatatagggaacttttgcaatagcccagttgaaagaagttcttggtttgactagaaggttgggcagtaggaagaaatcagacaagcagccccaagaggctacatgagaaaatggaacaaaggactaaagaaaagctgtgatggagcccagcatgctgccaccacctcatccgtttgagacaaataggagagtcttgaactcacaccgtccttgcaactcaaccccaatacagcctgtccctttgtttgaattatatcatcacctcctacctgcagtgagccacaggactcatgtctgtttgaaactaatattatgtttctgcagacacctgttcacctctgtttggaatgagaatgaaaggaacctctgactacataaccatgaactgagccactttttctcactgcttccaaattctatagaccctgaatatccatcatgcctctagatatttatcatatttactcagcacatatttttgaagtattgccacattttcatatttcatctccatgcctcccctaaatattaggtggctatagcctaaatatttaataaaactgtggctcagtaaagttaggaaacatttttaatgtgacctgttagtagaacaataagaagactgaatccccagtttccaaagtttctttctttttttaatgtaattgtgaagtttcttgttagagggattcttttccaatgaagatgaacttggaagttccagaggtttacattagctctatcttaaaagttcataccattatatttgtgaccgtgtgccttctttgtttaatagtttatcattctactgcttcctgagagtcctaggaaataatggctaagtgagaatagctctgagaaaatcataaatgctaagacagacttttcttttgctccacagcttagaaattagaggtgatgctaaagaaaacagctgtatttccatctcacagacatctgtgtattctgagtactgtagtacagaaatcagatggatctgccaaaaagaactaacacctgtgagaaataaagtgtatcctgactcttgactatgaatcccatctcaatttatttgcttcccattactgatctctgtacttgtagctgcacatactattggtactacctaatagtgccacatttagtggcacaaagtgaacaattctgagaattgtacaactgttatgaatcttacagaagttcatgtttatcatattcattctattaaatgaggaaacagagacatagagaaaaacgtgcatcgttttaaagaaacagtgatattctatggtgaaggagtgaaggatgtccccgaatatgccagattggtatatgattgttttgtgtttaaaacagtggagaaattgtagattcagaaagggagagctgacctgtctcttcccgcagcggcaagccgtgaagattcctctgggagggctatccgagtcatacgagggcaagaaaatagctcttatcgccagagacctggaattggatgctgcaatgaacctgaataaagatacttaataaacacctatctttcacctattttacagccccccgcaaccaatatatctcctagtgactcctctagaaaatttattgcccctagccagcttttcttcatcctgtcatttcttttcaaatttatcattcttggtctaaaaagcataaaagcatcttgcttaggccacttctatggatttcactctcttgcgagttcctcatgtacatgcaaaacgaataaaatgtgtatacttttattttgttcatctgcccggtgccagtttagtttctagatccaatagaagagcccgctacgagctaacaaggggctttggaggtgatctgtggctccccttcaatggaaagaaccccagacctgctgaagagaattagattctaatcctgacgtgtatgtgtggacttcattgatcccttccatgtaatggctcatctccaggaaaattttagtaaataattgctaaatccctgtgcatccatcatagtctatcattttttaaaccagtacacaattgagttgtggcagaacattgattaaagttcattcttttaactctgacaccagaatcccataattaaaggagtttgggaagggaccttaactcttcttgccattccatcattcttcccattttaattttaatattacatcattttcttccatattgtcttctacccacggctcacacacacaagctatagaaaatatgtaattaaatctttagttattctgatggaaaataagttataccttttaactgtgaagttaaagttaaaaaacagaagtatttattatcataaatctcttgaatgtccacctttcttaaaaatatgccaaattatgcatggaaatcaaataaatgaaaatggtgaatgtacctgataagaagacttatcataataaaattctgaaaaatagacatctgcttaccctaataattcatcaccaaattgaattatataaattcaagtgcatatgacatggctaaaataatggctcaattcctatatcccatacatgaggagttataatacttgttaaaacaataacttttgaagagatcaaaaatcaaagcaaaattcattttgtgccaattacttagaaaatagattacttagggaaacattttaggcaaatgtgtcattacaaaataatacacaacgaaagtgaggtttggaagtatttgatactttcggggaaggacacgtaatgacaccagtagagtagaaatctgatgaaaattgtcccatgatggaaaacgcacattcccacctttttggaatgatgtcgatagcagtcttctaaagtgattcaggataaggctatatccacccagttagtccagaattcactccaaacattgaccttttcctccttctgtacttgttagatctgaaatcaagcagccttaaagcacacatccgaaagaaaattttgcagaaaacttaaccccgagaagttaggttatctgtcaccgtaatgtgctattgcaaaatcagataattaaataaatttactatgtattggatattataattctgaggttatccctgaatctcaaaccatgaagtcacatttccatgaggaaggcatgtctaacatgcaggttcatgttatttcaggcaggttaaaaaatattaggtttgcggggaaatttttggttatagtatttgagtcaatgtttatgacataaactgcaactccaaggcatggtgaaaatatgatccttagtaaggcattaaagatctactgtctacctactatcaaaaagagaagagatagcaagtgttggtgagggtgtggagaaaagaaaaatcttatacgctgttggtggagacaaaaattggtatggccattatggaaaaaaataaggtttctcaaaaactaaaaatagaacatcatacaatccagcagtgccacttctgggtacatatccaagggaaattaaatcaacacctcatagaaatatctgcaccccatgtttattacagcactattcacaatagccaagatatggtatcattctgggtgtccatcagtagatgaatgaacaaagaaaaggtggtacgcattatatatatatatataaaaatacagtgtatgtatataacataatgaaataatttgcagctacaaaaaaagaagaaaattctggcacttacagcaacatgaataacttagagggcattatgctaagtgaaatgagccagatgcacaaatactatatgatttcacttatatgtggaatctaaaaaagtccaactcatagaagcagagcgtagaagaggggctgctaggggctggacggttggggaaatggggcatgttagtcaaaaggtatgaaatttcggtcctaagatgaataaattctggagatctaatgtacaatgtgttgagtgtagttaataatactgtactgtgtacttgaaatttggtaaaagagcagattttaagaacatatctcctcacactcacacacacatacacacacaaatgatatgggtggtgatgcatgtgttgatagtgctaatcatcacataatgtatatgtacattaaatcatcacattgtacaccttaaatatatacaatttttgtcaattaagtcttttaaagttaaaaagaaaaaagatctgccatctatgtttctgacgttgccttccactacgtgcctctgtgaagcccttgctccaggcacacggaccattgtccaaacaacactgaagtccttcgctctttgcctagaaaaatcctagcagttgtcgaaggctcgaattaaacgttaattcctttgatgaaatttaccccaaatctttttgctcttcataatttgtcatctatttcttcccacttttccaaaatctgattgaattctttgctgtgttacaattagttgcttttatgtttataaagctagttccacttttctcatggctggagttggacaatcaccaagacagaataattaaagggaaaaaaaagatcatctctgacttcattttaatatagtggcttagaaattactcttggcagagtaatctgtttatattatggtagaaagatctcaaggcagggccaatgagattccttctgtgtattttctgtgctacatgcttggatttgaagtctatctctgctttacctccctgccccacccattccacagacttcttcaatacacatggcatgggttaaaaagtaggcatagtagaaaaacatttctggtaggaaaattaaaaatttaaatattcttaatgcatccatctagttttttttgtttgtttgtttaaccagtctttccaatccacttatgtttaggcagccaccaatcaattcttcccttcataatgcagaaatggataagaaaaagtaacttttgccttctatatcaagcagcttggaaaagggaaaattcaaaaaaacaaaaattaaaaaaattctaaaagtaattttggattttaaacacctatagagtcatgaagcaactaacttatcttggtctggtggagatagactttaatctactccttggcggcaattcaagtttacttctacaactgtttgtgatgagcttcacctgctaccttagaggcttaatggttcattttgttttgtttttgtttttgcctttgatgtgctcttgtttcctcccaactgagcaaaacagaacaaataaaaaacagttctgtaccaatcagaacaagtttatcaacttttccccttcagaacatcttacttcctacacaataaataaaactgaataagtatttatttattttcttattttgttattgttgctactagtactactattattaggccctctccatgggaatatgagcccaggggggcaaggaccttcttagtactgtgaatcaacaaacggttctgttacatagtagatgctcaaaaatatttcttatgaacaaataaattattatataatcaattttctgtaatacctgggctcagaaggtggtttttccaaaagtactatttttcaaataataaagcaagcacacagaataatttttcaacatttacaaggtaacccactaatagggctggaacccaagtctgatttcccaggtctgggaagccaactgcactctgtatctcaacacaatctaccagggccctttcaaaataaacatggggacactgtaaaactagagtttacttttgatttgtcctttgcacttcatgaaaaattttcagtattctactttaggaagcaagtaactgctacacaagtaaacatttccaggcaaaaatagtcgaacaggcataatcactaaacgtaattccaattttgactgaaattgaaccccagatagcttgttttgctcacaggtttatgttcagatatttttattcatcagtagtgattttcaggctcaagacacaaacagtaatgtccaattattactactttatttcaatttttttttttggtgttaaaatgaagagtacaggatgacttaaattgttggttaacttataggttaagtgattttgcctaaatggcaatggaggactggattcctgtacagaatgcaagcacctcaataacaattatttttgcctgattcttcactgttgtatcccaaggacatagagaaatgcctaccacatggtaggcactcagtggctattggataaatgatggtgtaaaaaaaagtataaattttccaagacaatttaaactctctaggaaactgtagccagttaatagaaccatttttcaggagacattataaggagtgagaatgcctttgttcacgttgttcagattaaacacccttattttctactttgcctgttgaaaactatgaatatttttaagactcaaattatgtttgtctcctatgaggttgcactgcagtaaatactattttctatgaaatcttattgcaatttcaatctatgtcatacactttgtattacacatattttctttttcttttttgagacggagtctctctgtcacccaggatggagtacagtggcgccatcttggctcactgcaatctctgcctcctgggttcaagcaattctcctgcctcggcctcccgagtagctggggttataggcgtgcatcaccacgcctgggtaacttttctgtgtttctagtggagatgggatttcaccatgttggccaggctggtctcaactcctgacctcaggtgatccgcctgcctcggcctcccaaagtgctgggattacaggcgtgagccaccgagcctggcctgtgttacacatattttcaattttctgtctcaattttgttattatgctaagaaaaatgtaggtctttagggccgttttggtttttttttacatttatttgaaaattttcacactacttagcacttgcttagcgcataattgagctgcttctggtttctcaatattctttcctaaattaggattcactgcagttatcagctaaacacggacaaaaacaacccaaaggaatactttctaagaaaaaaaaaatcttttaaccaatcaaatcagaacaaatgaattactcgaaatcacttcaaatataattaatggaattatataatgctaaaatagggttctaatagaataaatacatataattataattgtagtttgctgcctatgtcagttaggattttcttcattacaaattactccaaagtttagtggcttaaaacaaaaggctttagttttgctctggagattacaagttagctggaactttctattgatctggtctttgctcatctgatttgttctgggcttactcatgcgtctatgggcagctgactggccagctgagggctggctggtctacgatgacctcagttacatctgggacagttagttcactgtccacttggctgctagatccatgtgtttctaattctccatcaggttatcccaggctgttcacatggtggctgggcagagttccaaaaggtagaggggccttcacttgcaactaaacactatcaccccccacatcctattagacaaataagtcaaaagtccagctcagattcaaggggtgggataaatagacttctcatcctgatgagaggaggtgtgaagtcacattacacagggcgtaggtgcaagggaggtgtagagaagcagaactcatgctaatttttaactcaaatgacatataacctttaaaattatttctttttataccagacttcacaaagtatctgtggagaagtttctgatattaattggggtgttggtactaaatagccttgaaggtattttccaacattaggattcaacaattctgtgatttcacccacaaaaactagaaaggatgaaggagggaaatttcaatcaataaaatacatggctgaaattctgtgaatcaggagattttccagaaaatgttgtttgaagttggactagagttaatccttccagctgcttttgttacaagataagttgttgaatcatgtaatgtgacaatggctgtgcaaacagcaactaaaattttggataggatgtaaacagccaaccgcaacacggacaaactaccagcacaattgttttagtccttggaatagaccacaaagccagggacccagaactaaacccagaccattaaaacatcccaatgtattgctgggtctgtttcaaagagctggatggctttttcttttagcttagtcatggttatttacttgactgtatttatgaggtgtagaaagaaccattttgctatagcataagcactcgctcgggaattccttaaaaggaaatcaaggataataccaaacttggctgatggattttaaatggtttgttgagtctttaaagcagaagtgatgttcacataagaaacagtatcctagaagagcacagccccattggtaatataagtagccttcattttaacaggagtgagtcaatcattggtaccttaagttggtcagattttctaagtagagcgaaataatttctgcaaagcaggctggagtgtttctgaaaaaacagaagacagactactatagtaatgatagtgttgaaattagtacatgtgtctgatgagctatgtctagctgataaggatataatgacctcagtggaagcatttcattgagtagggttaagatccactttttacaagattaaaggttggtgttaataatgtaaaggtaatttaagtagctgataagacctctaaaagagaattgactttctgaaatatttaagtaatgtttgtcaacttttttcaatattattttctaaagagcctttttagacattttgtttctaattgccatacccaagaaattttaataccatatagatgcatacctgttcatataccacgtgtagaaccatgattatacataaaaacgataagacatttttaattcataagaacagatttttgcctccgtgggggtgataccactcctgctgagaatgcatgttttaaagagacagctgttaaatccatgacagcagggttggatggaggatgacagagccaataatcagttaactgaaagtggtagaaatggtctgaagaaaatgcacaagagaattttgtttctttttgagcaactgaagaccataggtgccaacagtagaaagatggagaggaagcatgttgagaaatcggtctcttgtcaatatgatatgctacagtacagtagtaggcaaggttaaagaagagcaaacagaaaggaataggatgaagaagaatcacaaaattgattttgtttgttcgtgctgggtggcagttttctactccctagagctttccgattttagaagacagttaagtatcctcagttgaaagtctcccaattcaacggacactcagcaattaaaagaagatgatatgcagtggtcaaaagaaaatgatgtctgtctttttaagaaacatgaatccaaggatcaacttcttggaattttactgctatgctggttgttaccgtacctgctaagttcctttctgtagaagggtaagggtggattttttttaatggggtttctttcagaagactacacttccatgttcaaggtcatgagtagttattttagaaatgatttttgtacctgtttaatgataagactgatgatatctagtcatatccatttaccatagggaagtatcctaaattcatgaagtggcctggaattaagccctaagaaagaatctatgtatgtcatcaaggtttatggcaatatcttaggccttggaagttataaagtctgagagcattgccaatttttggttttgaattccatttgttatctctattttttactaaagattgcaaataggaacaatgaagtttttgagtagaaagtaaagccttaccaagatatttaataacattctcagtgaaacatagtcctcaaaataagcaatgaccaagcatactacaatgtgcctattatttgtataaatgttgatatttgtttctttttacctgggaggctcagatgaggacaatgaactcagttatatgaactgatataaattccagtagagtttcatgttccaagattgaatttgaatctgtaatcgtatagcctgtttgataatttcaagtttttgtttttaaatgcaaatcattataaaacaaaattaaatcagaattactcaaggaaatctacgttaagcctatgtaaagcccagaaaatattttcatacagattaaatcattgagaggtttttttttttttctttagtagaggaaggagtcctggagtcagcatgttacagtggtggatactgataggtgaagacgagagaaatagtatgggaactttaactgcaagtttattaatttatttcataaggtataagaagagtgccccgaccgggcacagtggttcacacctgtaatcctagcactttgggaggccaaggcgggtggatcatctgaggtcaggagttcaagaccagcctggccaacatggcgaaaaccccatctctactaaaaatacaaaaaaaaaaaaaaaaaaaaaattagccgggcatggtggcagatgcctgtaatcccagctactggggaggctgagggaggagaatcatttgaacccgggaggcggaggttgcagtgagccgagattgcaccattgcactccagcctgggtgacaggagtgactccgtctcaaaaaaaaaaaaaaaaaaaaaaaaagaatgccactaattgacaagagtttataaatctaggctctaaaaagcaaaatatttttgtaaacaattataccagtctatgcttaaatatgagtatgcatcttttaatttgaaaagtatacaatcattgaaacacatttacattgtatctttcaacatttgtaatcaacctaagaagacagcactttcttctagattaaccagtttttaaattttgacttatacttgttaaacaaaagtattctcacagtggctgtaaaatgatcaaattttgaatacaaacaaagtagattatttttattattctttcctcatttctttgaataaaacaaaggaaaaaatatgttacttgggggcctttc

SEQ ID NO: 134 - DNA, 737 bp, Homo sapiens
tcacagaattgagagtttgttcttacacacaagtttaatgccaccttcctctgtctgccatggaccaacaagcaatatatgctgagttaaacttacccacagactcaggcccagaaagttcttcaccttcatctcttcctcgggatgtctgtcagggttcaccttggcatcaatttgccctgaaacttagctgtgctgggattattctccttgtcttggttgttactgggttgagtgtttcagtgacatccttaatacagaaatcatcaatagaaaaatgcagtgtggacattcaacagagcaggaataaaacaacagagagaccgggtctcttaaactgcccaatatattggcagcaactccgagagaaatgcttgttattttctcacactgtcaacccttggaataacagtctagctgattgttccaccaaagaatccagcctgctgcttattcgagataaggatgaattgatacacacacagaacctgatacgtgacaaagcaattctgttttggattggattaaatttttcattatcagaaaagaactggaagtggataaacggctcttttttaaattctaatgacttagaaattagaggtgatgctaaagaaaacagctgtatttccatctcacagacatctgtgtattctgagtactgtagtacagaaatcagatggatctgccaaaaagaactaacacctgtgagaaataaagtgtatcctgactcttga

SEQ ID NO: 135 - protein, 223 aa, Homo sapiens
MDQQAIYAELNLPTDSGPESSSPSSLPRDVCQGSPWHQFALKLSCAGIILLVLVVTGLSVSVTSLIQKSSIEKCSVDIQQSRNKTTERPGLLNCPIYWQQLREKCLLFSHTVNPWNNSLADCSTKESSLLLIRDKDELIHTQNLIRDKAILFWIQFSLSEKNWKWINGSFLNSNDLEIRGDAKENSCISISQTSVYSEYCSTEIRWICQKELTPVRNKVYPDS

SEQ ID NO: 136 - DNA, 21808 bp, Mus musculus
  misc_feature (1)...(21808): n = A,T,C or G
cacggtaagtgatctctgtgtcttagtttatcaccctgttcgaaccaggcctgaacctgcctagtagtaggatccagagatgccttggcccggacaggtgagcagcaggaaactgaagcccggtgtccacagaaacgccatttcctggctggagaggtgcctcagctactaaagcacttaccactctggaacaagaccgagctcagttcatagatgtttataactccagtgccaggagctcctggaggaaggaaagcagtcactggccgctacaaaggattttccagtaaacttgtttagagaatattaagctacataaacgtaaaatttggctaaaggagcatgcttctgtctggcggttcagggaagacagcatggctgacagaccttgatgaaaccacaccactcctaccaggaagagcctaattctgccagggaggcaggataaccctggtaacagctgccctggaaaaggcgcatgcacacacacacacacacacacacacacacacgcacgcacacacacacagtctgattggggtgaccttgataatgttttacattgtaaatctccccattttcaggaacaaccaaaccttaatgcctgtccctgtaaaatatggttaattgctccaagtgtaacttggggccgtgaagttgtttaagcaggggatttctgtccaaggctggttcccttttgtgtattacccagagctggccattgtgctatcattgaagagctttttctttattaatctataagtacttggaatgatttctcattgggaagacatattttaaagcaatccagaacccctttcaggtcccaatgggcactagcagacacctagcagacacctgtgtagacacacacatcatttaaaatacaacagatcttcaaaaccaacacaacacatcagaatcctcatctcaaaggcgatacggtcaccacaatctatgtcccagagtggtaacaatttgatgaagcttttgtagaatggaacaaaggatcacaaatcaagacattttccaaatacagtgtttgaaacatcaagtagctgagccacagaaagcagggggatttcagctgcaggcctcagctgctacctgacggcaggcttggtgttttggttgggactgggcacattccaaaggactcacctaatggtctcaaaagcattaggtcacctacaggggaccgtgtgttttgcttttgtttctgttattttctaggaactttcattcctatagcagacacccgtaaacctttcggtgctgggaaggctgagacaggcagatcctgagttccaggctagtgagctacacagtgagactggccccagaatataaccatatctgcttatgtattacagaaggaacagatattgacgtgtgtgtgtgtgtgtgtgtgtgtgtgtgtgtgtgtgtgtgtgtgtaaggtgggagcgtacaagccacgtataaagaggttgtttggatgataaaatgagggcagctgtggttggtctggaaataaagctgacccacagttcagaattcctttcagaaatcagggtttttagaaagaatgaaaggtcttgtggccatgattgattcttgaagtggaagaaaagcatttgacaggaacactaatatctggggaatctaaacacagtggggccttaaagggaaggagaggctatgctttaaaacctggagagagttgggcatggtcatacatgcctttaatccaagcacccaggaagtagcagagaggcagaaggctctttaggccatcctagatgatgtagtgagttccaggctagccacatagtgagaccctgtctcaacaaacaaaaacccgggcaagtacttcatcaaaagtagcaatagctgaagagacggctcaacagagtactggctgctcttccagaggacccaggttcaagccccaaaacccctatgaccgctctcaactgtctcttgtgaggatctgacgccctcttctggcctcctcgggtactacactcacgtgatacacagaaatacatgcagacataaatacctatgcacataaaaataaatcttaaaaacaaaacaaaaaaatcaactgagaataaaaggctggacggataactcagtgggttacagttatgccctacatgaatggagacctgatctgggagcctcagaatctaccgcaagccaggttgagagacaaagacacagtttgtgtgtgtgtgtgtgtgtgtgtgtgtgtgtttgtgtttgtgtgtgtgtgcacgtgcgcacgcgcataagagcttcagcaactcttcctgggggaatctcctgaccaattccccaaacaaaggagagagctttctttttataatttttttcaggatagtgggaagtttcacgtcatgtgcttcagttcagtgtagcctatgggtcaaaaacacagaggagccaactaccatagcctcagggctgaaggcactgctgcaaggccatggcccaagccgcctctttactctcttgtcccagaaggttgtagggttccacctaagcttcagggtcttgttctaccttccaaggatccaactcaggttgtcaagtctgaacgaaaatgctcttactcactgaggcatttcactggcccctgacaccccattttaactgaaaacaaaacagcctcctctccttgcaggacggagtcctattcacttcagactgtgactcccttaagacacaacaggctccacagaggagccaggtctggcctgcgagccacacattgatcatggcaaaccccaacctattctcttctcaccaaccctgtgaaggggagtccaaggaagtccaagaggggaaggaacaccacatggcctgtccacatgccagtgcctgctctcgccagatctgctgtctctccctgcacagccttgctggggacgagtgtcctcctgctcaggccatgaatggcacccggagcagtagacgctggagcccttttaaggtcttgatccctgtgaggttgggattctttctcattgccggtatgggaggggtgagtatgggtttgacctagaatccttctgacctaacaaaggcctcttgaagcagcccatgggttccttctctgtttatggcgtctccaaataaacacacttgagaacttgctataagcacagagacaccatccagacaagtcaagggcagcctttggcctacatgcggatggggagtgggctcccatcctccagccttcctgatcgtcactgtctccttccagattcttcttcccacatcaatcttctttgggaacagagagggaaacctctgggttcttttcttgccttggaagagaaatattaaaacgtacttcctgcctggtgtggtggcaagagcttttgatcccaacactaggagaccagaggcagatctctgtgagttcaagctagcctggcctacatagcaagctccaggccagctcaggctacacaatgagaccctggttaaatgaaacaaaacaaccctccctgcaatcacgtcccttgtgttcaggaaatgtaccaagatttttgagatatgtgctgatgcgtatcttccagttttgaaatgactggtctacactcagtcacagcctagagctagagccttttgtcacccaacttttttttatgaggagactgtggcacaggaagtctaagcagcatgcctgtgaacaataacttatatattttaaagccaagactgcatgttgaagaaaattaacttcccatcccagctccatgggaaagatactaaatgggtccggcttatctccacacaggagctgcctctgggccaagcgagaaagtaccaggctagcccacggaagaagagtcaggaacaacactcaggaggggcagttctgggggaaatgggcaaagaggcacacagaatcctctcctctcctctcctctcctctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcccctcccctccccttccctcccctccctttgctttgcttctctcttctttcctgcgtgctctctctctctcctccccctttatatcccttccttccttcctttctttttttttttttttcttttttctttcctttatttttaaaggctgggctcttacacaatttgacaggcaagttggcttgtgcttctcactctagctttggggagacagagaggcaggaagatcataagttcaaggccagagtggactgtacagggagactgaaaagccttggagctaggtcagtggtagagtgctttctagtaaacacaaggccctgcgctcagctcctggcattaaaaagtggagaaaagaaagaaagataggggctggagagggcccagtggctagagcacttggtactgttgcagagaatgtgggtacattgtcagcagttctagagtggctctgaaacatctctaagtccagttcaggaatgcaatgcccttttctggcctctgtagatattagattcatgcatacgtgaagacaaagcactcgcacacataaaataaatcaatctaaaaacatttttagatattaaaagccacttcctgccaagtgtggtgataaatggctttaatctcatcactagggaggcagtggcaggttgatctctacaagtttgaagccagccttccctacctaaatagttctaggacaagcagggctacatagagaaaccctgttcaaaacaaacaagcaagcaaacaacaacaaaaagaaaataaaatgtcactttagaaatgggagatttgagtcagaattgaagagagtccagaatcgctttagaaaataaacattaagggctggagagatggctcagcggttaagagcactgactgttctttcagaggttctgagttcaactcccagcaaccacacggtggctcacaaccatctgtgatgccctcttctggtgggtctaaagactgctacagtgtactcataaataaaataaataaatctgaaaagaaaagaaaagaaaagaaacattaaattcaaatcccatcttcagcccttagtattaaggttggcagggagatctccgtggttctcttgagtgctccaactgccggcctgcatcaccctggctgggcatgtaacttagtaggtagagtgcttgcttaacatgcaccgtatcttgggttgagcccaacaccacacaaactggacacaaactggaggtcggctgggattacctgagacccctatctcagaaccaaaccgacctcacccgccaccaccatcatcaccacgagaaaccgatctacacacttcgtcttcggggaagctgggacgactgagtaactgccacctgcagcttaaaccaaactgctcatgagtctgctaccgtggccatggtgggtccaaacggaccaggagagggttcagcgtcccagttctcaggtgtagctaaggcatggctttgtgaatggttccttctcagtttgaacatctgagaagacatttcctctgttccttcaagaggtgtgctttcctgggtttctcctgagcctttttgaaaaaatggtttcatctacctcacaaacctgtcaggaagagcccccctcctcccacaactctctctctctctctctctctctctctctctctcacacacacacacacacacacacacaccaccccaaacaaacaaaaacagacaacacacctattggatccatgataccgccatagctgtctaccacttcctctgacttggggtgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagggatgtggggtgagagtagaggggtagggtgggggtaaagagggaggggtgagagtaaggggggagggagggaggagtgagagtaagggagtaggggtagggagggagggaatgagaggagggagggaggaggtgtgggattttatttcagaatctgacctggatggtaactttgagaattcgtatgggaaaaaccccaaaaggggcttccaggatgcagatgcctggctctgctgcttgagaagacttggaccaaagggtcagccatattgccctggataagtagggtgccaggagagccttgtgggtagccttttagagctggctccaggcccagagtgccatgaaatacagtcccaggagcacagagatcctggcattttctgcttgtcccagcgtgagaggccatgtgttctcccccatcaagtagggttgggcctagtgcacacactgagccccaagggaaagaaaggcagcacttcctgcccctccagctctagaggggtgcaggttctgttttgttcatttgtttagtcatgtgtcctatcctgaccctctttccccctcccccacccatttttgaagatatggttctctgtgtagtcctggctgtcttggaacttatgtagaccaggctggcctcaaacctagagatctgcctgcctctgcatcctgagtgctgggactaaaagcctgggccaacaccaccaggcttacctgccttctttaatcctcataagcggttaggagcaggacagaggtcagcgggaggctcaggagctgggttctactttggactcctgctgaggaagctgccccacccccagcggttctcaggaggggatggaaggctgtgagcaatgcactcacttcagctccaggagtcctacccatgcaccaggacttgacacagtgctgtcctgaagatctggaccctggttctaggacagccaccaaccgccatgctcgggaaatggatagacacacccacaaaatccagagaggctgcctcaggacagagcaggcaggagcaggtgctgctggctctgctggaacaccttgccatgtgttctgaagcttagatcctgaccaaggactctctggacaaaggatgaatagaggctgcaaccatgagaactaagggccctcctttttagagccgtcctttagcatggtggctgcagatgctgagcaaatgacacagccagtgcaagggacagtgactggtataggccatttgtcttctgtaagtcattctatagggaaccatgtcattcccccatcctttatgaggtttgaacattttcaaaaggcccacagggggcatgtgcaatggtgtgtgtgtgtgtgtgtgtgtgtgtgtgtgtgtgtgtgtgtgtgtgttccagagatgggagcacagtaagaaatgttcttcactggggctggtgagatggctcagtggttaagagcactgactgctcttccgaaggtcccgagttcaagtcccagcaaccacatgttggctcacaaccatccatcatgagatctgactcgctcttctggtgtgtctgaagacatcagcagtgggcttacatataataataataataaataaatcttaaaataaaacaaaagaagcattcttcacatactgtgaggctatagcaatctggttttgagtgacactgagccttgtcatgaccaatctagccctacttggtccatctgcagcggaataggaagctttcaaaattctttctcccaagggctctgaaaaataagtgccccagagttcccaacaatcttctaagccaggactgtttataaatgaagttcttaagaagccagggattgaggggggcggagcagaggaggcaatttcatggtgaggagatactgggaagctgaggggacactgaagacagaaatgcagacggtgagtgtggctatgacacctgactaggcttttgtgtgctcctttgagtgaagaagtgggtcgggacaatgctcggggaaagaatcggtgtgggaggaggtgctgaaaagagagagggcgatttccttggaggagactagtgcttggaccccggggctggaaaccccttatgagactgtgtgtattggggggattgctatcctgtgagtgtacaagtggagtcacggggatgagactctgtaggctgctgactttcaggggcttaaggggtgcgtaagaaggttgtctgaaaatgtgggtcagaaagaattgcaggacacggaacaagtcctgctcagtcggcgtgctgcaggtggggacagcattttagacccaagtctcacggacttcctctctctggctctttttttcttttcttctcacctgtaaaatgggattgttgtctagaaaaagaagacactctcagctccgggtgattccaacagctagctagtatggtttggatgcaggtagagtcctttgggagtggtcctaagtactccaagctccggggtcagcgttgccctctagtggcgattttgtgaacaacaggcgaagcaaccaggaaggcggggagggcagcctctgtcaggtcgccttcagctcagcatctatctgtcagtgggagccagggcgcacaggacctcctgggcagaaggcatggtaggtgagcgggatacgggccctgacaggagcggctctcagagtgagatgggtggaaaaactctgtgagacatttgggggttgtgggagagacctctcagttagtcagtttatttctgtcatttttctgatgactgtcgtctcagcgctgctctcttgaacctgggctgtcacctgcccatccccagctcctctccgtgagagttccgagagtgagaactccaggtctagtaggtgcaaagaatataaaatatttagactgggagtgattcaggtgacagaaaacagaatcaaatttgggtcaaagtacagttttttagctttttcactccttcacttaacccctacggtggctttctcttcacaccaaggtcacacacagcgttctgtatgtcaggtctgccatgtgtcgatgctttttgtggattaaataccgggatcttgcacctggagttggggaggtcaggtctgccctggcagttgctttaggagccccggctctttaaagaccaagcaatactgcagttgcacccacttttctgaggtccacatcaagtggctctcctgaagtctgtcttaaaagggagacagccaaaggagatagccaagcgttcttggaaaaacctggcatttcttcaaagattccagtagattgtaaagggccaatcttatcatttaaaaagtatttcatttgtgtgtgtgtgtgtacttgtgcatatatactgtttgcatgtatgtgtgtagaggatagaggataactctttgttgttgttgttgttgattggttttttgttgtttgtttttgtttgttttttagacagtgtctctctctgtagttctaactgtcctggaacttgctctgtagcccaggctagcctcaaactcacatgagacctgcctgcctcagcttccttcgcgttgggattaaagctgcgcactaccactgcccggccaattttattattttcaaggtttgcactccggatactctgtagttgaaatgcactttagtgggtggcagatgctttctttcccagtggcatgtgactaatcagtcctctacagtgtgataacttaggacagagctgggattacctaaatgacttctgggtatctcccccttctatcctacagactcctccctgcctcaattgttccatctttcctggagcgctctccccaaatgcttcaaggagccccctggtctgcaatatcagtgagttcaagtggccctatcaacctgaggatctgaaccttaccgatgaggccctgaggctgaagtatttggggccacagcagatgaaacagtttgtccccatctgtgtcacgtacctgctgatcttcgtggtgggcactctgggcaacgggctgacctgcaccgtcatcctgcgcaacaagactatgcgcacgcccaccaacttctacctcttcagcctcgctgtgtccgatatgctggtgctcctggtgggcttgcctctggagctttatgagatgcagcaaaattacccgttccagctgggtgcgagtgcctgctacttccgaatactgctcttagagaccgtctgcctagcttcagtgctcaatgtcacagccctgagtgtggagcgttatgtggccgtggtgcgcccactccaagccaagtctgtgatgacacgggcccatgtgcgccgcatggtgggggccatctgggtcctcgctactctcttctctctgcccaacaccagcctgcatggcctcagtcaactaactgtgccctgccgggggccggtgcccgactcagctatatgttcgctggtgggtcccatggacttctacaagttggtggtactgactaccgcactgctcttcttctgtctgcccatggtcaccatcagtgtgctgtatctgctcattgggctgcggctgcggagggagaggatgttgctccaagtggaggtcaagggcaggaaaaccgcagcaacccaggagacctcccacagaaggattcagctgcaagataggggacggagacaggtgaccaagatgctgtgtaagtcattgttgaggagaaagctgagcttcctccagtctggggaaggaattgagcttccagggtattgtttgcttgcttgcttgcttgttgttgttattgttttgagaaagggtttcagggctggtgagatggctcagcaggtaagagcactgaccactctcctggaggtcatgagttcaaatcccagcaaccacatggtgactcacaaccatccgtaatgagaaactaataataataataataataataataataataataataataaaacaaaaaaaacctatgggccagacttagcagggaccagagcaagtggggcttggggtggagggagcgaggccagagaaagacagaaaagggaagagggaaaaaaagagagaaggagtttctttgtgtagctctggctgttctagaacttgctgtgtagaccagagattcacctgcctctacctccaaagtactgggattaaaggtgtgcaccaccactacctggctctcctgtctgcttttctaggaccggaagatagtgagctgtagatgcaaactctaagcatgatgaagatcaaatctcttctctgtccttgcagttgcactggttgtggtattcggcatctgctgggctccattccatgctgaccgtatcatgtggagcctggtgtatggacactcaacggaaggcctgcacctggcctaccagtgtgtccacattgcctctggcatcttcttctatctcggctcagcagccaacccggtgctctacagcctcatgtctactcgcttccgagagaccttcctgcaagccctgggccttggaacccagtgctgtcatcgccgccaaccctatcatggctcccataaccacatcaggttgaccacaggcagcaccctgtgtgacgtgggccacaggaacagcagggacgaacctctggctgtgaatgaggatccagggtgtcagcaagagacagacccctcctgaataaaatttggaaggagccttacccacaaggccagagggcctcagaaagtctggggagctacaaaagtggtttctgccctgcccacatatttgagtattgagggaaacagtaagaaaaagagaattgaaccccaattgcccccattgaaggcctgaaacactggctcagcagttaagaatgtttgctgttcttccagagaacctgggttcaggtctcggcaccctcatgacaacaggccatccgacactctcttggcttctgacggcatctaccacatgcacatagcacacacccatgtattagaaagacccacgctgaaccaaatatatgctgtatgtccctccagaccccatacccctaaattcttctccacaaaactgtcacagttacctagttacctggggctcagccactattcctctggggatcccttcttcctctcaagttcatacgtgtttccattgggacccacctgtcatcctggtaacttccgaacctccatagactctctctgcccctccccagcccttgttttgtacttgagactgacttcacaccctgacagttcctggctctcattctgcaccgagattcgggcctgatcaagctgtcaggtggtaggggttcccagggatccaggggacctggacctgacctcagcctttgtcaccatgtttccttgtggcaacaagcaaatcaccctggctttctaagaggctttggttccttgcttgcaaaaataaaaggcgtgcttgcttgcccaagtcacgttttgaagggagcttgctgtgttttcatctgtgtgtacaacaaagtcaaccacttggtttcagattatctgcaccactcccaaaccctgctttctctctgatcttctcatggtcctgctccaagctgtcaagggcaggtcctttgcttgtcctgaaacagatagggccaacctatgcgcagcgcactcctggcctttctcacctgcagacaggctaccctggctgccctgggggaacacatgctagatcctgttagccaggggagatctggaagaagcagcaggaactgacttaaggaccatacacggctgtgcagagacagggtgttggttagtctttgtcagcttgacagaaactagagtcacctgagagagggaacatcagccgaagaattacatccatcggactgacctgtggacttgtctgtgggacattttcatgattaatgactgatgtcacagggcccaacccaccaagggcagtgtcacttctgggcaggtggtcccaggttgtctaagaaaataagctgagcaagccagtaagccagatttcccctggggcttccggtccagttcctgtctccaggttcctgcctccaggttcctgtctccaggttcctgccttagtttcccttgatgatggactataagctgaataaaccctttcatccccaaggtagctttggtcagggagttgggcacactggcacacctgggaagtgaggactggaagatcaggagtttgaagcaatgaaaatcaaatgaggacatgaagctccgcaaaggggactaggtggtcaagggcagtatttccctgacatttcatgccaccctgagtcccagggacaacctggtgctgaggaaggaccccattaatggatgaactgtgtcctgctgcaagttgctgggtcttgtcttgagagacctggtgtccacagctagggactgcccagtgaccctgcagacaacctgctaactggtgtcctgggcttctcagggcaccaggtgtccaggggaggagatggtagagagctatttcatgattcagttttatatgacaaagacaacttaaagggcagagagttgggcacactggcacacctgggaagtgaggactggaagatcaggagtttgaagctagagctagcctgggctacacaataaaactcccactgaaaaacaaataaacaagatttttatggctcatgttttcagtctatagtcagctggcttctctctctctctctgttttcaagacagggtttctctgtgtagccctggacatcctggaattctctttgtaaaccaggctggcctcaaactcatagagatctgcctgcctctgcctctggagtgctgggattaaaaggtgtatgccaccacgctaggctaggctttattattccgacctgtggggagagagaaggacatggtgagattgggtttcttgcctcacggtagtcaggaaacagtgaaacactgcagaaaaaaaatatgcttgtttttcctcccaaggcataccctcagtgacctatttcctgtcatgtagccttatcatgtcacctttaaaagtttctgtcaccccccccccaataatcctatgaacatatgaatccatcaatagcgtgcttatgatccaatcaccttctcaaatccccacttccagacatagcagcagtggacactgttgctctgggaaccaaacagtcaacacatgagccttaggagggttaatagtccaatcacaacagctgcagatttgttgtttactcaattatacaaatattaaatccactctgtagaaaaatctggaaaatacaagtaaacaaatgtggagaaaagaaagggacggggactggagtgatggctcagtccataaagcgcttgccttatgagtgtaaggacccaagttaatcctcagaacctatgggacaatgcctggggtcacagtcgcccatgataagtgacatcactgaggatggcatcccgctccatgcacacaatgcacacacaagcaaacacttgtgcacgacagtgtgcacccacacacagagactcatacatgtgcatgcacagacacatgcatgcacttatgcacagacataacacacatctgcatgtacctgcatactcacacacacagacacacatatgtgcatacacctgcacacacacaccgtacatacacatgtacatacacaccatacatacattttaaacagcatcttcactgggagccgtagggaaagagcaatgggaacttgctcaataggaacagagtttttgtcttgcaagatgaaaagtggtggagatcagctgcataattattacctcaataaaacttaagttagttatgttccttatgcttatgagcgaacagctgtcggaagcaatggaaggaaggaggctcatggttaaagggggtctatccaccctggtggaatggcagagttcatggtggtaggaatgtgcagtcaagactcctcacacctggacagaccaggaagcagaagtgggactgttgaggctccgctggcttgctcgcttttctttttactcagtccagtaccccccacccccaccccctggtgtggtggtttgaatacacttggtccaaggagtgacattattaggaggtgtggccttgttggaaaatgtgtgtcactgtgggggtgggctttgagagaccttcctcctagctgcccggaagttaatcttctcctatttgcctttggaacaagatgtagaactctcagctcccccagcatcatgccagcctggatgctgccatgcttcccaccatgatgataacagacttgaaccttagaacctgtaagccagccccaattaaatgttgttataagagttgccttggtcatggtgtctcttcacagcaatggaaaccctaactaagacaccctgtctatggggtggtccacattcagaatctgtgacaggtggcccttgagaagtcagctttaaatagcatctttccacaggcccctttgttcccagagtcccccttgtcccgcccaccactctccaagggtgcttaaactctagaacacctctggacagagatgctctgaagtgtgcctcttaggtaatttcaaatccagtcaaactgagccatcccaacactgaaccacccatttgaatggtaaacttactgtgtatattttatcacattttttcccatcactttgctctactgaatatactatgacatatttccttctttaagtgttttatccggttgttcccaccatctctaaacaagtcttttctgctttttccacagaagatgctgtatccaaactcaaggttgcaacccatttgacccacaggctccactgtgacgttcttggccagcctgactaagccccctgagtctcatacaagttacagtgggaggagttcctagatgttggcctaagaaggctctgccccctcctgtactctgagctcagaagagctgaccaaaccagggaagaaaagccaccctctctgtttgatctactattgcacagattctggctaagcaaagaggggaggcacaaggcccatgagcagtcagcagaggctaagggggaaggaagagatactctgatggcagtgggaatctcatagaggctacagtggaccacggagctgagagaaaagttccctgtaggaagggagtttcctcagggatgatcctggatgtgtggtgacagggtgcacacagcatgaggtcctaagcacccttggagagtggtgggcgagacaagagggattctgggaacaaaggggcctgtggaaagatgctatttcaagttgagttctcaagggccacctgtcacaagcactgggtagccagcccatgggtagatgtcagaactattctcagagaccacctctggactccaagagacttctgttcagtgtcacatggaacagtgttcctgaggggtggagtgtgtgtgtgtgtgtgtgtgtgtgtgtgtgtgtgtgtgtgtgtgtgtgaagggctgttccaccagagaagcacagggaacatgggaagacgggcacataggaagatgtgaggtataatgtgcttcttgctgtgaacttgccacatctatcgagggtgtcctcaggctctcaatggccaggttccataagtcataggccaccggtggctcctggaatagcagccaagctcggtccttgagaaaatgggctaggatggagagggtagcagcgatccctacctagggcactcacagggcacaaccagaagcatcggccctgtagtgcccctagggggcgctgctgctcctgtgcagtgtcagggtagcgctttgtgctccttgggctaggagccaacttttctgaaaggatatggcgtgtttgggatgtgtgttgtaacatctctctttctcatagaatctagtccataggcatggcactcctgcactaccgtgtgtgtcgatagagaccgtgtggatgatcccgcggtctccaagcacttctgctgcttagagacctctcccccacttggccttctggcttgtggccacactattgtcttgtaaaggaagttaggtgagccgggcagtggtggctcaagcctttaataccagcacttcggaggcagaggcgggcagatttctgagctcgaggccagcctggtctgcagagtgagttccaggacagccagggctacacagagaaaccgaaagaaaaaaaaagaaaagaaaagaaaagaaaagaataaaataaaatttaaaaagttaggtgagtgtttagtgagggctgagagttcttgctgtttaaagttcggatccacagaagcctgtgtagatgcctggtgtgtgcagagggtgcagggggtggggtgggagtggggtgggggaggggcctcaggctggaattccaacctcagaaggcacaggcaggatatcccggaacaagtcagctagtaaggttggtcataccttcaagctctggttttctgtttgtttgtttttaaagattcctttattttatgtatatgagtacactgcagctctcttcacacacagcagaagaggattctataacagatggctgtgagccaccatgtggttgctgggaactgaactcaggacctctggaagagcagtcagtgctcttaactactgagccatcgctccagcccctcaagctctggtttcgattgagactctgcttcaatagagaagatgcaagaagaatccaggataattcctggtattaaccttaggcctccacatgcacacatatataccatatgtgtaaaaagatacatacacaccatacacacatgtacattatacatatgtgcacaggggcacaccatacacacatgtacattatacatatgtgcacaggggcattctagggctccttaccttggtacacttttcctcacccttaacacacacacacacacacacacacacacacttttgagacaaggcctcactcatgtttcccactgctgtcaaagtctcagtggagccaagggtggtgatgaattcctgattctccagtcgtccccctttcagcagcaccacaaacggctgactcctgggggtttcatacccaatacttctggattgctgtccaagcttatcaaggcaacccaagccacaactggtaactcctgctgcctaagtcagctcacacattcctgtccccagtgaccttcctcctgtaaagccactgtcaggacctcccccaccaaacccccacctccaagagccagtaggatgggtgcagcagggccagctcctccaggacagatggcctgaaaagtgacaggccccctgtaactggaccaaccagagtccatgcagaccctgggcctgagccttgatccccatcctcccctgaggtaagcaataaagcggtgtaattttgtggtaaccagacagcaatgtaaaggactgaggggacaaccctagacacgctccttggctgctacggttccttatggttaaaagtgttagcatctgggtgttgagtggtatccgggaagggcatgaaggagccagctggcatgtagccctgggctggcctgccgcatcctaccggctcatgtggctctagagtgtgtgtgttgcagtctcagcaatggtgttacaggagaaaagtcactggggacaggaacgtgcagaccagcttcggcagcaggagttcctggttgtggcttgagttgccagtggtctgtgtgtagtaatgaatccaccgttactgaggctggagagctgaggtatttgagctgcgggggtgctacttgctacttttgtgttggtatgaagtctttattccacttaaagagttggtagtagtgttctgtattttaaaacgctgttcctagatacaagcttttttgagggtgaggaatttctatttctaggttgttgcaaaaccagaaggtgctatatttaaccacactaaagcaccaaaaaaattgtcatgtttttatgccaatttttaatattttccagcataagtaaagcattccacgtgaacgtgaaaaacaggctgatgtggtggctttaccctggacttggagctctcttatgctggttcttagtcttgttaataaaatgcagttaaaaccaaggagcattttactagcatttaaaagtcaagcaacagagcaagcaagatgtaaatcttagccgctgctaggaagagggaaatgggtgggaggagaattgtttcaggctaaggagcctggcagccggtgaaagcgattgctgccaccggcaggtctcacatgctgcaaagagagagccacctcctgcgtgatatcctctgatcgccacatgtgtgctgcagcaagtatacacacacacacacacacacacacagggaaagagaaagggagagagagagagagaggtgatctaaagctattatttttaattatgtgtgtgtgtgtgtgtgtgtgggtgtcgatggaagcctgaggcactgggtccctctggagctggcgttacggtggttgtgagcctccagaggtgaggagtgtacactcttaacacctgggccatcttcccagcatccaaatataattaaccaagaaaagtggtgcctttgaagttagaccaagcaagctgacaggttcagcgatggaggtcagcaagcacttgcttggtaggagtgggaggggaggcgtcaacgaaacagtgaaaggtccaaagggatcaaactgaagtcatcagacttggtgccaaatgtctctactcaacgagccatctcctggcctcttgatgacaaaagctctgatgttcctggggaacttttggatgttgtatctatggcgagcatgacatcaggagagattatattcttttaggtcgaggaagttttaaaaagcttaatgtggactggttaaaattagtaagtgttagcttgatggtgatttggccatgggaggtatgaaagcagtttattgccatattagaatcaaaggtggggcttagtctgtctgtggtaccactggcctggaatcattgtgttggaaacctacttgggtcacgtcatggaggtggagacaggagaatcaggctctcagggtcatctctaactacatagccaatagccctggctagccccacatcataacctggacacacacacacacacacacacacacacatacacacacacacacacacaccannnnnnnnnnnnnnnnnnnntgtcaaactatggtagacttagttgacttggaatttcctaaattgactgaactgtccttgaactcacagtgattcacctgtctaaatctttaggtctagcctgttgcactttcaaatacctttaaatccagctacttatgtggcaagaagatttgtatttgtggctaacctggggaaacaagtcatcttgtttccacacttcaaaacaacttaatatattttaggcatacacacacacacacacacacacacacacacacacacacacacacatatatatatatatatatatatatatatatatatatagtgatggtttgtatatccttggaccagggagtggcaccatctgaaggtgtggccttgttggaataggtgtgacctggttggaatgggtgtgtcactgtgggtgtgggtataagatcctcaccctagttgcctggaagtcagtcttccactagcagcctttggatgaagacatagaactctcagctcctcctgcaccatgcctgcctggatactgccatgctcttaccttgatgataatggactgaacctctgaacctgtaagccagccccaattaaaagttggttttttataagacttgccttggtcatggtgtctgttcacagcagtaaaaccctgatatatatatatatatatatatatatatatatatatatatatatgaaattaaacacaatatttaagttccccagactgttaatgacaacatgaccatttagatgctatttaaatgtgagcattgaagcgtttgctcatgtgaaacattttttaaaatgttaatttatttaattgtatatgtgtatatgtgcctaaatgtatgtatgtgcatcacacgcatgtaggagcctgtgaaggctggaaggggcatcagattccctggaactggagttaaagtcagctgtgagctaccatgtgggtgctgggaaccgaacccaggtcctttgtgagagcaagtactcttaaccactcagcaatttctttagaccccaacacacataaaggtttttaatactggttctcatttacaaaatgaaaacatagattgccctttaatgtctaacaacagcaattggttcagtaagtgaccctccttataacagctgagattagggtgtgtatcactatgcctttttgttttgttttgttacttttattttttatagtccagtcattggcctcctctgtgtccacccttgcaaagatcctcctcctcctgtctcctagaggatgtccccactcgccccccccaagttttggttttagtatttgtatttcatgtatttgtgtatgtgtctgccgcatgtgtatgggtgcctgagctaggtctcggacagacagccctctcagatgctgtgnnnnnnnnnnnnnnnnnnnntgcttggtaggagtgggaggggaggcgtcaacgaaacagtgaaaggtccaaagggatcaaactgaagtcatcagacttggtgccaaatgtctctactcaacgagccatctcctggcctcttgatgac

SEQ ID NO: 137 - DNA, 1218 bp, Mus musculus
ctggtctgcaatatcagtgagttcaagtggccctatcaacctgaggatctgaaccttaccgatgaggccctgaggctgaagtatttggggccacagcagatgaaacagtttgtccccatctgtgtcacgtacctgctgatcttcgtggtgggcactctgggcaacgggctgacctgcaccgtcatcctgcgcaacaagactatgcgcacgcccaccaacttctacctcttcagcctcgctgtgtccgatatgctggtgctcctggtgggcttgcctctggagctttatgagatgcagcaaaattacccgttccagctgggtgcgagtgcctgctacttccgaatactgctcttagagaccgtctgcctagcttcagtgctcaatgtcacagccctgagtgtggagcgttatgtggccgtggtgcgcccactccaagccaagtctgtgatgacacgggcccatgtgcgccgcatggtgggggccatctgggtcctcgctactctcttctctctgcccaacaccagcctgcatggcctcagtcaactaactgtgccctgccgggggccggtgcccgactcagctatatgttcgctggtgggtcccatggacttctacaagttggtggtactgactaccgcactgctcttcttctgtctgcccatggtcaccatcagtgtgctgtatctgctcattgggctgcggctgcggagggagaggatgttgctccaagtggaggtcaagggcaggaaaaccgcagcaacccaggagacctcccacagaaggattcagctgcaagataggggacggagacaggtgaccaagatgctgtttgcactggttgtggtattcggcatctgctgggctccattccatgctgaccgtatcatgtggagcctggtgtatggacactcaacggaaggcctgcacctggcctaccagtgtgtccacattgcctctggcatcttcttctatctcggctcagcagccaacccggtgctctacagcctcatgtctactcgcttccgagagaccttcctgcaagccctgggccttggaacccagtgctgtcatcgccgccaaccctatcatggctcccataaccacatcaggttgaccacaggcagcaccctgtgtgacgtgggccacaggaacagcagggacgaacctctggctgtgaatgaggatccagggtgtcagcaagagacagacccctcctga

SEQ ID NO: 138 - protein, 403 aa, Mus musculus
LVCNISEFKWPYQPEDLNLTDEALRLKYLGPQQMKQFVPICVTYLLIFVVGTLGNGLTCTVILRNKTMRTPTNFYLFSLAVSDMLVLLVGLPLELYEMQQNYPFQLGASACYFRILLLETVCLASVLNVTALSVERYVAVVRPLQAKSVMTRAHVRRMVGAIWVLATLFSLPNTSLHGLSQLTVPCRGPVPDSAICSLVGPMDFYKLVVLTTALLFFCLPMVTISVLYLLIGLRLRRERMLLQVEVKGRKTAATQETSHRRIQLQDRGRRQVTKMLFALVVVFGICWAPFHADRIMWSLVYGHSTEGLHLAYQCVHIASGIFFYLGSAANPVKLMSTRFRETFLQALGLGTQCCHRRQPYHGSHNHIRLTTGSTLCDVGHRNSRDEPLAVNEDPGCQQETDPS

SEQ ID NO: 139 - DNA, 23965 bp, Homo sapiens
caggtactgatgtcagtgcatgcttttcaacatttatagatagatataaaaataagtatcaggctgggtgcagtggctcacgtctgtaatcccagcattttgggaggccaaggcgggcagatagcctgaggtcaggagtttgagaccagcctggccaacatgctgaaaccctgtctctactaaaaatacaaaaattagccgggcgtcggctgccccgtctgggaagtgaggagcgcttctgcctggctgctgtgcaatcttccaagtgtgaagtgacagcctttctgcaggtgtacccaacagctccgaagagacagcgaccatcgagaacgggccatgatgacgatggcggttttgtcgaaaagaaaagggggaaatgtggggaaaagaaagagagatcagattgttactgtgtctgtgtagaaagaagtagacataggagactccattttgttctgtactaagaaaaattcttctgccttgggatgctgttaatctataaccttaccctcaaccccgtgctctctgaaacatgtgctgtgtcaactcaggattaaatggattaagggcggtgcaagatgtgctttgttaaacagatgcttgaaggcagcatgctcgttaagagtcatcaccactccctaatctcaagtacccagggacacaaacactgtggaaggccgcagggacctctgcctaggaaaaccagagacctttgttcatgtgtttatctgttgaccttctctccactattatcctatgaccctgccacatccccctctctgagaaacacccaagaatgatcaataaatactaaaaaaacaaacaaacaaacaaaaaaaaacccaaaaaaacaaaacaaaattagccggatgtggtggtaggtgcctgtgatcccagctacttgggaggctgaggcaggagaatcgcttgaacccgggagatgacgttgcagtgagctgagatcatgccactgcactccagcctgggtgacagagcaaaactccatctcaaaaaaaaaaaaaagtatcaatatatatgtgtgtatacatacagtatatatagtatgtgtgtatatatctatatatttatacatacatatattccctagctctgcccactggagggtctgggagcagcaacaacccaacagtaatgagcacactcagcacccagatcttgagcactgatttcattaccaccagatctgacccagatctcatgactattattacatatatatatatttttttaagcagagtttcgctcttgttgcccaggctggagtgcaatggtgtgatctcagctcactgtaacctctgcctcctggggttcaagtgattctcctgcctcagcctcccaagtggctgggattacaggcaagcgccaccatgccctgctaattttgtatttttagtagagtcggggtttcaccatgttggtcaggctgatcttgaactcctgacctcaggtgatccacctacctcggcctcccaaagtgctgggattacaggtgtgagccaccatgcctgtcctttatttatttatttatttatttattttttgagacagggtcttgctctgtcccctacacttgtgtgcagtggtacaagcatagttcactacagccttgacttcctgggcttgggtgatccttccatcttagactcccaggtagcttgggctacaggcatgcaccaccacacctggctagttttcgtatttttggtagagatggggtttcaccaagttgcccatgctggtcttgaactcctgggctcaagcaatctgcccgcctcggcctcccaaagtgctgggattacaggcgtgattacaggcgtgattacgggcgtgagtcactgtgcccggctgatcttggtttccatcattctccactaaaggagccagagctccttggaaaatggcttattccaggatagcccagagaaataggagatgagcctagaacattgtattgtgccagaaaatacaaaatattcataatgacacatcaaaaggatatacgatccaacttgaaggggctcccactggtcaaatctgggacaaatttgaacatcaacacaaataatgataatgaattagtatcctttgaatagaataagaaatcatgggtccacatggatataaataaaagtgataagaggaagtttctccttctagtcacagtcagctcggaaatgaagggatgatggggtttagaatcaccatttggcaggccatcatagtaataatttatgcatacaagaatcatacacaggccaagcacgatggctcccgcatgtaatcccagcattttgggaggccgaggtgggtagatcccttgagcacaggagttcgagaccagtctgggcaacatggtgaaacctcatctctacgaaaaaaatagaaacattagtggacatggtggtgtgtgcctgtagtctcagctacgcaggaggctgaggtgggaggatcagctgagcttgggaagtcagagctgcagtgagccgtgatcgcaccactgcactccagcgcctgggtgacaagcaagaccctgtcttaaaaaaaaaaaaagtcataaacagatgctaaagttctcctgggcatctttttgcaaaatggttttgccaaccttataagcctgctgggacaagctgtcccccaaccctgggtctcacaatgccttgtgactccattgtgctcacactagccgtctgccaccctctctgaggctgggtgcctttgacaagggcttgaatccctgagtggcagggtcatctgtggtttgttctggctgcttggcacctgggctgtctgccaggggctgtggatgacccactgggtggggaatctgcccctcctcccctccagaaggctgcaagacccatgctcaccccacctatgcagcgagagtgcagcagcaggacctgactttgtagcatcctgtctctcaccccggggcagggggtccagggcaagtgcttcaaaaggcggggacatggtcccagcctggggccagtgtccacgggatgccgggtcacagtgccaacccttctagctgcagccccaccgtctccctgcccctccagccttcttgttgattctgtgagctgccggatgtttttcaggaaatccggcctaaatcagctggagccagttttgatttttgaaaaccaagatccttacctgttgcagtagcttacacctgtaatcccaacactttgggagaccgaggtgggtggatcacttaaggccgggagttcaagaccagcctagacaacatagtgtaaccccgtctctacaagaaatacaaaaattagccaggcatggtggtgcatgcctgtagttccagctacttgaggggctgaggtgggaggatcgattgagccaggcaggttgaggctgcagtgagccgagatcgcaccactgcaccagcctgggtgacagagtgagaccctgtctcaaaaaaacaaacaaaaacaaacaaacaaacaaaaaaacaattcaacaggaggatcttctggcaccctgtctttcagtcttcacatacctggccttctcttagctttaggccaactgtgcccatgctggtgcccgctcctccatcacacaccctcagtgcacctgcctttggtcccctttccctgtgtccagcagttgctgttgataggcccagcactgtgtacttacctcctgattcagtctttgttcctaagaacaccccaaccctagaaagacgcattccgtatgcatgcaccactgtcatttcatcaccactttccggttctttgatatatttcctccaatttaatgttattccctttgtaatgctgaccttcctcgcactctgaatatttactgctttagtatctattggctgtggcagcagcctgccttgggaacaggcaataatggagaaggtttggaaaagagttgttgaactgactaaaagtggcctgctttttaaaaagtggcacgatgtgccagtgattctaaacaatgttggtgataaaatattactcctgccaggcggactgcctccttaacacctactccctggtaggctactgcctattggacagggggaactaatggtattcatagaacacttctaaactcaaccagaacagaagcatttagtggtaaagaagcattatgtctgcaactgactctcatagtcccccaaaaatataggaatcctttgtattattctttcaactttcctgtaggtatgaaataatgctaatataaaaggttaaaaaggtcagggctgggcgcggtggctcacacctgtaatcccagcactttgggaggccaaggtggatgcatcgcctgaggtcaggagttcaaaaccagcctgaccaacatagtgaaaccatgtctctactaattagcctagtgtggtgtcacgcacctgtaatagcagctacttgggaggttgaggcaggagaattgcttgaaccggggaggtggaggttgcagtgagctgagatcacacacaccattgcactccagcctgggcaacaagagtgaaattctgtctcagaaaaaaaaaaaaaagttaaaagggaaaagaaaaaaaactactaaatcaaacacagcaaactgctgcagactaacaagttcctgagtcctgatgctggtcacctgttgcagggggagaaacttttgttctgaaacctccctctgatcatgactatgagaatttataaatgggaagaccccaagaggagcttctgtaacacacccaagtgtggtgtgttagctgggaaggctggtggacttgagggtggcctttattgcttggaggagtaggtgccaggagcaccctgtgggcacacaataagatctggccccagtccagggtggcatgagggacacacaggccctagacatgagagacacaggctttttctggccttctcactgtgtgacttgaacatgtcctccctttggccacaagcggaggttggggcctggtacacaggctgagcccctgtgaggaggtgaccggctccctgtgcccagcaccctgcctgaagcctgtgagctggctgtctctgggagagctcaggaacaggcctcacagccctcagggggcaaggggctagacagtccccagtggtcccctctaggagcaggagaggcaggggcgatgctccccggaggtctcctccgctgctggtccccacccggctgcagggccccgactgcctgcactgtggctgggctccctgcaagcctgtgtgctcctttccactgggactcagctctccttcccggggtgctggggaccttgcccttccaaaccctactaaggacagctcccaccccagccctgcctcccagcagctttctggtatcttccagagaattccaggctcttcaaccctgcactgagtgcttaaacccacattatcactcttaatcctcatggcatccctgaaggacaggggctatgtttgtgttttacaggcaaagaagctgaggcctgaagcgcaaagtggcttatctgaggccacgctggcagaatgcggagtctcactctggcctcacagcctccaaagcctgtactcaccatgttccctgcctggcttgaccatctctcccaccagtttctgtgagcagaccagggctggtggctcagggagcatgggtgcatgatcacacaaaagccacgtggctccctgaggtgcaatcccagcccccaagttcggaaccccatcacctgaggggcccagaccatcctcctctagctcctggccatggccaggctgggaccccacagagcagagctgggtagggagctctctgaccttgggaggtgcccagatgggtacagcgactctcccttgcttcggatatttactgttcttgttctccatgtttgcccaatgaagcctagtgatgggggtcctgggtgatccccattgcccaggctgcagaacagtgcctccctcctgtccagagctacagtgtccccaagctcatctcatcctccctgcctcccctctgtaggcagtaagtggggtggggttggggcgtttctgggggaaccatgggcttgccaggagctgcgggtcagcccaaggctgagaaggttctggtttaagcctggcctgagtttaagcagcccctcttggctctcagggactcagcaggatgaggaggggatacggagctactcacatgcctctggccccatgagtcctgcacacgcctgggacttgggtggtatctcagcagctcctggaggtcccagtggccctccctgaatgcatttgctgttgtgcagagttgggtccttggccccctcatctgggcagacgcccaccagccaagcttagatggatgtgtacacccagaaaactggggggtgccacctcaggacggagcaggagcagcaggatgtcatacgtttctgatgggacactaccgtggtggccttgagctcaggcccggaggccagggcccctagggccctctgcacagtgcggaagtgagggccacagccattgtggccactgagcctctcctttttgggggctgctctttagcctttgatggctgctaatgttatgtgaatgatgcaacccgctgtaggaattcctgactggcaagagtcattctgcctctgcaaggctaggtgggtccttccccatcccctccagggctgtgtgaaccaaagggtccacggggactttcggactgctcagagtctgtgcagagtggtatgtgtgtgcgcgtgtgtgtggtgtggtatgtgcagagtgatgtgtgcatgcatgtgtgtgtatgtgtgtgtacatgcatgtgcgtgtgtgtgtgtgttccagtgaagggctggggtccaaatgctcctcacttgctaagagcagcctgtgatgccacagtggtctctgatgctgagtgatgtcatccctccttgcccgtctgttgtgctggcagccctgttactgaggatttctcctggactagctcatcaggggctgagtagttaattcccagggcaccacagaatcctttctcccaaggccctgaggaccacgtgcccctgcacttcccacaaccgtcccctgcctgggactctgtttacatgtggagttcctgggaaggccggcctggtgcaggctccttgagggcctaactcccatccccaagcccagacagtgacttatggaattggggggcagtggggaggaggagggtgcaggaaagcggggggaaggaggagcctccagttgccactaaatggtgacaatcccaccccacatttcttgagtgttggccatgtgccagcccctgtgctgaatcttgacgctcagtgtctcatgtcaccttcacaatagtggcgatggtggttagcccattctacaggaaggggaactgaggcacacagagcttctgagctcacggtggcctctcggggtcctgtggctttgtaacctctcctggtgctcctcagtgtgattctggggcatggggctctccagagggcgtttgtcaaacatgaggatttctgggccttgcccaggctaaggagacaaaactctgggcaaaggccccggaaccagcattttactctgtgtgatccgtcatttctagggtccctagaagtttctgatgaaacagcttccagctaaggagctgattgcaggactagggagtgggagcaggtgaggcactgggatttgcatgtgggcagtgtgggggagcaggaggctgtggctgggcattcttaacccttccctaaattccctccatccttgtctatacccccacccttggtacagtgatgggggcagaagaacatttgaacggataagggggacagtatttggggctgaggacaatggtgaggagagggtggcccagggaggcaggtgaggagtggggaggtccacccccaggctagactttggtgtgctctttttcagaaggcagtgggggggccccaaggaagggtttcgagggggtgatggtcgttggtggctgtgggaggatggactggagggagaatagggggctcttgccagctcctgcagggccgagcgcctggactcagggactggaggcccgaagagcatgcgggtgagaggggctgcggagctgcaatcatgggccttgggacagaagaagaggcctggagcctcgggaggatgaaccgcaccggggcatgtcgacttcaaggggctggtgggccgtccctgtccttggaggtgggtctgaatggggggcaggaggagctggaggccgcagggacaccgtgacggcgttaactaaactcagcacgctggagggcgggaatcacatgtgagccccaggtctctcgggctcctcctctgcggctctctgaggctcagttttctcatctgtaaaacgggttgttgtgagggttccgtcagataacgctgcttgtggaggtgtcgcctccacgctgcttgtggaggtgtcgcctccaacggccgcgtcctccgccagtgcgggagggggcgccgcccgggctgcggggactgcactgccccctggcggcgttcccggccggacaggcggggcgtcggggcgcgggctggggccgctgtcagtcagtccactggctcccgcgccgcgtctgtgtccgtcgctcggagggtggaagccggggtctcgcgggccgcgggccgcatggtaggtgcgcaggcgccggcgtgggctagggcgcggcagctgggccggggctcggtgcgggcagggtcgtcctagggcgggaagggtccgagggctccgtcggggtgccccccgtccccgccaccggggagcctcgcaacttctcgggtcatttgtgtcttccggccaggggcgccggggggctgcgggcttgcgacccttcctcgaggaccagggcgcctcccttgaacccgggctggccctgcgcgttcccaactggttcccgaggctccgcgctgctgtgcagcgggggtgagggcgggcgggaggaagggtgtggggctcaatagaggagagggaaccccagaactggcagtgccaagggcgtcaaatatggagactgaacagttcaggtgacagaaaacagaaaaaagaatcaacttgtggatgaagcatttgtagtgtgtagccttgacactccctcacttgactctcatagtgactgggtccccagagcaagggggtgatccccgtgcccttccgtatgccaggcaggccctgtgttaatgtctttaatggattaaactccctggatcctcctaatagggaaacagcctcagagaggttacctcgctaaaggtcacacagcctggaactggggaggctggattcgaatccaggcagttgcttcctgagcgcttgctcttgaagaccctgcaataccaggcattgtgcccattttacagatgcccaaacgagtgcctcatctagcatcattgcttgaaagaggagacacccaagatctgtcatttactcaaaggttccaatagatcatgaaatttaaaatcaaaaccccacgtgtttttttttttttaaatgtagatttttactttttcgttgtttgctttttgtttttttgagacaaggtctttctctgttgcccaggctggagtccggtggcacaatctccgctcactgcaacctctgtctcctgggttcaaacaattctcccgcctcagcctcccaagtagctggaattacaggcgtgtgctaccacgcccggctactttttgtattgttagtagagacggggtttcaccatattggccaggctggtcttgaactcctgatctcaagtgatccgcctgcctcgaccaaagtgttgggattacaggtgtgagccactgcaccaagcttatttttacatctctgacttgtggatggaagagttttttctttctcagtggtgcctaaaataatggtcatcatagcgctaatgtcacctttggcttgatgagtgaggacagagccagcattccctgaatgatctttctgggcatctctcccctctgttccacagactcctctctgcctcaattgctctgtcctccctggagacctgtacccagggggtgcaaggaaccccatggcttgcaatggcagtgcggccagggggcactttgaccctgaggacttgaacctgactgacgaggcactgagactcaagtacctggggccccagcagacagagctgttcatgcccatctgtgccacatacctgctgatcttcgtggtgggcgctgtgggcaatgggctgacctgtctggtcatcctgcgccacaaggccatgcgcacgcctaccaactactacctcttcagcctggccgtgtcggacctgctggtgctgctggtgggcctgcccctggagctctatgagatgtggcacaactaccccttcctgctgggcgttggtggctgctatttccgcacgctactgtttgagatggtctgcctggcctcagtgctcaacgtcactgccctgagcgtggaacgctatgtggccgtggtgcacccactccaggccaggtccatggtgacgcgggcccatgtgcgccgagtgcttggggccgtctggggtcttgccatgctctgctccctgcccaacaccagcctgcacggcatccggcagctgcacgtgccctgccggggcccagtgccagactcagctgtttgcatgctggtccgcccacgggccctctacaacatggtagtgcagaccaccgcgctgctcttcttctgcctgcccatggccatcatgagcgtgctctacctgctcattgggctgcgactgcggcgggagaggctgctgctcatgcaggaggccaagggcaggggctctgcagcagccaggtccagatacacctgcaggctccagcagcacgatcggggccggagacaagtgaccaagatgctgtgtaagtgtcacggctgggaagaggggctgagccaggcactgggtatgagtttggggctcctggggcctgggagaaggggctgagtatctgggtttatgggggacgaggaactcctctagtctcgtgtgtgtgtgtgtgtgtgtgtgtgtgtgtgtgtctgagttgcactcctgtgtactcttttagattaccctactagaatcttacaccaaaaatacctgttaatggctaacggtaagattgtgtaatttgtggagtccagtgcaacatgaaaattcagggtccctttttcaaaaatgaataagaatgtcaagacagcaacaacagagcattaaaccaagcccaggaccctgctaaacttggggccctggctctggaaccaaaacacagaaagggcagggcatgtggttgggctccaggatgacagaaaatgggatctggaccctccaggtctcaggtctctcctcttcttttttttttttttttttttttttgagacagggtcttgctctgtcactcaggctgtggtgtgaccacggctcactgcagcctcaacctcccaggctcaagcgatcctcctacctcactcagcctcctaagtagctggggctacaggcaggtgccaccatgcccagctaattttttcatttttgtagagacggggtctcactatgttgccagagcggatcttgaactcctggtctcaagtgatcctcccacctcagcctcccaaagtgctgggattacaggcataagccattgcacccggctctctttggttattaacgtgtcttggccttgttcttctcggcagcagcctgtgaggcatggccaccggcacgccatcttctttcctgaggaactgctgtctttccttagagatgagtgaaaaatcccaagaaggattctgatgggcgtggcctaggtcatgccccacctcctgagccagagtggcaggatgccgaggtgcacagcccccagtggaactacacagtgagaactggggggagcaaagtcccccagagaaggggaggagggtgttggagaggccaggtgctgaatttcccccatgccatgtctgcggttccctgggaaccgcaggagagaccatttgtctaaacagccccatcccgaggcgtgtctgtgaaggccgggctcaaggcacaggggatcaggccagaggcctgcggattagggcaggctaaggtactgggatgaggctctggatctctgtggcctggacctggctctttttcaaaagctgtggccctggggaagcaagacaaactgatactaagccgatcaaagatccgccccatccacctacctgcatcccagctcagccccacctcagcagagcctgaatcaggccagtggggtgagccaggtcagcagagggccactgagactttggacagagccagctaactgggggccgccccatctccagagtgactcgctcctctcacccctcagacaccgtcccagagctcagtctcttgtgcagctcctgaaacgaggctgaccccagagctatgtgcatgcctcccagctctgcacggtgaagcctgtgctcaggaccagctgcccactgccgccctgcctcctgcctactaccccgtcccctccctgaaaacatgggtgggcagagtctgcagtaggtgcttagctggggtggctcacccctggaaggtgggcttcctgcttgctggccttctctcttccctccctccctcccttgtccactttccgctggccctctgtgcaccaggccaggggccagggaggttgtgagcaacgtcctttttgaaatctgggattatgaggaaaaccatgctagggtatgatggggaagacactgcccaggaaagctagtgagttgcagcagcaaacccaagaaacaaggaacaaaaatcacagctgaccctgtggcagagacccagggaagggcatagttgggtaagaacaaggcaggagggatttggggagaaagtgaaggtttgccaaactctcctaccttttgttagggagggggtgggcaagggcctggcaagtaagatggggggcaggttagtgcagggcaagacattcagatgggccttggggagctgggggctggagctgaaaaggccggggccaaggcaggcagtgtgtgtgtgtgtgcatgcatgtgtgtgtgtgtgcatgcgtgtgtgtgtctcactctccctggccccatgacctccggtctgccgctctctgagcacgtgccccattcttcttttctgtacttatgcatcagcaagcatggcccccaagtgggcatccagagtggccctagccccacagcttgtatcaccccagaagctcaacagccacagctaagtgtcacccaatttcatattccagggtgagagaatctgattgggccggctgggcttaggtgtccacacctggtccagttggctgtggtcagaggcagggatatgccccattgcccacagtcagtgaccatggtgagggcagcctctctgagagaggcatggccagaacaggcaaatttccagaaacttccacctgggtgataggtgagggtggcctgtgggataggagaggatgtgaaaatgggtgacccaaactgaagcccgggaaggcagctgaggggcctcgggcgggcactcggcctcccttctctgtccctgcagttgtcctggtcgtggtgtttggcatctgctgggccccgttccacgccgaccgcgtcatgtggagcgtcgtgtcacagtggacagatggcctgcacctggccttccagcacgtgcacgtcatctccggcatcttcttctacctgggctcggcggccaaccccgtgctctatagcctcatgtccagccgcttccgagagaccttccaggaggccctgtgcctcggggcctgctgccatcgcctcagaccccgccacagctcccacagcctcagcaggatgaccacaggcagcaccctgtgtgatgtgggctccctgggcagctgggtccaccccctggctgggaacgatggcccagaggcgcagcaagagaccgatccatcctgagtggagccttaaagtggcttcacctggaggggccagagggtcacctggagctggggagacacatctgccttcctctgcagggatgccttcacgtactgtccctagttcagcctagaaattctgaccagcacctcagtttccctcagagggaaacagcaggaggagggatccctgactgctgaggactcacactgaccagacgccacaccttgtgcttcttatctgtccactgccactcccccagttcaaatccttaccctgcagaaatatcacagttagctggggctcagcagtcctccctctggggactccctgccaccactgccagtttctgaaacggtcccactgggtcctcactgtccttcccagttcctgttcaggttctggcaggggcccagggatccaggggacctggttccaatctcagccctgctgtcaccaccttgtcatgcaccatcaagcatatcagtctacctttctttttttctgagacagagtctcactctgtcgcccaggctagagtgcagtggcgcgattttgactcactgcaacctccgcctccggggttcaagcgattctcctgcctcagcctcccgagtagctgggactacaggtgagccccagcatgcccagctaattttttttaatttttagtagagacggggtttcaccatgttggccaggctggtctcaaactcttgacctcaggtgatccgccgacctcggcctcccaaagtcctcggattacaggcatgagccaccacacccggccaatcagtccacctttctaggccttggttccttgcctgaaaaatgaaagaggcgctggctttccacagtgtcatgctttggcactttagctatggttttctttctgtgtgtgtgtaagccactgcttataataaaaccaacaataccctcagactgaaagggcggaagttattatctgcatctttatcaaccccaagccccacttcctccctgacctccccatgccctccccagcctctcccagcacaagtggggcaaagccagcatgcaagcagaccccaccaccacagcccacctccgtcctcacatacgtgcaggctggctcgggagtccagtgagcagagcattggacttggctggccagagggtctctgagggcaagagacatggccaaccaagggcaaggagtgaccctgtggagggttctgccgaactcaatgcagtgagaagagggacagggacaagtagtccttgaaactgagccccattctgaatccctgcaggccaagtcattgctcagccaggactcagttcatggaggaaacttgtcctgctgcagtccctgagtcttgtcctcctgagaggaagccctggcttccaaggctgggagctggaggatgaccttcggtcggtctgtctgggttctccctgcagacagcttcctagctcatgcccatagctcatgctccctgccgagaaagtggaggacgtggtacagggttgcagatgtttagttttaaaaattcaattataaaaataataaatgctcatgatagaaaatttggaaagtgcaaataagcaaaaatgaaaacaattttaaaaatgtaaaacctctcttgccagggaatgggggaagggcaagtgaggagttctttaatgggtgaagagtttcagttttgcaaaatgaaaaagttctggagatcagttgtgcaacaatatgaatatacataacaatactgaactatacactgaaatggttaagatggtacattttatgttatgtgtattttaccacaatttttataaaaagaggattaaatctaaaggaaagaaaaaattaaaaccacccataactttactctgaagcagtaacagtggcatgtttcctcctagtgatgtgtcatatggtggttttattttatatacacaatacacatagacaattttgtatctggccttttgtccagtggatgttctatccaagctcacgcttgcactcatttgactcatgggatccactctgatgggccttggccagccctgggggagtaggacttgcataaaccatctgggtgaattcccagatgctggccaggaaggcctggatgccccctgcctactaagtccctggctcgggggaggaagagccgtcctgcctgtcagtcctgcccagtggacaagttctgggagaagcacaggggctcccggacagagagcaacagaggctgggggtggggagtggggacactgaggacaatgggagaaaatgggagaagtggggacctcgtggaggccagagagtggatgagggagctgaggggaggctggttggcggaggtggtttcctcagtggggggccctgagcctgccctgacttgaatgcacagtcaagccctgagtggggacagctcctaagaagtgggccttgggggagggtgggggataggggaggggagtgactgcagggacagggagattctgcagagaaaggagcctgtgaaaagctgtgcagagccgtgagcacctgagtgctgcccctgagctcccagggaagtagccttggggtgggagggggagatgccggatcccaaactgcaggctggaccctgaagttgttctcaagacgagctctggactcccagaggcctgcttcaaccacagtcagaggcacctcatgctcgaggcaccctggacagcactatgaagggcctccatgtgcaggcagcaagcagtacgggcagtggggttgttagaagggtgccctctgggccgggcatggtggctcatgcctgtaatcccagctcttcgggaagccaaggcaggtggatcacctgagctcaggagttcaagaccagtctaggcaacatggtgaaacccccgtctctacaatacacacacacaaaaagtagccaggtgtggtggcatacacctgtggtcccagctacttggaaggctgaggtgggaaaatcacctgagcccaggaggtctaggctgcagtaagccaaaattgtgctactgtactccagcctgggcaaattggagtgaggccctgtctcaaaaaaaaaaaaaaaaaaaaaaagagaaaaaaaaagaagggtgcccctttgtgagcaccatgtatgtctccgcagcacgtcagcaacaggtcctgtcagtcactggttcccatggaaaacgggaatagcagatctgaactcaccccttgagaaacagggatggcaatggaaagggcagaagcaagacctggcaaaaacaccggtcatgctggggctgcattctccttggtccccagtgctactcccaggtcaggaggcctccatgcttctcaaagtatctagctcatctggggctcaagtcacctccccttccgactgaggtcaccatatccctcctcctcctgtggagttcaggccctttctacttcccctcttctccactcctgctgctttcctgggtgacgtcagagtccatgggtgaccccactgctgctctgggtgccagctactgatggttcctgcagctctggagaccccaccccagtctcctagccccttggtcacatcctcactccctgtgcctccaggtgctctcccatttcagaaagtgtgagctcttgactgctactgcctctatcctgctctctgctcctatgacacatttattcttttatttttgtttgagatggggtcttgcttggtcacccagacaggagtgcagtggcacaaacatgactcactgcagcagtcaacctgctggcctcaagcaatcctcccacctcagcctctcaagtaggaccacaggtacacatcaccatgcctggctaattgtttttcttgtgttgtagaggcaccgtctcgccatgttgcccaggctggtttgaaactcctgggctcaagcaatctgcccaccgttggcctcttaaagtactgggattacaggcgggagccactgcatccggccatatttattctttaacctcatctagacttccaggttctagacggctttctcccaatccatcagcctcctctgagcttcacttcttttctgatcccaccatcagttcatctaccctactctgccagcgttcctgagggtgagtacactggaataattcttcccttctcagaaaaaggcttaatttccttgaaaattgaaagtccaagattagtctcatcaacaaacaaagctgcatatgcctacccttccttctgttaggcatctactcagcaaaggtaaagtgtgtagcactgcacatctgttctcttcattaccaggtggcatttccagatcattcctggcatctgggagcctatctcatttttgtacacttctccaagtcttcccctttccctattcttgtcttctaatggatccatcaggttcttgttccaaatttctttgtagcgtgctggcttcagcagcacatataccaaatttccttgtagagaggagttgccttgtgggggagagggggcacaccctagcatttgaactcctttcttattggggggaatctctcattgtgtgactcagtggaagactaagcccagtctcccacttacaggggtgaaagagttctggacactctccactgctgacatctattggtacatgatggaccaagccagctgggtgacccaacgtgggacctgtatctggagcaagtgacactaagacgcacaacaacaggggcaggcgtgtccaggggcagcagcactgacagcagtatcctgcccagtctgtcttgggttccgccctttttctcagccagtttttcctgccttcctgttgatatttgagctactgagagcatttcaataagttctttttctgctgaagttggctggagtcatttgcaaccaagaaccttaactgatctatccactggcttgaaggttacacattctgtttgttctactagcagttatctttacagtttctaagattagcaaatattattgatttcttttaaactgcaaactatagtctgtaatattctgtaattattctaatccccctcctcctcctggcaggaaaaatgaggacagatttcagaatttgatcctagaaacatacgtacactattttattttattttatcttatcttcttatcttattttatagagacagggtctcactatgttgcccaggctggtcttgaattcctgggctcaaatgatcctcctgccttggcctcccaaagtgctgggattacaggcaagagccactgcgcctgactcatacttacatttttctaacagtctaaacctcttcagcacaagaaaagaaccccagtgtgcttctaacacactgtgagttagtagagtggagtgtggaggtggtgagcaaggactctctggttgggctgcccagctgtgactcctggttctgctgctaattatccttacatgtcagaatgacctaaggccaaagtcagactggactgagaggtactgacatttctaaagaaagaatgtacaatctgcctgcacacaaatgagactcagaggcaaacactgacagtctgcaacatcgttccaaatggtgtccaggtttctaaatctacaaggtgtagtctgaggatggtggtgactctctaaagtaaatgttctttctgtggccccttcaaggcaataccccaacctaacattcaagtttctgcacaaggcagggcaggaaaactggggactgggcaggatcaaaggcctgacgcataggtgcgggacagtggggactcagggaaggcgaacttgggtaagtgcgccctggtcaataagaagaggccatgggctggaattagactggagagcctggaagctgcagccacatcctatggaacatccacaagagtttctggaatcttttaatctaacattcaagccccttcttcagctctaagcaacacaggcatcattcatccaacatttattgagcaccaaccatgtgccaggcacttttcaaggctgaggcggggtgaaggagagggcagataaacatactggcatataagtgctttgacagctggaactcaggcatcgaagagaggcacctgccccagccgagggaaggcttccaggaggaggtgatgcgcccaagtcctggggagaagggtctgactggcccctgagctttggccagggaagcagttccaccaaaactgaatcaggggaggaggtggagagcctaaagggaatgagggatgtcaggaggcagaatgaacactggacaggcacacacaaaagcaaagcaactgaggtccactatcatcactgctggcgcgtggacttccctggccacccttcctggaacttggacttggaaccttccctccagtctttctccctgttcgtctcacctcctttagatgtgttcaggcaggatttcttttatttgcatttcaggaaatttgaaaaaagtacaaaaaaccaccaaaaaaaattacttccattcccaacacccaaattaactgctgttaacattctggcaatttgattccatcattttcctgcatattaccccccttcaatttaatgagtaggctgggcgcggtggctcatgcctataatcccagcactttgggaggctgaggcaggcggatcgcctgaggtcaggagttcaagaccagcatggccgacgtggcaaaaccctgtctctactaaaaatacaaaaattagctgtgcgtggtggcacgcgcctgtaatcccaactactcaggaggctgagacaggagaatcacttgaaccgaggaggcagaggttgcagtaagctgagatcgtgccactgcactccagcctgggtaacagagcaagattccgtctcaaaaaaaaaaaaaaaatttaatgagtaacagattatccccaatcatttgctttgtaaaacaacactgctggccaggcatggtggctcatgcctgtaatcccagcactttgggaggccaaggtgggcagatcatctgaggtcaggagttcaagaccagcctggccaacacggtgaaaccccatctctactaaaaatacaaaaagttagctgggtgtggtggcagatgcctgtaatcccagctactcgggaggctgaagcaggagaatcgcttgaacctgggaggtggaggttgcagtgggccgagattgtgccattgcactccagcctgggcaacaagagggaaactctgtctcaaaaaaccaaaaaaccaaaaaccaaaaccaaaaacaaaaaaaaaatggcctaaaaccatctagtggaaggttgatggttatcctggatggatcaagctggcaacactcaaattgtctgatcaattttaacaccactgaatgtggaacaaccagatctgaagtggttaagtgccccctagagggacattacagaagtacacagcaccaaaaagaattcttgcaaaacagctgaacctgaatctaaccaagcctctagtttacaaaaacactgatgaaggaatatggtaaagaaccacaagattgtcaaccaagtccagattagagacaattctacaggacaactgacagtttctccaacaaataaaaggcatttttaaaggggaggttctcgattataggttttcaaaagatttaacggccaggcgtggtggctcatgcctgtaatcccagcactttgggaggctaaggtgggaggatcacttgggcccaggagtttgagaccagcctgggtaacagaaggcaatctcttctctacaaaaaatgaaaaataaagaaacttggcgtggtgtggtggtgcaccagctacttgggaggctgaggtgggaggactgcttgagtccaggaggtcgaagtgagccacgattcagccactgcacagcctggtgacagagggagactccagctcaaaatttttttttaaaaaagagacatatcaactaaatgtaatgtgtagatattttaaaatcctaattcaaaacaaaccaacaattaaaagacactttttatttttgttttttaaagacagggtctcactttgttacctaggttggagcacagtggtgggatcactgtagtctcaacctcctggtgggctcaagtgatcctcctgtctcagcctcctgtgtagctgggactactggcacacacccagctaattttttttttttttttttggtagaaatgagatctcgctgtgttgcccaggctggtctcaaactcctggcttcaagcaggaggatcccttgaccccaggagttcaagaccaggctgggcaacatggcaaaagtccatctctacagaaacaacaacaacaccccccccaaaaaaaaccccaaaaattaaccaatgcatgcctgtggtcccagctactcaggaggctgaggcgggaggattgcttgagcctgggaggtcaaggctgcagtgagccatgatggcaccactgcactccagcctgggtgagagcaagttcttgtctcaaacaacaacaacaacaacaaaaaactcccaaaatttgcaataaagattaacgtatatgtctctccagcagtttgaatgctctctaggttagacacatgcaagtggatttgctaaaggaaggaatgagtatttttacctttactaaaactgccaaatttctctccaagtgtttgtaacaatttgcccttttaccagtttctccacaatccccaaacactcgtaatttctgtcactctgacagataaagtatcttattaagttgcatttccctaatggttgtatagttgagcatgtcttcattctttgccactcaaatttctcctgaaaatggcttttcatatccttcagccatttttgtttttttcttgatttgtatttcattcatattacaatattaaatttgttttgtatatgttacaaatatttctaatttgttccttatgttttaaactggtttatagaaactcctgcatccagcagttgtaaattgtaatgtggtcaaatctgtcatcatttcgttggtaggggagaaaatattttcctctcccatcttaagggttatggctgacacccctataacaaggttaatgagagaaaggcataacaaatttaaagtcttatgtgacacaggaaccttaagaaacgaagaccccatgacctaaagaaaactgtatttttatgctaagtctgatgaaagaagtagatagttgtgcagaaacatgattggacaaaaggggcatcatctaatggtcatacataggggtgggaggagacttcggcatggcccgtttgctcagattctttcttgcgtctctgcatgacacttctcctccccaggtatggcacaagactcctctggaatgagggtcttacaacctacttcacatgaggtaggccagtgaattcctttatgaccctgctttatgggagggagcagattacttacagagaccttgcttctgtggttttctcaactgccaaggtgccatattttggcacatttatggattttgcttgtgacttatcctgtccttgttattgattttaataatacttcctggcagggagtggtgattcaatttgctaatactttatttgaaccctgcatctgttcttaaatgaaatgggcttttgccttttcttcagttgttcttgatcagatatatataatattttcttaaaatatttgggctaatctcataaagttagctaggtaacaagagtttggtgaggtaccaaatctaaaacaggtaggcagattgttttttctattctcattctttcccagtttgggtctttctgaagctaggataaggccagggctccttactcaagatcacccttccctatcccctaaaaacacacacaatatccccaaagtgtcactgttcaagttccaacatggggctaactccgaggagcttgatcctcctactggggctactggtgttaatggccatgaggccttgtgagagcacatgttcatgacagtccaactcaaaaaactacgagagtattaagtgatggagaattaaaccttaactaccgagcctcaacttctttaaatgaaaaatga

SEQ ID NO: 140 - DNA, 1281 bp, Homo sapiens
cagactcctctctgcctcaattgctctgtcctccctggagacctgtacccagggggtgcaaggaaccccatggcttgcaatggcagtgcggccagggggcactttgaccctgaggacttgaacctgactgacgaggcactgagactcaagtacctggggccccagcagacagagctgttcatgcccatctgtgccacatacctgctgatcttcgtggtgggcgctgtgggcaatgggctgacctgtctggtcatcctgcgccacaaggccatgcgcacgcctaccaactactacctcttcagcctggccgtgtcggacctgctggtgctgctggtgggcctgcccctggagctctatgagatgtggcacaactaccccttcctgctgggcgttggtggctgctatttccgcacgctactgtttgagatggtctgcctggcctcagtgctcaacgtcactgccctgagcgtggaacgctatgtggccgtggtgcacccactccaggccaggtccatggtgacgcgggcccatgtgcgccgagtgcttggggccgtctggggtcttgccatgctctgctccctgcccaacaccagcctgcacggcatccggcagctgcacgtgccctgccggggcccagtgccagactcagctgtttgcatgctggtccgcccacgggccctctacaacatggtagtgcagaccaccgcgctgctcttcttctgcctgcccatggccatcatgagcgtgctctacctgctcattgggctgcgactgcggcgggagaggctgctgctcatgcaggaggccaagggcaggggctctgcagcagccaggtccagatacacctgcaggctccagcagcacgatcggggccggagacaagtgaccaagatgctgtttgtcctggtcgtggtgtttggcatctgctgggccccgttccacgccgaccgcgtcatgtggagcgtcgtgtcacagtggacagatggcctgcacctggccttccagcacgtgcacgtcatctccggcatcttcttctacctgggctcggcggccaaccccgtgctctatagcctcatgtccagccgcttccgagagaccttccaggaggccctgtgcctcggggcctgctgccatcgcctcagaccccgccacagctcccacagcctcagcaggatgaccacaggcagcaccctgtgtgatgtgggctccctgggcagctgggtccaccccctggctgggaacgatggcccagaggcgcagcaagagaccgatccatcctga

SEQ ID NO: 141 - protein, 422 aa, Homo sapiens
QTPLCLNCSVLPGDLYPGGARNPMACNGSARHFDPEDLNLTDEALRLKYLGPQQTELFMPICATYLLIFVVGAVGNGLTCLVILRHKAMRTPTNYYLFSLAVSDLLVLLVGLPLELYEMWHNYPFLLGVGGCYFRTLLFEMVCLASVLNVTALSVERYVAVVHPLQARSMVTRAHVRRVLGAVWGLAMLCSLPNTSLHGIRQLHVPCRGPVPDSAVCMLVRPRALYNMVVQTTALLFFCLPMAIMSVLYLLIGLRLRRERLLLMQEAKGRGSAAARSRYTCRLQQHDRGRRQVTKMLFVLVVVFGICWAPFHADRVMWSVVSQWTDGLHLAFQHVHVISGIFFYLGSAANPVKLMSSRFRETFQEALCLGACCHRLRPRHSSHSLSRMTTGSTLCDVGSLGSWVHPLAGNDGPEAQQETDPS

SEQ ID NO: 142 - DNA, 24495 bp, Mus musculus
  misc_feature (1)...(24495): n = A,T,C or G
ctttggtggctctgacccagccaggagcagaaattcagtgcacgcccccttaccccttgagggtttgttctaatgggaagtggtttgcctgcaggtgcctctgaggtgtgactaaagccccaaggagagcaaacaaatcataatgaaaccaagtctgtgtgtttgattcctgtctttagcctccctcccctgtgtgtttggtaaatacataaaatgaaaacacttctcagtgacctgtgtaaggtttcaggctgtatctgcaggctggccttgaacttgtttgtagtagataactcccagagtcctgggagtactgtgcccagtctttatgccatgctggggaattgaactcagggcctggtgttgatcattccccaacattatccagcctgagggtggtgacggcactgagctgtgtttatttcatcttgtccctgtctgttcccagccctgaggtttcatctttttgcccatgtaatagggttggggtgaggggatgggtaaactccttttcatctagattttttaaaaaagacctgaaataatatgcttaggttatgtttgtatatgtttaagagcttctaaccctgagtttcctaagtttgttctgggataagcgcttcctcagggaagtccactacagtgaaaagccgagagaagggccacacacggaggctcatgctcataatgtcagcacttggaaggccgagacaagaggattgcactaagttcaaggccacttagctacatagcaagcaccgggccaattgtagaagatagaaggtagaggaggaagaagagggaaaggaggaagaaggggaggaggaggaagaggaggagaaaactcttcaagtgtacctttaaggcagaaagagtcaggcatggtagtgcatctctataatctcaacactggagaaactgaggcagcaggctaagtgtatgctggagaccagccagggctacccagtgagttccaggcctgtgtgaactatagtgtcagaccctgtctcaaacataagatgacgaaacaaataaaccaacccctccccaaaacaaacaaacaaacaaacaaacaaagcatcgatcaatcaaagggaaaaccctgaaacagcaaaacccgaggagtgaccacatggtgaactagaaaaccccaagctatgggggagctgcttgtggcacggactctgctgcttgtcaacccatgtggccctgatggagggcatggggctctggagagctcgtggtggctgctcactgcacccccaccccccgtgtcctgtgtctatgagtgttctcagtctgacgtgggtctccataccttgtgtggcatgaggcatgggctttggcactggaagtctcagcacactcgagggcctgggggctgtgggaatctccccaacactgccaagcatgaatccaggggtttgagagccaggagttcccctctgctctgctgggacaaaggctccttacactttttccacttgtggccccttgggcctaaaacatttttatgagaacccaggtatatgggaataaaataggtgacaaagcaaacgtttgctgacagcgatcataaagacagttattttaaaacaattcattgatactcacacgtcatgtgcattagatcggtaagctgtcgtgtgctgtgaggggctctccagtcccagactccagcaccttgtctggggacaggttgctccctgactcagactgtggctgagtgcttgatacagcaggactgagagcctcttcacggttgtgactacagagtctccaaactgagtacatgtggaaaaagctcctccggcagcttaactctcagaacaagactattcatcacgaccaagtcatcaccaaccatcataaccaaaatgatggttatcagcagtggagcccctggcctcctgaccaggagtgcggctctaaacggtgcagcctagttctgcctggttttgagtgacaggtgactgactgaacagactgtgtctgggttctgtcccctgttctgctcttgcagtggccaatgccacacagctctgacttgttctccctgtcacaggatagtccatgcaaaaacttgactgcagcgagatatttccggtaggtggctctggttgtccacttggttggttggttggtttggtcttttgtgtttgtttgtttgtttgtttgtttgtttgtttttgtgtttgaatggaacccaggctctcctgcgtgcttggaaaaccctctgggccacagccagcctgtcaagactcagaccctcagacaccactgtgataatcactgttacgaatgtatttatgtcagactgaggggaattgtcgggtctcagaatgatgtagttcctccaactctagaacgatctgccaaagtgttctcagctggttttctgtttttattacaatataggagttctcatcagtgcagacactcagtaaattggtaggattctgtttgcattcttgatttaaaaaaaaaaaaaaaaaagccgggcgtgatgacacacgcctttaatcccagcacttgggaggcagaggcaggtggatttctgagttcaaggccagcctggtctacaaagtgagttccaggacagccagggctacacagagaaaccctgtctccaaaaacaaaaaacaaaaaaccaaaccaaaccaaaccaaaccaacaacaacaacaagaacaactcaacagccgggcgtggtggcgcatgcctttaatccaatttgcctagaatgcttgaggtcctgagttcaatccccggcaccatataacacctgcatgtttggaggggcagaggcaggaagacaagaagttcaaagtcacccttggctgcacagcgagtgtgacctgtaatacatggggcgttggggaaggagtgccagtggcagagccggagccagggggagagccagaaatatagagagagacaaaagacagacagacagacagacagacagacacacacacacacaaagagagagagagagagagagaaagagagagagcgcattgatagataccccatttgtacctaacaaaaagcaatggatttagaaatggaagtcacctaagcattgttataaacaataaggagaatccagaagggaagctgcgttggaagtcagaaggtaaaataaacaatatgcactgagcgatacaaaccacagttaagcaggcctgtgagttaaagatcccgtttccatagcagcaagaattgcaaagggcccagggatttactgaacaggttacacatagacacatacatctaactgaaaataaaataaatcttaaaaaaaaaaagaagaaatccacattgtagtgtgttgtcatgatagtgcttcctgtctaatcatgcttgctaatgccagaaaagagagatatgtctggcctgcaggaggcctgaggttcatccccagcactgaaacaaacaaatagccaaatcagctatcaggcgtctcaattgccacccgactcagagcagtgataaggtctaattgcaaagaggcaaattaagtgtcagagtaaacaagtggccctcaagaagaactaaacctggctgctcctgggaggggaccctggggaggagggacttttcactggactgcttaaaggataaagtcgggggccatgtggacacggaagggtgaaaatgttatacggctccatccctagacagagagctacacatggccaatgactgctgggctggggagagttagcctttgccacccatgagcccccttagtggatgaccacggcagagtggtgggcctcagcccatatgcacacaaacaacaaaggctgggttaacatttacatttacacgtgagtgtgtatgtgtgagtggtgtgagtgtgtgagtggagtgagtatatgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacacaacagctttctgttgttgtgaaggatgaagccatggtgtttgcaggagagtggacactcccggaggtaaccatcgtgaaggaattaagtgaatctcagaaacagttcttatgcatttcctgtcacttccggctcccagattgtatgtgggtacagaagttgatattcatatatcatgagagtagaacggcctggggttatacggcagaccagtgggaaggggaaggagagaaaggagaatgtggagggggagcaagcaggatgttttcaatatgtagtatatgcatactcaaaagcttcaagacattaaaccatggatcagtgaggttcattggtgggtgatggcgcttgataccaagcctgacacacagacttcagtttctaggactaacatgatgggaggagagaaccaactcctttgtttgtttgtttagagatggggtctctctgtgtagctttgtctgtcctggaattcactctataaaccaggctggtcttgaattcacagagatccacctgcttctgcctcccaagtgctgagattaaaggtgtgcgccaccacagccccacaggaaccaactcttgaaagttgttctttgatattcacatacacactgtaacccatgcctctacctcccccaataaataaacaacaacaacaacaatatcaattaaaaacacagtttgggaacaaaaccacataaaattggggactgggcataaaggtctgaacctgtagccaccgtggagggtccggtggggaatcacattcagaagttggaggctagctgataggacatagtgaaaccccgactcttaaattaaattgggactggactatagcttagtggcagagtacatgcttagcatccttaaggccctgggttcagtctcagcattgtgtgtgtgtgtgtgtgtgtgtgtgtgtgtttgtgtgtgtgtgtgtgtgtgtgacaaaacaaaaacaaactcacaaaacaaaacagaacatatcttcacacacaccccagaacactccacatcaaaaacccaaataaacaacattcccctgctgtcaaatctgtaaagatgattttttaaaaactaaaaaatttaaaaacataggtgctgggggggggtagggcatgggggacttttgggatagcattggaaatgtaaatgaagaaaatacctaattaaaataaaataaaattaaattaaaaattaaaaaaaaacataggtgcaaataacggttgttaataaaatctgcctgacgaggaaaccattccatgttgtctgcaagagaggcagagaatggtgcgcaggaggagcaaaggaagagcctgtctcttcccacactccttccttccacagatctgaatgttcctgaattctaattatttttaagagagttaaaaagaaaagaaaagaaaagaaaagaaaaagagaaagaaagagagtcaagttacatcttagaaatttcacctctcaagtatgttaacagtgtaagaggcagctagaatttcttgagcacctactgtgtaccaagaggcttgccaggaattctgggaacatggtggttaaatggctaatttctgggggtctgttttcccagagggaaactggaatcgccttgagaagactctcatttcccacagtggatttatgtcacattgaggagggtctgagatctgcagaacttgtgagtgtggtacagcannnnnnnnnnnnnnnnnnnnaaataaaattaaattaaaaattaaaaaaaaacataggtgcaaataacggttgttaataaaatctgcctgacgaggaaaccattccatgttgtctgcaagataggcagataatggtgcgcaggaggagcaaaggaagatcctgtctcttcccacactccttccttccacagatctgaatgttcctgaattctaattttttttttttaatttagactgaccaattcagagtctgccatttatttatttatttatttatttatttatttatttatttattttttcgagacagggtttctctgtgtagccctggctgtcctggaactcactttgtagaccaggctggcctcgaactcagaaatccgcctgcctctgcctcccaagtgctgggactaaaggcatgcgccaccacgcccggcactaattatttttaagagagttaaaaagaaaagaaaagaaaagaaaaagagaaagaaagagagtcaagttacatcttagaaatttcacctctcaagtatgttaacagtgtaagaggcagctagaatttcttgagcacctactgtgtaccaagaggcttgccaggaattctgggaacatggtggttaaatggctaatttctggggtctgttttcccagagggaaacgggaatcgccttgagaagactctcatttcccacagtggatttatgtcacattgaggagggtctgagatctgcagaacttgtgagtgtggtacagcaagggtttgaattcaaacctgcaggaaggagaaggagccaacagcctaacacgctctctatatccctgtctgtacctgagatgctctgggagaacacggagtccaccagggcatgtctggaagtccctctgcactgcccaccagaagccacatggcctcgggcaggggttaggatctccacatgtggggccagactgcccatggcacctgggctggccttggagtacttgctaagagaacacaaagtgtctgctctgctcagtgagggcatcctagacaccaggagctagcctgcaaagactgtcctggactttagcttccctgacctcagaggcccttgggtctgatcctatgcctaatgttagccatacacttaactctgcaagtcccaagatgacttctgttcccattgcagtgtttgccccagcagcccaacctctgtttggagacagagagtggtaggaaacaccaggcttcttttcttacttagccctcatttccctcgtgattgggccactgaccacccctgggtcctttacactggtctcgagccaagaaaggcagcgcatcgtgtcagaagctgcagacttcattccagggcccccctctcctggtttggggcctgctttccaatctcaagcctgacctgggtcagacctgggcaggagccatggggaaggcagctgctcttctgcataacaaagggtggccctgctggagagccagggaacacaccagggacgagtcttacaatccactatggtttcttcatctatcccccgactaagattgtctgaatctgcaaataaaacctctagatactggtgtaatgcaaatcccaggtaaacagtgactgatatattgtgtaaccaagtcccagattcagtacgggttttatttggcagccctacccctggcagcttgctcaattttatttctccagcgcacaaagccacaaattcacactcgggtatcccagctgtgtcttggagaaggcttagcatattactggtgtatagccacacacccttgtccccaccccagccacatgcccctgtccccaacccagccacacaccctgtccccaccccagacacacacccctgggcaggacttagcagaaaataattggagctgtggaaagcccttcgtgggcaccgatcttaactatgttgcccctcgtctgagccgatgtactctggctcagagattgggatggggtagattttcaattctcctacagcaagaaagggaaaggataggttgctcattggcgagtcccaggctttgcaaccaaggaaggtcccccagcccccaaagtggagaagcctcactcttatcagccctagaaaagtcttttgcacacctgggaagcaagtcagttggagagcccaggtgttgattgacatctggttctctccagggtttagaagcagtgatggacaagactacaggtgcacattccagacactgggagcaggcatccagcagagaacgtgagacctccgcgtcgtctccaggacccaccttccatcccatgctgggattgaatttagggcttcacgtgtgcagggccggtgctgctctaccactgagctattaccacccctgtcctgaatgtcctaattggtcagacacccttaagtcaatggtgaagtatatggctaacagacagcggtgaccagatgttctcagtccagacaggcttttgtgtcctttctagacagcccctcctcaggactcaggggcttgtttcatgctgagctcccaggaggtcccaggggtgtgacctctcttcttcctccctgccccccaccccaggaccagctataaagctgttccgtaccgtaccattcctccgcagactcaagaccctttcaggacacctcagggacacacacatccaaggctcctcttcccggacagcaccatgccattcctgtggctctgctgggcactctgggcactgtcgctggttagcctcagggaagccctgaccggagagcagatcctgggcagcctgctgcaacagctgcagctcgatcaaccgccagtcctggacaaggctgatgtggaagggatggtcatcccctcgcacgtgaggactcagtatgtggccctgctacaacacagccatgccagccgctcccgaggcaagaggttcagccagaaccttcgaggtgagccctcccctgttgtccttggtctctaggaaaggccggctgatcatgccttccttccacctgtggtgtgtatggacccttgccttgtggtgctcagagtcagtcatgggggtggggggcacagggtgaggcggatgttagaggggagaagatctgggagggtgggcactggggatctggctgtgcactgaaggagtctcaggatgggaaaagcggggctgtgcttgctggtaaattaaggagcagagaagagggaggagagtggaagaaaacagaacccctggagcagtcagggccaggtagaacttcctggggtcactgcctggacgagtggctgactatgtcttgccatggacagagaacagtggctgggtagaggcagccctgggtgacagaatttggaagagagagagagaaagagagagagagagagagagagagagagagagagagagagagagagagagagagagagagagagagaacaggtatccagctgtcaagtagcaaaggcctgtgtggtggtgcagcattttccagctggaagcagccctcatgggcacagccacatccataaacttactgtcctgtgggtacctaggcctggagatagaaggatgctggttctgaacaggcaggcaagggagatgtctgctgaggataggtgtggctggcctctcaggtaaccaaccattctgctatcccagagagtgagcacactggctggagccatttaggaaggtgacaactccctgaacacttgccccagggttcagcagtcctgacaaggatgttcacagactcctgttccactgaacggaacccctcacaaatgcatctgtctcttaagaaaggcacctcgggctgggcttcttttctctagtctctgcagcctgattctgtattcctcccccaatcctctcctaaaaccttccagaaagaagccagcattgccacgctctggaacccctccagctcctttcttgcacagggttccaaagtcaccactaagtgtggaagagttagcattcagggcctcattgcaaactttataattcctgagtagaaagaaagacttctttttcatgttgttcatgggcttcctgcttacaactctccctgaggatttttaaggaatcttggccattggtcttgggtcttgccaccctggaagttatctggtacttgtagaggcccggctgactctgtccttgtnnnnnnnnnnnnnnnnnnnntggggggcacagggtgaggcggatgttagaggggagaagatctgggagggtgggcactggggatctggctgtgcactgaaggagtctcaggatgggaaaagcggggctgtgcttgctggtaaattaaggagcagagaagagggaggagagtggaagaaaacagaacccctggagaagtcagggccaggtagaactccctggggtcactgcctggacgagtggctgactatgtcttgccatggacagagaacagtggctgggtagaggcagccctgggtgacagaatttgggagagagagagagagagagagagagtgagagagaggaccaggtatccaactttcaagtaaccagaggcctgtgtggtggtgtagcattttccagctgggagcagccctcatgggcacagccacatccatgaacttgctgtcctgtggtaccctaggcctggagatagaaggatcctgcttctggacaggcaggcaagggagatgtctgctgaggataggtgtggctggcctctcaggtaaccagccactctgctatcccagagagtggacacactggctggagccatttaggaaggtgacaactccctgaacacttgccccagggttcagcggtcctgacgaggatattcgcagactcctgttcctctgaacggaacccctcacaaatgcatctgtctcttaagaaaggcacctcgggctgggcttcttttctctagtctctacagcctgattctgtattcctcccccaatcctctcctaaaacctccagagaggaaccagcatttccaccctctgggacccctccagctcctttctttcacagggttcccaagtcacccctaagtgtgccagagttagcaatcagggcctcatttccaactttataattcctgagtaggaagggaggcttctttttcatgttgttcatgggcttcctccttaccattttccctggggatttttaaggaattttggccattggttttgggttttgccaccctggaagttatttgggaattgtagaggcccggctgaactttgtccttgtccacagaggtggcaggcaggttcctggtgtcagagacctccactcacctgctagtgttcggaatggagcagcggctgccgcctaacagcgagctggtgcaggctgtgctgcggctgttccaggagcctgtgcccagaacagctctccggaggcaaaagaggctgtccccacacagtgcccgggctcgggtcaccattgaatggctgcgcttccgcgacgacggctccaaccgcactgcccttatcgattctaggtatagtctctctctctctctctctctctctctctctctctctctctctctctctctctctctctctcgagagttgggaagtgagggactcgcccatgcagggggaggggagcagcagatgataggggtgtgtaccagacgggacagactcctcctccagggcctccctaacagcctgccagtcccctcgcctgacgcgcactgctgtgtctcaggctcgtgtccatccacgagagcggctggaaggccttcgacgtgaccgaggccgtgaacttctggcagcagctgagccggccgaggcagccgctgctgctccaggtgtcggtgcagagggagcatctggggccgggaacctggagctcacacaagttggttcgtttcgcggcgcaggggacgccggatggcaaggggcagggcgagccacagctggagctgcacacgctggacctcaaggactatgggtaagcattgtgggctaagttgataagcgaaattgagagacaaatggggactttgacttaactgtgaaatgacaaaatttcagaatgtgagaatatttagaaaaggcttcctctgactgttatgaaactctcaataaatagtatttatttagttcttaggtgtccatccccataaatatccaatattcagttgtttcctttgctacggcagtgggtttgaaatctaggccagaaaattcctaataagctacacacccagcccagttcttcaatactcgaagaactagatcttacatctctcccagatgctcctgacccctgccctgtcaggtgacctttgctctctcacccctacagagctcaaggcaattgtgaccccgaggcaccagtgactgaaggcacccgatgctgtcgccaggagatgtacctggacctgcaggggatgaagtgggccgagaactggatcctagaaccgccagggttcctgacatatgaatgtgtgggcagctgcctgcagctaccggagtccctgaccagcaggtggccatttctggggcctcggcagtgtgtcgcctcagagatgacctccctgcccatgattgtcagcgtgaaggagggaggcaggaccaggcctcaagtggtcagcctgcccaacatgagggtgcagacctgtagctgcgcctcagatggggcgctcatacccaggaggctgcagccataggcgcggggtgtggcttccccaaggatgtgcctttcatgcaaatctgaagtgctcattatactgggagagctggggattctaactccctaatgggcaatccctgtgtgtgctctttgcttcctctgaagtagcctcatccctaaatttttaccttcgaggaatgtgactcgctggcccctggaggcgctctgacccagtggtctctgtccttcatattgttcactgcactgtatgcgaagcacttacatgtatagatactgcaaaccaaggacagaatccccaattgccattgttcccttaatttgtcgctgaatctgggctgagtcccagtcttgactctggacctaagccacaagttgggcaaacatgtccaacctaggcaatactggctttgctagatgtgaataaaatatgctttgttttgtagcttttttgtttccttattttctctctctctctctcaagacagggttttgtgtgtgtgtgtgtgtgtgtgtgtgtgtgtgtgtgtgtgtgtagcctctgtcttgtttccccatttaaactacatctgtgtaaactgaggcagaaaaaagaaaggcctggtgttagatcaacttaactgagaactaaagagcttgattttgctaagacttgatcgaagtttcagcgataaaagaagccaacttggtggtgtctgcttttcagaactgagatagaaatgtttggctgttgagattttggctttttgggtccaacaattagggttttatttcgattctcgttgcattaaggaaaaaaaatcttattatgtcaggtgtggaggtgtgcacctttaatcccagcagaggcaagcagatgtctgtgagtttgaggccatcctgtgacatagggagtttcaagtcacccagcactacactgtcagaccttgtttcaaacaaacaaacaaacaaataaataaataaataatcaaaaatcaaagtcataattctagaaggatagaactcagtcttcttgggctgatatagggggcgctattcacagcattgnnnnnnnnnnnnnnnnnnnnnnnnnnnnnnnnnnnnnnnnnnnnnnnnnnnnnnncagatggttgtgagccaccatgtggttgctgggatttgaactcccggaccttcagaagaacagtcgggtgctcttatccactgagccatctctccagccccccagaagctttttagaagcaagcatgaccagagtctcagcccaaggaatgggtctcttagtctccctacaggtctgcacagcggttggcttcaaattccatctcctctagtctaatctgaatcctaatctttcttgtcttgatcccctaaatagcagcagcaacccccaacttctgtagttttagtttaagaaaccaataatttttttaaaagaaaacctctattattttattttacgaagaaacccctgtacaaaaaaagctttatttccccttataaagtcaagagaccgataatttgtttattgtatttatatgagtacactgtcgctgtcttcagacacaccagaagagggcatcagatcccatcacagacagctgtgagccaccatgtggtttcagggaattgaactcaggacctctggaagagcagtcagtgctcttaaccactgagccatctctccaaccctagatttatttatttattgtatttagaaaccaataatttaataattactttacacactgactagtacaaccaggtctatggcttgttcaactcacaccctagatttattttcttagacagtgtctcatgtagcttcctgcttttatttaatttattattattattattattaaacaaggtgttaaatagcttaggatagcctccaactccatatgcagtcaaagatgactttaactttcttttttcaagacagggcttctttgtgtagtcctggctgtcctagaactcactctgaagaccaggctggccttgaactcagagatctgcctgtctctgcctcgaaagtgctggggctaaaggtaatgtcccaccttgcctggctttgagttttttgtttcgttttgttttgcttgttttttccagctagggtttctctgtgtagcctcagctgccctagaactcactctgtagacaaggcaggcctcaaacgcacagaaatttacctgcctttgcctccctagtgctgggattaaaggcatgcacaccactgctcagctgacgttaaatatttttaaaaatcaaattgtgtgtgtgtgtgtgtgtgtgtgtgtgtgaatgtgagtgtgtttgtgtgtgtgtgcatgtgagtgtgtatgtgagtgtgtttgtgtgagtgtatgtgagtgtgtgtgagtatgtgagtgtgtttgtgtgagtgtatgtgagtgtgtgtgtgtttgtgtgtgtgtttgtgtgagtgtgtgtgtgagtatgtgagtgtgtttgtgtgagtgtatgtgagtgtgtgtgagtatgtgagtgtgtttgtgtgagtgtgtgtttctgtgagtgtgtgtgtgaatgtgagtgtgtgtatgtgagtgtgtttgtgtgagtgtgtgtgtatgtgagtgtgtgtgtatgcgtatgtgagtgtgtgtgagtatgtgagtgtgtttgtgtgagtgtatgtgagtgtgtgtttctgtgaatgtgtgtgtgtgtgtgtgtgtgtgtgagtgccagccagcaagtgctttggaagtcaaatggaaactttagggagttggttctctctttcaacagtgggttctgtgggtcagactcagagacgcagctggttaggctttcgtggtaagcgcctttatcctgagcaccttgaacttctcatcctgtgtaaccacctttatcctgagcttgaaccttgaacttctcatcctgtgtccacatccatccacatccggagtgcggtgagtacagacctgtatcaccatgactggcttgtgtgtcactaggtatcgtgcacactacccaaacactctgccaacttgagctacatctctagcccaggtcttgtcaactcaaacactctgatccatcccagccttctctggaccttgagacaactgtaacctgcagaagaccagacatgggaagcctttccttcccttaccaagggccctaaccttttctttggtagctgggccattatcctaatgactggggctagatcccaggccacaggccaggtaggtgtcagcatgatcaacaaaggcagaaatgaggatgtgtgggatgggagcctggagaagatcaggcagagccaatctgaggagccaagtgcataaatgactgggggcctacaaccagggacctagagaagccagttgtggggtccctaacaaagaaaagacaaggacagaggatggctctgggaaattaactgttagctgggtgcttaaggggttggaggatgggagtgggaagggacagagaaccagagaggaaagagacaccctgtttcagatagttgcaggctgggctagaatcaggaccagggaggctgcgagagtatttttatctttacagtagaagatgaaagctaaaacatggaagtgaggtcagagaagcagcaaaactgtgtcttggggaatgaggatttgccgggcatgccggtgtcagtgtggcaagaactcagcagcaagctttggtcccactcctttccttgtgtaaaccgagacctgcaagtgggtggtttgaggcagtggcccctccaggatccttactccatttccctaaagatccagcgtcggtcctgtcctgggagagggcgcagagcaggtccagaggccgctgttatctggaaacctccaagtcgcagccagaacacaccagacgctcagcgtgtttggtcccagttggcaacgctggtgacccggggcagagcagtaacgcgtggtcctagggaacgctggaaatgttgttctttatttggggcaggacagagctttgtaactttcaaggtcccggctctcttatgcggcgggactgggaacagggtaggtccactgcgccctggtgttcccccgccctgaaatccaactgggccagcttagaatttcctggggacattcaatcacgaacatttgcagatgctctccaacgccgcaactatcctaggcacggcccagtgccctctcagtggggatgtgctagggcacaaaggaaaggcagttcggagacgtcctctcccagccttgtgggcgttagctggtctggtcccgcccctagacctccgtgaggacggccacgcgtggaccagcgttagagaaccacattggggttcactgcccggcgcacagagctcgaggtcctgctggggccggcgcgagcgaagagtccaaattaggtaacgcgtggacacagttctgcgcatgtgcaagaggagccggagtttcactttgtaacttttaagtggtgcggacgccgccccgccccgccaggtacggactgaccactcccccgggcgcgcgcgccgcgccgccgccgcaggtaaagtgggaaggggagcagagatggggaggttgcggccagcccctcccaggacgcgccggcccgggtcctcgcggggcggggcgcctcgggtcgctttccccggggactgtctggtgacagtagcggggtaggtggctggagagtgccaatcaagccccgcgccgctgggacttcctgacagctcttggctgcgtggcggatccttccctccacctcctcggcgggctttggagtttgtttgtggagtcggatctccccgcctaacccgaagggcagcgtcggagccctcttttctttaattccttacgaggctagacccggcttgggcgggcttcgtactgtccgggtgaccactccctcctgcccgggtagcaccgggtggaggaaaactggggacttgggaaagggcgggagggggagggaagagctgagacggcaaagaaaccacatccgacaacaacttacccagacctgataagcctggctacctgacacctcgggtgaggtggagttgctgtctttctgtcccaaacaggagccaacagcttgtagggacttttgcaaaaggcctgggaacatattttctctcctgaagctttggctgggtcccagagcctgccctgttgagagtttggggtgccaatgatatggtggagtgctgagcgtttgcgtgtacgaatattcactggatgtgggatggtggctattgctaagtgtgtacctaggcagggatcctgagaccacagtgtctaattgctgtttttaaggccccctcgctcctcgtagtgatgcggttggaatacagccttttgccttgcacattctaggcgtgcacttggctttgagcagcatttccatcccttagggacttgtttgatttcttccctacacacacccagagccttctctctctggcttggctgccccttggtgggtgtgctcccatctgccctctcagagcgtgttcctttgggaaggcaagaacggactggctcattgaaagcctagagaatgtttctgtagcagcctctgactctgctgctgctgggtgggcacaggttgctccgactggaggagagggtctcggactgtggcttctgatccctctcacttgtcaagcctttcttgtttgctctgcggtatttgatttccctgattctagcccacaggggatattgaggcagagaagcagcccttatgtctgcatgaggcagaataggctacctggttgaggaggcccttaggccttctgttttgcttttgaggcagggtcttactatgtagccacggatggcctagaactcacagagatccacctgcctctgcctcctgaatgttggggtaaatgggtgggtaccacaacactctcccttccttagttcttaccaaactttgtagattctcttgggaaacctgtttggcaagagaaaaatgacttaggagtgtggcttggccactaggggaaggcagccacagttaccctcctggggtcaaggcttctctgttcctccaggcctctgaaagagcaacattggtgagtcacctttcctacccacccagcactacccgtaccccccttccttgggacagcactccctctgtgagcatttatgaggatatttttccttttcttttccaagccttctttctttgctctagggtggcccatttcccccagttctagctttaggggatctttgggtgctgcagcagccctctggatgttcataggaaaccttggcttggtatgccacctcaagcccagagccactgtgcttctgagggagagaggccctcctgaccttggcaggacctgggttccattggacaagagacgagccatcctgctgggtgaagagaaaggaacagggtggcgcagacgaacccggggaggtggcggagagcttgttctaggagtttagatgcaaagccaggtagcaagaaactcagtgggcaagaccagaaaatgggcgcatgggataagaggcatgggcaggtctcagagtaacatcagagtgtagcgggtttctgttctgaaaccctaaactggaaggtggctcccctgtcacttatgtgacactggtggcatcaggacagtgtgtaaatgttggtgctgcagggacaggacaaagtggacagcctagcaggaaatgagaagcaggccagaggcctgactcactaagacttggagctgtcaggggtggggagtgggagggctgatccaactgaagacatctccagcagatgcccacagtccttcctccctacgtgtggcaacagtacagccttgcatcaccaggcagggatgtttcgaagtactggcgtcctggtgatttttttccccctttgaaacagccttatgtgatttccattagtgcccagggtgcctgaaacctcaggaggtgtcagcactgagcctggagccatgtctgttaatctcaagctttctgtgtagccaaggctggccttaaaatcctgatcctcctatccttgagtgctggggtggcaggtcttccgggaccctttgctcctctgggtttggtttaaaggagagaagcagggacatcactccaggtggaagtgccattcgtgattgttcacagtcactaaccggatggcaccagacacgtctacctacagccactgcaagttccttatagaaggggaaaaaatgatccattctcttaagccaagtcccctcccccatccttccctcactttccctcaggtgcggtgcatgtgtgaatctgggctagggcttgtgtgtgttgcatctgcgagtctgcgtagggtgtgtgtgtgtgtgtgtgtgtgtgcgcgcacgagcatgtgcatgcgcacagcagtgtcaggagtcagaattgggaccctaccccaacccagcacacctcactagcactttttgtagttcagacatctacttccggttctctacacccccttttctcgtccctaaaacttctgcctctctagcagaaggaaggaagtcctctgagaattacaatttaaatagacttggggaggtgggagcctgaggtgggaggggcttccttagacttcccactcataaataatgtgaagcaggccagaacctgggcaccaagttttcaggcttccgtgccaggggacagactgtagatttccattaaatttgccaggggttctgggagccttcaggagtcagcgcgcagcctgcagctgtgcctgtttgaaacactgaaccttctgttagaggggaggcgggaatggaagagggtggagctgagcacagctttgccagagcctcgcccaggagagggcttaggcctctccgctctggctgtccctcccacttttgcctctctctggaaagccctaagtgatggcagctacagagtgaagaccaaggctctgggagtcagagttggaggttcaatcctgcggtacccaactgttctgggggtggctttaagtttcttggaacttggatttcaagaacaaatcaaccagccttggagttcctggctctgactttctgaggatagttggagtgggcttctgtccttttctctgatgggccaactgtgaccctggattttcctcagatgacagctgaggcttcctcctcttcccagcctttgtggccctttcttctcgctcctgtctgtttctctgaggactcttgggggagttattttcccagcagcacttgaagctagaggaacttcagcagtggctacccctgaccaccctgacccctttatatcttatttcctcctttttggggcatctgctctttgcatccctgaagcggtcgtctagtctgaccatctgggctgttcctgtaaatggagctagtctttgtgaactcgaccaggcacagaggtgtgctgtccagattctgtgctccacctgcatgggggtgggtagatggggagcactaacctgtggcagcactggctgggggaaacttcaagtccacactctgatcatatacttcttgttccctagggagagaaggcacaatgaccagctccccgttcctggatccctggccgtccaaggctgtgtttgtccgtgagcgcctgggtcttggcgaacgtcccaatgactcctattgctacaactcagccaaaaacagcactgtgctccaaggggtcacctttggaggcatccccactgtcctgctcttagatgtcagttgctttctggtaagatcccctctcagtgatgtgtttaatcctttgttttctaggaccttctaggaaactcacatgaggtaggtacttacacctgtgcctgctctgtgaccctggacatggggtagatggaccttgagttctggaaccattgtaatggttccttcctcagagggtttggggattgagtagggccctgtgtgtcagtgtgatccagattacatagccactagtgagtcctgtcacgtctcactggccctcggggtgggtggcatgagagctgggaatgggggttatggaccagggttagagcaggtgcaacttctggtgtgtgagtggtggttccttttgccccgggatgcctggggcttttaaaagggaaccagaatagatcctttgagctgaccttagaggacatgtgtctctttccttaatattaactttctgttcacaaagattcttcccatttgaaacgggtgttattatctttgcagggtgactcaacaacatttgagatgtgtgtgtgtgtgtgtgtgtgtgtgtgtgtgtgtgtgtgttagggatagaacccagggccttgtgcatactccacactagtttaggtttattggggttaacatgtactgtttttttttcacaaacacccccagaacagttgctcccttgaccctggcttctaagaacagagaccatggggtagatgggagggtgaagtccacatcctaggtctgcctggagcagggtggctagtttgggtagggaagctaggatggaaggggaccccagtccctgctaggcaggagcacaaagcaagcaggtgaaggagagagcaaatcttccttcttccaatgtccttatataggtctccagcagaaggtgtggcccagattacaggcgtgtgcctctacacctggatctggggcttgctttgtcccagatgtccttgaacgcagagatttccttgtcttagtcttctgggattcatagccactatgcctcaatatctccatgtcaagatccaggtcagaaacttgtatctcccagccaccagattaggatcactggtgagccttctaattctggaccttaggtcattccagatagagtcaagttgacaaccaggaacagccactacaacttcctgattcaccttaagaaaatccccacagaaattcagagcttatggatctcccttaaggaaataacttctgccttcaaaacctattacatctaaggtgtcaggttccaccccagcactaaataaacataggaccaaagcaggcaagcctgtgctatttgagatgtctttccccctttctgtctttcaaaggagcccatgtaagttggggagagaggttaagacccactagagagctggccaaggtggaggtaaagggtccgagggggcaggcgagcgtctcagacatcaggaccctttaataggcagaaatgggtctcactccgcacatgaggttgttgctatcacacaagcctgtttttccatcccagctctctggggttgggctggcctagagcaccagggcggaatggggttcactggatggatgcactctctgtgtggggccctcaaacttgccgttagggggaggttagtgtgaagagttggacacaaaacaaatgaaatgtaatttaaaaaaaaaatcaagccaggtgcacacctgtagtctcagctcccaagagctaaggctggaggatcaccggagctcaggagttggaagcaagcctgggcgacctagtga

SEQ ID NO: 143 - DNA, 1620 bp, Mus musculus
gtaccgtaccattcctccgcagactcaagaccctttcaggacacctcagggacacacacatccaaggctcctcttcccggacagcaccatgccattcctgtggctctgctgggcactctgggcactgtcgctggttagcctcagggaagccctgaccggagagcagatcctgggcagcctgctgcaacagctgcagctcgatcaaccgccagtcctggacaaggctgatgtggaagggatggtcatcccctcgcacgtgaggactcagtatgtggccctgctacaacacagccatgccagccgctcccgaggcaagaggttcagccagaaccttcgagaggtggcaggcaggttcctggtgtcagagacctccactcacctgctagtgttcggaatggagcagcggctgccgcctaacagcgagctggtgcaggctgtgctgcggctgttccaggagcctgtgcccagaacagctctccggaggcaaaagaggctgtccccacacagtgcccgggctcgggtcaccattgaatggctgcgcttccgcgacgacggctccaaccgcactgcccttatcgattctaggctcgtgtccatccacgagagcggctggaaggccttcgacgtgaccgaggccgtgaacttctggcagcagctgagccggccgaggcagccgctgctgctccaggtgtcggtgcagagggagcatctggggccgggaacctggagctcacacaagttggttcgtttcgcggcgcaggggacgccggatggcaaggggcagggcgagccacagctggagctgcacacgctggacctcaaggactatggagctcaaggcaattgtgaccccgaggcaccagtgactgaaggcacccgatgctgtcgccaggagatgtacctggacctgcaggggatgaagtgggccgagaactggatcctagaaccgccagggttcctgacatatgaatgtgtgggcagctgcctgcagctaccggagtccctgaccagcaggtggccatttctggggcctcggcagtgtgtcgcctcagagatgacctccctgcccatgattgtcagcgtgaaggagggaggcaggaccaggcctcaagtggtcagcctgcccaacatgagggtgcagacctgtagctgcgcctcagatggggcgctcatacccaggaggctgcagccataggcgcggggtgtggcttccccaaggatgtgcctttcatgcaaatctgaagtgctcattatactgggagagctggggattctaactccctaatgggcaatccctgtgtgtgctctttgcttcctctgaagtagcctcatccctaaatttttaccttcgaggaatgtgactcgctggcccctggaggcgctctgacccagtggtctctgtccttcatattgttcactgcactgtatgcgaagcacttacatgtatagatactgcaaaccaaggacagaatccccaattgccattgttcccttaatttgtcgctgaatctgggctgagtcccagtcttgactctggacctaagccacaagttgggcaaacatgtccaacctaggcaatactggctttgctagatgtgaataaaatatgctttgttttgt

SEQ ID NO: 144 - protein, 362 aa, Mus musculus
MPFLWLCWALWALSLVSLREALTGEQILGSLLQQLQLDQPPVLDKADVEGMVIPSHVRTQYVLQHSHASRSRGKRFSQNLREVAGRFLVSETSTHLLVFGMEQRLPPNSELVQAVLRLFQEPVPRTALRRQKRLSPHSARARVTIEWLRFRDDGSNRTALIDSRLVSIHESGWKAFDVTEAVNFWQQLSRPRQPLLLQVSVQREHLGPGTWSSHKLVRFAAQGTPDGKGQGEPQLELHTLDLKDYGAQGNCDPEAPVTEGTRCCRQEMYLDLQGMKWAENWIPPGFLTYECVGSCLQLPESLTSRWPFLGPRQCVASEMTSLPMIVSVKEGGRWQVVSLPNMRVQTCSCASDGALIPRRLQP

SEQ ID NO: 145 - DNA, 24810 bp, Homo sapiens
tcctattttctggcccagaaacatttctgtctcttggcaccaccttagagttccttaaacacggactcctgtgtgtcattttttaaaagacggatggaagtcgcaacatttccctgcacttccatctgcccgctcgccctttccctctacttccctgcctctgtctgtcctgccctgtgcccagcaggggacctagggggaggagctaagcagggggctgggacgctgctgagcctgttgctgctccgcctaggcagaagaggccggagcccctggcctgattccacagctctttctttcaggaccacctccccagagtccccccacaaaaaggagcccctcaggccagtgggctgcgtagatgctggtggcaaagcctgttgtcccctgccagccctcttgtctgccattttcaagctacttttgccttctgtgcctctaggtctcccctccccacttctgggtatggaggtagtgtgtggatgccacctcctgactcctccttcttgctgccctgaagaccaacctagcgggcccttcactgtcagccttggagggcagagttcacagcctagtggtgttcagggcttaaggtctttgcaggtcttacacatggacctggtcattctaccttctctagttcagtattcaaaagatcagtgggagcccggggagctcatggtgcatctcctaaggtccaggggctctgctcccagctcctctcattgtggtgggggggttgctctgggaccctctccccttttagcttcttccaactcccagccaaatttgaaagccctcttcccagcagcacagtgttgaaactgcccgtcgagtgggcgttatgggtggacagaagcatccagtcgggatgagcagcccggcctctgtgcaggagcaggttcctgcagatggggtctcctgacccagccttgaccagcctgacttcctgctctgcttctcttccctcaaccagcccttccattcctctctgcctcttggtttcagggaaaagcaaagccatttaaagcgcgtagcaccgtgtacggctggttcagaccttccgtaaatgtttgttaaatggataaaagaatgaagctaaaaagaaaaaaaaaggctgggcgcggtggctcatgcctgtaatcccagcactttgggaggctgaggcgggcaggagttgaggccaggaggcacttgaggccaggagttcaagaccagcctgggcaacatggtgaaaccctgtctctactaaaaatacaaaaaattagcccggcgtggtgactcgcacctataatcccagcttcttgggaggctgaggtacaagaatcgcttgaacttggaggtggaggttgcagtgagccgaaatcgcaccactgcactccagcctacgcaacagagcaagactgtgtctcaaaaaaaaaaaaaaaaaaaaaaaattgccacacgcagtggctcaagtctgtaaccccaacactttcggaggccaaggtgggcggatcacctgaggccatgagtttgagaccttcctggccaacatggtgtaaccccatctctactaaaaatacgaaaaattagccgggcatggtggcacttgcctgtagtcccagctactcgggaggctgaggcaggagaattgcttgaacctgggaggtggaggttgcagtgagccgagattgtgccactgcactccagcctgggtgacagagcgagactccatctcaaaaaaaaaaagaaaagaaaagaaaaaaagaggcacaagtattctgtttattgttttggaggtaaaccctcagaactgaccgctggagtggggaagggtggagtggagattattgcttactgcttttcactgtagactcttctgtgctatttgattttgtaccaagacatgtctttaattacatacaccacacgtgcacacacacatacacccctacccacccaaaaggttctttggaaaactcatcagctcccaccaggaacctctcagggctccaaaaccaagaggcaggccaaatgctgaagggatagcttagcgttgcattgcagaggaagcaaaaagtgtttctaggaggtgtcagggccgcttggtggctggagtgtcacattccctaatgaacatgcaggaagggggtcaaatacgccagtagcttctcacaagtgtggatggcaaaagctcgtttcctctccacgacagctgcagggctgagctgttgatgaaatgctgcaggtttggagaagaggatctaccccagcaggacagggcttatcccggggattcccaaatgactccatattcattattctgaattttgtttacttggcccacctttccaattatctgtcagaatgtgcaaatcctccctccctgcttatcagccacactctggagattagggaacagggtaatgaccctcattatcaataccacagcccccacggatcctcttccctgggctggtgagaacgctccctctgcttcatggacttagtacccacagcctagaagacacgatccgagtctttaacattttccatctagaacagggtgatcctaaagaaaggccaagggaatcctgtgaggtcaggagaactgcatctccgagggaagggaggtggttgaagatgtgtccccaggtgaaatcagggtacaggggaacaatgttcctgcatacacagtgttatcacacacctgggctttggcaagcttagactgtcctggaagtgcatacaagatagagcgctgctttggggaagctgaccaggggttaggtgtcagaataagagagacacttcttaccttcttcactgtctgtatttttttcctttttctttttttttttttttttgagacagggtctcgctctgtcatccagcctagagtgcagtggtacgatcttggctcactgcaacctctgcctcctgggctcaaagtatcctcttgcctcagcctcctgagttgctgggaccacaggtgcatgccactatgcatggccaatttttaaattttttgtagagatggggtctcagtatgttgcccaggctggtctcaatctcctggactcaagcaatcctccagactcaacctcccaaaggtctgggattacaagtgttgagcgatcgcacccagcctgttttttcaactttaaagttgtgtttgttggttaccagtttccttaaagaatactggccttaatctggactaaaatctcatgtctcaaattttccattttaaatttcttagcaaaaaaggtatgatccatctattctctctctctttttctttctttcagcaaatagcatttgagcaccaattattttctgtgcagtatgctcggcataattacaggatggagtaagagggaatccctttgctgagcccgtgctgtatgggagcacctgggcatatctctctatgatgccaggagaaggtgtcatcccactgtgttcatgagggaccaagggccacccggagaaccagcgatgagcaaagcagcgagaggcgggagtggtcagaacaggacgggaggattttcatgaagaaagtgagtgttatgccgaggcttgccagatgagctgtgatttcaaaggtaaagaagagatgaagggcacgcaggcatgggaaaaagaatgagcaaagagatgaccattcagggcctcagaatgctgggggcgaagggcagtggcaagggcaggatgtgggggttggaaagccagggtggaacctggagaagagcttccaggtaaactaaggagaagaaacttctgtgatgcggggagtcatgatagtggcttctgatcaggggcaagataggaacttctctgcataagcatggaaatggcaggctaagtgttcccaggcaggcacaggtcagaatcagcaccttggtctcctgcctcctatgtcaggggtcttgtaggagaaaatttccggaagtactgaagctgtggggaaagatacaaaagggttttttgcaggagagtgaggcagagtgggtggagaagaaacaaaaatttagaggagggtggaaataattacactttgatagatctattgacctacatactgttaccttggagcattaaatgttatgatgctgaggccgagcgcagtggctcacacctataatcccagcattttgggaggccaaggtgggtggatcatttgaggtcaggagtttgagaccagcctggccaacatggtgaaacctcacctctactaaaaatacaaaaattagccgggcgtaattgtgggtgcctgtagtcccaactacttgggaggctgaggcaggagaatcacttgaacccgggtggtggaagttgcagtgagccgagatcgcaccactgcactcctgcctaggcaacagagtgagactctgtctcaaaaaaataaatgaataaataaatgttttaatgctgaatttgcatataacctgattatgttcagggtatttagagagagagaaaagaaacccctctgttcacctgttcttactctcaaatattcagagaaagcccagaaaatacctcaggaaaaaatgtttttctagtttgttcccatttgtgttcttttctctcatcactggcaatcatgaagtggaggaatcatccagaagggccaggttataagtgtaatggaatgacggagttcttctcacctgaattctccggcagcttccttgcctgctattggcccccacctatcctcaccctcccctgcttctcaaacctaatgcgcatagaatctttaacactcagattactggacactgcccccagcaaagtccattcaggaggcctgagttggggtccaggaatctgtatttacacaggtttctcaggtgattctgggcagaaatcactagccccagagactcccccatggaacatccccagacctggtggaaggtgggaggtgctggagcagtgggttgtggaaaagctgtctggggctaagaggaggtgaggaatggggagcccatccccaaagctcaggggcagcttgcctcgtggctccatcatggccaagctgggtgggtgggatggctgggacggataacaccatattagggagacaggagtggtccagggaggacagagcaagcggagaagtttgggttatctgaaggtcatctgggttggaagagactttggtcctaagtgcctcagtcctaacggatatgcacaccaacaaaacagctggcagtgcaaagcatccacatcctcacacagcatccatacaattacacctagagcatctgcaacataacatctccaaagaaaaaaaagtcttcacaacatcttaaaacccctaacaatagaggttcagaaacagtctgcattttttccactttagtaatttttgattgagacagcttggttaagtagtattccctgttcttcaaacaccgtccctcccaccaggacagaagaggctttttttacaatttttcaagcctgacctgaccccacagccagactctccactcagaccctcagaggcccagctccttccactgcatgacaaagggtggctgccctctctcctgacgactaatcagaccattgtaaaaagtttcccaatccacattcaagctcttcttttggctgctagctaattgcccaattattttatttccccaacaaaactcttcaggctgccgggaatccacatttaggacccaggcctgtatcttgggcctcaggagtctgggggatttggcctttgtctgtttgtctgcttctcacgcctccctgccccctgcccagacccgaccctgggttgactgagtccccagcttgcctggggctgacagatgaccctactggcttcagggggtcagggcaggactggaaatagtttgagggcatggaaagaactttggtctgggagtgggaagacctgactttatgggggtattgatcgtggatcatcgactgtgtgtgtttggggaagatgtcatctctctgagcctcattttctcgtttctaaaacccggggggcaggagcatggcctggatagccaatttcagtgctaagctctctctgattctacaaactagcaggtgaaataaagagggtaagtcgcgtctggctggacaaacccctccattggtgctaaatgttccccagctcctccacctaagggaggtcccccaacatcaggaagggatctcagtttcccaatcgtggatcacttgcccaggctaccagcggcccccagggccaccctgagcactacgtcccagacacccatccctgcaggcaggatcggtccttagagaggctggatattgactgtgtagtttcacttcctgttgagggctctgctctagctttggtcctgtgctgaggggccgatgcagaaatatcagcaagacatctgggggaggcagggaatcaagaaggtggggggtccctccagggggaggcagggaatcaagaaggtgtaggggggtccctccactttgctatcttctctggaaatgaggtttcaatttagctggtctgttaccccagatgtagaaggagctcctgaatccctggggacttccagaggttctcagccctgtggtgtttcatagctggaagagaacctcgaatgggcatctgcaggtcagggaagcagcagcagcaggggcctggcctccctcagccctggaacagcaggtccctgctaaaccagaacaggggcctgtgaggtctcattgtgagtgtccagccttagtgagctcccagtgggtctatatgttggggttctggggagggggtagtggcatgcaaggacagcctgggtgtgatatccttggcaccagtgataagccacagggcttcctgtcacccagcagcaagggtagtggactattgcatatttatgaaacaccagcccagaacagcttccagagactgaggcccgcaggtcccggcttgcctgtaaatgtgacacttctgcaccttttggcctgacttaagacccaaatgtttgcatcaagtaagtcctttccctgttaatcacttgcaaagaaaggcaacagcttctcttttgaagaaagctacccttgtcacagagagaacaggaggtcttgtttggaccggacacagtggtgggaatttatatttcacgggatgttccaactatgggagatgagtgccaagatgggatttgaattcctccttgtgaattacacaaatcccacggaaatatagatgggagagaaaaggaaagggaaacagagaagcagctgaggtcatgattctatgaccccaagggtctccttctcccaccccggggtcagctgttaggatttctgtatttcctcttaccttggtttgtggacacatgtgaccaaatccctgttccttcccttcagataccctgagctctagcatctactatctgtatgactttgggctagtcagacagcagttttatgctcagtttcttcatctataaaaaggaaataataacagcaacttcctcctcaagttatggtgagaataaagagttaacaataaatataaaacattcagaacagtgcatggcccacaagcactattagccattgtggttattatttatgcttatctgtagagatggggtcttgctacattgttcaggctggcctcgaactcctggcctcaagtgatcctcctgccttggcctccccgagtgctgagattacaggcgtgagtcacaccacactcagcccattacgtttattatcagtgttattcttatccctcccccttctctgatgctaaacactcccccaacacacacactgctaaaagcccttcagacagcagtatcattctggggtatgctctccccagtgagctagtggactggctcatgccaccagcactcagctggagcccaggtcatttccagacacagaacaagggacagaaacctagaaaacagaggccaaaactgcccagaggcatggcctgtacaaagccacaggtactgggggcagattgaggtgggagccccccatgcctcctcaaacacacactgtagactggctgggttcaaatatgagacttccatatacatatacatatgcatttgcatatatatgtggtggcatgaagtccctgggctttcatccaaaagaaattccaccttcgagcaccagaagattccctcttcctctgcctgaaatgtttgaggacagaagcagggggatgacatggagagacctgtcagtgacacagcattcccacaaaggggccagagtgcccccatttagaaggtgaagggggatgacatggagagacctgtcagtgacacagcattcccacaaaggggccagagtgcccccatttagaaggtgaagggggatgccccttgcccggcagcccccttggcccagggtccttgtcctcctccaccatccttactcatgcgacagaacatgggcaagtgaggctgtggagttttgggaagagcttccccctgcacatcctcaaatcccctatgccagtgccagaaggagatgcctacagagacagaggctccatttagctcccaagcccttcattgaggttggcgagcaggtcacttccccaggcagtggtctgaccttgcatctgcaagatgcacctgaaactgacacctgcctcctaagggctgtgtgaatacacattcagagcttagaacaatgactggcacatgcactcaggaaatgtgtgctattattgttgttgagagttttataaaaagccacgacctggcccggcacggtggctcatgcctgtaatcccagcactctgggaggccaaggcaggcggatcaccaggtcaggggatcgagaccattctggctgacacggtgaaaccccatctctactaaaaatacaaaaaattagccgggcgtggcatgcgcctgtagtcccagctactcgggaggccgaggcaggagaattgcttgaacccaggaggcagaggttgcagtgagcctagatcgcgccactgcactctagcctgggtgacagagtgaggctacgtcaaaaaaaaaaaaaaaatgcaaaaagccacgaccctgtgaatgcagatttcaggcagataataatgatagcaaacccttacagagtgtttacctgtcactagacactgggtgaaacatcctgcatgtattaatgcatttaatcttcacactaaccctatgaagaagaccttatgatcatcaccctctttctgtagatgaggaaactgaggcactgagaagttaactcacttgctagcaggtcaaacagttagcagatggcagttctcatatttgaacgtggccagtctaaaatgtgtgtttgaagagacacaggggggctcccacctcaatctgcccccagtacctgtggctttggacaggccatgcctttgggcagctctggcctctgctttctaagtccctgtcccttgtctgtgtctggaaatgacctgggctccagctgagtgctggtggcatgaaccggccagccagctcactggggagagcacaccccagaataattctgctgtctgaagggaggactcctgtgctgtggtcacgtgactgcaaaggcacttgctgaaattgctgttcctgggactcctaaagacagtagagctgccagatttgtgtcctgaccgtgtctagacagaggatgtcatggggggagggcaaggacggtgcgacaaccctgagggacccctggtgtggggagaggcagggggtgtgcaaggagtgtaggttggagggagatgaccaaggggcttctgtgaatgtggccagaaccagcaggaaggcagaatccttcccgcccttcctttatgatttgcagacctggacccagcccagcctccagaagagacttaaagagatttaagcagctggctagcaggactttgtttttcacagaatagactcactttttcatagaacagggctggggtaaggccaggaaaattcaacaggcactaaaaatattgtcaagctgctgacagcacagccagaggccccaggcctgggtggcatccagacagccctgtcctttctagacagccccctcctccaggctcagggacctgtctggctgtgagctcccaggaggtcccaggggtgtgacctccctccctccctccctccctcttcccttcaccccaggccagcccagggccagctataaagctggcccagcctggctctcagcacacccagctgcctgagaccctccttcaacctccctagaggacagccccactctgcctcctgctcccccagggcagcaccatgtggcccctgtggctctgctgggcactctgggtgctgcccctggctggccccggggcggccctgaccgaggagcagctcctgggcagcctgctgcggcagctgcagctcagcgaggtgcccgtactggacagggccgacatggagaagctggtcatccccgcccacgtgagggcccagtatgtagtcctgctgcggcgcagccacggggaccgctcccgcggaaagaggttcagccagagcttccgaggtgagaccctccctccctgctggccccggtcccatggtcgggggcaggccggttgtgcccactctggaggtgtcgaagggcccctggccttttgggactctgtgggaggctgtgtgagggccacggtccaaggagcagtgaggaggagccgggcctgggtccagggtctccagctgtgcactgaggcccccctccagcccaggggaggtgcaccaggctagacctgctggaaaaaccaagacttcagagaaggggagggtagaggagagaaagtagagctgggggagcaggtgagtgtgtgcctcaaggcacttggtgcagctggactcccagggtatgttttcacactgccactctggtctgagcctgaccttgagtaaatggctttaaaatcctctctccaccatgtgctcatctggaacaggggtatgactatgtcttcgccatctcccagcactgtgaacgtcaaagtgagtccttgtggatagaagcgtgtttggataactgaaaaatacctaagtagactacctgggttatacctggctgtcaggggtgcaactgggcctgaatcctcctgcagcctctcgcctccctagctcctcagtgcccagagctagagccagtgccaggcacctgggtgaggattctgctcccagcatctcagctgaggcaaacttgctagccagggtcccacaggcccccctgcctgctggatggaaattgttactaaacaaggcccagatccaaggaagatttgtaaactgggtttgccccagagatagaacagggccggtgtctcctggcctggctgccagctcagtggccctgccatcctcagagctccgctggagtccggggaggccctgctgaccctgctcttgtccccagaggtggccggcaggttcctggcgtcggaggccagcacacacctgctggtgttcggcatggagcagcggctgccgcccaacagcgagctggtgcaggccgtgctgcggctcttccaggagccggtccccaaggccgcgctgcacaggcacgggcggctgtccccgcgcagcgcccaggcccgggtgaccgtcgagtggctgcgcgtccgcgacgacggctccaaccgcacctccctcatcgactccaggtgggggtcgcgcgggcgcgcagggcaggagtaggaggctgctcggcccggcttgggggcggggacgcagggggcggtgcagggtcctcggggcccgtcccagtccccgccctcaagcggcgctgggtctccgtgtcgtgtgtatcatgtctcaggctggtgtccgtccacgagagcggctggaaggccttcgacgtgaccgaggccgtgaacttctggcagcagctgagccggccccggcagccgctgctgctacaggtgtcggtgcagagggagcatctgggcccgctggcgtccggcgcccacaagctggtccgctttgcctcgcagggggcgccagccgggcttggggagccccagctggagctgcacaccctggacctcagggactatgggtaggtgcaggactgggcagaagggaggcaagcagccactgagtggtccagacccccgtccccaggactgtctgggggaccggatggtggcggtgggctaggggtagggagagcgcggtgcagactgtcccaggatgccagcgattgcccactacatgtcagggtttctaatggcagaaattgtattgttggccaggcgtggtggctcagacctgtaatcctagcactttgggaggccgaggcgggctggatcacaagatcaggagtttgagaccagcctgaccaacatgatgaaaccccgtgtctaccaaaaatacaaaaattagccgggcgtggtggcgcgtgcctgtaatcccagctactcaggaggctgaggcaggagaatcacttgaatccgggaggtgaaggttgcagtgagctgagatcacaccactgcactccatccagcctggaggacagagcgtgattctgtctcaaaaaaaaaaaaaaaaaaaggaaacaaagaaaagaaaagaaaaagaaatattatattattcaggccaggcgcagtggctcatgcctgtaatcccaacactttgggaagctgaggtggaggattgcttaaagccaggagtttgacaccagcctcggccacacagtgaaatcctatccttaaaaaaataaataaaaaaaaaaagttttaaagaaacgacaaaaaaaaaattgtaaggccaagtatggtggctcacgcctgtaatcccagcactttgggagtggaggccagcgggtcacctgaggtcaggaattccagaccagcctggccaacatggtgaaaccccgtctctactaaaaatataaaaattagctgggcgtggtggcgggcgcctgtaatcccagctacttgggaggctgtggcaggagaattgtatgatttattttatttaaaaatatctttgacaatcttcaatggatttttctattgccattgactccatatacacgattgtaatcatctactttcactttacccttctccatgattaaatctttgaaaaatcctagctttagctgttactaggggcgatgagctttcctcctgctttggtgaattctttctcatggacaagttagctctctggagcagatgggggctgtgtagcacagtggttaagaagaggccttggagccggttggcctgggctccatctagctctgccttccactggctgtaggtcctctggcccatcaccgaacacctctgggtgtcagtggcctcaggtggaatggggataatgctggaacctacctgaggatgaaatgcagacatcacctgagataatacatgtgaagtacctagttcattgtctggcctattaggagacctttaattaatagtagctgatttattatttatgtttcagatatgtttattcatcttctcacaaatatccagcttttagaacatagtgagagctggatcataaacctccctcccaggtgcccactaagctgtgccccaggccttctgacttcagccttcccagatgacctctgaccctgctctccttgcccacacagagctcagggcgactgtgaccctgaagcaccaatgaccgagggcacccgctgctgccgccaggagatgtacattgacctgcaggggatgaagtgggccaagaactgggtgctggagcccccgggcttcctggcttacgagtgtgtgggcacctgccagcagcccccggaggccctggccttcaattggccatttctggggccgcgacagtgtatcgcctcggagactgcctcgctgcccatgatcgtcagcatcaaggagggaggcaggaccaggccccaggtggtcagcctgcccaacatgagggtgcagaagtgcagctgtgcctcggatggggcgctcgtgccaaggaggctccagccataggcgcctggtgtatccattgagccctctaactgaacgtgtgcatagaggtggtcttaatgtaggtcttaactttatacttagcaagttactccatcccaatttagtgctcctgtgtgaccttcgccctgtgtccttccatttcctgtctttcccgtccatcacccatcctaagcacttacgtgagtaaataatgcagctcagatgctgagctctagtaggaaatgctggcatgctgattacaagatacagctgagcaatgcacacattttcagctgggagtttctgttctctggcaaattcttcactgagtctggaacaataataccctatgattagaactggggaaacagaactgaattgctgtgttatatgaggaattaaaaccttcaaatctctatttcccccaaatactgacccattctggacttttgtaaacatacctaggcccctgttcccctgagagggtgctaagaggaaggatgaagggcttcaggctgggggcagtggacagggaattgggatacctggattctggttctgacagggccacaagctaggatctctaacaaacgcagaaggctttggctcgtcatttcctcttaaaaaggaggagctgggcttcagctctaagaacttcattgccctggggatcagacagcccctacctacccctgcccactcctctggagactgagccttgcccgtgcatatttaggtcatttcccacactgtcttagagaacttgtcaccagaaaccacatgtatttgcatgttttttgttaatttagctaaagcaattgaatgtagatactcagaagaaataaaaaatgatgtttcactctgtgtctgtttttaatttccaggagcaataatggggaatgagagcaacacaatgatctgaagaaaggacccccaacctctagggcgcaagactataatagttaaatttatatagatgaggctttcatttatgatatttctattttctcacacaactctcattccaaaaatattaaacaatcactcacggatgtctcctctttagtttatgtgttgccaaagcaagcactgcagcctcatttttttttttttgagacagagtgtggctctgtcacccaggctggaatgcagtggcacgatcatggctcaccgcaaactccgcctccctcccaggtttaagcaattctcacgcctcagcctcccgaattacaggcatgtgccaccatgcccagctaatttttttttttttttgagacggagtctcactctgttgcccaggctgtagtgcagtggcatgatctcggttcactgcaacctcctcctcctgggttcaagcaattctcctgcctcaggctccctagtagctgggactataggcgaccaccaccatggccagctaattttttgggttttgttgttgttgttgttgagatgagtctcgcactgtcacctgggcggaagtgcagtggcgtgatctcagctcactgcaacctctgcctcccaggttcaagcgattctcctgcctcagcctcccaagtagctgggattacaggcgcccaccaccacgcccggctaattttttgtatttttagtagagatggggtttccccatgttggccaggctggtctcgaactcctgatctcgtgattcacctgcctcggcctcccaaagtgctgggattacaggtgtgagccaccgtgcccggcccttggtatttttttagtagagactgggtttcaccatgttggcccggctggtttcgaactcctgatttcaggtgatccgaccgccttggcctcccaaaatgctgggattacaggcataagccactgtgcccagcctaatttttgcatcttttagtagagacggggttttgctatttggccaggctggtcttgaactcctgacctcaagtgatccgcccgcctcagtttcccaaagtgctgggattacaggcgtgagccacggtgcccggcctacctcctctttagaaagcactgtaacccctacaatagtggtgatgggcaatgggggttgacaatagtgtggtaagcgagctaacatttcttatcattcactatgaaccagggaactggactaggcattgtcacatgtcacttaattcttgcagctatcccataaggtgggtattattaatcctattttttagatgaagaaacagcctgaggtaatgcgagcatgttgaatctctatcccacagaatgggttataaacttcttcctatgccagtccccaataagctgctctgctgatgacacaggcatcaggttaaaatgtcatttgggagctgtcttatgcaattcccctccatttagctttcccattgagctgggtttccttatgcttgtctatggagaaagttatacagtcatataccgcaaaatgatagttcggtcaatgacagaccacatacacaatggtggtcccataagattacaatggagctgaaaaatccctatggtctagtgacatcatagtcattataatgtcctagcacaacccattactcatgtgtttgtggtgatgctgatataaacacacttactgtgctgtcagttgtataaaaacatagcacatgctaggccgggcatggtggctcacgcctgtaatcctagcactgtgggaggctgaggagggtggatcacctggagtcaggagttcgaggccagcctgaccaatatagtaaaaccccttctctactaaaaaaacagaaactagtcaggcgtggtggcgggtgcctgtagtcccagttactcaggaggatgagacaggagaagaatcacttgaaccctggagacggaggttgcagtgagctgatatcacaccactgcactccagtctgggtaacagagtgagactccatctcaaaaaataaataaaataaagcacagcacatgtaattatatatagtatataatacttgataagtgactgttactgttatgtatttactatactttttattattttagagtactcgttctacttattaaaaaaaaaaagttaactgtaaaacaggctcaggcggttccttcaggaggaatccagaagaaggcattgttatcataagagatgacagctccgtatatgttattgcccctgaagaccttctactgggacaagatgtggaggtggaagacagtgatattgctgatcctgaccctgtgtaggcctaggctactgtgtgtgtttgtgttttattttttaacaaaaaacttaaaaattagaaaaaaaataaactttttaatagaaaaagtttatagaataaggataaaaagaggccaggcgcggtggctcatgcctgtaatcctagcactttgggaggccgaggtggcaaattggctgaactcaggagtttgagaccagccagggcaacatggtgaaaccccaactctactaaaatacaaaaaaattacctgggcatggtggcgcatgcctatagtcccagctactcgggaagctgagacaggagaatcacttggatccgagaggcagaagttgcagtgagccgagatcacaccactggactccagcctgggcaacagagcaggactctgttcccctccaaaaaaataaaagaataaggataaaaagaaaaatattgtataaatctgtacaatatgtttctgttttaattgttattacaaaagagttggccaggtgtggtggctcatgcctgtaatcccagcactttgggaggctgaggtgggcggatcacctgaggtcgcgagttcaagaccagcctgaccaacatggtgaaaccctttctctactaaaaatataaaattagccgggcatggtggtgcatgcctgtaatcccagctactcgggaggctgaggcaggagaatcacttgaacctgggaggcagaggttgcagtgagctgagatcgcaccattgcactccagcctggtgacagagtgagactccgtttccaaaaaaaaaaaagagtcaaaaagtttctttttaatttaacgtttataaaaaagttacagtaagctaaggtcaattattaaagaaagaaaaatttatttttacaaatttagtgtaggctaagtatacagtgttgataaagtctacagtagtgtacagtaatgtcctaagccttcacattcactcattactcactcactgactcacccaaagcaacctccactcctccaagctccattcatggcaagtgccctatagatgttgtgccattttaaaatattttacactatatttctactatatcttctctatgtttaggtatgtttagatacacaaatacttaccattgtgttacgattgcctacagtattcagtacagtaatatgctgcacaggtttgtagcctaggagcaataggctacaccacatagtctaggtgtgtagtaaactccaccgtgtaggtttatgtgagtgcgctccatgatgtttccacagcaatgaaatcgcctaacaatgcatttcttagaacacatccccatcgtttttttttttttttttttttgagttggagtcttgctctgtcacccaggctagagtgcagtggtgtgatctcagctcactgcagactccgcctcccagactcaatcgattctcctgcctcagcctcccaagtagctgggattacaggtacccgccaccgcgctcagctaatttttgtattttttagtagaggcagggtttcaccatcttggccaggctggtctccaactcccgacctcatgatccatctactttggcctcccaaaatgctgggattacaggcatgaaccaccgcaccaggccaatatccccattgttaagtgaggcatggctgtacttcgggataaaggactctctatttcttacctgcaaagctaattaatactaactaaataataagagaaaaataggctgggtgtggtggctcatgcctgtaatcccagcactttgggaggctgaggcgggtagatcgctctaggccaaggagttctagaccagcctggccaacatggtgaaaccccatctctactaaaaatacaaaaattagctgggcatggtggtgcacacctgtgatcctagctactcaggaggctgaggtagagaatcacttgaacctgggaggtggaggttgcagtgagccgagattgtgccactgcactccagcctgggtgacagagccagactctgtctcaaaaaaaaaattaaaatcataacagaagaaaaatagagctaaaaaatgtctaaagagggccaagattttccagttggggtattgtaaataccagggcatatggttgctttgtgtaccagaaggatatcaatatccacctgaagaactctaccagttacacagtgatgtatctgtggctctaaaagatctgtggattcccaggcagtcacatgcaatcagtgacaaagatgggcctgctcacaccaggctgagtgtgagctaaaaaaaaaaaaaaatgtaggagattggcttcatttcaaaatgtaaggcgtgctcattaggatagggagacagtgtggtagacagaacgctctccccaaagacacctgggccctaatccttgcaacctgtgactgttatgttacatagcaaaaaggactctgcagatgtaattaaggttacaaaccttaaaatagggagattatcgtggattatctgagtgtgcccaatctaatcacatgagcccttcaaagcagagaactttctctggctggaggcaggagagatgaggtagaagggagaggtcaaagagatctgaagcatgagaaggacttgccctgccattgctggtctgaagatgagggaagccatgagctagagaatgtgagtggcctctaaaaggtgggctgactcccagctgatagccagcaaggaaaggggacctcagatctacacccacatggaagtcgaattctgccaacacttgaatgagtctgaaggtggatcctcccccagagcctccagataagagcccagattatcagctgacatggggatttgtctttatgagacctggagcagagaaaccagctgaggctactcagactgtttttttgtcttgttttgttttgttttgttttgttttgttttaaagacagggtctcactgccacccagactggagtaaagcacgatcatagctcactgcagcctctatctcccaggctcaagtgatcctcccacctccctctccccaagtagctgggactacaggctcataccaccatactggctaatttttacaatttttgtaaagacaggggtctccctacattgcccagcatggcctcaaactcagactttaaatctacaaaatgtgagataaagttgtttcattttaagcagctaaatttgtgatgaattaatacagcagcaatagaaaattaatacagacagtaagccaaatcccattagaagtaggatgtaattacaattttttttcacttaaaagatgaaataaagggccaggtgcagtggctcaagcctgtaatgccagcgctttgggaggccaaggcaggcagattgcttgagcctgcgagttcaaaaccaaactgtacaacatagtgagaccatccccatcatctatactttaaaaaatacaaaaaattagccaggagtagtggttgtagttccagctacttggcaggcagaagtgggaggagtgtttgagcctgggaagttgaggctgcagtgagctgtgatgatgccactacactttagcctgggtgacacagcaagaacttgtctcaaaaaataaataaataaataaataaataaataacattaaagataatttttaatgtattgcaaaccacccataatcccaccatcctaaaacaaaattattttggtttttgcatatcacctgtttccatgcagcatgagtaaatacttattttaaaaaccaaggttttggctgggcacgatggctcacgcctgtaatcccagcactttgggaggccgaggtgggtggatcacgaggtcaggagatggagaccatcctggctaacatggtgaaactctgtctctactaaaaaaaaaaaaaaacaaaacaacaaaaaaaattagccaggcgtggtggtgggcacctgtagtcccagctactcgggaggctgaggcaggaggatggtgtgaacccgggaggcggagcttgcagtgagctgagatcccgccactgcactccagcctggggcgacagagcgagactctgtctcaaaaaaaaaaaaaaaaaaaaaatcaaggttttggccaggtatggtggctcacgcttgtaatcccagcactttgggaggccaaggtgggtggatcacctgaggtcaggggttcgagaccagcttggccaacacggtgaaaccccgtctctactaaaaatacaaaaattagctgggtgtggtggtgcacacctgtagtcccagctcctcaggaggctggggcaggagaattacttgaacctgggaggcagaggttgcagtgtgctgagattgcaccactgtactccagcctgggtgacaaagctagactccgtctcaaaaaaaaaaaaaagtttttcttatctttcttttttttttaattatactttaagttctagggtacttgtgcacaacgtacaggtttgttacatatgtatacatgtgccatgttggtgtgctgcacccattaagtcatcatttacattaggtatatctcctaatgctatccctcccccctccccctaccccacaacaagccctggtgtgtgatgttccccttcctgtgtccaagtgttctcattgttcaattgccacctatgagtgagaacatgcggtgtttggttttttgttcttgcgatagtttgcttttttttctttcttttctttttctttttttttttgagacagggtctcacccttttgctcaggctggagtgcagtagcaggatcttagctcactgtaacctccacctcccaggctcaagtgatcctgccacctcagcttcctgagtagttgggcctacaggcacgaaccaccacactcggctaattttttatttttattatttatttatttttatttttttattttttggtagagacagggttttgccatgttgcccaggatggtctcaaactcctgagctcaagtgatcctcctgtctcagccttccaaagtgttggaattacaggcatgagccactgcgcccggccaaaatcaagttttaatgtgcttattgcatgggaaaaagaagtgaagagagttattctccaaaagggtcacatttgttctaaatctttgtgtggtggaattgaaaacaatgtttttccatttgttctctttcttttttgttttttcgaggcagagtgtcactctgtcgcccaggctgaagtgcagtggcacgatctcagctcactgtaaccaccgcttcctgggttcaagcgattcttgtgcatccgccaccagagtagctgggagtacaagcgcaggccatgatgcccggctaatttttgtatttttagtagacagggttttgccacgttggctaggctggtttggaactcctgttttcaaatgatcgcctgccttgttctcccaaagtgctgggattacaggaatgagccactgcacccagccttccatttgatctcatttctaatttttctaaaataaacatggattatttatgcaataacaaaaagaatgcaaaaatgcactcaaaaatgcgcctctttggagaggctcctaggacagggaggattgagggccaaggcacttgccatctgtttatctgggagcagcacaggcttctctctcatttcctaggtcatctcagttcttaggagagactggcctgctgtttagagataggagagactggcctgctgtttagagggaggccctgaggccctgatagtgaagaagcagaagtagacagaagtgaagcagtatccattttgtctgagacagctggagagggccatcaggcaggacagaggggagtgaagagggaggaagggtacaaacagcagaacctgactggtggatgagaggatgggagtagaggggtgaaggtgggcagtcctggcagctttgtggacgtgtctgctccgagacagcaaaaggatagtgggtgcccaaggagacaagtgccagcagggactgagcatgtcccatggcaggatggcagtgcaaggctggggtgtcctttagggtggctggatgggaacgaagggcttcccctctcctctcctcaacttcagttcagaggaactccacaggcatcagatgtgactgccttagaaaccaaggcagtggccacagcaccaaggaaatgggacgttagagtcagcaaggtcattaaaagagaataaaatggtcttacctatatttaaaataggtaacaggctgggtgcggtggctcatgcctgtaatcctaacactgggaggccaaggagggaggattgcttgaggtcaagagttcaagatcaacctagactaacatagtgagaccccgtctctattttatatatatattttatatatacatatatttgggtttttttttgttttcttactttgtttttattttttgttgttttcttttctcttttgctcttttttatttccatcttatatttttaaaaaataaaatataatagattttgtatatataaactttaaactttggagatgaaaaaataatagatcaaaactaccacaaaaaagaacagtttgtggtcagtggctcacttgctgccctaagtccaaactgaggggagcaagtgcttttgctactccgtgtcttatgtggccagtcctggctggggatgaagccaacactgggggtcaccaacatggcctcttttttttttttttttttttttttagacagagtctcacactgtcactcagcctggagtgcagtggcacaatcttggctcactgcaatctccacctcccaggttcaagcaattcccctgtctcagcctcctgagtagctgagattataggtgcccgccaccacatccggctaattttttgtatttttagtagagatggggtttcaccatgttggccaggctggtctcgaactcctgacctcaggtggtccattcgcctcagcctcccaaagttctgggattacaggtgtgagccaccgcacccggccatcctttcttaggcttttgcagttctcccatttcaccctggctcccggaagcggaaacgggagatatcaacgcaaggcaaccaggtaagggatgggtgtatgtaaggggtcagaaaggagtgagacacaagtgtcccccacacctcactccaaaacacacattcagcttcagcacaacctcctgtattgcaggtcagatccagagctccccacaacagaccacagccaggaaaagcaaagggccctgcagtgccctggtggactatggggagggtgagtatcctgcagaggagcaggcagcattaggaagttgtgaaggagggtaaacccccaacttcctcactacctgacaaagactcctctacaacaaaagggaggccaaatgcaggcaaacagaaatgagacaaagagaagaggggaagtgctggcagcgcagtgttctagttccattcctgaggtcctgctctctgtaggtgccccttctggtctgtgagctcccctgtgcctctcccaagcgctgtacagaagccccccttttccttcagccagtttggtttctgctgggtttctggtttcagagctttacgctggtaaccattaggctatgctgcaacatggcagctatgggagctcttaaagccccaaaccactggaccttacaaatctcacttctgggagtcatgttaagaaaa

SEQ ID NO: 146 - DNA, 2210 bp, Homo sapiens
ccccaggcctgggtggcatccagacagccctgtcctttctagacagccccctcctccaggctcagggacctgtctggctgtgagctcccaggaggtcccaggggtgtgacctccctccctccctccctccctcttcccttcaccccaggccagcccagggccagctataaagctggcccagcctggctctcagcacacccagctgcctgagaccctccttcaacctccctagaggacagccccactctgcctcctgctcccccagggcagcaccatgtggcccctgtggctctgctgggcactctgggtgctgcccctggctggccccggggcggccctgaccgaggagcagctcctgggcagcctgctgcggcagctgcagctcagcgaggtgcccgtactggacagggccgacatggagaagctggtcatccccgcccacgtgagggcccagtatgtagtcctgctgcggcgcagccacggggaccgctcccgcggaaagaggttcagccagagcttccgagaggtggccggcaggttcctggcgtcggaggccagcacacacctgctggtgttcggcatggagcagcggctgccgcccaacagcgagctggtgcaggccgtgctgcggctcttccaggagccggtccccaaggccgcgctgcacaggcacgggcggctgtccccgcgcagcgcccaggcccgggtgaccgtcgagtggctgcgcgtccgcgacgacggctccaaccgcacctccctcatcgactccaggctggtgtccgtccacgagagcggctggaaggccttcgacgtgaccgaggccgtgaacttctggcagcagctgagccggccccggcagccgctgctgctacaggtgtcggtgcagagggagcatctgggcccgctggcgtccggcgcccacaagctggtccgctttgcctcgcagggggcgccagccgggcttggggagccccagctggagctgcacaccctggacctcagggactatggagctcagggcgactgtgaccctgaagcaccaatgaccgagggcacccgctgctgccgccaggagatgtacattgacctgcaggggatgaagtgggccaagaactgggtgctggagcccccgggcttcctggcttacgagtgtgtgggcacctgccagcagcccccggaggccctggccttcaattggccatttctggggccgcgacagtgtatcgcctcggagactgcctcgctgcccatgatcgtcagcatcaaggagggaggcaggaccaggccccaggtggtcagcctgcccaacatgagggtgcagaagtgcagctgtgcctcggatggggcgctcgtgccaaggaggctccagccataggcgcctggtgtatccattgagccctctaactgaacgtgtgcatagaggtggtcttaatgtaggtcttaactttatacttagcaagttactccatcccaatttagtgctcctgtgtgaccttcgccctgtgtccttccatttcctgtctttcccgtccatcacccatcctaagcacttacgtgagtaaataatgcagctcagatgctgagctctagtaggaaatgctggcatgctgattacaagatacagctgagcaatgcacacattttcagctgggagtttctgttctctggcaaattcttcactgagtctggaacaataataccctatgattagaactggggaaacagaactgaattgctgtgttatatgaggaattaaaaccttcaaatctctatttcccccaaatactgacccattctggacttttgtaaacatacctaggcccctgttcccctgagagggtgctaagaggaaggatgaagggcttcaggctgggggcagtggacagggaattgggatacctggattctggttctgacagggccacaagctaggatctctaacaaacgcagaaggctttggctcgtcatttcctcttaaaaaggaggagctgggcttcagctctaagaacttcattgccctggggatcagacagcccctacctacccctgcccactcctctggagactgagccttgcccgtgcatatttaggtcatttcccacactgtcttagagaacttgtcaccagaaaccacatgtatttgcatgttttttgttaatttagctaaagcaattgaatgtagatactcagaagaaataaaaaatgatgtt

SEQ ID NO: 147 - protein, 362 aa, Homo sapiens
MWPLWLCWALWVLPLAGPGAALTEEQLLGSLLRQLQLSEVPVLDRADMEKLVIPAHVRAQYVVLLRRSHGDRSRGKRFSQSFREVAGRFLASEASTHLLVFGMEQRLPPNSELVQAVLRLFQEPVPKAALHRHGRLSPRSAQARVTVEWLRVRDDGSNRTSLIDSRLVSVHESGWKAFDVTEAVNFWQQLSRPRQPLLLQVSVQREHLGPLASGAHKLVRFASQGAPAGLGEPQLELHTLDLRDYGAQGDCDPEAPMTEGTRCCRQEMYIDLQGMKWAKNWVLEPPGFLAYECVGTCQQPPEAFNWPFLGPRQCIASETASLPMIVSIKEGGRWQVVSLPNMRVQKCSCASDGALVPRRLQP

SEQ ID NO: 148 - DNA, 42360 bp, Mus musculus
aggggaaacctggatagagacttgaggctggaagagaacttacaaagtgttgggaactataagacactagcatagtaaagacaggaataaccaatggagagaggcaagtgggagtctagctccttcaagtcttgtaggctctgttgaagaatatagacttcatattaaaggaaaggaaagtcagtgaagagttttcagcaagaaaatgcaatggttaatcttaattttaaacacactgctctatttgatgagtgtatcaggaatagagaggatagtcctggagaagccaatggagatggagaaacggtgactcaagatgaccctttcctaattctggaaggcaatgcttctctcatgtttcagaacacacttgtgatttagaaagaaaattagaacttttatgatcttcctagtcctaatcaatggtttgccattcaggtcttctggcagtcaatccccacatccatacatttatccttagaaaatgccccctggtttggccctgttgttctatcagtcctgccagctctctctagtttgcatactccatccctggagaaaacacatctgggaaacagctgcctggcaattatcacagaatcatctcctgatccacttgaagctggggtggagaggaggcattgaggactaaagaaaaccatggattttttttcctggtataagataagggtagagtgttggagcagcacttcattgttttggagataggtctccagggtagctgatacatttacaactggccactgtgtcttcctctaattcctaaaaggcccgatgtgtcccacagctgcacaccatctgccaccttctaccactggggaagctacagttggagcttagagacagaaggaagaggggtaagctctctttggctctggcagggttactgtgaggatcagcaatcaaggcttcccataaagtgggcatagagcctggcattctgtacaaccactccctttaaagtaccctggaatttctaaactgcttccctaccaatagttccaatgctagcttccaaactttatctctctatttgttctgcccgttgatctttttctttactccctactccaaatgtaccctgagttcccaacctgggtcatggtgagtctaactgcaaccagtcaagctgacatctaatcctcccagagaaagagaacacagtcctgtccagcagatgatgttatcggccccaccctgggctccaggcttggctcagcccagacatatggatctttttaaagacttatgcaatttggcatccccatttcacactctgcaagccctgctgctttgacactgtatgctgggaatgcacccagagagggagggaatagatctgtgcagtctcttttattctcttttccttgtcatttctcctggcaacttcctgctcaatttggaaaacaaaaagttttcttctcctggctcagactttgcctaagaacaggaaagaacaaaaaaatggagagagaaaagagaaaatgggggggaaagaaagaacatagaactgccttgtgagtattctggtcagtttttcaagagaaaaactgggagcccctcagccaccaacacaatctgtttctcctcctcttcttcaccttccctttatgtggacagacatagatgcaagtctcctcggatcttctggttagtacagtatataacctgagcaccgtctgttacacaacagcctcccccatcactgaatccattctgatcttttgatgagtgaattgagccttgctctgtgttctcagaaagattcttctccttctgtggagacaaaaatatgtctctgaattgcagcccctttccccctgcccatgccagaccccaatctagacacaggaagcttataagtcttgggataagggaaactcttctgctacccctggaagaaagaatgccttttctgcttagactacagcagctgcacagttaagggaggggacctggcactcagctcttactcttccagcatgaatcccttggtggccctagctgagaagtctgcaaaacttgaacccaagggtggggacattttggttgcaaatgctaattgggagtgtccagaactttataggaatttggcaatctctgagccatcctcatactcagcctctaaggtgacctctttgcaggctataggcccaagttagagaggaagaaaagaaagcttcattgcacccttttcttccaaatctgaggatgggctgggcactgtgttgaaatttgatagaggagtcctgtgtgaagtcaggagaacagttggacagatgtttgctttgtagccaagtttaaaacagccagcctagtgcttgggcattcttaatgcactttacatgaaagctcctcctttgagtttgcagacattggctgattggttcctgcccttttcagcctgttgaggtggggaccagatgtagtatagggtgtaagaagagtcagctggagaggattccacttctcttcaataaactgaattgttgtcctaatttaccttgtggacataaaaaagaataatgtttctatattctcttttttctggctaaatgtatgtttattaggtattttctttatttacatttcaaatgtcatcccctttcctggtttcccctccgaaatcatcctatcccctgtcccctccccctgctcaccaacctacccactcctgcttcctggccctgacattcacctacactgggggcactgggcatcgagccttctcaggaccaagggcctctcctcccactgatgacagacaagggcatcttctgctacatactctgctggagccatgggtccctccatgtgaactctttggttggtggtttattccctgggagctctggggttactggttggttcatattcttgctcctcctagagggccacaaaccccttcagttccttgggtactttctctaactcctccattgggaccctgtgctctgttcaatggttgcctgagagcatccacctctgtatttgttaggcactggcaaaggctctcaggagacagctatatcaggatcctgtcagcaagcactttttgtcatccacaataatgtctgggtttggtgactgtatatgggatggatccccaggtggggcagtctatggatggcctttcctttagtctctgcaccacactttttctctgtatctcttcccatgggtattttgttcccccgtctaagaaggatcaaagtatctatactttgatcttccttcttgagcttaatgttgtctgtgaattaattgtatcttgggtattcggaacttctgggctaatatccactcataagtgagtgcataccatgtgtgttcttttgtgattgggttacctcactcaggatgatattttctagttccatccatttgcctaagaatttcataaattcattgtttttaatacctgagtagtgcttcattgtgtaaatgtaccacattttctgtgtccattcctctattgatgggcatctgggttctttccagcttctggctattataaataaggctgctatgaacataatggcatatatgtttttactacatgttggagcatcttctaggtatgtgcccaggagtgctattgctgggtcctcaggtagtagtactatgttcaattttctaaggaactgccaaactgatttccagagtggttgtgccagcttgcaatcccatcagcaatggaggagtgttcctctttctccacattcttgccagcatctgctgtcacctgagtttttgatcttagccattttgagtggtgggaggtagaatctcagggcatttccctgatgactaaagatgatgaacatttctttaggtgcttttcagccattcagtattccacagttgagaattctttgtttctaaacagaaggaacactacccaattccttctatgaagccacaattactctgatacctaaagcacacaaagacccaacaaagaaagagaacttcagaccaattttccttatgaatatcaatgcaaaaacactcaataaaattctcaaaaaccaaatccaagagcacatcaaaatgatcatccatcatgatcaagtaggcttcatcccagggatgcaggaatggttcaacatacagaaatctatcaatgtaatccaccatataaacaaactcaaagaaaaagaccacatggttatttcattagatgctgagaaaacatttgataaaatccaacatcccttcatgataaaagtcttggaaagatcaggaattcaaggcccctacctaaatatagtagaagcaatatacagcaaaccagtagccaacatcaaactaaatggagagaaacttgaagcaatcccactaaaatcagagactagtcaaggctgctcactctctccctacctattccatatagtttctatattcttgaatgaattttttatcttgcagttttcctggcttgattatcccctaaccttaggtaccagaaatctcttcagagcccttggctgtaacagagacacacatactgatttgtggcacttatattaagttagacctgcaccatcccaaagattttccagtttagaagagatttagaaaaaggagcagaggcaatactagcaccccaaaatgctacattcatacaaagcagaaagtctcaaaagctacttcccagaacagaagagaactacccagtttccttcattactaacatttgggcaagctatatccacccttcataagactgtttccacaatgacctgacacactcaaagaaaactagtatagtagtatagctgctattcctttgtaaaagaaaaatacattcgtttattacaattatttgcaaaatagtgaatgcttattgtgaaaaataaatatattatatgtaagatgtaggaataagaaagtgaaaatttcttataactccagcatctagaatgtggtggtttcaatgagaatagacacatgtgtttgaatgcttgattcctagttgatggaactggaaagggttaggaggtgtagcctgttggaggaaatgtatcactgggggtgagctttagttttcaaaggcccgcagcatcactagtgtgttctgtctcctgcttgtgtatccagttgaaaactctccactcttcttttgtttagccttcatggactgcaaccatctgaaactataagcccaattttgggctttcttttataagttaccttggtcatggtgttttgtcacagcaacagaaaagtaaataagacacaaaataatcatatatatcatgtatggcacattatcaccatctacagtgactttttttgcctccttttcaataaaacattttacaatgatatacttttattgcactcgcacaagctcctagcagctatagcaaatagaaacactgcatattgtgggtatgattcctgctcagaggccatctcttctctttaattataagttggttgctttagaggccaaactgatagatggtcttgggcctctgattagatgagagaggatacatggggccttgctttcatggccttttttctgaacatcaattaaacattagtcctgcctttaatgatatctcttccaatgaacagcctcacccatacaagtgtaagagatggtattttaacagcataaaagactttccagctcacttaaagttacttatatataagatatttatatataatatatttattagacacatatataagatatgtttgtataaattatatatttataagaatttgaaaacttttctgttagacatctaaaagactaagaaatgattcaaaaacaaggaattctattatcaaaatacttattatgattgtgtttacaatacccttgcaacattcacaagttagtagtgctaacttagcaggacgatctctgcaaacattaagagaccaaagaaaggaactgagtgaatgccttgcaccacaacctggtacattcaaggaatggccctgaagaaacataaattagaatcccttaagggaaaaccactaactttagcaaagactcaaacaatgattaggcatatctagttcatggaagtagacagattcagttctgcctgaattaatctatataataattttagtcataattcaaaggagtggagcaaactgtggtggtgaagctcatggtcctggcactgagaaggcagaggcaggaaaacctcaaatttgaaggctgcttaggcaacattttaaaaccctgcctcaaagacaaacaaacaaaaataacaaagagagggaaaaagagaggggaggaaaatataaaaatctaagaggacagtttgggagaggatcagataatctattatcaaatatttattatgcactgaataataattatccaaagatatttagggaaattctgaagaaaataaaggaggtgacttgtctgaaaaaaaataggacttactgaaaatgaaattaactaagaggataattcagacagtgtgagacatgtgtattttaaagggcagatgaaccagcatatgaatatagaagataactaaaaagtcatgtcaggccaggaaagaggagattacacagaaaaacaaaagattgggacagggtactctgtatgaataatatttgagcacagatagaatgggttgcctgtcattgagacaaccacaacatcaagataattccccccagaagacactgagcctgagaatgagcaggccaaatgttccagaatttactgtcagtacgtgctagtcagattatagctaaaggaggccctggagggcaggaagagcaaaaaaggaactcacttttagagtgtagattctcacagctcccctccagtacctggcatcaccaccattaaagatctttcttttcatactcggacagtccctgagtgctttcaacaaatttaaaagaatattttgcaacatgggtagtagtgggggagctttagttccaaagtatgaaactgaaaaaatagaaatgaaaaaatgcttcattaatgtccataaaaagtaacaacgtataaactggaattcaactccttaataattttatataaaggcgttagggcttagattataaagacaaaatgacaaatacattttaaacaacagatttattaaaatcttcaatttctactgttcaaatattttttctaaatttcatatattaatctgaaaatttagatcttaatggtatttgagggctctgccttgctgggtaaatgaatctatttaaagattaatgggctatccatgggagtggtctggatccaaactgagtgagcttttgactcatttgtctcaccatgtgattccctctgctatgatgcaacccaaaaggttcccaacagacatagttgatacaggtacttaaactaccaacactctagaaccatgaagcaaagtaaatttctgttcttgtttttaagttttctttttgtttatgggagggggaagtcctttgaaatagggtcttgtatacctcagtcttgactcaaacttgctaatatggctgaaaatgacttctatttcctagtcgtcctgcttctggcattctctattctttataaagtatcaagcctcggatattttgttaaagggaactaagatatttactgtttttcacatcaaaggcattgtatttcacagtctatttttatctgataggaagtgtgttttgcagaggatggggaatgtacaggacactcagtgataagtgtggccatgacctttaagacctcacaaagggtcccactgagcagctcttaatgtgtttcttttacactctctgccttgagtggtatagctataatagctagtgtcttctggaatcagcttaggagatggagtgtgaaagcagggatgttgaggggcagactgggaggactaaaagagaaatgattgctcaattctacctggtctgcgagttgtcagaaggttgaggcaataagtggatttgtatatgtgctgagagaaggtgtgtgagctgtgagtgatgtgtctcagtgactgcgtgctgagggccagtcttccatcatgctttatattctggttgcattatagctctgcagaacagaaaagtacagatttggtttcttcgggggatggatttctaaactccccgccccccccccaactaagatgtctacatttactttccttccctggtgctgaacactgctttgtccttacgcttgtacttaggaggtattctttttctttcatgacctcttgaaagaaatgacagacagcacatattacaagttaagattcttggcactcagccttgattctggttctatatggattttgctttcagaaacttttccatagagtcaatatctttcactctcctcccccacttcaaagctagttaagaagttcaagtacaaaatatttcctatagtcccatttcccatggtccaaaagacaaaagatatttaaagtaatcagaagagagcctaaaacaatggtacatacctatgatcccaccattcaggaagctaggataggattttttttttttgagtccaagaccagatgggactatagagtgagatcctgtctcaaaacactttaattaattaaactaacagagaaaacatctggaagtaaaggtagactcaaatgaaccaactcatttttacatataacaatttacctaccataaaaagtatgagcaaaatgtaggtaccagaagaaaatccacttttgaaactgaagaattaggtgtaatatttccttcttagttcatattccaaggaccagaatttaattttaaaagtacattttgcaatcctttctgaccctacctccaggttctccatcacaatatgccaactgtactttgacacaaactcacttaatgtcgttgtattcaatgagcctctgcctttattatgatgaaaacctccgcttcttgttttaatggtgtgatatgaaacagggtaagagtatagatttgaggactgatactcttcttctcaaccccaaggtatattaggcccagggtaggcaacacaaacaaatgtactttcttcgtggaggtagatcttcagagaaataaatacagaaatttatccagggcgtttgtctgatctttctttctccctttaggttatgtgaccagacattatgggaaaactagggctaagtatttacagtcatcatcacagacccttctgtgccttatctcaatttctacctgctgctatatgccttgtcttgcttctctctcctcctgccttgatcttctgacctgtgacgagtcagaatcctgcaatccagcgcatcaacatgcagcaccattgcgtggagaagcacaaggagtgctagaaggtctgttaggtagggcagggtaagaatctaagaaatcttttgtctgaagggagggcaagaaaagctcccatagaatcaggaaacttaaatctaggattgaaaagggaacattggagaaaaaccatgtactatggagtatctatattatctctatggtattgacaattgctatgacccaactagctaaggaaatatggatgatcacaggaaagttaatacaaattctgttgattttgctggaaaatgagtataaaagagagatggtaggatagcagatggtctggactgtgaaaaggctattagtgtcctgtttgtgtcctgctcaattttaacatgcagcacagattccaccgtgactatctctaaaggtgtcttggaattgtgttgtttcctgcttagctgaaagatcatactcctgtaaactcaggcgtacacagtggcttcctgccacacttaaaacttgaaaataaagaaatcagaaaggagaaatttgaccctgccgagaggcagccaagatgacacacggttaaaagtgaagtaggaactacgagaggggctggcctcaccaagacgcaacagggaggggataagccagcatcccccacccactccggacagggagcaggggaggagagccaatatcccccacccctgcgcagggcggaggagcgcgtcccgcgccgggccgcctcctgcaccgagcgcatctccggagcggtacaggagaatgcaggtccacagggacacgcgcgcggggctcctgctgccatggcgctgggtagctctctgcctgatgagtctgctgcgtgagtattaacagctgagggccaagggaccaggctatgggccgggaggagggaagacgccggccactaacctcacctgggaatcctgcgctccagcacgcagaagtgagcttactcaggtagtgctgggggacgccagctcctctgcgtggctggaggtgcaaagctcaaagttgaggctagaatgcagacagaaggaaggaaaagttctgtaactctccttaattgaggaagcaaggacccagagtggtccagagaagggtccaggcacccattgttcccaggacttggacataaagaattcatgagggtagccatttccagtaagggccaggagacctttaaggaggactgagggacattagtggaagagtctggaataaagaacaggcagagaggaaaaaaaggacaattttaaatttcagattagaaagctagagtcgcccctgcagaaaccatgcagatgctagtagggaggtggtttggtgtacacaccaagtccttctgctcaccagtcttccccgtgcacaaacatacattcattgctagttggaattttcttgctctgcttcccttcagattctaaagctagtggacaggccaagacacctcctgctgcccacgcatactcttacttcttaagttcttcccctcttaggttggcaaaaaatagtattcactcagtctatagcaaactttattgcactggagggtgttgttcttcatcccaactcatgtcctttgaggttttcagggttgtgaattactcattttgcttttaacccttggggctcctaaatcttcattgtatatcttaaaggacactcaacatgtagagtagcctggatctacccacaagacctcttttctcccagtcttctgctccattgcctttgggtctatcccaaagagagctggcagaggagaagttgaattaggttctgggttctcctgattggcagcgctagacatgtccattttgatggagtaaaacttgcttggacaaaaatgcccagaatgatgctacactgtgcacgggtaggtgaccacgggctggagtcctcatcagatgctctgtacttactcttttggtcactcagctcagcactgacccaagtctgggtgtagtgctgtcttttcttatttcctcagctggccagtatcagccttgtcttgggctgaatggggcagggtggagagagcaaaaaaacctctgcaaaccttggggaaatatgctgaagatatcagtgtctcaactttagggtaaaggacagggcaggggccaccattcccaacccagctagacttcataagccggccaaggctctgtactttctccaagaacttcctagggtttgtgttgagattcttctgtttgttaatactattattttctgtcctggaataaattgtaaaataaattaaactgatgaattatgtaatttaaaatgtcccacagtagacaaccgtgatgttattactgggaaagttggtgtagaatggaaagtcactctgaagagatagttctcttctgtcccatgagaagctagtgtgaacatcttctagacagccacaagtgtcactttttcaggggcaagagagatcagtggccagaatctgggttgtgactggggacacacgctccagctgacctaaaagtctttcaggaaactaggaacccctttgcctgggtttccttccacaagacctctttttcccttattccaacactacctccagcttctactcacattccctttcttcctttgggctctttgaatctgatgatctacaactatatcctgcctgggactgcatgtaaaaagggaaaaagaaaatagaaaatactttttatcagatagtttccctgctacatggtaaggagggaggtgtaagagtttggggactgccaagtaattcagtgatttgaaggctccccagtgaaggactagaccaggcttcacaacctttgtaaatgtacttcttcatcttggccagcactcctgcctgtctgatgagcaggcaagagcctaggcctctcttgtatccctttggcttcatcaccttggtcctgtttgtttgagttgcctttactgctttcctttcctgagtgatctttgtctccaaaatctcagagcaaggagtgccaaaattgtagcagataaagttggggacaaaattctggaaaaaaaaaaaaaagcaaaaagggagcagattccactgtttctgatcttgcctggtttcctttgtgttttggacctgaagacctaagcttcctttcagagtttcccagctccaggctccagtacttgggtttccttctctcattgactttggttcatctgacgaaatgtcctataatgtggcaaattaaaaatatgaaggcatggaaaaagaacacaaattcatctctaaaagaaatgttcatagtggccagggcagaatttacatatgatgggtagggagagactttgacatttctaatgataatattttcttcttatgttggttaaaaaataaaaacatagtatctttaaatttgctatcaagtttcctggctgtgctacagggagaatgatgcatgcatcttggggtggggtaggtagggtagggatccaaacaaattggaaggcctggcaaggtactttcctggacctacacttgggatgggcagggaatgaatcatttccctaatgatgcaaaggaaaaggcctcctggcttaactgggaagtctgctgcttcctggagtggaaaataaaagcaagcctcttagaaaagtggttatctctaggtagtttgctccattgcttaagaaaatgtgtaaatggttctttgggtaagaaatctcaaaatgttagacaagttctcaatattcaagggcaggcaggaagcaggctggctaaatgggaagtagagtcttatattggagtgggtcaagagatgaaggcataaggactgcagaatctaaggtaaagacaaaagggtgacgctcttgcagagttggaagctttaaaggagatttcttatagaatagcttcattagcacagtattaactaacatttcaaggtgtgctactgtctcttctggctaccctgaaatttcactccatgctttcaaatctctggtaaaaattgcccacgcatgggaggtttgccagagaaggactcagggagactgaagaaaatggtatttgggtggctgccctacggaaatgattgtagtgaccatggtactaagctgcaagccaggaatgagtggcaccagaaaaatgaaagaaatgcaagtagaagaaatataaacctcctgaggatccacagaaatgaagggatgaagacaagctatttgaatataatggataatctcaatgtagtgtgggtgttcaggctggtttatactgacaactctgccttacctctgaaatgaaggaagtttctgtcaagccctttgttctagttcagcaatggctcgggcttgtggagcataatttgtggtacatagcaggtgtcaagtgactctaataggagttttttgaatgctcactcacctactaatgagctcatcccactaaaaaaagatcaaactgcgtttagttctcttcctgtatcactgcgaaattagcctttttctaacttcttatcattgtcctatttttattatttgatttgccccaagtttcatgaaaatccctaaagacctgtctagtcatccccagtcctaaagagatttgtgcaaatcacagtgatgctaaagcctaaagaagtcaaatgatcccttattttgtgttttcttcagaattttgtaagatcctttgcatgtttgtggtgcttaaggaaaaaaaatgcacaaattatgaaagtgaaattagtctccaaaagggttgtttacaaacttttcttatgaaaggcaagacagaaagcatcccaggcttgggatctggatgtggcttctggtgcatatgactttgtatgactttaatggcacttgaaaatatagatgacatgcttgacagactgaccacacactgtcaaccccagcacagaacttgtcttaagagttatagtttgctaactactgatatggatgagataaaatcaggtcttttgcaatatgacttggattctagactttccctcattatatggagataattggtttatctttatactaatgtaaattaggacaagcaagatggctcagtgggtaaaagtgtttgccatgcaaatttgaggacctgagtttgatccccagaacacaaatggtaggagaaaaatgactgtgaattgtcctatgacctctgtgtgtactgtggtagatccttgtctgcactcatctcatttcctttctccctctctccctccactctctctttgtcacacacattgataataatgaatatttttaaataataataaaacatagagtatcagaatgagactagaatgctgtcgatggtgagtgtgagtagtattgttcatccctgttgtctgtcctagcgctgcagggtctgccaagcattctgaataaaacacgtgtatgttaaaaaaaaatcttgacattcaagaaaatttataacttaagtgaggagaaagacagttaaacctctcctgaggaagcgacttgtgggactttgtgccagatgagtgatagagataagttctgctctgcaaaagcagaaggaagggccctttcataacgatggtcagagaccagacagtctgactactttgtatttccttaccttctttgttcctcagaacaaccaggaggcagggcctactttgatttcattttactggagaagtttaaaagttgtcagttgccttggagcctccaagctagaactcagaaaagaagcacctggaacatctacctacaagacttggcctctttgtctctgggaaggtctgccttcaaattgggtagtgcagtggctcacctctcagggatgtgacttcagcacagatatagtcagaaatgttgtactagtgaggggctggctgaggaggggatcagaaaataagaactaaaactagcctggtgtggtggtgtaccccaggaatctcagcactcaggagtcctaggcagggcaaacaggagtgcaacaccacccttagctaaagtggcttgcataaaatgtcatttagcctgggctacatggcacctctctgaaagaaaaacaaaacaaaacaactacaaaaaaaaaacccaagctctataaagatatatgaaaaaattagaccaagaatgtatggtaaattggtaatttaaataataacttactgaatcttttagaatatgtaacctttttatcaaaactggacaaaactggaatatatatttcatatgtaaatatatataataaaaactggaataaaaaatataaatctccagtttactaatattaagtaaattttttcaaaatgtattacacatgcctttgtttcttcagagtacctacccaaaggactttaactttcatgaagtgtctgtttttcattttgaaatttcagtttcttagttttcagctgttgcttctccctatatgtttctaattttcaactttgactagaatatcaatataaccaggcttatattaatgctgtattacaatgtgaacacagtattaatattgtattaccaaagtaagtacctgtaaggtcagtgtctgaatttcactacaaaaattcttggtgttacatctgttggtgtcctaaaatcctcatttaataacttgcccatagcttgtttcctgtcttgttccaagtttgttaagtgaagattgacaggaagaagttagaaagatgatttaattctgagttaatctatctttcctgaggcatgagagaggggcttttcctcatgtccatgtggaatagaggaaaggtttccttctttgattttcagcatctgaaaggcattcagagagtttaggcttctcttcttccccagagatttggagaaagaaggccagtgttggatggtttaaggtagtggatataggcagaaagagagaacaaaaagacattggtagccttagtagaacctttttaaaaatctattagatttataatctttataatctattagctctgcaaaagagccatagaggctaagtaaggcccagggatgcaccatagaagacctatgctgcagtttgtaagtcaggtgtgactcctgacctaaggcgatggtagtccctcatggtaagctagttcttatatagctcttcatgtaaccttgcttttctgaccctcttctttgttctgttctggtagcctcacaagtgttgctgcttactctaggcttggagctatacatctgtcttgggtcctcttttcatttgcaatctggccaaagagtgggagagatgaggctgctacagctgggagcccatccccaatgggtccatagctagcttggatctggagttgattcactgttctggaacaggcacctctgtctttagaactagcagcgggtctctcttcacatctggaaaagttcaaaattgtttgtctgggtgaaggaggccccttgggggaggggttcaaaagcatgacatcatctcagccaggcctggtttcctttggggttgggccaacctagaccagatgggattcccaggaattgacgtgtttgagtagagcaaggagggtgtgggcagaaagaaggatttcaaagggaaattcaagggatatcttagaatggtaaattgaaaatatgattcctttaattcagtgtctaaatgctaccaccactttcccttataataaattaatgtctagggtcagattggcttctgtatctagactaaataggaatagacatatatcctactgtccacaaaggctttgagatccttaacaactacctagtcagcaagacctacactctttgctgcttgcccaaatgatctatattcttcccctgaccaaaaacttggtgacatagatttttcatttttagaatgaagatagtaatattacttttttccctatttacctgacatataataaaacatgatttctgtggtcaatattaatacagcctgcttgctacttgttgggaagatggcaaagatgggagagggaaccctggctagcacctatggaaaacattcttggccttgggttgactagaagttaaaattctaacttccctctagatgttgatggcaatagcaatcagtctacattgttgaccttgggaaatggaaaaaatacagagttagatttcaatcaggaaactttagagatgcacttcaggtatccttacaaatattattacagttgtcagctatggagtctgagttggtttctgaacaattcacaaagaggcccacatcctcttgtatgcttgaactccacatttgtagttgaggccaacttgtaaactaagcagctcatccccataccgtaaccatacaccttctcagtcattgagaaaactaactttgaatctggaactttaacacttttggatgtcagtcttctgtgatttgtcaggacaagatagaccttggccccagcttgcggtccttcccttcttcctgcccacaactctggccccagtctacttctttcctcttctttctactaatgagtctggccccagcccacttcccttaccttcttccttcacatgactcaggccctcagtgtggaggatcttgcatgtacatataggacactagtatacccatatgctaacccttctcccttcaaacagttactcctggaccttggaagtacacattttggtactgaagttcattcctagaaggatgagccatcacaggttaatgcaggtctgaatgtgagcaaagggccattggagcaaagtgtatgaagacttgtagtctccaaagcgtgatctagaagggagggtcatcttggtttgaccatacaggaagtaaaacaggctttgggacacataagatataaagtcaaggttctccttccaagtctaaagatatatagaagaatgtgcaagggcaatcataaggctattcagagaatgcatagatcaaaaatcattctaatttagtagtttgatttcctgacaattcatgtaaaaatagacaaacaacctacatttaaggattaaactgaggtgtgcatgcttgaaaatgtgtggtttctggcaaagctctctgtcctccctctatgagacagaatgagaaaccagtcccatcaagttaaattctagcttagaacctcctgaaagaaatctccaggttgctcactgcagttgagttcttcatttaaagaaaaggataatgggtttgaaggtcctgaagtttctaaatgagcaagactgagaatgaaaaattatgcaaggggattttcatagagaaattatgaatctagattatttctaaaaattaattgaacttgagcaaaaaagaaaagtgtgtaaaatggagctaggaacttagcctctcacattttcaatccttgttatgtttacataggtaatattttgtatcttggtattttgctaaacacattacaagcaatgacttatatttctgtgttgctacagtttttaattatttgtgacattcctgtgtttataaatgctcagtatatttcattagggaaagcctagtaataggaaactagtttgatgtctaggaatacattattaatgtttctccattatcatgggcaacaaggatgttccagtcagattcacctaaagccatgaagttgaatcaggtgttgttataaggttccaggaaggttgagttctaacttgtccttatttccctgtaacctcttggtttacagatctaaataacttgacttctgctaccacggagacttctacacaaggaatatccccatcagttcctaccaatgagtctgttgaggaaaatatcacatctagcatccctggaagtaccagccactacttgatctatcaggacagcagtaagaccacaccagccatctcaggtaactagaagtagtcaactagtacagcctgttcccccaccacagatgaggtcatataaaccaatgattcaagaaatggtattcttttttttattattagatgttttcttcatttacatttcaaatgctatcccctttcctagtttcccctccgaatatcccctataccctgtcccctccccctgctgcccaacccacccactcctacttcctggccctggcattcccctatactggggcatagaatcttcacaagaccaagggcctctcatcccattgatggccgactaggccatcttctgctacatatgcagctagagacacatgctctgggggtactggttagttcatattgttgttcctcctataatgctgcagaccccttcagttccttgggtactttctctagctccttcactggggaccctgtgttccatccaatagatgactgtgagcatccacttctgtatttgccaggcactggcatagcctcacaggagacagctatatcagggtcctgtcagcaaaatcttgttggtatatgcaatagtgtctgggtttggtggttgtttatgggatggatccctgggtggagcagtccctggatggtcctttcttccgtctcagctccaaactttgcctctgtaactccttccatggatattttgttcccctatctgagaaggaacgaattatccacactttggtcttccttcttcttgagtaagaaatggtattctaaataagttctaaatagctttctctgtgttggaaacatttgtaggccatacatgacaagtgggtccagaataggactgattctcatagtcatgctaagttcagctggtataagtaaggatcagtttggattcaattgatggatgtctctgttctcttctaagtggtggaagatgggtctgggttcaaaccaactaaaagtcttctgtaggataaaattttcagtttcataattagagtgcaccttggctacattctagatcttgcatggacaatctgatacctgcaggtctcatacatctcaggttagctacaaataaggtccaacatatttgtaatgataacatcatgatacaatgttaataaaagggtggacacccctgctatatattatagctatggttctaacagctggcttgaattgagttgggccaggattaagatataaagtaactgtaacctcaccaaattcctgtttctgtgcagaaatctacaaagtgagattgtgtgtttctgagtgcattgtgaagatgcatatatactgttttggtgtattccagagactatggtcaactttacagttacctctgggatcccttcaggctctggaactccacacactttttcacaaccacagacttccccaactggcatactgcctactacttcagacagtatttccacttcagagatgacctggaagtccagcctgccatctataaatgtttctgattattcgcctaataatagcagctttgagatgacatcacccaccgagccatatgcttacacatcatcttctgctccgagtgccattaaggtgggtgagttgggccccaaacagcagattatgcctcactgctcataaaagcatgagatttaggtatcttggagtcaacatggaatatgtattttatattgctagaaaggctagtcaggaggaagatggggaggagagggtgaagtccagtgagaagtctgatctgtgctttaggttttgcactttggggagattcttagagatccttctagctctctaattcttcagaaacaccatttccctttgggaatatttgtatctgtcccctgtctactggggttgcctttcttaaaatatttagggcaaagtatttctcatatatgtaagggcttagtagctgtcccaggccagaatggcagtgaggatgtcatctaatgaattcagaactggacacataagggtggtgagttcagtctgaccttcttggcattttagcctgtggcaatcaccagctttcaatctgacagacagaaattagagcatgtagcctacagacagccatgagggacctagcttttgtttttaaagagatagcagataaatggaaagactcttacgggccaagagaaaaacgggtgtcaacaacagctgcctggctactccgttgtcagtgtgtaattgactgaagagaaaaacaaaacaatttcttcttttgccctttaagcatcactaggggttcccaagataagcaaatggcctcttgcttatggtctagatttgttaacaaaaggcttgattctctcataggagtagtttataagatgggaacaatgtaactacactcctcctacccttatctgaaaatctttagtccagcctttttattttggaatacataatttgatttttgaataaataatgagatatcttgaggataagacccaaaatcaaaacttgtctgtgcttcttatataccataagcacataatttaagggtcatcttatatcatacttttcaataattttatacattcaaaaatctgtagtatatatgccccacttacgtcaccacattagggatcacaaagatttagattttcaaacactttatattctgaattttttgattaagggtgctcaatttttatttcaaatctcactgggcatgtcaacaacaactaaaggcaggacaattatgagttgaggccagcaggggttacattgctacattgtgaattctggtctaccctgatctatagaaaaaaaaaaaaaaaagaagtaactaaataaatcacagaaatctctaggcctctgacaagctttaaatttcctttttcctaatcttttcaagagaataccatgacagaaatgaggtgaggaagaagtgaccagcaaggatacttgcatgttaactttgtttttcttttactatagggagaaatcaaatgctctggaatccgagaagtgaggttggcccagggtatctgcctggaactaagtgaagcatctagttgtgtaagttggccttggtcttcctcccacacaccccaacccctctgaaaccctgaagctaccctgaattggcctcctctgaaaaaggaatctgggacttaacagagtcaggctatttctgatattgggtttcggcagtcagaggccccatctagtgagcaagaagggcaaaaacaatttaaattgtgttgttatttgaagtcagatttaaccttgcttttatgttgagaaattccttgtcattgcccagatatgaaccattcaactaaactgtaactcaaaagacttacatgtaactctttagtgcacactgaatttatttttgtgtttatattaagtttgtatatgatctggtacttcagaggtattttatttgtccattttaatctgctgtgttttcatattacagtgcttttaatatccaacaagccagatctttcctaattagaccacagaaggatgattcacaactctttttttaaaaaaatcttaaaaagtcacacaaatttgaataagaacttgtctgaaatccttgagttttttctagtcttattttgtatcttttatcatttttttaatttaaaatgtttccctatttattcccactcttcttcaacatattttttttcttttgggtaggaatggaacccaagaccttgtacatactaggcaaatgttttgctgctgaggtatatccccaacattgtttactataagtttgatggattttaaacaaggatatcctaacatatatttgctatcatgtagatattagaaaattattggagtctaatatttatctttagtttctgtctttcttgaatctgttaattctaggagcttcttggttggttctttttcatttttaaagtgaactaccaaggtatctactatgatgtgttatttttctcattttttttaaaacaatagtgattcttattttatttccttgtcagactgcattggttagaatgtacatggcatggtgtgaattttgtgtgttacagtaaatcctgtttcctgacagtaactaggccctggagaaagaatggatgtgaaagaaaaagtgctgttttcttttacagtaaaatattttcttacaaattgggaatgcagtgaagggaaacttgtagctaacagctggctgcatggtttagacagactttaggctgtagggaacatgccttatttattttggctactcaaataactggtttcttacctacagctatcaggtgggtacctctgacttacaaatctttttaaactacatattaaaaggatcctttaacttaagagcatttaaaagtgacagaaatcatagatacaagtttttagaataactcagtgcagttttcaaaaacatttagggtaaacataaataggcaaagtacaagcaacagttaatgtgtgcctgatgccaatttttaaccttactgattaaagctaaagacaaaataatcccatcagtttttattttgcctatcttaatggagtattctttcatgtgtgtgtgtgtgtgtgtgtgtgtgtgtgtgtgtgtgtgtgtatgtatgtgtgtgtgtgtttgtgtgtgtgtgtgtgtgtgtgtgtgttattacatagatctgtgccagaatgctagttctttgtgctcagtatttcctatccttctgctgttctcaggatcacatattgtcatcatctaagataagtgcttctctggaaagaactgttctttctacctgtggtctatgcagtcagtctgctccattcctgaccagagaaaactctgtgtgttcctttgagattggtggaggatctaggattagggtctggatggagcagccccatccaacctccacctgagccaataacaggacttccacacttcacaaggtctaccactaccgagcacatgtgaagcattgtcattctctggagttcccatcactccagagggatgttctcatcccatttcttccccagagctcttcatcccaaggcccaagcagacctcctgggggaatttttctctggatccagaatttctagccatggatcccaatgtttcaagattcccttcttagtcctgctagtctaatagtctattgcaaagggtacagtgcctcctagctgccataggtagtgtgtctgcttgctgtcagggggcttttaagtactggctttcctagtgcagaggttctcaacatgtgggtcatgacccctttgggggtcaaaggatgctttcatgggggttgcctgagaccattggaaaacacagatatttacattagggttcagaacagtagcaaaattacagttatgaagtagtaacaaaataattttatgattgggggttaccaaaacatgagggactgtgctaaaggaccacagcattgagaagattaagaaccactatactagttggagactcaggccctacccacaccccaaattaggaacataaaggatttggtttttccctatgaacacatcctgcagaactcatttgatactgatacctaactagtacaagtttcaacataactgtgtatgtggtcctcagccttcccagcccccattttgcaagatgcatgatgagcaacaaggtgctagctctccctgtgtagaccatttagatcttttagtataaacattcagttacagtgactccccactaactctcctgttctgcatcctttgcttctgagcatcttatacatgctaaggaatagaatgttttcaagcatgttgcctaatctcaaagtccttgttagtagagcatcatgtctccccaggtcttatttccattctttccacttcactatctgcttaatttagtgtttgtgatcaagattctcaagatcctttctaaaatataagattactttattttcttatatcgtagtcataggtacaggggaattcaccaacatttttaattgtagtaaaatacccacaacatgaaaagtactaccattacaatttctcattaaaactgagtaatttgaacatcaacactacatataccttgaagccagtctctctggaactctgtgtatcttcctatgacatggttccctactccccaggcaactactgctctcctgtctatctccatgaacttggttattctaggtactgatatgagatcataacacagattacttctggattaagtctgaataatattcagttatgtatgtgtacttcattctgtccatctactcattcattagtagacacttgtttttttccatttgttggctattgtgaataaagtggctatgaatacatatggacatgttttatggcaccctaatataaactttgaggtaaataccaagctgtataatttctaaacgatatggtaaatctattttagaggaactactatatttttggttttttttttgaattcttggagattgaatccaggtctttgtatatactaagcaagttctctgtactgtgtactctagtccatcttactgttttttttaatagtggctgtactatttgatatttctcccaaccttacagaagggctctgactcctctggatccttgttagcacctgctctcctctactctctgttttaaacacacagtcaacctaatggatgtgaatagttatctcgttatggttgagtttacatttcctggtgcttagtgacattgaaaatcttttcctgtgctccttggcatttgtatctctggagaaatatcaaatcaagttctttgttacaagaataatttttggaactactgtatctatttagtgccctgtctattatatttactatttgtatccatacaactcacaaagatgaaactgtttgggtagtttgattactttttcaaagttcatatctagtcagaacacattggctcacttatacagtataccaacttcctctgaggtaggctatttccaacctctgatcacacatagcttctgctttccttgccctctaccaaacactaaaggtcagtttctgtacaaaattcatctgttatagatggaggaagaccatctgttggaaagaaatatttggagacaatttaatgtctcctgcttagtcattacccacttgttgtctaacttataacaacaacctcttaattatttcagtctcctcaatgaagatatgggttttgcctgcgctgccaaatttaatacagcaaaatatataaaattactttgaaataggtggctgcagggtgtcttaggtagggtttcttattgtcatgataaacaccatgaccaaaagcaacttgaggagaaaagggttgaaattcaaggcatatgatgcagaatccatggaggagtgctgcttactggtttgcttgctcctggcttgcttagcctgctttcttacacaatccaggaccaccacatcccccgaagtggtactatccacaattggttggggtatccatatcaatcactagttaagaaaatgcactacaaacttggatacagaaaaatcctatagggtcatcttttcaattgagggtccctctttccaaataatttttaacttgtgtcaagttgataacaaacaaacctaatcagaacacaataggggacaattgatcctagaaatttagcattgttaaatatctcaaagatcctttataaatatttatctcctcctcctcagtatttgatgtgcttctttactgtggtaagagacattgcagaatttgagaatgcccctctagaaagattagtaatattctttttttttttttttagaaagtaacatgtgtacacagatgtagttagatacttttaactgtgattctcacaaacaaaatggtgattctgtggcttcttcctgcccactctctcatgtgttcgccctcagtgtctcttgggggaggatgtttatcctaagcaaccggagaagcattgtgttttgttcaggatccacctgctcctctccagagcaaacacaattcatcagggctggcagatcccagagtgggaggctggtcactgttattgccttgaatttaatccaacaaactaaccttacagtggaaggactccagggagaggccaaccagttggggtgttaggctcaacaacaagtttttgagttcttctgtttattttatacaataagaagtatggtattgcttcaaaatgacataacttgcaccatcaccctcaatatataggcactcaggagccttacagtttagtcagagagaaatggcaacagtgaggcagaagatggtcacagtttgcacccctaagcattacattgagaactatgattattagtaataatagtacttgttattgtttagtaccaatcagaatccttgtatattaaatgttttatacattactgtagtagtcacacacagtttagagatgagtatccaggacagactagttgctgatgacttgaaaagattctagaaaatgagagggcaggcattaatatctaatttgccaaagagaggactggcttcttggaggacaagggacttgagttgagtcttgcaggacatggagcaaaacagagatggtagggtcttttcatcttattttagctgtagtggggctaggcagactgtcacacaccagacttgcttccatgccctcccatatacccccccggggggggggggacagctttacctaagcacactgaattatttctgctaacacaatttggtatgtttttgccctcttttgcaaagttcagttctttcttatatttttcttaaggtaactagtctttatgcctcagtttcttcatctgtaaaataaaaagaataaaagaattatagttctcactttcttgactagtgaggacttataaataaataaagatgtgaaaggtacctgagattaagcattagacatagtaactgacatttattttaactgccatatatctatatatatagacaagatcatgtaaaattcatagcttctcttaccatccaccttatcctcacataaagacagacaaatacacaacaaacacacaacacacacatatacattttctgacagtgcatgatagcaagccattatcggggtttgagaaatgttaaaatggatttatattgtcaaagtacagcttcttagcactggagaatggcagaaggttccattttatttagattttgtttagattctgtgggagacctgccccttgtcttatcagaaagcaaacatttaaaccgaagactcataaagaaccctgagtcactgcctgaagtcttcctcctaacctgaagagcatggtgttagggaaggtgctttgcccaagtggagagcttataaggccagtcacatcctcactcacacccagttattttcctactgctctctgtgatccctgagggcctaaggccaatcttgactttgtcaggtacagacacaaagaaggttttccttcctcagacctcaacaaaaggaaaatacccaggctcccttccaactgtaaagacctttggactctactatggacagcagacctgcctccagacaggaagccttctccagaaggctcaggtctgatgatggttataacctccagcagttttcccctaacaggaatgctgtcagatctatgaagcattttctcctttgacatctgccatcaaaactggagaatgtcttggtttgggttgtgtgagggaagccattttgatgacaggctctacagtaagttctgggcaatgggagagcccattctgaaggatatagtcagggtctccaacttttgagacttagttgctaaaaatgctgggggcttatctcctgagctcttgagtcctgtagaacaatcagcaacctgaaggaagacctggaaatttcattaaattggtttctatgctttccttttttaaaatttttttattaggtattttcttcatttacatcaatggaaacactatgtcattgtgatagtcttggaacagtaaaaaggaagaagcttccccgagattgtgtattgtatcggctcattggctttctccactactcacctttgttggctttttactatcatttagcgctggtgtaacaatgaagcaaattttgttattaattagcattaaatagtcattattgcattaatttggtgttagtggtgattctgaattcagtttgagcagcatgcatacacaggaaattattgaataaggaaatatttcctgattgtatgttcacatcttatttttttcttactgtgttattgcacataagtcagcattgatgttttacattggaattctagcaagaaggatttcttgtggagggcataataatgtgtcctgaatcggaattattaccagagactctagatgagattcagggttactagtaatttcacctcttggtttcttttcttttcttttttcttttttcttttctgtcttcccaggaggagtttaagaaggaaaagggagaagatctaattcaaatactgtgtgaaaaggaggaggctgaggctgatgctggtgctagtgtctgctccctgcttctagcccagtctgaggttaggcctgagtgtttgctgatggtcttggccaatagcacaggtaaggtccactagggggctttgggttgaataggactaaaattaaatggggctcatgttagaagatcctggttggagctcctatagcctcagcttaagaaaccacaggtgctgggaagaaaggacttgctgaaaagaaccactctgaataaaagagtttctaggacaacatggaaggatagctcaagatgagctggactggcttctagatttaacaacccctgtttctaattctagaacttcccagcaaactccagcttatggaaaagcaccaatctgacttgagaaaggtatgttcacaagatcatgtaccttatggagagcactggattagcagaggaaatggtggccttcaggcatccccttccttctttccatcctctgatagtcttcaacagggagttccatcaagggatacggagtggtctggacttctcactagaagtccttttccacaagtgacatgctactgtgtatttgtcttttccttaagctggggatccaaagcttcaataaacaagatatcgggagccaccagagctattcccgaaagactcttattgcattggtcacctctggagttctgctggccatcttgggcaccactggttatttcctgatgaaccgtcgcagttggagccctacaggagaaaggctggtcagttttggggtacaggggcaagcaaatgggaaaaataatgaacttctgggggaggcccatagatgttatgaaagggagaaggagaaatatcataaaagatacttttgacatagggatatgcatgcaggaagatattgtacttacaaaagagtagggacatcatgcagcaaatctgtagaagggtaaactggggcaagctcatctgctagtcaatgtcacagttgatgatttatgacatctactcactttatcccagatagttcagctgaataagagagaataggctgttagattggacatgcttacttgtaaacatattgaatgccccatgggtgccattttgctcacaaacatgggacatatggaagggaaatctactcttaaagtgttctggatagagggaggggaaaagctgaaggttgactcttgccaatggctggtatctactgggggggctcttctgccccgagactggtttcttatggggttggttactgagccacattgacatggtgtggtgcctctcctctgtcctttctcctctaggagctggaaccttgatggctgttgggaagaaaagaggctgcacatgtagctgtacctgctctgccccccccccactcctacttcctttgtgctctcctcacagtacctcacaaccctgcttaccagataatgctactttatttctatactgtccagggtgaagacccttattacacggagaatggtggaggccagggctatagctcaggacctggggcctcccctgagactcagggaaaggccaatgtgacccgaggggctcaggagaacgggaccggccaggccacttccagaaacggccattcagcaagacaacatgtggtggctgacacagaactgtgatttggttgggtgggcaactgggtggtatgcaggaaagtggcatctcttgtctctgacttcatgctgccttcagctcatgtccggccttctcctattacatacacttctgaaactgttcctgggactcttcaccttggggaaggcagataaactgccttctgcacattcaacttcctgaatccaatctctgacctttgggtcaagttgtggtgggaagaagcctaggtctagaggagctgccaaaaaagttggtggctatgtagcacttgccctggacccatttctcctctctcgcctcttcacgggaactctccggaagactagcttttctaagctaccacttcttcccaggaaactttgctatttttactgcttcttcccctactttatggaaaccaaggtattcactgacatgtgctcccttgcaagggtacagccagaaaagtgctattttaaaatacatccttaaaaaatgcatcccttataacttcaagacactgtggatttagtcaccaacttctatcttgttcacctgttcctgaatgtctgtctacagaggccaggacaactttctgtctggagtctgctcaatgttttagagcaacagctcaatctgatcccttgggcccacacagaaatctcattggttcaacctagacaggacagtggaattagactttgaactgagcctctgttttttgttttattttattgctggggtttgaacccagagcttcacacagcttctttaggcttccaagtagcttgagctaccaggcccagctgagctaaacctcctgacctgagctcttcaaaggaatactcttgctctgaggcccttggccttctctaaattacgtgacttcccccttcctctgactcctgggggagctgtggcctcagtcccctggcagattcctttcagtctgtgcctttcctagtccaaaccccttcactattttataaccctttgtgatcagaggttcagaatatctacaaagactataagcttcctctcctggggttaaggggagaacaggggtcctgattttaatgatggctaggaacaaaactttccagagatgagaggattgggtgtattctcttctgaataaacgtgatgagtgaaaatgatgtaattaaattgatgatgaaatatttgatgtggccctataatgctgactgtgctaactgaccgactggtttccatatcaggcttgggaagattgtatggcagtatgggggaagtcaaccaaggagaagactgccataggagagggacacaggtaccagccagggcacccagaacttgtaactttatgaaaagttcctttccatgttgagaggcagagaggttgaaagctttccatagtagggagaagggcaggctgaaatgttctttcaaaggggtgaggcatgttaggtattcagaaacatctttctgagaagataggcatataagcagctgcatgcaaaatatacaaatgagggggtaaaggattcatattatctgagcatcctctaacccagctcatagcacaaccaggcaggactatgtgagctctattctgtatctggctaccaatcccagattacagcagccacatataagcacttgctcacaccagattctaggtgatctgccctcatgccacaagaagtggaaaggggcgatgctggactttcagaggcctctagaaacacccctaagtgcatagggagtcagaggttaaacaaaaatgtattccttaagtcttatcttgtcaaaatcagacacatcttcaacctatttatttctagtttttgtctaactttgctaatggaaacttctccctaggattagggaaactaagggacaaggctcgaccttgcccaaaatgtggtgactgtttgggggatcagagaaaggcaagatggtgactgaacataaaagtctagttagcttccatttggtaacatgttttacaatgaatgaccagttaagggtctggccctggttagtggtgtctggaagtaataggttcagggaatagagtctttggaaacattagagggaggagaaacagcacctgggcctcaggatcattttactctgagcttttgagggtaaaggcttaggggaaaggtacgtgtatgttctggggatagatgagtagtgtccatgatagcttagaagcttactctaaaggcctcatttgcttccttaaaacatcctttcccatccggcctaaaaatcatgatgcagcaatggcaccacctgctggccctgctgggctcccactgttcagcctcagtactggtatcttgtgtttgctgggtttctttcttgtgtcagcctacccttaacaatctagtcctgtttaccacattattaacacacacacgcacatgctcacacgcatagcagggtaacaatggaaaggactttaacgatacatttagttccactccttgtgtacagcaaacccacaccaaagatttaggaaggatgccctgagcatgaggcttcttctcatctttgcttcccgtgcttctgcagaggcttctgggttcttttaattgggtatcttgatgccagtggcatgtttcagagtgagtttagaactacatttttgcatcatttcaccactgtatactgtgcaggactcaaaagcctagcaggtcctgagcctagaacaaaaatcctgggaagatctgaggctctacattcattatgactgtgcaaatggactcttgccagatttacatataaacagatatatgacagtgtccttcaagtctggacaagtatactaccctctttttatctcttctaaacaaatcaaacttatgtccctttgccaaggcataagttcagggataggctaacaacatttttgcaataggatgttactcatttccttataaacctactcatagcccaagggttttctattgcaatttagccattcaacaagtctttatcaagggcattgtgtggctgctgctctaaaggcaggataaagcaggctttcaaagagctctagaagaggagaaagacagcaaaatattttagcttagtaaaaatacacaaacatcttcaggtaatattcagaactatgataagcttcctcttcaatatgttccaagaccccttggtagagatggaaaccttagtactgaggcctgcagacaatcactgtgatattttaagagttgacctgataaccatgatggctaccaaggaacagaacactatttgagggattttatttacaagattggcatgtaggcatgtctatatggtttttctgaattgttgatcattgtaggcagttctgtgaagtataagaaagatagcaggatatgaacctgagaacaggggagtggggaacattctcccacaatctctactccagtttttgcctccaggttcctgtcttgagtccttgccctaattagccttgataagtcaggtaacctcttttctctccaagttgagtttggtcagtgtttgatcgtatcaacagagacaaaactaggacagcaatgaacatttcttttcatagctcgttgtagaactttttgtaggagcttccataatttggctagccattttagacaccactggcaaacaaattgatgaaattgatttacatatgacgttagtattcaataagcaaaagactgtctgctttgtcttccctgagcatggcttaccaaagatgaacaccacacaatgtaattcagggatagcagcaccagcagatgaagtaatcagggcagtcattcagcagagatggactatggcattgtaagggtctcagacacaaaactatagaccaacagttattctaaactttaactcattggaatgtcattggccttggtgaatcaattcactgtcctctgagctcacacagaaggatttcctaagttacacttagtccatgaatagaactgcttggacctgcttgagctgctttgtggtcaacctatgagtctttggagtcagacaagctacagttggataatctgatattagctatgtgaccttgtattacatttcaaatcctcttcactctgtttccccatttgtgaaaaaaaggggaaaataatatataaaaagttgttatgccacaaatgacagccccatgttttcaatagggtgggacagaatctcagaagtaattagctcattggtcaaagaaacctctttagtaacatttgtttaaagaaagcagaagagagactggagagatggttcagtggctaagaaagctcattgttcttgtagagaatggaggctctgctcctaatatccacaacagatggcttacaatgacttgtaactccagttctaggggatctgctgtctgctgctttctggactctgcaggcatcagcataagacatggtatatatgaattcatataggtgcacacaaacacattaaatctttaagaggatgagcagtgaagatttttttctgacctcagactgaaaatagcctagagtggagactttgttcaaaagctaaatttctttgcataataatctactgttttcaggaagatatgggaggcactagagacatggctgagaatattagagagatggaaacatggttgcagcagggcacttggtgcagaacaactgggaaggacatgggagcataaatagaggactttaagtgtggctgcattggtgaacctgtaagtattctgctgcattgtgcctactgtcagtaaaagtctttgtgccaaatgcctgtgttctggggaagaagaagaaagaagaagaggaggaggaggaagaggaggaggaggaggaggaaggggaaggggagggagggggagggggagggggaggcagccagtatcttccagaagcaatttgaggagcatgagttcagctggcccaggcattcctaagggtacatgaatatgtgagcccttggaggtcttgggagaacacacagttctcagataattttgtatgaggggctcaggcttttgaaacaaacaagccatgatttaaggaggctgataaaaatcaggttacataggattaaatgaaagaatgtacaagaagcaattagctcagaacctagaccttgattgataagcactcaagcaaaggcccttattattttgatttattattcatttcctcttattttcacccctttgagcttcaaggcttcataatctactcataaattatgttactcatttattctactagcatccatcaaattatcttcccatgaagtgggtatatttaatagctactgagggcttagtatgtactaagtacttgacacaacttacttcattggatcctcagatcaaccttagagaataacaaatggattcccacttgttacatgattctttcttgaaaagacttgaataaacctcactagatatgagagtaaaaaggagaggggaaaaaaaaaaagaaaaccctgcatctttatttctcgggggtcagaaatgggatgatgttatctttatcccgctgattagagttgccgagcttcttggaacaaattttatcttcaaaattaggctatctaatttcttcttgtttcatctttgtatatgactacttaacaatccaagaccaacagcaaccaacaaccaaccaacaacccacaactcccaccccttagggcgctagcatttatataccctctgaaaagttcccagaattccaaatgtcacacaattgcagaaactatctgcagctggcaaaatcacacacacatgagagcacaaggcaaatcaaagtcagctgcacacgggattaaatgaagaacataatatttctgtgtttttcaaagaaaccaaaattccaaaattctcactacataagggtagctgaattttcagttcctacaaatagtgtgaaaacctgtgacatcagggtcctagcacatctgtcaaagctgcctgtcagctgatttcattctttcatattgcctgagcacactacagcaaggagaaagagaaagaaagaagatgtgatagctttaagttgccaatagttagaagttgactactttaccctaatgcagcacgacagcaatgaataaattaatcactgaagggtggggaatgactttcctataatcagttattaaaggcttgtatccctaattactctattagttagaacttttctctcccttccacatattatcagcttgacagagcagagaaaacctagccttcagggcagaaaataggagaaaaaagatgcagcagatacaaacacctgtgcttctgtatgttttaaagcacagttcttagtgcctggggcaaatccacctgctacaaggaaaggaagatttatcaaaaaccaaagggctgttgtctttgttgaacagaaaaggggaaaaatgttttaatctttaaagaaaaaaatctactataatgatataatactataatcacaagaagacctgtgaagggcagttccactggaaaaaatatatatacacacacacaattacgtatgcaaattgatccctgtggtggcagtgagggctcctcactacccaccccactgttttgagttcccaaatgaaatacacacacacacacacatacacacacacacacactcagcctttatattttgacgtgcctgaaatagctcaatggctggtttacctcctaacctctacgtggctaatccacctccctccaatattcccaagattactaaaatctgtatttcatctttgctgccccagaaccagtctggcagccctcttggggccacactggctcctaatggtggctaagctctctgccctgcaccttctcaggccagcttctcctctcctccaccttctcccagcttcgggggaactttccttctctctcctttgatccattgccctggaatcctaaatgttccatgtctctcttccctgcccagccattggctgccggcaactttatttaccaatcaaaaccaactaagggcatggtccctcagtgtcataatacaagcagcattagaccaaacctcactacagatgtgtgtgtgtgtgtgtgtgagagagagagagagagagagagagagatcttactaacacaatttctgtcctgcatatttatagtaactttgatgatttcattgatgttttcaaagttgtttctatcattctttcccagttgtctctgggaattcccaaaaagaagcttcaaatgagccctgataccaactatagtcaatcatgaaaactactttgctcttcttttcttcttcttctgttgcgtccaactcaaccagcaaggaaaatgcaaccaccggttcttcttaatgcactttactcaggcagcttctctcttcaaatcccccgcacctcggggtacaagcgatttttatccactcaagccacaaccatgcctcaaccaatcaccacaagtcacatcacctcaccaggcaggcttgctcagccaatcagggattaagggtgagccatccaccaaatatgggcttgtttactgcctggcacagatttctgtctgggctggccagggagtcaggaatggcttcccacaattcccccttttatattcttttgaagcaagctccttgggtgaagatagaggtctgatccccagtgtgcagaaataggggccatgtacaggattgactcttaggctcaggttgttacccagagcaatcctgacttgctcccgtgccgttttttcttgggggaaggacactaggacactcaaccttcatgcaatcagacatacctcccagagattgtcaaacagcttccagactaacctctgtgcagtgcttagccttacaaccctgcagagtgatggcttcattgttcattcttcatggcaacaagccaaatctgaggtgactgccctgcttccactgtgacaaaagcttgcaccaccatggcggcagtgcggacctgggcattctgcaaccgacacatacaccatacacacaacatgcatgccaaaacaagggccacagcgagggcacctatcccagcccattctttcccgatgccaagccaggatccactcaggtagaattcacagtgacaatcgccgagtgaagctcattcatcttgacatcaaaatttgcagtccaatttaaacaccgacagtatcccccatctgggttccgcacccatcaggggcagacacatgctcatcaccagcaagatcagcttcttcattttgacagcgtcgcactagctgctccggaacccacactggctctgcgcgattctgtggaaacatgcaaacagaccctctcgcccaggccaatacgggatccagaccattccatgatcctgtaaccacatccttccatttagcataccccagtttactggggctggtattagcatgtaattcagcagcagagcgaccttccttatccaattgcaaaaaatttaaggtaaaagagctaaggagagtcttatctttggggtatggccatagcctattccccctttttgttttattaataattcttttaaagttctttgtgctcgttcaatgattccttggccttgaggattatatggcaggtcatgtttaacttgtactttcatctgttgacaaaaagacaccagggttttggcagtatatgcaggaccattgtctgttttaagttgttggggcttaccccaagctgcccaggcctccaaacaatgctgtataacattggaggccttttcccctgccatgggagatgcataaactattcctgaacatgtatcaatggatacatgaacgtatttcaatttgccaaattctgaaaaatgtgtcacatccatctgccatacctgtagagggagcaatcctctaggattcactccataagaaggtgggtgttgaaactcaaggtgacgtccacaggtagtgacttcatcccgagcttgtgctctagagattccaaattttctctgcagagttttagcattaacatgaaatttagaatgaaattgtgaggctaactccataggggatgctaaaaatatgaactccatacgagtacaattatccacaatatcatttcccctacttaagggtactggaagcccactatgggcacggacatgtccaatatataatggttggtgtctttcccacagcaacttctgtaattgtaaggccaaggcttagatggtactacgagcttttatttggccagccacttttagggataaaactaaattaactacatattgtgaatctgaaattagattaaaaggaaaatcacagtccttaatgatctcaataactatttgtaattccaccatctgtggagtacagggataatactgcctgaccacaggatctttcccccctaccatatatactccacatccggtttttgatccatcagtaaacacgttaactgcatccttaatgggtgttttcctcaccacttgagggaaaatgactgaatgatcctttaaaaaggtcattaacggatgtttgggataatgattatcaaatgggccctcattaatacaggctaaaatagcccactcatcaatattggctgttaggaccttttgctgatacccatcataagggattacaatggagctgggttttataccaaaaaattgtaaacaatgctgaattcccaacaaggctaaagaagccactgttgtagggtaatgatctaatgtcctctcagcggatattttggaatggatccataacaatgggccttcttgtcacaataatcctgtgggttgcatctcagtaggtaatattatcaaaatgatgggtaacccttctctacaatgctgaagctgggctttaatcaattcttcttccactagggcaagggcctttctagcctcaggtgttaattcccttttggaacttaactctgagtctccttctaaaatttgaaacagaggttttaatttaacatttgggatcttcaaatagggccgaatccaattgatatcgcctaataatttctgaaaatcatttaaagtatgcaaggaatcaaccctcaattgtatcttttgaggccaaacggccgtaggagcgaaccttgctcctaaataggacactatttttaacaaatccctaccccataaggtaatgggtagctcaaacacatatggttgaaacattcccatcatgcccttccttatctttccaagggagcatcctggcacttatgtctgggctctttgcatagcccaggtcttgtaatatttgttctgactcctgaatcgaccatccttttggccagtccttaaaccaaaaggcagtaagaaaaattacccaaatggctagaaaaagaaagtaatccatagactgtccctattaccctcttactttcattaccctcttacttccactttctcgtctccagacccggagagctttattgtctcttaccgagagccttattgtctctttaccgagagccttattatctctttaccatatggtgagttacttaccgtacttatcctgttgacagaccctgactgcagaaagttctgaacctcttcggtgggggagtcgggtcccgggtttcagcaccacttgttgcgtccaactcaaccagcaaggaaaatgcaacttcttaatgcagttaaaactgttcttcttaatgtagtttactcaggcagcttctctcttcaaatcccccgcgcctcggggtacaagcgtttttatccactcaagccacaaccatgcctcaaccaatcaccacaagtcacatcacctcaccaggcaggcttgctcagccaatcagggattaagggcgagccatccaccaaatatgggcttgtttactgcctggcacagatttctatctgggctggccagggagtcaggaatggcttcccacattctttttctttctttttctttttctttttctttttctttttctttttctttttctttttctttttctttttcttttcctctttctttttcttcttcttcttcttcttcttcttcttcttcttcttcttcttcttcttcttcttcttcttctcctcctcctcctcctcctcctcctcctcctcctcctcctcgtcccccttcttcttcttctccttcttcttctgtcttggtactcactggttgtggcttcctacccactaaggtc

SEQ ID NO: 149 - DNA, 2242 bp, Mus musculus
gcgcagggcggaggagcgcgtcccgcgccgggccgcctcctgcaccgagcgcatctccggagcggtacaggagaatgcaggtccacagggacacgcgcgcggggctcctgctgccatggcgctgggtagctctctgcctgatgagtctgctgcatctaaataacttgacttctgctaccacggagacttctacacaaggaatatccccatcagttcctaccaatgagtctgttgaggaaaatatcacatctagcatccctggaagtaccagccactacttgatctatcaggacagcagtaagaccacaccagccatctcagacagtatttccacttcagagatgacctggaagtccagcctgccatctataaatgtttctgattattcgcctaataatagcagctttgagatgacatcacccaccgagccatatgcttacacatcatcttctgctccgagtgccattaagggagaaatcaaatgctctggaatccgagaagtgaggttggcccagggtatctgcctggaactaagtgaagcatctagttgtgaggagtttaagaaggaaaagggagaagatctaattcaaatactgtgtgaaaaggaggaggctgaggctgatgctggtgctagtgtctgctccctgcttctagcccagtctgaggttaggcctgagtgtttgctgatggtcttggccaatagcacagaacttcccagcaaactccagcttatggaaaagcaccaatctgacttgagaaagctggggatccaaagcttcaataaacaagatatcgggagccaccagagctattcccgaaagactcttattgcattggtcacctctggagttctgctggccatcttgggcaccactggttatttcctgatgaaccgtcgcagttggagccctacaggagaaaggctgggtgaagacccttattacacggagaatggtggaggccagggctatagctcaggacctggggcctcccctgagactcagggaaaggccaatgtgacccgaggggctcaggagaacgggaccggccaggccacttccagaaacggccattcagcaagacaacatgtggtggctgacacagaactgtgatttggttgggtgggcaactgggtggtatgcaggaaagtggcatctcttgtctctgacttcatgctgccttcagctcatgtccggccttctcctattacatacacttctgaaactgttcctgggactcttcaccttggggaaggcagataaactgccttctgcacattcaacttcctgaatccaatctctgacctttgggtcaagttgtggtgggaagaagcctaggtctagaggagctgccaaaaaagttggtggctatgtagcacttgccctggacccatttctcctctctcgcctcttcacgggaactctccggaagactagcttttctaagctaccacttcttcccaggaaactttgctatttttactgcttcttcccctactttatggaaaccaaggtattcactgacatgtgctcccttgcaagggtacagccagaaaagtgctattttaaaatacatccttaaaaaatgcatcccttataacttcaagacactgtggatttagtcaccaacttctatcttgttcacctgttcctgaatgtctgtctacagaggccaggacaactttctgtctggagtctgctcaatgttttagagcaacagctcaatctgatcccttgggcccacacagaaatctcattggttcaacctagacaggacagtggaattagactttgaactgagcctctgttttttgttttattttattgctggggtttgaacccagagcttcacacagcttctttaggcttccaagtagcttgagctaccaggcccagctgagctaaacctcctgacctgagctcttcaaaggaatactcttgctctgaggcccttggccttctctaaattacgtgacttcccccttcctctgactcctgggggagctgtggcctcagtcccctggcagattcctttcagtctgtgcctttcctagtccaaaccccttcactattttataaccctttgtgatcagaggttcagaatatctacaaagactataagcttcctctcctggggttaaggggagaacaggggtcctgattttaatgatggctaggaacaaaactttccagagatgagaggattgggtgtattctcttctgaataaacgtgatgagtgaaa

SEQ ID NO: 150 - protein, 341 aa, Mus musculus
MQVHRDTRAGLLLPWRWVCLMSLLHLNNLTSATTETSTQGISPSVPTNESVEENITSSIPGSTSHYLIYQDSSKTTPAISDSISTSEMTWKSSLPSINVSDYSPNNSSFEMTSPTEPYAYTSSSAPSAIKGEIKCSGIREVRLAQGICLELSEASSCEEFKKEKGEDLIQILCEKEEAEADAGASVCSLLLAQSEVRPECLLMVLANSTELPSKLQLMEKHQSDLRKLGIQSFNKQDIGSHQSYSRKTLIALVTSGVLLAILGTTGYFLMNRRSWSPTGERLGEDPYYTENGGGQGYSSGPGDETQGKANVTRGAQENGTGQATSRNGHSARQHVVADTEL

SEQ ID NO: 151 - DNA, 47096 bp, Homo sapiens
tcatctctagattacttataatacctaatgcaatgcaaatgctatgtaaatagatattatattgtatagttttgggaatgataacaagaaaaaagtatgcacatgtttaatacagatgcgattttggggggaatatttttagaatccacaaatgcagaacccagagaaacggagggccaactgtgcttttctttacctgctgtgtgaagaatggacaggagcaactcaagaatggtcctagggagaccagagtagaggccactgatattccaggtgagaagtggtaggttcaagaccttcctagagaagataattttctacttgttgagaaaacacacacatacatgctaaatgaatcaggtcatctggcaaatgtagtaaagtcatatgtttggacacagagttttggaaaggagagctgagaacattccaggaccttcccaatccctctctagctccaatcttttaccctggggtcatcagctggtcgctgggcttgttccccataggttaatacatcctcagaggaatttccaaggccctgtccctaatatccccaaccaatcctcccaaagctctccagtttggatatgaccatttctgcagaatgcacacatctgggaagcagctgcctggccactctcacaaaatcatctccctgtaattcagttaaagctggagtagagaggaggcatgggggactaaggaaaaatgtgaagtctgcccaagatgggatctgggtagatgtcaggggtaccacccctgatctttgtagacaggcctccagggtagccactgggatttcaactggcctctgtgtcttcctctgatccccgcaagaccagatgtgtcccacagctgtacaccatctgctaccctctaccccagaggaagctatagtttagagcttgaagaagtggcggggaagacagtgagctctcccttgtctatagagagttaattgtgggaataaagagtctagacttcccatgaagtgggcaaatggtttggcattcatctgcacagtggctccccaaaaatgtcctggcatgggaaaaaatttcaaagaaaactcaatgtcccagggtttttaaactcccttcctactcaatgtttcacagactctagcttacaaacttcatctttcctatttgctctgctctgtgctcctcttctttcctcccttccccaaacaccgacaccccgaattcccaatctgggtcatcaaaagcctaacagcatctattcaagctgacatctaatcctccccagaggaagagaactgcactcccatccagcagatgatgttattggccccctccctgagctcagaggcttggtagagcccagacatatggatctttttagagacttatgcaatttggcaaccctgtttcacaccctccaagccctgctgctcagacactgctctgcagagagtacacccagagagggagggagtggatccctacatgctcttttactcttattctttccttgtcatttctcctggcaactctctactcaatttggaaaaaaaaagtaaagtgttcttctcctagccaaatctttgactgaaaacaggaaagagaaaaaaaatcaaataaaaagaaaaagaggaagagaaaatgggaaaaagaacacagaactgcaccatgaatattctgatcagttctccaagacaaagactgagaaccacctgagccaacaacacactgtcttgcttctcctcttctccatctgctgtctatgtgaatagacatagattccagtctatatggagctcctggctttgtgcagtgcacaacctgagcactatctgctgcaaccctacctcctccaacacttaattcatcctgagcctctgatgggtgaatttgaccttgctctatgtgctcagaatgatgtatagtgcttctactgaggcaaaaacatctctgacgcttggtaggctcacacttgcccctttgtcacctcagtcagacacacaggtgactggcgtgtctttgaaaaataaggaactttcttgctgcttatggaagaaagaatggcttctctgctcaaggaccaacagccagaactgccaaggaaattttgtagactccccagtcaggagtcaccagaggtctggtgctagaagtataagaccttctaaggtcccaagacctaatttccaaattgagaccttagcaccgagaccttagaatgtcttactctcctagtactagacctctgatggctcctggctggagagtctgcaaaatctgaaccttaaagggtggggccattttggatgaagatgttaaactaggaggggtccataaaattcacaggaattaggttgtccttgagccatgcccccatgctctgcctctgaggtggtctcttccaggccataggcccaactcaaaagcctagaagtgggagaaatgtgacgtagggaagctttgcctttttctttcggacccaggcctggaccaacaccttattttatttttgatggcttcatgatagatgggacctctgtataaagctcaagagaatagtttgggacagatgtttcctttccagccacattttcctgcctcaagttaaaaatagccatcctctttgctttggcttccgtaagatgtatgccattaaagctctctatttgggtttacagagacaaaggctgttaagtccctggctttcacagcctgttgggccgtgaactgatgcaatattgggttcgggaagatccagccccttgagacagattcctggacactttagtgaaaaaagattgctttcctatacctacctttaggtagcaccagaaagagaatttccaagtggggaaggacctttcgcaaagtagttctatttttgttttcctgaataaatccttcattatggagttttcttgaatcaatgacaacatcacccccagggtaacctgaaccccctttgatatctggctttaatggaggtataaatgctgtcggtagtattcatgagcaatgttgagttaggcctacaccatcaggaagattgactgaaagcttagctactacagagggaaatgagcagagacaataccagaattacagacacaaatccacaaacaatggatttctgagctgttctcagggagctgcttcccagggtgtaaggaatctttacttaagtctcccttatcgctgacatattcgccctttggccaagctgtttcccctgtcacctgacagctcctgtggacagctcaggacctgacaaatccgaagaaaataactacggtaatgcataattgccacatcttctccttttcacagaaatatagctttatgtatttttgtttgtaaaagtagcacatgtttattgtgaaaaacaaatgtatgtgttgcatactggagtgaggacgaaactgaaaattacccacacttccaacactgagacaaatcattatgtgtgtatatgagacatgtattaccactgacactgactttttacctctgccacaacaaaatagcgtcatactgtgacatgcttttcttccccacttatatgtcagatcaccaggtctttttttttttttttttttttttgagacagagtctcactttgtcagccaggctggagtgtagaggcgcgaccttggctcactgcaacctccgcctcctgggttccagcgattctcctgcctcagcctcccaagtagctgggaatacaggcgcgtaccaccacgcccagctaatttttgtaatttttagtagagacgaggttttgccatgttggccaggctggttttgaactcctgacctcgggtaatccacccacctcggcctcccaacgtgctgggattataggcatgaaccaccgctcttggcttcaggtcactaggtcttaatagctgtagcaatgacagaaaagctgtggactctgtagtagtctagctgaaacaccacatctttctcactcactcacaaggttgtcccttaggaggcaaaactgggacggcagccctagaattatgcttggaggggagggggacacaaggcattgcattttactgctctgttctgaacatcattacatttttgcttttgctaacatcccaaggggtctatgaaacacaccaacagattatcttgggcgccttgcactggttgatcagtccaagctcactcccttctaagaaacagctccacccgctcaagcgcaagagaagggcgttttcacaacataagaatcacctccaacccattggaagtaacatataagtatatttaacatatgtatatatacatgtaagtaatttgaaaacttttataatttaagtatctgtaataaattaagacaaattattcacaaagaagtaatagcacaaattaaaaagggaacacactctagataaagtacagattaacaagcaaataggaattttatcaacaacaatttgaaaggtttgataaatactcagtttcctaggaaaataacaaaatgtactcaagaagaaatttttttaaatctgagaattcaacaattacaaaaatgcaagcagtattgttaaataatcccacattaaatactaggcccaaatgattttacaggcaagttcccacaaatcttaaaaggaagtgatcatcccagtctcataaaaaacttttcttgagaatagaaaaaaagggaaatactctccaactcattttatatggactctgtaaccccaataccaaaaccagactatgacaagaagaaaaggaaaaattacagggctgtttcatttatgactatagaagcaaaaatcataaatagaagattgtattagtaaattaaattctacagtgtataaaaaagataatacactgacaaagtttggtttaactcaagaaggcaaagttgatttaatgttagaaaatctacaaatgtaattcaccatactaccatattaaaagagaaaaaccatatgtaattttaataggtatagataaggcatttgaaaaaaatcatcattagttcattattaaagaaaaaaatcttttagtcaattaggaatagaagagaataaccttaaaatgataaaaagcacatataggccagttgcagcaactcattcctataataccagcactttaagaagccaaggtgggaggatcacatgaggccaggagttcgagaccagcctggacaatatagcaagcccctgtctctaagataaaataataatttaaaaatgataactaaataaataaaaagcacatttaaaaaattaagcaaatgtggaaacattagaagcttacacttcaaaatctggaatgaggtgaggatgtgcatgatcaccactcctttctatccttagatgttcttgccagtatattaacttaagtaaaacaaatcagttgcagaaggattgggaaggaaacataaaattgtcactatttgcttgtgatatgatcatttacatataaaacccaaaataatctagaaatacttcaatctaataagataagttaataaggtagctcaataaaagattaatataaaacaataaattgcaatttcatacaccagcaacaaaaataattaaaaagaagataatatttgccatagtcttagaggacataaattacctaggaataaatctaacaatgaattaaatgaatttatcacttaacaataatgaatgaattaaaaccattacagggaaaattataaactttaatgaagactcaaacaatggagatatataccaagttctctgaaggaaagattccgttctccccaggttgatctatggaggaattttgatcaaaatccaaaaggctgttttggaaggaaatctgataagcatttataaaattgtatattattattattatttggaagaacaaagagccaagaatagtcagggcatttctgaagacaatttgggagaggaaaacttgccctacagatgtctgaacttatttaatgctacagtaaataaggcaatggcgaaggcacttggggtgtccatactgaccaatgctagagagcctagagccagacccacatacgtatgaaatgtggaacacgacagaaatggcatgtcaggtcagaagggaaagaagagactactcagtaaatgcaactaggaaaatggttagctgtatgaaaaatacataaaactggttttctgctagttatttattttgtctccctcagccccaacctcactcctctgtacttttctctataatactggctacaatgtgtgtttgctctgttacatgagaatattcagtttcatacagaggacaagaaaagcaggtgggtgaaactcatcagatgtattaactatagatacaaagtaagcaagtcatttgtgagacataggcagaattcagaagatgtgctaaaaatgcaggatggagtatcccttatccgggatactttttggattttggaatacttgcattacacttatatgttgagcaccccattccagaaatctgaaatccaaaatgcctcaatgagcatttcctttgagtgccatgtcagtactcgaaaagtttcagaatttggagcatttcaaatttcagacttgggattctcaatctatagtaagttagtaacctgcaagacatgtaaaacagaataaatggaatagactacaaaaggatggaacaaacaagagtgctacttacaggcagaaaaggataggaaaaaacaaatcataagccatgaggtatagattatgccaccttctggctggtgtccatgtcatccctaaattgactacctactggtggcaccttctggccccccataagctctacccaagaaatactggcaaaaagtatggcttcccagaacactgacaaagacctgtggccaagcctacctacccttaaacatctctcaatagaatgagtataccttggttctaagcatcttcctcatattgatccccttactcaatctcagttctggtcctcataactataccactgcagagcgaaacacatgactgaggctgtgagactgtgcaggacttttgccctgcttgcattcccaagtgtatcaaccttgtgtaaatctgtccccttggttctggctctatgctttaaatagattccataacccttgtgatttgatcatcataatttggtctgagtcttcctgatctgtggcctctggaatagcctgcctatcatggaggcaaacattgcatcatggtgacttaccacaggacactggttcccagactcccttgtcagctgatttcttgttaggttctgccaagaggaggcactggagggagactagaaggtggaaagaggaaaaaagggacttgcaggttgtcactgcatcagtccagcatctgaacacttctaccgctaaggatccctgccaaactgaaaaaaaaaaaaaaaaaaagtttgcaatgtgggaaaaaagtcttggttccaaaatataaaattggaaaatcaaaattcacaaatttttcattaaatgcctacaaaaatgtcaactcaacttgtaaactgcaattcaactctttcatagtttcatgtaaatataataaagtttgaattataagaacaaaatgaatatattttaaaattcagaattataacaaccattttccttacttttttaacatcagacatatttgacataggatgaggtcctcttttaggttgattgacatgatgcgtgtgtattttggggaggggtgaggtaagggatgtttaatagtaaaagtggttgtgacctccaagggtctgtaaagggcctgagacagcctctgactcagtgtatttctgttgtatcctccattttgtgcggtgtagctaacatcttctagcaacagcttatgaagcaggagagcagagaattgaggagcagcccagaaaggctagaactttgaagagactacatagctcaactctacctggcctgtgaggaaatgtaaggctggggtccctgggtacccttgtgtccagtggccagaacgtgtgtttgggggtggcttgggcaagggtgtgtgtgcttggggtgatgagtctcagtgaccctggaaaatatgaagagtggccaatcactgtctagctttgtagttctggggctatccataacctttgcaagccagagaagaaacagctctggtctctcagaggaagggatttgccagcctcccatatcccctacttctatttttcctccctgaagcctgacatccacttcgcccttgctccttgtacccagcaagtgttctttctataccagggcttcttgaacctcagtgtgcatgagtcatggagaatacttactcaaagtacagattctggccctcacccttgattctgtgtagaccatgctttgagaaaactctgctccacagaatcattctctctctctttgctcccaaagctagttaagaagttcaggtactaaagaaagacaagttatttcccctgtttcccgtggtccagctatgggagacaaatggtatttaaagtaaccagaaaaaaaaaatctggaaatggaagttaaagtggaccaaattagctttcatatctagcagggattacaaccccacatttgttctcaactgcacactggatgcctgaagcagacccagcggtccctggagctgaggaagttgaggggagtggggggcctggcagtgttggaactaactccttttccctgttaattgggagtcccaaggaccaatgactgattttaaaatgcatgtttgccactccttctgtccccaggcccttgccatcactatgtgatcagttctgaatcatcatttgtactttgaaacagattcataccattccgttgtattcaatcaaattagcatatcaggcctttgctcttattgtgtgatgaaagactttgttccctgtttaaaggaatgctaggcaacaagaccagaataaggagattttgggtttgtttttagacctggatccttctcctgtgcaaccccaacgcatagtaggtttgagatggactataaaggtaaagctacttttataatgctagagtgtctgcggagaaatcagaaaggaccacagagtgctggtctggcttctcttttttccctttaggctatgtggtacagacatcatggaagagcctgaactgagtatttataatttcatgattctgctctggatatcagagcagcctctcccaggttataccttatctgatcctcccctggtgccatcatctgcccaggctggcttctcctttctcccgtctctacgtccccaagactaggctgcctacccggctcagagtttcttctattcagtacaaccaacacccagaggaactggtgaggaacaggaagctcaaggatctatcaagtggtggaggatggagtcacagaaagtcctttttctgatgggagagcaaggtgaaatccctagtggcttagacccagggctggagaggggataactggggagaaggcatccagggaagtcctttttctttaggatgatggtgatggggaactaaatggggaaatatggaaggtcacaggaaaagttaacacaagttagcaaaaagttaacataacacaaaaaggtcttgcaggaaaaaaaaaagaaaagaaaagaaagaaaaagtctccaagaatggtttggacagccaaaatgaatacttatagtcacgtatacctgctcactcctgacgcttcactcacacacagcacaggatctggtgaggctatcactaaatgtgccacattgtggttaagttttacctgattaacgaaatgctcacacttctaaactgaggtccttacagtagattccttttgcaagattgttactggcttacaacttaaaaataaaggaaaatcacaaggaaagaaaagtggggaaaaaatcggaggaaacttgcccctgccctggccaccggcaaggctgccacaaaggggttaaaagttaagtggaagtggagcttgaagaagtgggatggggcctctccagaaagctgaacgaggcatctggagcccgaacaaacctccaccttttttggcctcgacggcggcaacccagcctccctcctaacgccctccgcctttgggaccaaccaggggagctcaagttagtagcagccaaggagaggcgctgccttgccaagactaaaaagggaggggagaagagaggaaaaaagcaagaatcccccacccctctcccgggcggagggggcgggaagagcgcgtcctggccaagccgagtagtgtcttccactcggtgcgtctctctaggagccgcgcgggaaggatgctggtccgcaggggcgcgcgcgcagggcccaggatgccgcggggctggaccgcgctttgcttgctgagtttgctgcgtgagtaccgcccgcgcgccgcggccgcttggcttcgccgcggggagggtggaggctttctgggaggctgaacagcagagcagagtctcacggagggaagggacccctgcccaacccacgcactgccgcccacagctgcttccccccggggccagcgcctcacctgggagctgacgggggtgggaggggaagggaaggccatcacccccgcgagtgtgcgttagccgaggtgtgaatcggtcagcacgactggttccaatggactgagataaagcgctttggagatgccagggtctcttctggttgccagaggcgcggagtgcgaagttgcagccagaaccgggagactggggaggagagaagcaggaaaagttttgtggctcttggttgattcagaaagtatagacacggagcggattgctgggaaggggccggtgtgcccaccttgcacagggactgggagagccagaagtggacattaaggaattcgagggaagcgaatcagggatgaggctccaggtcccaggccaggggtgttcggaatgaacagtccgtgaaaaggaaaaacaaaaccaaacaaccaaccaaacaaaaaccttgcatttaagattgggaagctgagtttgaattcccacttcagcaaccccaccgcggaggaggtagaagtagacagaatttgctctgcgcccagcctcgctcgccttaccaaaaaccgtcacccctgcacaaatttcaaaacttgtcaccttttggagttttcttcctctgcccctgctccaagttctaaagctagtggatgggttagaacactgcccccactcacctacacatatccttactcttaaggtcttgctctcacttcggttaaaaaaaaaataggcacccggtaaatatttatactcgattactttccttggggaatgacattctccacctcatctctttgcacttggaaggtttgaaacttttgaaactttgtacattgctctcccttttgcttacagcactctagggctcccaattctgtactctcactacatcctaagggccacccactgtggccctgcagagtgacctggactagacctctttgttcccagtctcctctgttgtccatctttgggtccgcccagctggggacagctgcccctgggctggaggaagctctgagagaagttttgggttgccctgtttggcagtcctggatgtgtgctttggggcaaggaaaagctatcaatgaggtttcaaaattctagagtgggtgctagactaggccctcataacaggagtgagtcggccgggcgcagtggctcacgcttgcaatcccagcactttgggaggccgaggcaggcagatcatgaggtcaagagatcgagaccatcctggccaacatggtgaaaccccatctctactaaaattacaaaaattagctgggcatggtggcacacccctatagtcccagctactcgggaggctgaggcaggagaatcccttgaacccaggaggcggaggttgcagcgagccaagatcctggcactgcactccagcctgggagacagagcgagactccttctcaaaacaaacaaacaaacaaaaaacaaaaaacaaaaaaacaggggtgagttggccagtggtgcagattccaatcagatgctccattctcctttggctacacagcttgtgatgacctggtcctcagccgaatgaggtccacccttttcttatttcctcagctggtaagtgccagtctcgccttggcctgccgaggttggggttgggggagcaacacaaccttggcaaaactttggactgatatgctgagaatatcccagcttttggtggggagggatgaggcacaaggccccattcccagccttgccagactacttgagccaattgtagttttatgcccttcccaagagctttctagggtttttgcttggatttgttttgttttgttaatactaggagtcattttcagtcctgggatacattgtgggataaatgagataactgagtgtaccttgaaatgctaccatagggccattgcagaaatgctattattattgtaaaatttagggtagaggggatttctgtggtttgttttctcatcatttaccccaacaaagagcttgttttgggaagttctttttttctgtccctttgagaaggtggcatgtgcataggcactgcaactaaccagaagtgggctgtctttgttggaagtgggggagatcacagagcagagtcagggtaaggggctcaagggccaccaggcagcactgccagagtgctggctggagcaggaagcctttcaggtaattagggaacccctttgtcaggctcagggtatctatttcctccaagctttccaaggcctgtccctatcctcactctaacaacacccccaggccctccccgtcacattcctcttcttcctttgggtccttcgtgcctgctgaccccacacccatatcctgtccagggctacatgtaagaggggaaaaataaaagggaaaagaattttatcagctattttccagaggggagaggactccaccctttgaatctctgccatatggcgacagaggaggagcaggcttggggacctctgactaattcagtggtccccagtgctccgcacttgtagacccaacccagttggcaccacctttgcagatgcatgtcttcagcagcatttctgttcggctgataaaacacacaggggcctggggcctctttttcttatccctttggctccacctcctgggcctcctcattcccttgtcctcatctccttccttcgcaatctttgtctcaaaaagcttagggcaagaagtgccaaactgcagcagataaactcagctgcagagtcctacgaaaacaaatgaaaatgaggaacaaattccacttcttaccgttggtctcattgcctgatttcctttagaccctgagctggagggcctgggtttactttcagggctggatggttacccaactccactctcaggtacttgggcctccctctctcattgactttggttgatctaactaaatggcttgcagtgtggagaattaaaaataagaaggtatggaaaaagaacacaacaccaccctccagaagaaaattctcacagtcgccagggctgtgagaattccatatttttgtgggcttggacttctctaatgagaacattctcttccctccttagctaataaatgaaaacatattatctatgacttttagtcccagagctggacgttgtgctaaggagaaagatgcgtgcatgttggaaagatggagagacaaacaaatagggatgcatataaaggtgtacttcttagtacctgtgctcttggagtccgtcggaatgagttacttcccttcagatgcaacggaaaaggcctttgggcttaattgggaagtaggcttcttctttatttggaaaaatgaaatcaaactgatacttcttagagaggagtggcatccctaggcagctgatttaagaaaatgtcttaagaggtctttgagtgacaaagcctagaaccccagacaatcctggatgagcaaaggtaggcaggaggctgaattgctgagcatgataaaatgaagtgaagccttgtgtttaggtgggcacaagagacacaaggctgataggactccagagcccaggaagagcatataaagggtggagaggtgcctggagtcatagcaggacagtggtgggtggaggatggaaaagacctgggaggaaatttttttttaatacatggcttcattagcacagtaatgtctaatatttcagggttatgccattgtctcccctgggctgccctgtaatctcgttccatgccctcaacctttcagtaaatactggctacacacactagccttgtgttagtggctctctggggagggtaaagtaacttactttaccttggctaacttacggtgaagtggtatactagtgcggacagggagccattgagccatggagccacaacccaggagtctgtggtgctggtaaaatggaggaagaggtgacagggagaaatgtaggtgcccagagaatcttcaaaataattagggttccacagtaagtggatggggtccaagacatgctattttatttatttatttatttatttatttatttgagaagaagtttctctcttgttgctcaggctggagtacaatggtgtgatctcggatcaccgcaacctctgcctcccaggttcaagcagttctccttcctcagcctcctaagtagctgggattacaggcatgcgccaccatgcccagctaattttgtatttttagtagagacgggttttctctatattggtcaggctggtctcgaactcctgacttcagatgatccacccacatcggcctcccaaaatgttgggattacaggcgtgagccatggtgtctggccaagacatgctatttgaatataaaacagaaatctcggtacactgggaaccctcaggccacagacccttggtttatatatactcacaccttagcttagcctttgaagcttaagaaggcatctgctcagtcccttgttctagtctaggatgactgaaattcatggtaggcctcagagttggacagccccctaacacggatgcctcctgagtgtttgcaggaagcatggatggatcacttatctcccaaagtggctcatttcattcttataaatagctacatcattttacactttttccttggattgcagtgaaattggccttcccataacttctaatcattagttctaattctattctttgggctggtacagatttaatctggtccttcatgacaatacctgaagatgtttctagtgggccccactagattacaaactccttgagggattgatttaaatgacaatgacactaacacctaatggaggaaagagatccagctctcattttgtactctccacagcactgagcgagatcctttgcacatcactggcactgcagaaaaatgagaatgaatacacagaatgaatgtatcccttatccaaaatgcttaggaccagaagtgtttcaaatttcagattttttcagattttggaatatctgtgtaaacataatgagatgtctcagcaataggacccaagtctaagcatgaatttgtgtttcctgtataccttatatacatagcctgaagataattttagacaatatttttaataaacttgtggatgaaacaaagtgttgactgtgttttgactgtgacctgtcacatgaggtcaggtgtggaatcttccacttgcggcatcatgttggcactcaaaaagtttcgtattttggagtattttagaatttctgattttcagattaggggtgctcaaccagtgtaaataacatgcatcttaaagaaagttatttatttttcctccccaaattcttcttttccatatcaggggtcagcaaactttttctataaagggccagagagtaaatattgtaggctttaggggccatatatggtttctgatggatggtctactttgtcttatcttacgacacttttagaaatgtaaaagccggccacgcacggtggctcatgcctgcaatcccagcacttcgggaggccgaggcaggcagatcacctgaggtcaggagtttgagaccagcttggccaatatggctaaaccccgtctctactaaaaatacaaaaattagccgggcatggtggcacatgcctgtagtctcagctacttgggaggctgaggcaggagaatgtcttgaacctgggaggcagtggttgcagccagccaagatcgtgccactgcactccagcctgggcaacagagtgagactgtctcaagaaaaaaagaaagaaaggaatgtaaaagccattctttactgactgaccatacaaacacaacccctgagtcaggttaggttcactggccatagtttgccaaccccccatctagatgaaataacactagaccctcaacaatatgacttggtttctagaactctcctaatcctggttatcttcacatgaacactccccaatttaattaattcccccttaaaatataacatgagaacaagactgccatgactagaggtagctggcaggaacacacctgccacagttgtcctccaatcctattgcttttcctaaactccaaggattgtgctaagcaccaggagtaaaacacataagaataagaatggctccagcactttagaagtttatattcttactgaggtgacagttagacctatcctgaggaagcagcatatatgattttgtggcagatgagtcacagaaataagtatctcatgcccactgagaagcagaaggaaggggcctaaaacaaaagatatccactatttcttgaacttttaccagacaggataactgcttctacttcttagctcctttgttcctcaaaacagctaagacatagggactacttttatctctgttttacaggtgaggtttacagagttgaagtaacttcccaaaccacagctaaaacatggtaaagaagcctttgaatgtggcctgtctggctgcagagcctgagctctttgtctctgggctataccgccttcctggtgatacagtctgtggctcccaacggcctacttcctggcagaggctggcatgtcccttcatcctagttctgtaactctatggactaagattcccaggaactccttcgagatactcctcttgatccaggtgctagaatatgaaagcatgggcaaaataagactggcaggctaggagatcaggaaacagcaccaggaaaaaactaaggagggctgtgaaaagcaagaccaagtataggaaaactcagtctcttaaaatatggggatttagttattttggtagcagagctttctggatcgctgaggatttgcaaactcactttaaagaacaaaagagtcttcaatttactagtggcaggtagaaatattttcaaaatgtattgcacatgtctttgctttcttagaatacccccccgaaaaggactttatgactcagatgtatcatgaacatgtcgtggctatgttgcaactcagtgacatcattaatgcttattaaggtatagatatctaacctattcactcctaccataaatgattcaagaaaactggtgtgagttttcatacttatgtctgcttttcatttatttctgtttcttagttttcagctgttgcttctccttattatttgcttctaataggctcttcctacgtttcaactttagctaggatatcagataaccagggttattagaattatgtgtaaaacaagaataattgactctgaagaagtacctgaaagttcagtgcatgacttttactacatgaattttgtgacatctcttagaatcctcattttactaatttcttgagaccttgtctcctcccttgctcccagttcataagttgagatcaactagagtaactaagggtcaaatggagtccctagggaaacacagttaataaggatggactgagaagtaaacaacagaagagagctttttattcaactttaaattgtactataattcttgtagccttgtgggtagggaccgttcctcccatctagaatgaaaaagagtggaggtttcatcaattgtctcttaggatgtgacaagctctcactgactggtaggctcctgctactcccctacagagttgggagtcagaaggtcagataaagaaaggtcagtgtttgatggtttaatgccatggatgtgtgtgggaagacaggataaaaagagatctgtggtcagtcttgactctcataaatgtcattcctccagggctctagagactgtgaacctaaaagatgcactctccctgctgtgccgcagtgtttatgccaggattggctccaggcccctggctaaggtgtccccttgctctgcaccagctcaggcatttccagtcactcagtttggtctttctgccctcccacttgtcctgtccccctggtgtctcagagggtgctctgctcaccctggggtcagagccctgactctgaagttggggtccctttctcatttgcaggtggatcctgctactcattccacagcgctcggcctggtggtgggtggaggggctgctgcagctgcgagcctggccccagtgggtcagtagctggcttgggtccagagttgctttgctcttctggaacaggcacctctgtcctcagaactagcagcaggtctcactccacatctggaaaagttcaaaagtgtttgtctaggtgaaggaggcccttcgggggaggggattcaaaagcatgacatcatctcagtcaggcccagcttcctctggagagagaaaagggctgggccagggtggaccagatggggtccccagtaatcagtatgctgggggcgaagaggaagagagcaggcaagaagaggagtcttggaatggtgtcttgagaaggtgatcctttaattcagtgtctgaatactgcccccttggatgaattcagatgaatctgaccttaaagtcagagtggtgagagggtcccatctaaacaggaaagaagcctggattggcttctgcatcaatttattttgatcaacccacctcctgtttaagccagatgggagcccatccttttctctacagagatgtggggaataaattccgattttttggcagtttagacccagcctaacctccttgttgcatctactcaagagtcagctaaacgtcagtgttccattgctgcttcccttcatgaactatggccttccttttgggcagcaccttggtgattcaggctcttcatctctaagacagagatagtgatattccttctccccactgcttacctgacacataacagtaagacacgattgctgcagtcaccattaatagcaatctgcttgcagcaggttgtggaaggaagcagatatgagagagtgaaacccttgtcatcacctttagggaaaccgttcttggccccaggttgatggccgtgaagccaaaagtctaacttccctcttgatcctgagggaaacaagagatgtcattctaccttgctgtttacctggaaatcgctgaaaagtacagatctagatcccaatcaggaaaatttagagacaagctttagggtggcctgggaccctcagaggctcttccttgaagatgcaactgcctttatgaactctggataccaagttcacccttaacatttacaaggcccaaggcaagagtacaacagaggcctacatactatatttctaaacatttcaaggttgtaagtcaggccaactaactaataaaatatcttctatcctcttaccttgacaaacatatcttcgtgatcacctggaaggccaagtttcaatttgggatgctcagattcttggaattcactgccacagtgcagcttagcaggaagagatggctcctggccccagcccacttcccttcatctactttctacccatgactctggctcacattgcaaggcaattgcatgtgtgcctgggacaccccacccacaggcttaagcactaagcactaactcttctccctgcaagcagtcatcatttggccaccactgggccttgggggtgtacacccttgtgctgcagttccccttagcaggatggactgggagaagcggcccatcgtggatgtgagcaaagtgccatttgatcaagaagtgctaggacttctggtccccacagtatgacctagaagagagggtacatcctgattggtcctcacaggaagcaggacagggtgtgggctctttgaggcatagggttcagtcaagaagcttctccttcctgtgtctaatgaggatactgactgggaatggtgagtaacatctgtaatcccagagctttgggaggccaagacaggaggatcacttgaggccaggagcttaaggttacagtgagctatgatctcaccactgcattctagcctgggtgctgtgatgacagagcaagaccctgtcttaaaaaaaaaaaaaaaaaaagtatgtatcccaggatatacagaagagatgtgcaaagacactcatgaagatcttcagagaaaaatgagatccaaaacattatactataatactataataacttagcatttgttatctcattgtttatcccagcaatccatgtaaggtagccagaaaagacccttacttaagaggtaagagagctgagatacatacatgcattaaattacatggttagttattggaagagccagaacaaagcttgtctaccttcccactacattgatgagaaaccagaccttgtgttccctggttcattagctgaattcctaggtcagagcatgctaaaagaagaaaaggaaaggcgaatgggtttgaaggccatgagcaaaaggatgaggggagtatgggaatgggaagtctgagaagtatagatttttaaggggatcgcatagagacagtgagtctagtgattattccaagagttagtatactggatggagagtgaccaaaaaagaggatacagtgaaaagaaaaaagaagcatgaccttttgcacacattagatctttgcaatatttatgcaggtgtaattttatattttagtatgtaactaaacatactatgaacatcacctcatagttccacgttgctacagtttttataatttttttctttctaatgtttgtttatatgattatataatgattatggtatattaagtgcatatatcacttatcctatcataattcatttagttgttcacgtttccctcctataaataatactgtatgagacatttgtatgcatataaatctttccttccctatgtcctcagggcaaatttggtagtgggaaattaatccactgtccaggagtatgttcttgttgctgccaacaaggggcagcagggaatgttctagacgaattctacctgaagtcaggaaattgcatcaggtgatatcaccaggctgatatctttaggttctgattcttcctcctcgtttccctatagcttctgggttcatgagtcttgacaacaacggtactgctaccccagagttacctacccagggaacattttcaaatgtttctacaaatgtatcctaccaagaaactacaacacctagtacccttggaagtaccagcctgcaccctgtgtctcaacatggcaatgaggccacaacaaacatcacaggtaaaaacagcatttgtgtcagatcccggagagatgctggtgatgcttgggtaaagcatttaggatgttttcagaccgctcccctctccacagaggaaattatacaagtccctagtattaatgacttgagtatcatgcttagggtgccctgaagtaagttctagataattcttccttcagtgacagttttctcaggcccatgtcttgggagctgatcctgatcagtaatgcctccataccccttctctcatgctgagtctagcttagtgataaaataaggatcagaagactcaatagagatctccgatctcttctaaaggaaagaaggtgggtacaggtccaaactgggggtctttggcttctctaaggtagaccagcatctatttcagtttcaggacacctctaatacattctagattctagctctggttccaacagcttgaaatgagtttggtcagggatgggacacgaagtaactgttaactccccaaactcccttttctgtgttgaagtgcatgcccatatcatgacctgagattttgtgtatctatgagcacatgcacacatgcacacccatgttttggtctcttccagaaacgacagtcaaattcacatctacctctgtgataacctcagtttatggaaacacaaactcttctgtccagtcacagacctctgtaatcagcacagtgttcaccaccccagccaacgtttcaactccagagacaaccttgaagcctagcctgtcacctggaaatgtttcagacctttcaaccactagcactagccttgcaacatctcccactaaaccctatacatcatcttctcctatcctaagtgacatcaaggtgggtgaattgggccaaaaatggcagattgcccctcacttcatatgtatgcaggcaagctgtttctttccctccacccctctcctcatccctgccagtgggatttgggtcatgtgggaatcagcacggaaatacacagtttaaatattgctgggagaagtagaaagaggaggaaaggggtagagttaggtggtaaggcccatccaggctttgggtattgcattttagggaatagagagtaaacgggattctcagagatccatccaatcctctggttctttctagtacctatcagtggggctttgaccaggacaccatttccctttgggaatatttggcaactattgcttatttgctggggctgcttctcccacaatggttaggacaaataacatttcctctacatgagagggtttggtggttgtgccaggcacagagaggcagtaaaggggggcattggcaatggcaggaactgggcagaccagggatggtgagctcagcctggccttctcagccttagggcctatgactgtcaacagctttcagcatgcaggacagaaaatatgagggcctcagtcatgagatatgcccgagggatctttctgctttctgtttttaaaggagccagggccaggcgtggtggctcatgcctgtaatcccaacactttgggagcctgaagtgggcagatcacttgaggtcaggagttcaagaccagcccgggcaacatggtgaaaccccgtctctaccaaaacatacaaaaattagctgggtgtggtcatgcacctgtagtcccagctacccaggaggctgaggcaagagaatcacttgaaccagggaggtggaggttgcagtgagccgagatcatgccactgaactctaacctgggcaagactcgatctcaaaataaataaataaataaataaataaataaataaataaaagagccaaaatgggaatttggagagtcctggaggccaggagaaaaaacaggtaccccagcatctgctggtccaccccattatccctgtttgcctatatggccttcctgcaagtttgtgattgactggagagaaaacaacccaaatgggaaaagatcctcccctctcccagtcctgcaccatccaagccagtgtttaccaaggttgcaaatagctgcttgccagtaagcccaggctagtaacaaaagttttgtcatctgatgaggatagatatgaaatagacgagagtatgactattagaaatctctagtcccctgacaaattttaaatgtccttttccttaaaacctcctaagagagcacctcacagaaagcaaactggaaaaagttgggaaagaaatgaggagcaaagatactggcttatttactttgtttttgttattgtttttgttttaatacaggcagaaatcaaatgttcaggcatcagagaagtgaaattgactcagggcatctgcctggagcaaaataagacctccagctgtgtaagtcaaccccccacccaacctcttcctcccgcccctgtccctttcctccatcccttctgaacacccttaaaccttcttggattgcactggatttgagtaggggtccggggagtttagcttggtcagcctgcctttaatactgagctttctgtttagggagtaagaggccccatctggtgggcaaaaaagacaataacaattttaattattaataaattttgttatttttccatcctctatagtactttttccccctcctctatagtactttttaaattttcccctcctctgtagtacttttaaatctgagagagtcagatttaagttgctttttggttaagaaagtccttctcactcaccagatataaactagtcacctaaaatgtcagttcatttattatttcatttattattattaaatatttacacgtaactctttaatccatatagaatttattttgctgtaatgttatattttccatgtaaccgtttttcctaacattatttgttgaatgactccctcttctgttgcatgggatgtatcctttagcttatattaagtttttatatgtcttagggcatactcttcagacatattttatttgttcagtttgtctgtacttttgcctattttaaattttcaaaattattgtatgtttttactacagtatttgtaatatccagtcaggcagatctttttttattacactgtaaaaaatgtaaattatttttttctttttgaaaaaaatgcaaaaaaaatgctttaaaatttgaattgtaattgctctaaaatttcttcattttttctggttttcttttgcatctctcagcatcttgtttctttagcttttttctctagatttgatggatgtcataggcctatttgtcacatagatctcccactatatattcaaattgattgtcactgatagattaaaaagttaatagagttttgaacaattattttgggtttggccagtttcttgaatttgcctattgattctaggagctttttagttgattcctttcaattttaaggtaagctatcttgttatctactacaatatattgcttttctcctcctgtttagtagctatgcctcttgtttcagtttcatgtcttactgcattggaaagaatgtacagggaattgtgttattttaaatgattctggcagaccttgctttgtttcagtaaatctaatttcctaacagtaacatggctctggaggaaggatgaggtgaaggaaagagtggtatttacttacagaagaaaacattttcttacaagttggggatccatctaagggaatcacatatgtgatgtgctggcatgcatagactggaaagatcgcagcctgtagagggcttaaattacttattttttccattctaactcggtagttttactacgatcatcagttgggtctctctgacttacaaatttgtaaaaattatacctgaaagaatttaacttaggacatctaaaaacaacagaaatagtgaagacatgagtttgcatagtagaataactaaatgcagtctgcaaaatagttaacttaaacatgaacatacaatgtacaagtaacatgcagcatgtttctgatgctgattttcaactcaactcattagaaaaaaaattgtcaagttctttgctagttgtagccaaggaaaatgacgatctttccccctgcaaccccatcgacttggtggagcatacattttgctgtgtatcacacaggtatgtgccagaatgctaattctttgtgcctggaatttagagttaactgcagagcctttgcctttctgttgctcttcaaagctcacatgtaacttgggtcactgtatgagaaaagtgccagaaacttactgctcttttagaaataattcctcctaactctgctgtggtctttgctgtctggcctacttcgtgccacagctgagaaggtctctgcatgttcctctaagattgaggtagtatctgtgagtggggatgtgaaaagagagcagctcccctccagttcctatgccaaagaagacttccatccacactgccccttcataaagcaactctgtggcagctcatatgagtgcttttgttcccctggtctctccaccagtgttgatcccctttcttcctgagggctcctcatcctcagcccccatgcggcaaagcctcctgctactccccaaggtaatttatcctcagcttgctatcctgttccaaaatgtttagccacagctcccgattatgtccaagatgacctttccttggtccctactccctgcttgtctgataaacaatctgttccaaaagctgcgaatgctgcagagcctcctaattttccttaggttggatttgtactttcggtgtcagagggccttaaggtattggttctaatgttgggagcctcaggccctacctaataccctggtgaagagcaggaaggatttggtttccccgagcatcacatccttgatgtatgttggtatgctcctcatctaatatatgcccataacaggaatatatgtgcatgagtctagctatccagacactcattctgcactgacacatagtgagtaccaatatgttagctcaccctatgtggattctgtaggcgtgtcttctgtatgtgcattctgtagacatgtctatcccaatcactcttttttttttgctccccagccatcatctctaggcagccaggggaagggaaggtgataccactctcatctcaaacaccttttaccatatctcagcaccctcattagtaggatgtgtcttcctgagtctaactgtcattcttttggcagcagtgtcagcttaatttagtttttgtggttgtggttccccaaatagtttccaaaatgtaagattactttatactattatgctacacccatttgtccagagaaacccaccaaaatatttttaattgtggtaaaatatacataacataagtcatcaccttaaccacttttaagggtaccattgagtagtagtaagtacgttcacattattgtacaaccaatctctagaactgtctgcatcttccatcactgaaactgtgtacccatgaaacaactccctgctctccccagaccctggcaactttctgttcctatgttcctatgactttgcctactctaggtacctcatatgagtagagtcatagtgtttgtcttgttatgtgactggttgatttcactcagtataatgtctttaaagtccaaccatgttgtagcacgtgtcagaatttccttcctttttaaggatgaatgatattccattgtaagtgtaaaccttgttttgcttctccattcatctgttgatggacacttgggctttttcccctttaggctaatgtgaataatactgcttttaacataagtgtacaaatatctccttggcaacctgatttgagtccttttggggatatatccaaaagtgaaatggctggaccacatgggaattctatttttgaatttttgaggaaccaccagaccgttttacattcccaccagtagggtacaagggttccaatttcttctcatcctcatcaacacgtgttattttctgggtttttaaaatagcagccatcctaatgggtatgcggtggtatttcatggtggttttgatttgcatttccctgatgattagtgatgttgagcctctttcatgtgtttgttggccatttgtatatcttctttggggaaaagtctagtcaagtcctttgtccgccaatttgtatacctatctttagtaccacatctgtttatatgcagagtttgtaattactcagctagctcactttactcttattcacattgacttcatctgaggcaggctgcctccagcttgcactaaaggtcagtttccatgcggaaaacataagttacagatgaaggatttatgaagatggtgtgtctactggaaaaagcctgcaatctggaaacgatctcacttctcatccttcgttagctgcccccacttgttaggtgacttgaaacaggtcccttcattattccattttctatgtgaaaatagcgttttcacctgcattgtcaaactcacaccaaaatagataaaattatattaaaaggggttgggggagatgattgatcctagaatctcagcgttctaggatcttaatatcttaaatatcttaaaggtcattagaaaaatacctgtccctccctcacccccatctccgtccccattgcaatgcttgatgttaagagtctttgcaaagtttgagaatgctactctagagaggttagatgggtttattgtgtttgcagagaaacatgtgtgagctgatgtagttaggagcttgtaaatctgattctcatgaacaaaatggtgaggctgtgtcttcctcctgcccactctcccgtgatgtttgcccacagcctctcttgggggaggatgtttattccaagtgtccggagaagcattgtgctttgttcaggatccacctgctcctcttggggcccaaacacaattcactgatgcggttggattccagagtgggaggctggccgctattattcccttgaatctagtccaagaaactgtgcaaggggtggagggaccctgtgtggaggccaactggttgggatgttaagttgaacaacaattccctgagttcttttgtttggtgccacggttcatgcagtctgggttgtaaatgctataatgtgcactccccccaacacacacttaggagtcttacaatctagtcacagaaaaatgacaataacaatgcatagaatatgatcaatatgtagactctagatgatatggtatataaggtattactattattaataatgatagtagcagctgctatttatctagtgcccactagattctcaacaccacattggacacttttttttttttgagacagagtcttgctctgttgcccaggccggagtgcagagtgtagtgttgtgatctcagttcactgcaacctctgtctcctgggttcaagcgattctcgtgcctcagcctgccgagtagctgggattacagatgcccaccaccatgcccagctaatttttgcattttttagaagagacaaagtttcaccattttggccaggctggtctcgaacccttggcctcatctgatttgtccatctcggcctcccaaagtgctgggattacaggcatgagccactgcacccaactggacactttcatacaatatctatttagtcaccacaacaacctagtgtacagctgaggaacatgacactcagactagttgcatgacttgcaaagaatccagtaaagagcagagtaaggattgatgcccagtctggttgaaggtaggaccagcttcattgaggaggtagaaactgagttgagtcttgaaggatagtgaataccagggagaaggtagtgttcttcattctctttgaaatgagggttgtggaataatgcatgctgtccccatcttgggcttcctggaggtggggcctcagttccaaatgctcttccccactggcttcctctgctcaccctccagccattcttcaaggcctatagtgacatgtgtctgctaaccttaaccagacgtgtcctcacgctccttagtatgtccatagcactttggttgtacctttcttatggtgcttaccatggcagtagctctggcctctggagtctcttcacgcctccatttcttcatctacaaaattagtagaataactctaccaatctcgtaggtcgtgtgaggcctaaatgagttaatatatggaaagcactcagaactgtgcctggatatcataggcatctgttactttattttttatttctttatttttgagccagggtctctgtcacccagggtggagtacagtggactcaacctctcagggtggagagaccctcccacctcagccccccaagtagctggtactataagtgcatgccaccacacccggttgaatttctaaattttttatagagatagggtttccctgtgttgcccaggctggtctcgaattcctgggctgaagtaatcctcccacctcagcctcccaaagtgctaggatgacaggcatgagtcaccgcgcctggttggcatccatcattttaattgccgtacatgcaaactgaaagctttgacaaggtggaattcatagatacctcccaatccccacccccctacacatgacacatgaatacaacacacatacacatgacacttgcacagaggctttcacgcagtgtcctatattcagggcttgatacattgtcaaggtgtggcttcttgcactcagcaggtggaggaaggtgccatttggtttggctagtttacaacctgcaggagccctgtccctctgcctctcttgggaagcagacctatttcaactggagatacttcagaagcccagagtcatccaggcaagaaaccccctcctcctcatccagactctcggtgctggggagcgggggtgctcaaggggaagccatgtaaggctcccctgagacaactgggtttagagaggtggagactgttgattggttcagtgtggcattcagactacttagttcaaatgctgttcagaaaaacggatttttccagagttagaacgtctatccaaggacttactgggagacctgcagaattgctccttttcctgaggaatgaagcagcagtggcctgagaactcatttctctgtagccttgtttcctgggggttttttgaggctccagtttgggctcgtgtctctgtgacctggagtttggctaaccacactctcctggccttatccaagcccagttgttttccctcagctgcttcaaattccagctgggtcctgaggccaatcttgaccttgctttgtgtaggagcaaaggagcctgggttttcctgccttgggtcacagcagtgggaaaatacccaggctccattccaactgggaggaccctgtggccttgttgcaagcagcggccctgcccgcaaacaggaagctttctcctccacagagacccagttctgatgatggtcacataccccagcagttttcccctaacaggaaagttgtcagggctgttcaggcatttccttctctgccatctgccatccggactgaagagaaagtcttagtttcaattcctttcctgttcaggggaggaggacactctgattggaggctgctggaataaattctgactcactattgaagaattatctgagtttttcttctgagtccaaattcctgggtctgatggcccagtcagcaacctgaagaaaaatctatgaacttcattaaaactgggttccatgcttttaatggaaaacagagatggaagacgagacaaaaatgccatttcagtttgagcaatgcactttttgagactcctttgggtagaaagagggaggaggccactgaggtttccactgagtgtatattatagatttgttctctcctcctcacctcccttggcttttcttccatcattggggactgctgtaatcttgaaacagaatattttctcttagttattattgcattattaatattttctgtttttggccatttcttttgagtttaatttgcatatgtgtacatgggcaatgcttcaacgagacaatttttttaagtttgttctctaacatcttagatactagaagatatggattttggtcctgggagattatttaggtttttttcttattgtgttgttgcacatatacagttagcagttttttttttttctgttggaattttagaaacaaggatccttcttgcggacggggtaagagtatgactgtaatcagagactctgggtgcagtttagggcagagcagtaatttcatctcttgctctccatgtttctctgtcttcccaggcggagtttaagaaggacaggggagagggcctggcccgagtgctgtgtggggaggagcaggctgatgctgatgctggggcccaggtatgctccctgctccttgcccagtctgaggtgaggcctcagtgtctactgctggtcttggccaacagaacaggtaaggtgcacctctgcctgggggaacagggaaggagtagggctgaggttagagaatcctgggtggagatggggcatcttagatccagagagaccacaggtgctggggagaaggacttggctggctttgggagcggtccccccgagatggaccaccctggccatcagagcatcttctagaacagcatgggagggtggagcaggataagctggtttctctttagatttagcaacccttgtttctaattctagaaatttccagcaaactccaacttatgaaaaagcaccaatctgacctgaaaaaggtaagtcctctgagatgatgggcctgagagggaatgccggggcaggggggctccctggagtaaggggggaagtcattatcttccccagttctacctaccatccttctctgagtcttctcctttctagtcttgaaccaaaaatggtggggtatgactgaattaagagacgtcagtctcaaatcccatttcaaaaattcctgaggtcaatgccctcaagcatctgttcactgttgagtcacacacagggggctggagcgggctgggctccacttttggcaagtgacaggctgtatcttctttgtcttcttttcaagctggggatcctagatttcactgagcaagatgttgcaagccaccagagctattcccaaaagaccctgattgcactggtcacctcgggagccctgctggctgtcttgggcatcactggctatttcctgatgaatcgccgcagctggagccccacaggagaaaggctggtcagttctgggggccagggtaaaggaaatgaggaagatagtgggtttctggggagttcagtggatgtcatggagcaggaggagaaatactagaaaaagcccttctgtgagcttacataaagatatgcatgtgtgcacacacagtaatcggtggaagattcaaaatattatgtagcaaactggggaggggacagtaatggtgccagcccacctactcggtgtggtagcagatgattcgtgtcatctattcattatgttttctgggatagttcagcttggggccaccagaacaggctgtttaatcagccacactgtatttgcaaccgtgttaaatgcccagtgggtgcccccttgctcaaaaggaggtatacggaaggagaatccccatttgccattctggatgagggaggacaaggctgaggtctgaatcttggcctctggcctgtcccctaccctggggaggtcatcccacccttcttggaactgcccgttttcctgcgggagctggctgccgagctgcggtggcatggtgtggtgcctctcctatgtcctttctcctctaggagctggaaccctgaccactcttcaggaagaaaggagtctgcacatgcagctgcaccctccctccgatccttcctcccacctccccctcccccttctcccacccctgcccccacttcctgtttgggcccctctcccatccagtgtctcacagccctgcttaccagataatgctactttatttatacactgtctagggcgaagacccttattacacggaaaacggtggaggccagggctatagctcaggacctgggacctcccctgaggctcagggaaaggccagtgtgaaccgaggggctcaggaaaacgggaccggccaggccacctccagaaacggccattcagcaagacaacacgtggtggctgataccgaattgtgactcggctaggtggggcaaggctgggcagtgtccgagagagcacccctctctgcatctgaccacgtgctacccccatgctggaggtgacatctcttacgcccaacccttccccactgcacacacctcagaggctgttcttggggccctacaccttgaggaggggcaggtaaactcctgtcctttacacattcggctccctggagccagactctggtcttctttgggtaaacgtgtgacgggggaaagccaaggtctggagaagctcccaggaacaactgatggccttgcagcactcacacaggacccccttcccctaccccctcctctctgccgcaatacaggaacccccaggggaaagatgagcttttctaggctacaattttctcccaggaagctttgatttttaccgtttcttccctgtattttctttctctactttgaggaaaccaaagtaaccttttgcacctgctctcttgtaatgatatagccagaaaaacgtgttgccttgaaccacttccctcatctctcctccaagacactgtggacttggtcaccagctcctcccttgttctctaagttccactgagctccatgtgccccctctaccatttgcagagtcctgcacagttttctggctggagcctagaacaggcctcccaagttttaggacaaacagctcagttctagtctctctggggccacacagaaactctttttgggctcctttttctccctctggatcaaagtaggcaggaccatgggaccaggtcttggagctgagcctctcacctgtactcttccgaaaaatcctcttcctctgaggctggatcctagccttatcctctgatctccatggcttcctcctccctcctgccgactcctgggttgagctgttgcctcagtcccccaacagatgcttttctgtctctgcctccctcaccctgagccccttccttgctctgcacccccatatggtcatagcccagatcagctcctaacccttatcaccagctgcctcttctgtgggtgacccaggtccttgtttgctgttgatttctttccagaggggttgagcagggatcctggtttcaatgacggttggaaatagaaatttccagagaagagagtattgggtagatattttttctgaatacaaagtgatgtgtttaaatactgcaattaaagtgatactgaaacacatctgttatgtgactctgtcttagctgggtgtgtctgcatgcaagagtgacaccctccattagacctagctagactgtgcagtgatgtggtggggaggaccagccagggaagagggagcacctcagcagacacaggcaccagccaggatgctaaggacctttagccaagtctgccaactattctcctccatgaggagaggaaacatccatttccagtggtagaaaggcagacccgaatgtaccagggagcttccaaatggagggtggtatgttgggttcttaggagctgtacccttcatgaacacccttctgagaagaggagcatgctgatcactgctgcaaaatatgcaaaacaaagggaaggggcaatgtcctgtgcaccctttattatcaggccacccccctccccagccccccaggtcagagtagacacagtgaaggactatgtggggactgttgttctagagacctggcagccaactcagggagggggctggtttccaccctcaagattaagacagcagcctaattaaaaaaaaaatctgtaagcatgtacctccccccagcttccaaaacaacccccaccccacccctaccaggccataggaagttggggagggagtgctgaggagctccaggaaacactcccaagtgtgtcgacagtggcagaggcagttggggccaaacaaaggttgattcttccattcttatctccataaagccagacctttcccttcagcactcctccacccccatctccttcttgcttttctccaactcctctaatcataggttcttccctaggacagaggggaggcgaaatgatgaggttcagagtcttccctcaaaggcgatggctgccttgagggttggagcaaaggatgatgagcaaaagacgatggtaatcagtagggaagtccagcccacttgcatctagttgcacatcttgccttgagagtgatccagtgagggtctgtcccagctaggacatcaagtaggaggggtgggttcagggttcagattcctaggaaatatgggaggagaggaaaaggcaacttggatgcacctccagcttcaggcctagcaacctgcaatgcatctcaccctgagtttgctggaatgtgtatgtatgctttgggaggaagggctgtgtgtgtattgcggggtggggtggggcagctggttccctctgacagctggacagcttgccctgaagaatttgcctgctttctggaaaaatccaactttcccaccgtgggcctgagcgtcctggtacagcaatggcgccacctgctggccttattgaggtcctactgctcagcctcagctcaatcgcctccatgttgggcttctctccctggctgccccaccctctagtccaatttctcttgtacacaaagctcatataactatagaacgtcactgttgaagagaactttaaagatacatttaattaaactcccttatggtatagttaaagacaaactaaggctcagagaagggaggtggcttgcccaatcacccagaattccaaagtcctgaatctgtagttttcccttccatcatatcatcctactcttctgccgagtcctccgtgttactccagttggatgtcatgaagccagtgtggcagtgtgaagataggtttgggacttcacttctggagcatttcatcaacataagctatcctaggcctggccagccaagcaggtcctggaggagccccaggacaaagatcacaggaggccatgaggttcggcttcttcggcgcccacagtgagcccaggaaaattagctgtagggtattacactgttgactatggagagcatatctggaattatcttcagccagattttcatctgaatggataaatgggaataccatctaagtccagataaatagatcacttccatctcatcccttctaggtagattaatcccacacttcctcttcacacaaaaccagtaataggtcatcgattttgtgcaacaggatgctgcttctcttcctaaagcccccatcgaagaggcttccagccaccattcaatcattcatcaagtcttatgatgtgccagacactgcgcgaaatgtgccagaacatctgttatgtgccagacactgttcttgagactggggatacagcaaacactcatgaagcttataattctagcagaagaggacagtaaacaatgtcatctcagtaagtatatacatgtgttttcaggattgagagctatgaaaaacataaaatatattgagaataatggttggtattttacatatggtggttacttttagaaaaataacagtggagagcacagcttcacttgaatgaagtggagaagcaggttgtatgccaagctgggagagattatcccacacaggggaaaggacaagtgcaaagccctatgatgaaaagctgccaagtgcagaaagcctcagatggcagggggcaagatggccatgaggttgtgtcagtgagtgggggtggggagaggcaggaggtcagactacatggggcctttttagttgtagattgggaagccactggagggttttgagcagagaagtcatatcatctgctttatgttttaaaaggatcatgctggctgctgagtagagaatagaggttgagggataagaaagtagaaggagaccgtagcaagaagaacgatcatggctgggagcaggtgatcatattggcagtgatgagatcaagcagaattcaaaaagtggtttcaaagtagaggtaacaggacttgctcagtctatttatttcttcaaataataatcatatttacaatgatagtagctaacagtttttgagtgcttactgtatgaaaattgagatatggtgccaatatttaaatagcatattttacttaacattcacagaaaccctgtgaagtaggttctattatctcagaaaaagaaactgaaactcagagaataacaagggactgtgttacgtgcacagtggcagaggcaaagatgaataggatgtgagtttatttgaaccccaaatgtttaaatcttggggataatacaacacacatttaaacaaagaagcaagaaaaaaaatgcacaacagaaagtgagaaataacacgaggaaagactaaatgaagtgctttgtatctagatgtgggcaggaccctttccagctgagaagatctgagactgggtcatgaacaggtggtttctgagtgggtcctgtaaaaatgaatacgattttgatgatagtaatgagtaaggacatttgagactgatagaagagtacatacaatatgtagtgatggggaaagataaggtactgtcaaaggacaatgtgttttctggtatgacagagaagtagaatgtgttaagggaagccgagtaccagaaagatccgggtgtcacagtttgtgtagggtgtttaaagctaaaccacagagtttaattttatccaatagaagaggagccacagaagagtttccatttattcattaatttattcatttattcaaaaaatatttgagtgcttattataagccaggtactatgccaggcacctgggataagacatagtcccttctgtcaagtctttacattgggtggatgtgggagggacagatgacagaacaatatgcattgagtgtaagtgctatggtataggaagctctgagtgggaggggcatggaagccgtggaagaccatggaaggcttcccaggagaagtgacgtctggactgatcctttggtcaagcaggagttaaagaggagaaaaggagagatatgggtgttcccgagagaggaagaagccttgtcccaggagcaaagtgagggtgattgttccagaaatgtgagtgattcttttaaggctcaagcaaagcatgtgattcttctttataccttctatttctttgctgagtgtttctgttcttttgtttcaagcatgctgcaattgctcattaaagcatgtttatgatggctgtctgttttaaaattcttgtcagatggtttcaacatctttatcatctcaatgttggcatctgttaatggttttttctcaatcaaattgagattttcctggttcttggtattaccagtgattttaattgcatctggaaatttgggatttatgttgaaagactggatcttattgaaagattctgtttagcacccctcctttgataccacactggtgggtccaggttccccattcagctgttgacaccttcagggcagagaggtgggatggggtgaagggggtacctcattattgctggcccaggttagaagttcaggcttcccagtagatctctgctgataccaccctggtgccatgtcattccttgagtccaaaagtccctcccaattctgccttcttctctctacatatcggagtctccctatgtttgacttatatataatgtccagggtttttagagttagttaacaggaggcataagaaaaagtgtgtccactccatcttgtctggaactggaagttcaagtcgaatataagagagaggagaggaaattacaagccatgagactggagagttaggcaggttctacaccagctattctcaaagccctcttacactcttaaaaatttagaacttcaaagagcttttgattttgaaagttacatctatcaattattactgtttcaaaaattaaaattgagaaaattttatttattaatttgtttaaaaataacaataattattcaattacatgataatgtaagtaatgcttttcttaatgaaaaataattatattttccaaaacaaaaacaattaggaaaaagagtgtcattgttttagactttggtaaatctctctaatatctggctgaagagaagaatgctgattctttttttttttttttttttttgagacggagtctcgctctgtcacccaggctggagtgtagtggtgtgatctcggctcactgcaagctctgcctcccgggttcacgccattctcctgcctcagcctcccaagtagctgggactacaggcacccgccaccacgcccggctaatttttttgtatttttagtagagatggggtttcaccgtgttagccaggctggtctcgatctcctgacctcatgatccacccacctcagcctcccaaagcgctgggattacaggtgtgagacaccgcgcccagcccccgaatgctgattcttttatctgcttctgtattcaatctgttgtgatatgatgggtagcctctgaaacactccactgtatacttgtgaaagaatgaatgtgaaaaaggaaaatagatttgtagtattattattcaaattgttttgacctcagagaccacttggaaatgttttagggaacccccagaggaccttggatcatgctttgagaaccgcggctctagatatgttactatttcagtagcatctaagtacatgtggctgctgagcacttgtaatgtggctagtgcaaatgagagacaggacttccagctatatgtaatttaataaactcaaatttaaaaactggaacctcataaaatgttttgttgttgttgttaaacatgaccttatagttttggtaggaatacatttcactttaacccttcaaaatttagcatttgaattgagatatgctgtatatgttaaatacatgacagattttggggacttagaaaaaaataatgtaagatatttcattaatagtttttatattgagtattttttgctatgataatatttttgatatattgggttaaataaaatgtattttaaaattaatttaagctatatttattaaaatctttagaatgtggataatagaacatttaaaatgacatacgtggttcacattttatttctcctggagtgtactgctgtagatgaatttagatgatgaaggctttgtgtgtcatgtaaagcttattctttattttgaaggtaatgtagagccattgaaaagtctgaagtagagaagtgacatatcagatttgcattttagaaagcttactctggcttcagtgtggagcatggactgaagaaggaaccagttagggttaggaggtgattgcattattgaagggtaggaagactgtggcctgaagaaaagtggctaaaccggagacatatggctgggcgcagtggcacacgcctgtaatcccagcactctgggaggctgaggcaggtggatcacttgaggtcaggagttcgagagcagcctggccaaaatggtgaaaccctgcctctactaaaaatacaaaagtagccgggcatggtggcgcctgcctgtaatcccagctaatcaggaggctgaggcacaagaatcacttgaacccgggaggtaaagattgcagtgagccgagatcatgccactgcactccagtctgggcaacagagtgagactctgtctcaaaaaaataataaacaaacaaacaaacaaataaataaataaattggagaccatagtggaaagatgaaatcaactggatttggttcttaggtgtaataatggcattttggttatgtaagagaatgttcttatttctaagagatgcacacaggaatctttagggatgaagggccataatgtctgtaatttactttcaaatgtccatcatattcatacacacatacacagtatatctgtgagataataagagtgaaaaggtaaatagcatcttagtagtattatgaaaaaaatatatatggagagagggaaaggggagaaaaagcaaatatgagacaaaatattagcaattttgaatctacatgaaagcaatctagtaaatgatgaatcattttagtcttcttccagccctttctgtaggtttgacaattttcaaaataaaaagatggggaaaaaatgaaaagaaaaaaaaaactttaaaaagtcttggtaatcactgattagatatgagagaaagggagtgactttctggttccttgcctggcaacagagtagacagcactgtccttcccaagagggaagtgcaagaggagaaatcgaattggagggatgatgagttcgttatggagtgtgtggactttgaggtgctctgggctccaacaggcaacgtgcaaccctgaagtttttgagagggaaatgtggtaaagatgcagacatgggtgtctttagaatctagatggtaatggaaggtactgggggaccctggagtatcaagggcatgtgtggagaatgagaagagatgaggtgtgaggatgaaatcctggcggacactgacatttcagggtcagcaaagaaggatattggagtagacaacttccaaggtggcccatgacaccacctcttcacaggcaggcttttgtgtagtcagcccctctcacactgtatcagtgttggcctgtcagacaagaggggtggaagtgatggcatgtcactcctgagattacatcataaaagacattgtggctttcatctaggcttgctacatgctcattcttgtggatcccttgttctgggggaagccatctatcatgtcatggtaggctacagggagttccatgtggggaagaactgaaacctcctcccaacagccatgtgaggaagcttggaaaaccttagaagagtatcctttaaaaaaaagttttaaattaaacacaaataaatacataaacagtacaactgcaatctcatgagacatcccaagcgagacaactcaggtaagccattccacccagctaaattgctccagattgctgaccctaagaaactgcgtgaggccaggtatggtggctcatgctgtaaacccaaccctttaggaggctgaggtgggaggattgcttgaggccaggagtttgagaccagcctaggcaaataatgagaacccctgtctccacaacaaattaaaaaattagccaggcatgatggcacgtgcctgtagtgccagctacacaggaggtgaggcagaaggattgcttgagcccagaaggttgaggctgcagtgagctgtgtttgtgccactgcgctccagcctgggcaacagggcaagattttgtcagaaaaaaaaaaaaatcaagaaactgtgtgagagaatccatgttttttttttattattattatactttaagttttagggtacacgtgcacaatgtgcaggttagttacatatgtatgcatgtgccatgctggtgtgctgcacccagtaacttgtcatttagcattaggtatatctcctaatgctatccctcccccctccccccaccccacaacagtccccaaagtgtgatgttccccttcctgtgtccatgtgttctcactgttcaattcccatctatgagtgagaacatgcggtgtttggttttttgtccttgcgatagtttgctgagaatgatggtttccagcttcatccatgtccctacaaaagacatgaactcatcattttttatggctgcatagtattccatggtgtatatgtgccacattttatccatgttgttctaagcttctgaattttggggtaatttgttatgcagcaacagataacgaacacagacaagcctcaaaggtgagttagaagggaatatgtcgagacaggagaaccatgagcctgggatcttgagaatatgtcatggaagacagcctggaatacggtggctaatactactgaatggcagaggattggaattttcaacaaagaggtgatttataaccttggtgaaagcagtcaggagagtgggggagggcagagaccagattatagtaggccaaagggcaaattagaaaagctgtaatttttccattatcacatttattgaggggaaaagtacaatgagtatcacaatcctaattttaggtatgagaaagccaaagtcacattgctaatatatggcaaaatcctcctgaccgttccaccagtgatatattaaataattttctccgctagcatggtggctcatggctataatcccagcactttgggaggctgaggtaggaggattgcttgaggccaggagttcaagaccagcctacgcaacatagcaagatctgtctctatgcaaataaaaaataataaaaataaattagccaggtgtgacggcgcatacctgtagtcccagatactcaggaggctgaggtgggaggatcacttgagcccaggaaagaggtcaaggctgcagtgagccatgatcgcaccacagcactccagcctaggcaacacagtgagaccctgtctttaaaaaagaaaattcttggccaggcacggtggctcacgcctgtaatctcagcactttgggaggctgaggtgggcggatcacgaggtcaggagatcaagaccatcccggctaacacggtgaaaccccgtctctactaaaaatacaaaaaattagccgggcgtggtggcgggcgcctgtagacccagctactcgggatgctgaggcaggagaatggcgtgaacccgggaggcggagcttgcagggagccgagatcgccccactgcactccagcctgggcgacagagcgagactccgtcttaaaaaaaagaaaaagaaaaagaaaaaaaagattctctccacctacattcattaccgtttctgggaagagttctgataaattcagtttttgcaaccttgctccatttccagtgatattcttgaatcccttatgattgtggtgacccagcccgcttcctagctgggatgctccttcatctggttctgcctaactcacccctcagcccccactgccttgggtaagtccttagaaagagaactgacaaattaaagtgagacattctttcattcattccatagctatttattgagcttcttagaagagcttcagctacctggctagcattcttagacatcaatgggcaaccaacttgtcattggcagttttacatgtgaagtcagcactccacaagcaaaagaaaatctgccttagcttcctagagaggggggccctactcaaggttgaatagagcacagtaaaattcagcaactgcagcatcaacaaatgaagcaatcagggtaatcattcagcagtgattaatagcaacatctcttcttgggtctcagacatgaagctatacataggtagctattcctagctctaactctattttaatgtatttggccttcagtcaatcaattcaccttcctctgacccatacagtgtcccccgtgaaaggtttcctgagtaagattcaccctggggatgcaacccacttcagacctgcttgagctgcaccgagcggccacatggtgtcgtggtcaccccctctggctttggagtcagacatgcctgcatttggggtccagctctgacatgttagctatgtcactttgagcagattacttttttaaccttttccatccttggtttcctcatctgaaaaaaaagggggcaagggctaatatccacctcatagtattaccatatgtataacaggaagaaaaaaatgtaatgtaaaaaatgattgccatatttcttcattctggggggagcaggattcctcacagaggtgcttcactcatttgtggaggaataaacactttgttcaacttttttggttaagaaaagcagctgaggatccaattctcagctccttctctgatctcagagtgagaatagcccagaatggagatgtttgttcaaaagagttaaatttcctttgtataataaagtaacagtaatcagatattttcagggagaggtggagggcagtagagagatggagggaaaggattggggaaagggagaaatggctgcaggcagggctctgggaggcagagcagccaggaaaaagggtgctgggcacgctagtgtgacgattttcagcacttcctggtccgagtggtgctgtcacaatcctatgttgccctgacctttagttaaagtcttccaggcaaaatgaccttaagtcctgggagtctttggggaaagaagaaaagaaggggcccgcttgccatgaatgagagtgatgtgataagaggacaacattgtcagcaggcaggtgaaagtgcccaaattcagctggagcaggaattcataaggaaaagtgatcacaaaaaatgtcactccatgccccaagagtttttggaaatcttggctgggtgtggtggctcacacttgtaatcctagcactttgagaggtcaaggcaggaggatcacttgaagctgggagttcgagatcagcctgagcaataaagcaagacttcgtctctacaaaaaatacaacaacaacaacaacaaatttagctaggcatggtggcttgcacctctcaccccagatactcaggtggctgaggctggaggatcgcttgggcccaggagttcgagtctgcagtgagctatgactgggcaacagagcaagactctgtctcaaagtaaaaaaaataaaataaaataaaaatatatcttgggaaaacatggactttccagacttgggttgttaataaaacatgattcaagaacgcgggtaaaaattaagttacataaggattaaatgagagaatgtactaaagcaagtagctcagagcccagttcttgataagctttcaacttaaaatagcccttattattatgacttaatgttcaatttcctcttttcttcaccccttttacttcaagggctcacaatctacttaaaaatttcgatatagtcactcatttattctacaaacatttaccaaagtcctttgatgtgtcaggtaagttaaataatttcaggcagtagtaattgtcatagctaatgtttttgagggcttagtatatactaggtactgtgctaagtgctttacatagctttttaaatttaatcctcaacagtcctagggaggaacaattatattcctactttacaaatgaggttagagaatatggcacagtgaggtcaagagacttgccccagatcacacagctagccagtgggagagccaaggtggaacccaggctgttgaatttcagtgcacactttttttttttttttttttcctgagacggagtctcgctctgtcacccaggctggagtgcagtggcgtgatctcggctcactgcaacctccgcctcccgggttcacgccattctcctgcctcagcctccccagttgctgggactacaggagctcgccaccacgcccagctaattttttgtggtttttggtagagacagggtttcaccgtgttagccaggatggtctcaatctcctgacctcgtgatctgcctgcctcggcctcccaaagtgctgggattacaggcgtaagcccctgcgcccggcctagtgcatgcttttaagctccacgctacactattttgtatttaatttttttcttttt

SEQ ID NO: 152 - DNA, 1515 bp, Homo sapiens
ctccaccttttttggcctcgacggcggcaacccagcctccctcctaacgccctccgcctttgggaccaaccaggggagctcaagttagtagcagccaaggagaggcgctgccttgccaagactaaaaagggaggggagaagagaggaaaaaagcaagaatcccccacccctctcccgggcggagggggcgggaagagcgcgtcctggccaagccgagtagtgtcttccactcggtgcgtctctctaggagccgcgcgggaaggatgctggtccgcaggggcgcgcgcgcagggcccaggatgccgcggggctggaccgcgctttgcttgctgagtttgctgccttctgggttcatgagtcttgacaacaacggtactgctaccccagagttacctacccagggaacattttcaaatgtttctacaaatgtatcctaccaagaaactacaacacctagtacccttggaagtaccagcctgcaccctgtgtctcaacatggcaatgaggccacaacaaacatcacagaaacgacagtcaaattcacatctacctctgtgataacctcagtttatggaaacacaaactcttctgtccagtcacagacctctgtaatcagcacagtgttcaccaccccagccaacgtttcaactccagagacaaccttgaagcctagcctgtcacctggaaatgtttcagacctttcaaccactagcactagccttgcaacatctcccactaaaccctatacatcatcttctcctatcctaagtgacatcaaggcagaaatcaaatgttcaggcatcagagaagtgaaattgactcagggcatctgcctggagcaaaataagacctccagctgtgcggagtttaagaaggacaggggagagggcctggcccgagtgctgtgtggggaggagcaggctgatgctgatgctggggcccaggtatgctccctgctccttgcccagtctgaggtgaggcctcagtgtctactgctggtcttggccaacagaacagaaatttccagcaaactccaacttatgaaaaagcaccaatctgacctgaaaaagctggggatcctagatttcactgagcaagatgttgcaagccaccagagctattcccaaaagaccctgattgcactggtcacctcgggagccctgctggctgtcttgggcatcactggctatttcctgatgaatcgccgcagctggagccccacaggagaaaggctggatgctgcttctcttcctaaagcccccatcgaagaggcttccagccaccattcaatcattcatcaagtcttatgatgtgccagacactgcgcgaaatgtgccagaacatctgttatgtgccagacactgttcttgagactggggatacagcaaacactcatgaagcttataattctagcagaagaggacagtaaacaatgtcatctcagtaagtatatacatgtgttttcaggattgagagctatgaaaaacataaaatatattgagaataatggttggt

SEQ ID NO: 153 - protein, 348 aa, Homo sapiens
MLVRRGARAGPRMPRGWTALCLLSLLPSGFMSLDNNGTATPELPTQGTFSNVSTNVSYQETTTPSTLGSTSLHPVSQHGNEATTNITETTVKFTSTSVITSVYGNTNSSVQSQTSVISTVFTTPANVSTPETTLKPSLSPGNVSDLSTTSTSLATSPTKPYTSSSPILSDIKAEIKCSGIREVKLTQGICLEQNKTSSCAEFKKDRGEGLARVLCGEEQADADAGAQVCSLLLAQSEVRPQCLLLVLANRTEISSKLQLMKKHQSDLKKLGILDFTEQDVASHQSYSQKTLIALVTSGALLAVLGITGYFLMNRRSWSPTGERLDAASLPKAPIEEASSHHSIIHQVL

SEQ ID NO: 154 - DNA, 2836 bp, Homo sapiens
ctggagcccgaacaaacctccaccttttttggcctcgacggcggcaacccagcctccctcctaacgccctccgcctttgggaccaaccaggggagctcaagttagtagcagccaaggagaggcgctgccttgccaagactaaaaagggaggggagaagagaggaaaaaagcaagaatcccccacccctctcccgggcggagggggcgggaagagcgcgtcctggccaagccgagtagtgtcttccactcggtgcgtctctctaggagccgcgcgggaaggatgctggtccgcaggggcgcgcgcgcagggcccaggatgccgcggggctggaccgcgctttgcttgctgagtttgctgccttctgggttcatgagtcttgacaacaacggtactgctaccccagagttacctacccagggaacattttcaaatgtttctacaaatgtatcctaccaagaaactacaacacctagtacccttggaagtaccagcctgcaccctgtgtctcaacatggcaatgaggccacaacaaacatcacagaaacgacagtcaaattcacatctacctctgtgataacctcagtttatggaaacacaaactcttctgtccagtcacagacctctgtaatcagcacagtgttcaccaccccagccaacgtttcaactccagagacaaccttgaagcctagcctgtcacctggaaatgtttcagacctttcaaccactagcactagccttgcaacatctcccactaaaccctatacatcatcttctcctatcctaagtgacatcaaggcagaaatcaaatgttcaggcatcagagaagtgaaattgactcagggcatctgcctggagcaaaataagacctccagctgtgcggagtttaagaaggacaggggagagggcctggcccgagtgctgtgtggggaggagcaggctgatgctgatgctggggcccaggtatgctccctgctccttgcccagtctgaggtgaggcctcagtgtctactgctggtcttggccaacagaacagaaatttccagcaaactccaacttatgaaaaagcaccaatctgacctgaaaaagctggggatcctagatttcactgagcaagatgttgcaagccaccagagctattcccaaaagaccctgattgcactggtcacctcgggagccctgctggctgtcttgggcatcactggctatttcctgatgaatcgccgcagctggagccccacaggagaaaggctggagctggaaccctgaccactcttcaggaagaaaggagtctgcacatgcagctgcaccctccctccgatccttcctcccacctccccctcccccttctcccacccctgcccccacttcctgtttgggcccctctcccatccagtgtctcacagccctgcttaccagataatgctactttatttatacactgtctagggcgaagacccttattacacggaaaacggtggaggccagggctatagctcaggacctgggacctcccctgaggctcagggaaaggccagtgtgaaccgaggggctcaggaaaacgggaccggccaggccacctccagaaacggccattcagcaagacaacacgtggtggctgataccgaattgtgactcggctaggtggggcaaggctgggcagtgtccgagagagcacccctctctgcatctgaccacgtgctacccccatgctggaggtgacatctcttacgcccaacccttccccactgcacacacctcagaggctgttcttggggccctacaccttgaggaggggcaggtaaactcctgtcctttacacattcggctccctggagccagactctggtcttctttgggtaaacgtgtgacgggggaaagccaaggtctggagaagctcccaggaacaactgatggccttgcagcactcacacaggacccccttcccctaccccctcctctctgccgcaatacaggaacccccaggggaaagatgagcttttctaggctacaattttctcccaggaagctttgatttttaccgtttcttccctgtattttctttctctactttgaggaaaccaaagtaaccttttgcacctgctctcttgtaatgatatagccagaaaaacgtgttgccttgaaccacttccctcatctctcctccaagacactgtggacttggtcaccagctcctcccttgttctctaagttccactgagctccatgtgccccctctaccatttgcagagtcctgcacagttttctggctggagcctagaacaggcctcccaagttttaggacaaacagctcagttctagtctctctggggccacacagaaactctttttgggctcctttttctccctctggatcaaagtaggcaggaccatgggaccaggtcttggagctgagcctctcacctgtactcttccgaaaaatcctcttcctctgaggctggatcctagccttatcctctgatctccatggcttcctcctccctcctgccgactcctgggttgagctgttgcctcagtcccccaacagatgcttttctgtctctgcctccctcaccctgagccccttccttgctctgcacccccatatggtcatagcccagatcagctcctaacccttatcaccagctgcctcttctgtgggtgacccaggtccttgtttgctgttgatttctttccagaggggttgagcagggatcctggtttcaatgacggttggaaatagaaatttccagagaagagagtattgggtagatattttttctgaatacaaagtgatgtgtttaaatactgcaattaaagtgatactgaaacacatct

SEQ ID NO: 155 - protein, 328 aa, Homo sapiens
MLVRRGARAGPRMPRGWTALCLLSLLPSGFMSLDNNGTATPELPTQGTFSNVSTNVSYQETTTPSTLGSTSLHPVSQHGNEATTNITETTVKFTSTSVITSVYGNTNSSVQSQTSVISTVFTTPANVSTPETTLKPSLSPGNVSDLSTTSTSLATSPTKPYTSSSPILSDIKAEIKCSGIREVKLTQGICLEQNKTSSCAEFKKDRGEGLARVLCGEEQADADAGAQVCSLLLAQSEVRPQCLLLVLANRTEISSKLQLMKKHQSDLKKLGILDFTEQDVASHQSYSQKTLIALVTSGALLAVLGITGYFLMNRRSWSPTGERLELEP

SEQ ID NO: 156 - DNA, 864 bp, Homo sapiens
ctggagcccgaacaaacctccaccttttttggcctcgacggcggcaacccagcctccctcctaacgccctccgcctttgggaccaaccaggggagctcaagttagtagcagccaaggagaggcgctgccttgccaagactaaaaagggaggggagaagagaggaaaaaagcaagaatcccccacccctctcccgggcggagggggcgggaagagcgcgtcctggccaagccgagtagtgtcttccactcggtgcgtctctctaggagccgcgcgggaaggatgctggtccgcaggggcgcgcgcgcagggcccaggatgccgcggggctggaccgcgctttgcttgctgagtttgctgccttctgggttcatgagtcttgacaacaacggtactgctaccccagagttacctacccagggaacattttcaaatgtttctacaaatgtatcctaccaagaaactacaacacctagtacccttggaagtaccagcctgcaccctgtgtctcaacatggcaatgaggccacaacaaacatcacagaaacgacagtcaaattcacatctacctctgtgataacctcagtttatggaaacacaaactcttctgtccagtcacagacctctgtaatcagcacagtgttcaccaccccagccaacgtttcaactccagagacaaccttgaagcctagcctgtcacctggaaatgtttcagacctttcaaccactagcactagtccttgtttgctgttgatttctttccagaggggttgagcagggatcctggtttcaatgacggttggaaatagaaatttccagagaagagagtattgggtagatattttttctgaatacaaagtgatgtg

SEQ ID NO: 157 - protein, 209 aa, Homo sapiens
KGRGEERKKARIPHPSPGRRGREERVLAKPSSVFHSVRLSRSRAGRMLVRRGARAGPRMPRGWTALCLLSLLPSGFMSLDNNGTATPELPTQGTFSNVSTNVSYQETTTPSTLGSTSLHPVSQHGNEATTNITETTVKFTSTSVITSVYGNTNSSVQSQTSVISTVFTTPANVSTPETTLKPSLSPGNVSDLSTTSTSPCLLLISFQRG

SEQ ID NO: 158 - DNA, 2615 bp, Homo sapiens
ccttttttggcctcgacggcggcaacccagcctccctcctaacgccctccgcctttgggaccaaccaggggagctcaagttagtagcagccaaggagaggcgctgccttgccaagactaaaaagggaggggagaagagaggaaaaaagcaagaatcccccacccctctcccgggcggagggggcgggaagagcgcgtcctggccaagccgagtagtgtcttccactcggtgcgtctctctaggagccgcgcgggaaggatgctggtccgcaggggcgcgcgcgcagggcccaggatgccgcggggctggaccgcgctttgcttgctgagtttgctgccttctgggttcatgagtcttgacaacaacggtactgctaccccagagttacctacccagggaacattttcaaatgtttctacaaatgtatcctaccaagaaactacaacacctagtacccttggaagtaccagcctgcaccctgtgtctcaacatggcaatgaggccacaacaaacatcacagaaacgacagtcaaattcacatctacctctgtgataacctcagtttatggaaacacaaactcttctgtccagtcacagacctctgtaatcagcacagtgttcaccaccccagccaacgtttcaactccagagacaaccttgaagcctagcctgtcacctggaaatgtttcagacctttcaaccactagcactagccttgcaacatctcccactaaaccctatacatcatcttctcctatcctaagtgacatcaaggcagaaatcaaatgttcaggcatcagagaagtgaaattgactcagggcatctgcctggagcaaaataagacctccagctgtgcggagtttaagaaggacaggggagagggcctggcccgagtgctgtgtggggaggagcaggctgatgctgatgctggggcccaggtatgctccctgctccttgcccagtctgaggtgaggcctcagtgtctactgctggtcttggccaacagaacagaaatttccagcaaactccaacttatgaaaaagcaccaatctgacctgaaaaagctggggatcctagatttcactgagcaagatgttgcaagccaccagagctattcccaaaagaccctgattgcactggtcacctcgggagccctgctggctgtcttgggcatcactggctatttcctgatgaatcgccgcagctggagccccacaggagaaaggctgggcgaagacccttattacacggaaaacggtggaggccagggctatagctcaggacctgggacctcccctgaggctcagggaaaggccagtgtgaaccgaggggctcaggaaaacgggaccggccaggccacctccagaaacggccattcagcaagacaacacgtggtggctgataccgaattgtgactcggctaggtggggcaaggctgggcagtgtccgagagagcacccctctctgcatctgaccacgtgctacccccatgctggaggtgacatctcttacgcccaacccttccccactgcacacacctcagaggctgttcttggggccctacaccttgaggaggggcaggtaaactcctgtcctttacacattcggctccctggagccagactctggtcttctttgggtaaacgtgtgacgggggaaagccaaggtctggagaagctcccaggaacaactgatggccttgcagcactcacacaggacccccttcccctaccccctcctctctgccgcaatacaggaacccccaggggaaagatgagcttttctaggctacaattttctcccaggaagctttgatttttaccgtttcttccctgtattttctttctctactttgaggaaaccaaagtaaccttttgcacctgctctcttgtaatgatatagccagaaaaacgtgttgccttgaaccacttccctcatctctcctccaagacactgtggacttggtcaccagctcctcccttgttctctaagttccactgagctccatgtgccccctctaccatttgcagagtcctgcacagttttctggctggagcctagaacaggcctcccaagttttaggacaaacagctcagttctagtctctctggggccacacagaaactctttttgggctcctttttctccctctggatcaaagtaggcaggaccatgggaccaggtcttggagctgagcctctcacctgtactcttccgaaaaatcctcttcctctgaggctggatcctagccttatcctctgatctccatggcttcctcctccctcctgccgactcctgggttgagctgttgcctcagtcccccaacagatgcttttctgtctctgcctccctcaccctgagccccttccttgctctgcacccccatatggtcatagcccagatcagctcctaacccttatcaccagctgcctcttctgtgggtgacccaggtccttgtttgctgttgatttctttccagaggggttgagcagggatcctggtttcaatgacggttggaaatagaaatttccagagaagagagtattgggtagatattttttctgaatacaaagtgatgtgtttaaatactgcaattaaagtgatactgaaacac

SEQ ID NO: 159 - protein, 385 aa, Homo sapiens
MLVRRGARAGPRMPRGWTALCLLSLLPSGFMSLDNNGTATPELPTQGTFSNVSTNVSYQETTTPSTLGSTSLHPVSQHGNEATTNITETTVKFTSTSVITSVYGNTNSSVQSQTSVISTVFTTPANVSTPETTLKPSLSPGNVSDLSTTSTSLATSPTKPYTSSSPILSDIKAEIKCSGIREVKLTQGICLEQNKTSSCAEFKKDRGEGLARVLCGEEQADADAGAQVCSLLLAQSEVRPQCLLLVLANRTEISSKLQLMKKHQSDLKKLGILDFTEQDVASHQSYSQKTLIALVTSGALLAVLGITGYFLMNRRSWSPTGERLGEDPYYTENGGGQGYSSGPGTSPEAQGKASVNRGAQENGTGQATSRNGHSARQHVVADTEL

SEQ ID NO: 160 - DNA, 100534 bp, Mus musculus
  misc_feature (1)...(100534): n = A,T,C or G
gcaggaggatgagtgttcacggtcatctttgactaccgtagagtttaactccaggctaaactccacggggcttaaactcaaagagaataatgatgaggggaatttatggtcagaagtatggatgtggcatacataggaagtcatggtagtgttcagatgccccccccccatgtgacttgtttctgactaaattctgttagcaaatgcacactgggcaagccttgggggtgggagtcagtactgaggtagcttcttccatgaggagtacttggcctaacagagaaatgatgtgcataaattatcccaaatccccttctggggtgcgaagaaacaagagagtgttcctgttgcattctgtggcaactataacgggaaatgaaaaggttgaccaatgggagatggcagagcagaatgttggacagtcaaaggggcgggctgaatgaccaaacctgtgctttcaattgtaatgacccttggcctcacgtgctcttggaacctctcccaaggtaaaagtgacttcccctctgctatccgagggaaccatccgctagctgcttgcttttgctcctgctgtgttaacttctcccaacagccaagcccatgatcaagatgaatggctcccaggctgtggatgtccctctgagagtgacagtcaaggctggtgaagaggtgaccctggactgtgaggcccaaggctccccaactccactgctcacctggaccaaggatgccaaccctctactgcctgtcaccaacaggtacccagtcctagcatgtggggccaagcttgggtcggagagaaaatggtgtcaaggttgttgtgacctaagcaggtgcatatgaccttaagactcggggaagcctcaagagcttctgcaaatgtggctcatgacccagcacacaccttgcagatctgagcttctgcgtcccaggtcccgtaggtcatcttgcttcttgtttgcctaatgatttttgctttctgagctataccaagatgctgagggttcctgggctggagtgagaccctcagagtcactggagtaagaaaaaccagagcgagggtgggagatacatcttgaccaatacacaagtggcctccacagccactgtgtacagcaggtgtctggtggcttgtcctccttctctttactggggaccctgcaaggggcttttagtagcacagaattctgcctcaagagaagctgtccattgctacttccagccagtaagtgagtctctaaattcctggagtccttgacctggagtgggatagaggcaccgcagcacaggctgtgtgacatcagtcctggcaaagtctttgagacggctcagaccgagaaggtctccagcagttggctctcacccccaccacccccacgggtccctcagaacatctgcttcctgaatccttccaaacctcacagccgcggatctctgaattcacttggagcgcagagagctagtcctgggtgggctcttcagtgtccttgagcagccacgggatgagatgtgggtggnnnnnnnnnnnnnnnnnnnnccccccccccccccaccaaaaagctagtgtttactccttgccaggcggtggctgtggtgtttgtttatggcttgttactgaaatgggaagcaaattccagttgttcacccctccagtctgatgcgttaatggatcaacagggagtcataaatttcccagggcctcccgagcaacagcggtcatagaatgtgttttctccttttgcttttactggcatccttctggaagattcccactgcttttctctggacttgagggatgctgggagtttatctctaaggcagtcagcatgctcaggatagggagagagagacactagatgctccggcttctgttctgactggggagcacaggtggcccttggcgactctcagccatctttgacatctataaagtgaacatcctgcagatcctcctctcctggtgtgatggctcttcagagcttagatgccatagatggtgccattagctttatacctctgtcctgcggctgctgccgctgccgctgccgctcacagaggcattgccattggctttcaaacacttgtgatcctggggctggtaaaatggcacagcagtttagagcatatactgctcttacagaggacccaagttcagctcctagcatccagattaggtgggtcacaagcttctgtaactgcagctccaggagatcaatgccctcttctggcctctttgggtactgcacacacacacacacacacacacacacacgcacgcacaagcacacatgaaattaatctaaaaattgttttaagacaaccctgggcctagggagatgggtcagtgggttaagtgtctacatgagaacttaatttgattctcagtacccatgaaaaggccagatgtggtgtccagagactaaccctgtgtgtgcaaggagtggggcagacacgggaagctctctgagttcactagccactaaatcagtgaagcaagctcagtgagagagcttgttccaaaactaaggtggagaatgataggcggagacactcgttgacctctggcttccacatgtgtgtgcacacacaatgctcatcgtaccctgtctgttgtccttggaattgtcccatgactagcttttgggaatcccctctaatacaggatggctcccttctttcacctgcccagttcagcaggtcttattttcagtacatttacaattgtgcagagctcgccacaatcgactctagaacattcccgttactcgcaccaacagctaacgacatgcaggtcttcccatccctgggcggttgcttcgtgcctctgttcttttaattatcttctaaacaaacaagatgtgtgtgtttgaggttctttgggctttctaggagcctgaagctgagcacagacacagcatagctctactgccccgtcccccacattcagccactacatagagaactgaaggtgagacaggcatggacctactctctgtgctcctccagccctctcccctctcctctgcctactcctcttccttcttggaagagccccaaggctcagtttcaagactcattctaaaaaccaaagagctcacttccttccgtgagctggaggtacctgattgcctcaggatctagattggtctcagcatgcctccagtggccccttccctgccctctaacgttcttccttccctgagcaaagcctggcccaaaggtctgcctcctagaatggccttgccttgtttcagcatcccttgtaacgctgtggaagcggctggttggttggaatcaggatgtgccgggccgctacggcctcttctattccagtttggccacgagtggtgggcccagccagcagcaggccaccctggagtaggtgcggtaaatgttgtcatgctggggccacagaggcagagagggaaccaggagctgggggagggtgagctggatggagattttcttcttccctaggctggacacacaggtacagaatatacagacgtgaacacattcagatgcgcccagagagatgagacacacatacgcattcacatacacaatgcaggttaggatgccactgctttcccaagtacctagaaaagaatattctgaaccagggttgggaggggggtgtctctaatacccccaagtcagagcttactggagaaagtgagcttggggctggagaagccaagagaccctgacatccacctgagttcccctcctttccgatgaccttatacatacatgctcctatatgaatttggtgagtctggcttctgtctgggttctttcttgaatagccaaatgcctggcctttctgccctgctctgctggtgtgactatacgctatctcaaagggtaagtctgcattcaggctgccctggcgttactaagagctgttcttctgctcgggacatacacttctccaacagtttcactgttgtaagtggtgctgctgggtgactctgctcacatgctcctttctgcctcctgggtcacctcctttggggagcaggccccagggcacccagctaaggacaagattaagatatggtctttggctatctgatctcactgtcctggaactgttgtttttgcagaagcctcctagtcaccaatgcaaaaactaaagcaggctgcatggattggggacagctcatgctggctctgtgccagatcaaactagacactgaagggcctggggggaccctgcccagtgttacccaactcaaacaagatccatctcctcctcagaactcagtcttcccatttgagatgtgaaagggtccaacttgtgatggtagccagagagcatctctctcctcagctgggatactgggctggggcgtgttgctaggcaacaatgtttaatgtttgtttagggattctgctgtggagtgggggcagctggaagtgctcctggcttctgctcctgctcccaaggcatcaatccagggactcacacagggccagatccccaattccaaaaggggagtggtagtaagggaacatggctgctccaggcttccagttgtcagagtctcttcattctttgcctactctcttgcaccctgaaggacagccacccacctgtctccttatgggctgactgatgagagctagtgaccgaggatggactacctaagggccgggtgtggagctctctaccttggtggagcctcagagttagtgttggtggccattctggttctcagcctaccatgaccagtggctccctttgttaacttagcatcagaccccaaacttgtggaccctcaatgacacgatctgagggccaggtgccactgtttctggtcagctgagtgacatcagcaacagagcttctctctgacctctgctttgctaacatggtgatggtacccatgagggctctgtcctgaggtgtggctggggagtgtcaaatgagaagtcacccagcaggtacccaactgtgtaaatatctacaggaagcacacaagagctggcagccattgctgacatccgtgcaacccattcttccttctctcccctctcccccccccccccagattatcatgccctctcctcagatttcctagctcagctcttccatctgtgacttcctggtgagggattgtgccacttggatgaatggttctccactctgggcttagactgatgcacacacggcacacagtaggcatatgctgagaagtgtggacagtggacagggcagcatctccaacctccagtcctactgtgtactctttggggagaattgaaagcattgcagaatgaccttttatagccagaggcagcaagatgacccctgtagcaatggcagggaccaggacagacaagtaccaagattctcagcagcccaagaaaaagagcacagacactccagtcattaggaactgggggaggggagcactcccattgaatgaataaatgaacaagcttaggttctggaacattagcctgcatgggagtgtctggagaaacttcagggaagggctggagccagtcctgccttgaggaggtccagagagcagcatggctgtattgagactgttgttgccaaatattcatgtgcacctactatgtgctaaggactgcgacaaagtagaaacctgagcatacctgattcctcgaagataatgtcagagatcacttctgtgataaataccctaacggcttcaggagctggctggacagaggtgcacagggagggtaggcaggtgtgggctatggatgcttccaccaggtgcatttcccaccaggtgcatttcccaccagatacatttcccaccaggtgtacttcccaccaggtgtacctcccaccaagtatttcccaccagctgcacttcccatcaggtgtattttctaccaggtgtaatttccaccaagtatttcccaccaggtgcactttggaccatctgggcagatcaggtggtttgttggccactctctgcctgggaggttctgccagagtcagtgggtcccctgcaggtcctccatcccagccctctgacatctgtgtatgcctggccctggattgtgaggccccagccaatggacatcataaacaggaaactccccttgaatccaagtgctcccttgggtgctgtgaagagtcgtctggctgcagagccttggagaagccctcctattgatggagccccatccccagcagctcacggcttgaagagtctgtcgttctatatacctcctcccaggcctggccagcacttccctatgagctgcttggaaggttgcggggagggctctgggggaggggagcaggttgaatctgcctgctggaacctcctaaccagcacctcccaagcagctctatccagccctggactgggacagtggctttactttgtctctgagccttgttgggaattcatgctggtggccatagacgctgttctgtgcagggcctggtgataaagggtatccccctggagcctctggaagacaaagaggcttccagtgtcacagctgggtagagccatgggacaccacagatgggcttgccagcctggaggtatggagatggccttcttgaaagaagtggtacctgcctgaaggatggagaaaagggcaccccagcaggcgcagagctgcaggagtcagcctgagctctgaggggttggacagggcctgggaggttggacagggttgacagtgctgagagaggagatgcgctgcaaagatccctccaagccctgcccctgccccttgctatggccaccttggcacacagagcaaaaatctactcctctggacaggcccaggtcctctcaggccctgcaagtgtcagcttgcacatctgaaccgcgggtccacaggttttcatctcttctttatgatacagtgagcacccaccccctccaacttctgtaaaaaatgactgtaattggttataggaaagacaggtgccaagggcctggagtgtagttcagtttgtagagtaaatgtcgttggcttgcatgtcacccaacgctgtgtacagtgcctgctggatactcggaccagctagaaggttctggtagggaggttatcacctcacttacagatgagtggatagaggcaaggcagtgatgacagctaggatgtggttggaaaccatgcaccctggcaactgcatggagagatgtggggggctgcagggttggctcccacatctcctgccagggaccccgtgatacaattttgcagaggtagatgcttggtctcagcagggagggggtagggaaccaggctgaagcccatctgaatattgaaggtcacctctaggttgacaattgatcctggggtcctccagccccgatctgagcacttggccttggacttgtcagggccacaggctgcagcctctgttccttagggccagcacagatggagttgacatcatgtctgcagggctccttggggtccatcccagctgctggagtctggctagtggcctgtagccttgtgagaagggtcaggggactagtgaggtgggccagatctgggggagggtctgcaatgttccttctcatgggtccctgagatgcctctggacagtgactctccaagaggcctggttctgggcttaggagtctgagaactcagacactgggggcttggagctggtggacgacttttctctgaaagcagagggagtctagcctcctcacaaacagatgtgctgagggcaaggggcattgctaccaattggtgacgcatggagtttggggtgccagagcccccattttatagatgatgaaatggaaacccaggtcatgttctgggtcacacagctaagaaggaaggaaatgtggattgggacccaactatctctctacactgagagggtctgaccttgacttttggaggccaattaggggctggagttgaggccagaaggtagttgtgacttcagcctgggaaggctgcctggaggaggcagctgctagatccttgaaggtgggtcttcaagcctttctctggccagggtggaatgagatttcactggtgtccctcctccccacaggtatgagctcctcccatcaggctccctgcgcctggcacaggcccaggtgggtgacaatggcctttatgggtgtacagccagcaaccccgcgggggccacatctcgccgctacgtcctcagagttcaaggtagggctcacagacgattctcttactccatctctcatctccatgcctgccttgccctataacacctctcaggctccacagtgccagaccggccactcctctccctgacttcgggcctgggagagctgttaaaagaggcccaccaagatcagggctcagtggggaccaacactagagacacacaaggggcaatagttccgagagcctctatctgacggaagtcacgcttctgtaacaggcccactgatactgggagaggctcctggtcttccagccaccactgtagacctccctctctgtggccaaggtctaaatgtgcactcactgtggtcctgatccccagcacagttaggggtccctggagtggtcccattcaaaagaagtcatcccaagccagccacacaggagagccctgggcagaccataggacaggaccatgcatggcctagcccacgtgctactctcatggggcccaagagggaagggcagggagatagtgaacgttccacatcattgataatgacttgaaatctgttctcagagtctgtgggtaatggggaacagatgcacgtttcatctatgtccttcacaccccagctgggcgcctagacacatcatctgccctcgagatcaagttgcagatgctcaccggccctatccaagccagcttcccactttgcagatagataggctgaggcctggggtggggggtggagagaaaagatccctccctccccgcaagtgagaggagagtgaaggtggaaatgcgaggtggagctggaaacagcatagcagggttggagctcaatcagtgtctaccaatgtgctgtgtgatccctctgaaccttgtaacgtggggccacgatgatgcccaacctgtaatcattacaagggagtcctatatcaggtgctgagaacaaagaagcctgaggtatggcaaagatggtgggcatggcatagtgactgtggacatctccgagctcctgggccctttctgagcactgccaagcagctggcctgtgctaggttccaaagcctgggctcatgtttgactgtgtcttagagactgggacaatatcagggttctactcagcttccctgatggcgcaggagagcagctgggcctgggccctgcttatgctcctaacctgaacaggctgggccttccagaagctgtccggaccctcagacacacagacccagggctacggtcttcaggagagaaatctttacatgcttcagtttcctcatcttcaaactgggtgtggcactctccaccctgcaggaggactcacggggtagagtgtgagaaaatggttgagaaatgcaaacacagcccatagctgaggccgggggctgctgggagccagtgccatctcacctctcattctgacggcagcaaggggaagctggggctcagccggtgcatagcaccacggtgtggggaaggaagctgggcttgtgtagctgctcagactgcgctgctccaacctcaccaggccattctgagtttgtcctgccttcagtgcctcagtttccccatatgcccactaccctggtgtagaccagatggcacgtctcacatggcacagggcacactggtgagggaggacaggggataaatgcattgagagcatgcagcaggtgtccaggtggaagatggattctgctctttcagggtgtggggaagaccacataggtcctgacagctctgctttgcaataaggagcagctgccttagacgtcccaccctgggatgattttgctggttgctcatatcagggttgtaacatgggctgtggctctgagacccttaactggatagcccacctcgatgcccatccctggggccctgccagtcccccctcaggtgcagcctggccctcgggtcctgaaggtactggctggagaagcccttgacctgaactgtgtggccgaaggcaacccccaacctcagctgaactggttcaaggacgggatggccctgatgggcgagggagcccagggctctgtccactttgctgctgtcaagacctctgatgctgggctgtaccgctgtgaggcctccaatagcgctggcacagatacctggaagctggagctccttgtgctcggtgagtccctgagtccctccctccgccatgacccacacctctgagtactcgctgttctgggctctgctagtcaggtctgaagcagtaagtcctcagagcctccatgaaggctccatgatttgcagagaagacctgtggcctatgaccctaggggcctgaaggggacttttacaacatgggtaactcaggccatttaaaaaacaaaacaaaacaaaacaaaaacaaaaaacaaacaaacaaaacaaaacaaaaaacactgaaaggtgatccagtaataggcaaggccactaagaaattatgcatgacctacagaatattctggaatatcctagcattttcgctgttagagactggaagaaagacacagttggaaggacacctacaggaccctattatacatcttgtgtttgaggcacagggtccagcctcaaatactggcctccctgggaggatggaggctggcactctgggaggagacgcccctcctcccagcccttactgggagggaatgctggacctgagggttatgaacatgaccttgctacctctcacagagccaccacactgggggactgacgagaccaagagcctgctggagcgagtggccggagagaatgccagtctgccatgtcctgcccaaggtgaggccaagccccgggtgggactagggaagcagggctagctggattccaggaactcggccaccagatagtgacctccttgggttgtggaggtcactcagacaactctatagtataggtcaaagcatccttgacctcagcagctcgctctgcaaaagctgggcacctggaagagccctcaacaacactaaggtggcaggcaggagaacaggtgcttaagtagggactgggagccttgatcacagtgccacctagtgttggactctagaaatagcaggcagggacacaaccatgggcaagccacccaacctagccttccacttcaagctgttccacagtgtggcccgctcatatccctccccctctcatccttggaccggaagggctagacttcagcctcaccagcctcacccaaaggccctctgtagtgcaacctctctggactgttccacccccaggttgtatttggcactttccccaagggtggacagcaataggggctgggcctgagtgctaaagggcatagcatcatagcctggcacaaggaatacttacagacaccatcacttcccctccagggctgggatgtagccaggagcatggctgtcccaaatttggtcacactgtgaggggagggacaggacaggcagagtcaacagctcccactgtgcatgcccagctcagttggcacggtgagcatgctacgcacagcaggcttgctcattcacacagtacctagtgtgtgggctgtgctggtggcatagcaaggaacagtgaagaccctgaccctcatgggggaagatgctgagcagcaaaagctggcaggagtggactgtcagtcatttgaaagtcagtgttggcacagagaggagagctcagggctggcaggagatacctggaaggatacctctggcctccttgagagtcagaaagcatgtttttctcatgctcctatggacactcaaccctgtgtggagataggggacacatgctgaagatctgagggagcccctccccctcctcactctcctcctcttccttttcctcctcttcctcctcctgacatgggggtgacacagggcctgagaccacccatcatgaaagtcagcactatgtgcacagggggtcacatgaggggacagtgcaggcatggagggggtgtccgatatcttgcctgatgattctacataccctgccagggactccaaagccacgaatcacatggcggaggggcccatcctcagagcccctgaatggccggccagatgtggcggtgctggatgaagggtcgctgttcctgtcctcagtctctcttgcagacagcggggagtacgagtgccaggccaccaatgaggtgggctctgcatccaggagagccaagctggtggtctatggtaagctgaggccttagagctagagaccggggacaggtctgtttccacttaccacgtggagacccataatggtgccaggagccagggccccaaagcttcctacagagcagactatggacacctgattccttctccccaagagaccaggaaagattagggtttgagggtattgcgtggggcaccccattttgccaggtacatctaaagggacagtggaggcttctggggtgtcagctggtcaagatctgcagcaaaggctcagccactaacgtgctcgctgtgtaaccttgaggatctgagtctgatctcggcacccatggaaaagtcggggcaacacagtgtgcacctgtgctgggaaagctaggcatgcctgggagctcgctggccagccaggctagcctgctatgtgtttctaattcctttctaagcagagaaggtggctggcacttggggaattacatcccagattgtcctctggcctccacacacacaaggctagtaagaatagagctgagcagagttctagtccacctctaacccatgacggccttgtgtaatcacccacagcaggagctgcacccaagggtgccagcacagactccacaaggccagggcaggctgggagtgctccccctgctggcaggctgggagtgctccccctactgggatgcgccggacctctcagcctgagcagatctcacagccactttgtgtccccaattttctggggaataacttccctgggaggttggctagagacactggggtgggagtgggggggactgacctttggcacttcccactcggaacctcccttgtgtgatatctggttgcaggtagaactggctatgtcctgcttcgtagacggagtgtcggaatctggcatctgttcacagtgggggaggggaggtgctgatcccagggggaagctgctgtgtccacctgtgatccgtaggcccttgtggttagatcaggatagatgaaggcaggagagtctcccagggtctcagtgacgggctgatgacaggcctgaggaccgagggatggggctggatgtgggtggcccgccttagactctaagctcaaccaaagtgggagccactcttctgtttctcactgctccccaagtgccccccagcatccgggaagaggggcacataaccaacgtgtcgggcctagctggacagcccctgacgctggagtgtgacataaacggctttcctgcccctgaggtggcgtggctcaaggatgggcagctggtgggtgactccgggggaggttgggatggggaaggtgggacttttgggtgatgatatgtttctctgtgtgctaagggacatgggaatgtgacaaatgtccttgaggatgctggagttcagggacagtggggaactatcgtcctgagaggacttcctgagggtcctcttggggaactgagaactctgctctagtgaccacctccatgggcctctgttctctcattgcttatacatactccctctggcctcctgtgctcagatcccagaggcaagtggacatcgcctcttggatggctcccggtccctccacttccctaggatccaagagagccattctggcctctattcctgccaggctgagaatcaggcggggagcgcccagagagacttcaatcttgctgtgttcagtgagtgaggactgtgccccaaactcccaagcatgtgttagcagagaccaaagggtgcatgggggccaccacagacctaggccctatcctcaggagcccacagagcagaccacacaggggaccgtcacatgattagctaagcagtgccatccaggtagtcttagttgctgtgggggaaaggtaaccacggttcaaaggtacagtctattatattgatgtcatagccatgggagcttgaggtggctggtacatcacatccccacacaggaagcagagagagatggttgtcggtgctcagccagctttctgctttttaaaatgcagtccagaaccctagcctggtgatagagccacacatatttagggtgtgtcttcttacctcggttaacccattctagaaaattcctcacagacacaatgggagatttatttccatggcgattttaactttcatccagttgacaagattagccatcacagcggtgctacacaagagcagtacaggctgctgataagtctggggaaagggctcgtccagccatgtctgggagctcctcaggtggagggtgtacaggccaagggaccttcctgtggtcagcagggagtatggagtctgaggcatccccccttttcctcccttcccacccccagtccctccctccttgctgggagctggggccgctcaggaggtgcttggcctggctggtgctgatgtgacattggagtgtcagacctcaggggttcccacgccccaggtggaatggaccaaggatgggcagtgagtgattctctcggtggagtgggaggaggctgggtggtcagggaagcctgagaaagcctggcgggtgtgttatgtgctaccctgaattctgtgaagggcagcatgggtgtctctctcccgtgggagattcccaggaaacgctgccgccggcaccctggcctgattgatggcttttctctaggcctatccttccaggggatcctcacatcctgctgcaggaggatggccaagttctcagaattatcagcagtcacttaggtgacgaagggcagtatcagtgtgtggtcttcagcccagccggccagcaggccaaggactttcagctcagcattcactgtgagtccagtaccttccagccctagctggtccaggaacttgcttccctgcctcctgttgctgcctgggagggagagcgaggtcagaaacggggcctgagggtcaataacaggagccaagggcatatggcccctcatctccccaaactaccaactttatacactcactacttccgatgtgtgttgaacttacatttatctgagaacgccaaataaggcaagttagtatttcaaatgtcagtgggaagccagtgtccatcacatcagtggaaggaacaggaaaaattaatacattcagggctggggtggggctctgcagtggaatccctttgcctggatgggagaagccctaagtactataggtgatagcatagtggcctcagagggagcctttcctcactgccaccggggacaggagagttaggagggcatgggtctgggaagcaccaagaaacgcattcaaagagatggaggcagtcctcctaaggccaagcaatgggcgctcggcctgcatctgtgctctgtggtaacaaggggggctgagagcttagggaaaaggctcagttggtacagtgctcgctccacaagcctgtgagcccgagtctgaatccccagaactcatgtggctgctgggaagatcacctcacctagacagtcaccagcactgaggacactgagacaagtggactcttggggttctcaggccagctagcctagctgagctggtgagttccagagccagtgtcacaagcagtaagggacagggtctaatagaggaagacaccagatgtcgacctttgacctgtgtgtgtatgtgtgcgtgtgcgtgtgcgtgtgcgtgtgcgtgtgtgtgtgtgtgtgtgtacccacgtgcacatgttctgggaggcagagtgatgtcctactgtacccatgtacctcagccattgtcctgagtaccagctgtaagtaccctgccctaggggaagccctgatcaagttcctccacagatggggaccccgaggcccagagaggggaaaggacttaccccaggtcatacagtgagttagaagccctgtgggctccagaactcaagcctgcggcccctctccccatctgcaccatccctacccatagtgactggacttgctccccacattagcatgtccctgagctagcctcttccgtttgtgtccccatatccctcccttatccctcatgcctgccagtccctatagtagaagcctgggtgtgtgcatgctactcacgggacatccgccacctactcagtttgtctgtgaccaccctcatgtccctctctgtccccagcaccacccaccatctggggctcgaatgagacaggtgaggtgactgtcctggagggccacactgcacagctcctatgtgaggcccgaggaatgccatcccctgccatcacctggtacaaggatgggaccctgctggcccccagctcagaagtggtttacagcaagggcggccggcagctgcagctggtgaaggcccagccctccgatgctggcctctacacctgccaggccagcaaccctgcagggattacgaagaaatccaccagtctggaggtttatggtgagtggccagggggttgcagcagtgggcagctggtatagacaatgtgaggtgacctctgactgtctctaaaggtcagtgaggtgtggccacgaggtgatcgaatcaaatggggtgacttaaggacagcattcatttcagctctctaccttccctgtgcaaacaaggaaactgaggctggaggcagggcctgggtgcgagtctgtgggagtctagctccctctggaggactgtgagatcccctacaaaacttcccaaggtggcaaatatccctgatttacctctgtgtagcttaggacttagagcaagccccatagcctgcgactggtgctactgaaaacatttggcctcttgtgtccccatgggatggagaagcttatccggctcatatctcagggatacatgggctctgttcctccctgcaggggagagactgaattggcaaccctgaagggtggaactcagaaaaaaacggggagcactcttgagaaaggatgagggtaggcctgcgtcaggcagaacagggtgctctggggagttgggggacagcctgagagtcaataggagtcacttgacccctgttgaggagtcagcaaagggcttgggtgccagagtctggaggtgctgaactgtggaaagggtgggtcccaccgcagcacctgccaccaggggctcccatgaggctctgtcaccatctggagtgcaatgaaatgcacatgtccagtaccttctccaagagcctcagggccctaataaggtttgaagcatcttgaggccaagttcatgactgtacaaggtcctctagtggtgattctatgagctccacaactcagggcctgagggacatcacacacacacacacacacacacacacacacacacacacacacgcacgcactcacacacaccaggctgagtgagctctgagcacacttcaaatatcaggagtccccaagatcataccatcttggctcagatctactgtcccactttaagagtaaggagacttccagggtggcagcctagtctagagttttggagacccatcagtttgttaaacagacaggctggaatcctcctagtgacaagctttctgggtggcagtgagcacagaagagatacaagcaggggctggggaggtgagtctcttcctgcgagggtctgagaggcttgttggaagagagagactgtgcctgagtaaggtctagctaacagaatgaggctagggagtaaagcttcaactcctggcccctgagacggccctgcctcttccctagttccacctaccattgagggtgctgacggagggccatacctggtgcaggctgtggctgggagacccgtggcactggagtgtgtggccagaggccatccaccccctacgatctcctggcagcatgaagggctgccagtggtggacagtaatgggacatggctggaggcaggaggtgccctgcagctggagaacccaggagaggcatccggtggcctctacagctgtgtggccagcagccccgctggagaggctgtactgcagtactcagtggagatgcagggtgagccagctgtgggcgggtcttctcccatgcccactccatgtgtagccccagaggaggtggagggtggcagggaagccgcgtgttcccttttcctgtatgccacagatgaatagcgaggcctgggttgggaacgtgtggtgggagaggcaaggttgagttctggggttctgatcctcactccagcccacggctgtagaccaactcatccaggaaaggtggtgctctgctttctgtccagcatttctcagacccaaagctgggagtgggtatgagtcttgcttagctgacatttagcccatatgtggcccctgtgacataagacagagagaagactgcaagacagacagggctctgggctccgagtctgaggacagacatgaaataaatggtccctggggagggaggccacagaggcccctcttacgtcctttagtggccctgtaaggcctcctggggtgcatctgagggaagactagaaggctgtggggagaatggggccctggcatcactcaaggctcagatgagctccagccagcagcatgtcctgcccacagtgcccccacagctgctggtggctgaaggcatgggccaggtcactgccaccgtgggacagtctctggatcttccctgccaggcatcaggctccccagtgcccaccatccagtatgtacagaattgttcagggagtggacaggcagaatgtggtttggggtgaggggaaggtgagccatccctgattgatcatggtcattaagccatggaagagaggcttcaaagtgacctgaccccctctccatccacgtcagatggttacagaatggtcgcccagcagaggagctggctggggtgcagctggcctcacaggggaccatactgcacatcagccacgtggagctgaaccactcaggcctctttgcctgccaggccaccaacgaggcaggaacagctggggctgaggtggaggtctctgtgcatggtaagcaggttatctgtgaatctggggcactggggcaacctgagataatgggctagtggagctggagtccatgacagacctgggaatggcatggggcatgtctcctctgtgtggacatctagcctggacttccaaagacacgtgggtgggagaggcttgttacagatgctcatcatacctccaattcatcccgtccagctacctggagacatctttgcctcctgtttccactcagtctcatctaacatcactcaaatatttagttttaaatacctgctgtccaacttctgggtttgtctagctcccccttgattcttaggtctgccctttcttccaggaaggcttcttgattccaccacatgtgtcaacctcactgttgaggctctcagtgcctgccaccccactactctggagtggtttgtgtaactgtcctcttctctatgccagaaacatggtggtctcctttattttatctggggcctgaagtagttctagtcctagaatagacactctaacactcttatgtacacatatggataggttgatgggtgaatagttgattgggtgtatgggtaggtagttaggtgggtaccaagatggatggatggatggatggatagtttacttagtgaatgcataggctgggtggatgagtgggtgagtaggtagatggatgaatggacaggtacatgaatgaatggatagatcaatggatgtgtagatagatagataggtagatacatacatacatacatacatacatacatacatacatacatgaataaataggtaagtggatggatgtgtgggtgaatgaattgataactggatggatggatggatggatggatggatggatggatggatggatggatggatggatagatgggtagatgaatagatgggtggacggatggaaggatggatggatggatggatggatggatggatggatggatggatggatatgtgggtacatgaatagatgggtggatagatggatggatggatgatggatggatgagtgaatgggatggatgggtggatgaatggataagtgaatagttgggtagaaagatggatggatgggtagatggatattcgggtgaatgcatgaatgaatagatggataaatggatgcatagatggatatattaatgaatatgtgggtggatgaatagatgagtgaatgaatggataagtgaatagatgggtagatggatggttatgtgaatggatagatggatgaatatgtagatggatgtgtgagtggatcattggatctgtggatgtgtggattggcagaactttcaaagggaatgcactgtcctgttttctctcagtttggagctccttccattatccaggtgtttgaggagcaagggttctacagccattctttgaccaggccttcaaagccattccttcacttctagccatttaggggattgctggatatctaccacagccccccgaccccagcctgactcaggctctctcaatctctcctgtgcagagcttccttcagtgcacatcattggtggggagaacctcacagcccctttcctgcaacctgtaaccctccagtgtgtaggcattggagtgcctaccccaagccttcgctggtggaaagatggcgtggccgtggcaacctcagggggcaaccttcaggtacagttagggaaccaggactggctgtagaggtcctggagaccctgagcacagtctttacagaaaggtgggacaacagagccctctcagtgtgttcactttgaataggtacttgggtgttaggcctggggaatggagggatcccttagcctggtccaggccacggaagcttagcccccagagggaaaagacagagacgatatcatggagaagagagctcatttgcatgcttgcacctgcctatgggggccattcccacgttctgtcctctctccaactgtggcctggtcctggactttgtggcttcccctcatccccagacccttctctcccagattgagaaggcagacctgagagatgaaggtgtctacacgtgttcagccaccaacctggcaggggagagcaagaaggatgtaacactaaaggttctgggtgaggactgcagctcaatggggtccaaagcctggggacacctcaagggtcctcgagaccagaagtggaagttttagattcacaactgtgtgcttaaccttgtaaatggtggacaatgctgagatgaaccattagacgaagcatcccagatcccaatagaagacctgggagagagggatctggggatgagtggaagccacagagtccagacccttgcaaaggttttcactggtcaccttacccatgttaatggcttccttgctggctggagtcatgttttgggttcacatgtgtccctgacagtgtggacaaaccctgcctggttactccagggctacttgggattccagctcctgctgtgccagctttggtcctccctgggacgaggggttgggggctgggagccctgtggaacctccgggaagatcttataggccctgctcagatttggggcctttctaaaaggcaagctccctgctccaagtatgtgagctttgtcactggaaccctttaggagaaaccagaagagacacggggtatctgggattatagctgcccagagcccacatctaacaagaggggtctctctttgtaaccccctagttcctcccaacattgaaccaggcccagtcaacaaggcggttctggagaatgcctctgtgaccttggagtgtctggcatccggtgtcccccctccaggtaagccccatccccttggccggaagtcccctctagccagtcccaattccctgtggaaagaggctgcaagtgcccagaatcctgtatgcagctcaggaacaagcctgtaagagttctgtttagaggttatagcatccctggggctggtccaggctgtggttggggtttagaatcccctctatctgggcttctccagatcagttgaaggagaaggctggagcacttgggtgaatcatacaagtgaccacatccaggctagggtgggacttacccatgttccaaggagaaggctatttcctgtcccctcatgaacaaagacagccacttgctttgggtggctgagcccaggaggcacttagctcttgttgagccctggggaggaatgatgggccctggctgaacttaggaagcccagggcacagtgctccattcttgcctctgagaatgttgcccagggtgtcttcctctacactcctggcaagggtggctgtagggaaagaggcttggctggctttgactaactatccctggctgattagcccccatcttggaacttcctcttagcccccgatcttatctcctgtggtgctgctgtcctgtcctctctccccttcctaaaaacccccgattgtctctagcatcggaagaagcccatgcttgctctgcgagcttctcggaatgccccacagccaacatcaatagctgataggatacttacacgtcttttctctcccagacgtctcctggttcaagggtcgccagcccatctctacccagagacgggtgatagtgtcagctgatggaagagttcttcatattgagcgagtccagctttctgatgcagggagctaccgctgtgtggcgaccaatgtggcgggcagtgcagggctgaagtatggcctacgggtcaatggtgagtggctaagactacagggccttcccaaagtgcttagtttcttcccatttgtgtagccttctgtctcttgtccatttgcttttcagtttatctaccgttcgttcatctgcccattccccatctatacatctgtccatctgcccacctactattcacacacctatctttacattcacccaccacccacctatgtatccatacattcacccatatatctacttatctaccatctacttttccatctatccatttatttacagtctacccccacccacccaccgatctacctgcccattcacccactgaacatccatgcactcaactatccatccactcatccatccatccatccatccatccattcatccatctacccgcccattcaccactagcaatctagactttcactcattcatataaacaattattgcccatacattgagccaaccatctatgtattctaaacttctgttcatccatttactcagccatccagccttctatctatgtacacaaatatgtgcctatccatgactgatccactatccatccatccaatcctgtgcccatccatctcatctctattcccccatctaaactatagagacatagggaacatgagaaactgaatggagactgggtgttgaacaactttccctgacagcttgtgaacaaatgctaatacatcctgcctagggtcccagtggcaaaccaaagacaccattccacccaattccagcttggggagccaatgggtttactgggctcccttacaggagtatgggtgagggttttcttctaggagtatgaatgcaccccaaacaagaacattactaaaaacccccatctcagcatctcaaaggctgcatggataaagtctccttcggtcaatctcccacctcccatagcacctctagcatcctccagcactccccaatatcatgtgcagctggagaagagggagcagccctccccaccttctctttcagtgacagaatcccagcaggctcaatcttgtgaggatctcaaacaataagtcttagctgctccggtgaggataatagtcacggcatgcgtggaggccaaccttgccccacactgggcatgtgtggagcatacaaattaaggggcactggatgatggtggtagccatctggagctgtcagcttgggtctcatgggctgtgagagaggatagcttttgttctcctcttggctacagtgagatcttttggctgtggttttcccaggatgacagtgttacatctgagaccccacagtgtccccataataaatccccaagacctgagttcaagcgtggggtctgccacgttttagctgattagcctcggccaggtgaccctcctctctcagcctcagtctctcattagaagcctctggtgtgttgacacaatgcctactgcgtggctgcctgagttgcaatgtcacattctgcttttgtttgtgacttgtgctcctgagggtatactagaccatgtcacatgcaatggggctcaactctgttccctgtttccttgccaccacttttcagtgccaccccgaattaccctgccacccaacctaccaggcccagtactgcttggcacacccttccgcctgacctgtaatgccactggcaccccccgccccaccctgatatggctgaaggatggaaaccctgtgtctcctgaaggaatccctggcctcaaggtcagtagcattgggtggtctctgagctacctcctggtgtctcccatagggactggtagcagaggttaggccctggaagtctaggataagggagaggcagggcgtccctacttactgagataaggttcatgccaccagtgccagccaaatttgtcccctagagtgttttgtcaccacattgaaataagggaaaggggactatctatgatagtgcatgtccaaacccccatcactcaggaaactgaggcaggaggattgctatgacttcaaagtccagactgatcaacatagtgagttctaggccagtgtgattgacatagtgagacctgtctcaaccctccctcaaaaagaagtaatgaaaagggctggtgatgcagcagttgatagagcccccttgcctggcatgcatgaagccctggcttccatccccagcgctgcatcacttaggcatgccaacgcacctggaaagtactcaggaggtaaagttcaaggttattttcagctacgtgacaagttcgagatcagcctggactacaggtgaccttctctcaaaacaataaaacaaaaaaagcaaaacaaatttttgttttgtttctgagctagggtctctttatgtaactggggctgtcctggaactcattatgtagcatgtagaccaggctggcttgaactcatagagatctgctggtctctgcttcccaagtgctggcattaaaggtgacccactccatgtgtagcaaaagcaaagcaatttaaatgttatcaagtccaatataaaaaaaaaatgttccttttgccatgtgacccatattaaaaagtcactcataagacattccatgtgcttctcacgccaactctgagtttgtgttttttatacacatggcccactcaatttaatatcctcttgaggtcttctggcttcgcatggcaaatggccactgtagtgggcataatggctccaggtgactcttctagaaacagataaaactgccaccagccagcaggggtcctgaggtcaggggtacagcttgtgactctcctgctttgggggacccccaggggtctagagcaggatccaggcaggtgtggtatgagagagggctggcttgtaagggcaggtaccatccctgtagtaagagctgtgtttaatgcggacttgcctctggggttacaggtcttccccggaggacaggtcctcactgtggccagtgcccgtgcctctgattcgggcagctactcctgtgtagcagtgagtgctgtgggtgaggatcgccgggatgtcatcctgcaagttcacagtgagtctctagcctgggactgggcaggggcagagggaacattgctgtaggtcagccattccaagaagctgaactggggcagccatgtgcccagggacagctagggtccagatggaagagttaccacctgaccttgtggttgccagtagacactggagggctgtcctggggcatgagcatccctgtgggtgtgcaggtagcaggcaggtggccacctatggccaggagtggttagagaagaagccacatggttggggcaatatgcacactcaggagggaagcccagtggtttctggctcccaaactgacaggggtaggactcagcaggtagccttattaccaagtctacaaagcaacactgaggtggccaggctacagatgtagctttcttcccctggggtttgctcctggctgtggggatcgggctaagccagctcctctgtgacctctcctgatggcccatcgcttgcaagggttccttccatgtctgcacccacagtgccccccagcatcctcggagaagagctaaacatgtccgtcgtcgtaaatgagtcagtgaccctggagtgccagagccatgcagtgccaccacccgtgctgagatggcagaaggacgggagacccctgcagcctcaccctgggatccgcctctctgcagacaaggccttgctggaggtgtgccacagtgtggctggctgccccggggagttgaatgagcagggcagggcagggcaggacttaagggtgtcccaggtccctgtgagcattgttcagctcagtgtgaccaatcatcacccaccaggagacagagttctcagagtctccctcagaaccctggcatatgctggctgcccctccctcccctgcccctgtcttgtgatttgaccattctccgaggcacaccgttcatctcctctcctttccttcatcctccaaagccacggtgcagtctcattactccccccacgtccccaccccatcagggtcagactctagatggcagatcatttacccatcatccttcactgtccagcttctcctctggttgactctaagggcgttctgagggctgtgggaatggatgaagggctggtgtaggactggatcaccatgtgcccagcctcttagcaaatctgaactatgtatgtgatgtagaggagccagaacagcgccacagagaggccctggcttctagaaacctcttggtggtgccctgggcagggagatgcttcacactccagacagggaatgtgctaatgaggtcatggggcatgatgaggctgacaaggtctgtctaggggtgacacagcctttgctttgctcctggccaggtggaccgagcggcggtgtgggatgcaggccactacacctgtgaagctattaaccaggcaggccgctctgagaaacacttcaacttgcatgtctggggtgagggtctccaggtccctggaagaagggatacccatttgagcctcaggctacaaccctccctagcctaccccactccccagcacaccccccaactcctgtctgctctgaaccagtccctccagcgttcccctcaaaggagccctacactctcactgtgactgagggacagaccgccagactgtcgtgtgactgccagggcattcctttccccaagatctcatggaggaaagatggtaggatggctacccccaaccagtgccccctcacccagcaccccctcacccagtactcccttacccaggaccccctcacctaacacccccttactcactacccccttacccagtaccccttacccagcaccccctcacccagtacctcctcactcagtacctccccacccagtaccttctcacccagtatcccctcacccagcaccccctcacccagcacctcctcactcaataccccctcacccagtaccttctcacccagcacctcctcactcagtaccccctcacccagtaccttctcacccagcacctcctcactcagtaccccctcaccgagcacccccatccagtacctgagtgcctcagtgaatgggtgagttttcagcccttagtccccagccagctacagagtgctgctttcccagtctctctctgcttggccccacctgcaggccccttctagcctgtgacagtaggctgatcttcagtccccaaatccctgttatttctgctaggatgccatttcctaagccctggctgggcaggtgacaaacagaaagttagggagcgagtctgggcctagggagtaggtgacaaagggaaaggcacatgcggccaggatttggaattttaagttatgtggccgggatgtttgacccaaggtgagagataatgccgagcaaagggaaacattccaggccgaggtcatggtaggtgtaaaggccctgaggcagaagcaaggcaggcatgttttggggaacagcagaggggtcagtaggactacagcaaagtcagccagaaaagatgtagtggggaaatggcccacagagcagtggagtgtgagcctggggcccttgtgaagggcttggctttgcctccagtggggcagggcacgctcagagctccaaagttgagagtatggcagctcagaggttgccagaactctgggaaggcttcctggaggaggtgtcatacatgggggcatctggaggaggagctagtggttggaaggcccactgttccttgagaaaggacctcaagtccctggacaagaaccttttctcactgccccaggtcagcccctgcctggggagggggacagcctggaacaggtgttggcagtcgggaggctgctgtacctgggacaggcccagtcggcccaggaggggacatatacctgtgaatgcagcaatgcagccgggaccagcagccaggagcagtcgctggaggttctgggtgagccctgccaggctggggaggatgggtgagtgggtggatctgaaacctagaacacacggtgggggagggggcatagcaaggctgggcatgtgtctgtccttccagtctagactctgaactccccagttgtgcatacaggagggatgtgtgcatacagggacgcaggccctgtgtggctctgaaatgtttagaaaagagtgtacaaagagctcctatagtgcccacgcatggcgacatgaatcctgctagaggaacaactgagggtgattctgtctgtagacctcaggcttccacatgctcgcatatctgcacacacatgtgaatgcacataagccaacatgctacatgcaacacacatacacatgtgtgtgcgcgcaaggggaaaaaaagaaaagaaatattctggccttgtaaaaaccatgctctcgggatgaggccgctgctgggttggtagagtgcttgccgagagtataatccaaactcctgggaagggaggcaggagatcaggagttcaaggccatcctcagtcacacagtgagttcaaggccagcctgagctgcatgacacagcagatgtgctagagaacaagtcccacaaaggcactgggcactgcagtccctactggagaggctcagcagaaggaacacacattcaaagcaagcacgggcaacccagagaaactccagctcttgagactgaaagtacacagaccaagaatggtgggctctattccccaaggagcggcccactcagatccccagtgtgtctgagaggtcacccaaggatgaagcagtcactctgtcacagagatggaaaaggctgagacaggggaagtgacagtaaggtcacacagcgtgtcatgcaaggaggaacatccatctaaatggccgtgtccagcaaggccttagtatccgtcctgcctggtactagctggccctaactgctttcactgatgggtccctcttcacctcagttcctcctcaggtcactggcctctgggagcccctcacaacagtctccgtgatccaggatggaaacaccaccctggcctgtaatgccacagggaagcccctcccagtggtgacatggcagagggatggtcagcctgtctcggtggaacccggcttgcggcttcagaatcagaaccacagcctacacgtggaacgggctcaggcctcccacgccggcggctacagctgtgtggctgagaatacagctgggcgtgccgagaggaggtttgcactgtctgtgctgggtgaggaccagtggcctgtggggaggacagagagactggggccaagcaaggcccaaacacagcttgatgcaggcagctcttggggcttcttcaatctgggctttgatgagggctgccactgagggccatggacaacagggccctcagtatggctgttctcagaacacccatctcctcccttccctctctcccacattggcttttcccaaccctgtcaattcacggtctatgtggctagtgtcatgttcttgggggacaatgggtaggaaagccagggagaccatacacattgtagaagaatctagatgcttgtctgggggaggtggccttggggttgtagctgaaagactacgtaagagttggaaggcttcttgggtatgctggaacccactatcacccctattgtgtacctgggtctattgcagggggaggcaggatatggttctggagaaggctgggaagggggtgggagcacggtgggttaggaaggctcctcccatcagccccagttttaagctttctgtgccttgccatcccactggtagaaggtaggagataattccacaaagacagcactgctacttcacccaggggtaagtgtgggctcacctttgttggcatgccaccctgcttggctcctgccctgtaacaggtactattgtctctacctcttgaatgctaatgcaattgaatgttaattcaaatgtctatgagagtgtaggaatgaatagtgatggcatgtgtgtgttctgggtcccaggtgggtcttatataatgtgtgccaaatgggtgcatttggctaggtatagctcatttagcattctgccaacaaactcctgggtaccatggccagaactgaacaagccaggccctgtcaccctagcattcaagaggtagagacgagaagatgagggattcaagatcatccttggctacatagcaagttggaggccagcccggatacaaaagacactgtcttgaaagaaaggacagagagagagagagagagagagagagagagagagagagagagagagagagagagaatcctctcttatatacctctgaaaggatagggaaactgaggcctgagatgcccgcctgatcccaaaggcccacttatggccaaaattaatgcccttgtagctatcacatctttgatgaaagcagctggaaccctcccagtccttgacccctcccagctcctggtccctcccagtggggctgcgagtccctggacagacagagctcaagtgccaagctcctgtctatactctgaatacagttctccctgtgtctagcacctcctcatcttactggagactcagactcactgaccaatgtcactgctaccttacacggctccttcacactgctctgtgaagctgcaggggtcccggccccaacagtccagtggtttcaggaaggacagccaatcagccccagagagggcacctatctcttggcaggtaaggcactaagccaggtgtgtttcgggatcagcctgtcagatgcctatgacctctgaccctgagctgtcaggcctcagtgacccattagttgtggaattacaaaacacatttcccactttgtagaagttgtctgatccattgtataaacaggaacacagagatgggaactaggccctgcagaaaggggactgagaattaattcataatgtctgccatgagtgtgggactaacagtgatgtgtgtgtgtgtgtgtgtgtgtgtgtgtgtgtgtgtgtgtgtgttttctgccccacgtggtcttacaagatctgtggttctctggggaactgactctacttcaaaggtccctggaggagaaggcttttcttttctgggcctcttgagacaaaatgagcatctgaaatagaccagggctttgtagctctctgttgtctctcagccctagcccagagccgcatagagccagcacttcagttccttcttgcctgaagacgttgtgctctatccagactgtctcgggcacatctggttccctacttgaagaactaggaagcagatgcttgcatattagtgtttgacatcatgggcagagagaggctgctgagcctacaccttcccttcccttccctccccaggtggctggatgctgaagatgacccaggcacaggagcaggacagaggcctctattcgtgcctggccagcaatgaggctggggaggcacggaggaacttcagtgtagaggtcttgggtaggacgcatctctatgttctcaggagcaccaggagccttctccttccgctgggacacttctggggcaggcagagaatgggaggctctgattccctcgcttcatatctttgttctgggggctgcagaggtggctcagtcaataaagtgcttgctgtgcaagtgtgtggccctgcgtttggtcccagagcccaaggacaaggaaaacaatatgggtgtggtgtcactcactcagaatcccaacccttaggggctgcagacaggaaaagccctgagttccctggctggccagcctagcctgctcaggaattctgggccagagaccctggggattctttaatttcatttttatttttaagtgggtgatccctggggaatgaaacttaaggcttaatctttggcctctatacacatatgcattcccatacatgtgtgaacgcatcacacattcacacaatacacacacataacacatatacgccacatacatcatatacacaatatataccataaacacaaacacacaaggcatacacaatatattcaccatgcacacatgtaccacacacacacatacatgtcacaaatcacgcatacatatacacaacacatatcatatacatacacactatacacatatatcatacacacgtatatacaccatacacacatgtactgtacatatacacatatacatataccacaaaccactcatacatatacatataccacacacacacgcataaataccacaaaccattcacacacacatgcacacacaccactcacacacatgcacacataccacacatacacataaataaacatacacaccacatactacatacacatactcacacacacacacacacatatacatacataccctctgttgtgaatatgtggtcaaatttttccagaaacagtaagaatcaattcaaagttgggacagcagatagtcagaaccacacgcacttgtctgttcagagtctcccagcagcaacaatacactacactgactctgggtaggagtaaggggagtggggaactgaggcacaggaaacgtagcttcccactctgtggatgggccacccagttggcaactgtttgtctcccttctcctcctagttcctcccagcattgaaaatgaagacttggaggaagtgatcaaggtgcctgagggacagactgcccagctggagtgcaacgccacaggtgagggtgatgcagcacagcgagcccgccttagctggtccccaaccctgggactacccaccaagaatctacattttccctgtctgtgtcaggccttgtttgtgttcacgtattgtttgctctgctctttgctgactacagtgacgtgccaaaaccttcccaggtcctcactgcacgaggacccccttgccccaccccactgaccacacataaaaccataataaactgtgctggctgagatccctgactccatggctcccccactgcctggaagactgggctccctctgattcttgggggttgaagggtggaaatttgtgtagataaagagaaagacagtgaatgaatgaatgaatgaatgaatgggagaatagatagattctattctatctattaggtgtttgactaaagatgatagatgataaatgaatgagtgaatgatggatgggtaggtggatggatgggtgggtgggtggatggatggatgatgggtggatggatggatggatggatgggtaatagatgggtgggtgaatgaatggatgggtggatgatggatggatggatggatggatgggtggatgggtggatggatgaggatatagaagaatggactaataggtggaaaaatacatgtgtcttaagtgagtaggaagatagatggacagatggatagaaagatccattcatgagcatgcagtaaggtaggaagacagatagatgggtcgaaggatggacagacaaaggaaggatagatggacaaatggatcttgcctgtctgtgccaggccatctctgcccagttcccagtaaggcaatggagttcctgaagaaaggcccaggctatccctgctgtatgtcctaaatgaggatgcaaacgccacatctgtactagacaggagtctcctgtgacccctgagcccacctggtcagagcctgctgaaggatctcactgtctcctctttgtttaggccacccaccgcccaaggtcacatggttcaaagatggccagtccctgactgttgaagacccttatgagatgtccccagatggggccttcctgtggatcccccaggccaatctgtccaatgctggccactattcttgcattgctagcaatgctgtgggggagaagaccaaacacacacagctcagtgtcctgggtgagtgctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagacctgtaaccccacaggcaagtccgcattaaacacagctcttactacagggatggtacctgcccttacaagccagccctctctcataccacacctgcctggatcctgctctagacccctgggggtcccccaaagcaggagagtcacaagctgtacccctgacctcaggacccctgctgggtgccccccccccccgttccacatccccatcaccggatgctgcaggagggaaccccaagtttccacaagcaaccactatggaaggagcaactagatctccatagcaacccctgctggggaccaggctttctgcacagaggtctttcctgtgacagttcatgcccaaactgtaacactaccccctgcaggagtaggaaaagaaagtttaggatccaagaagcagttagaccaaaagcccccccccctccctcctcctcttcctcagaaccaagaaggttttgattgaataaatagcaagggcacatgttaagtgaatgttgagggacactggtcgttcatctcgtcctgtaacctggtgggggagggcttggctgccctgagctgcatttcccactctcctcacacaacgcagcaccaagaagaagcatagggtcctagctgtcctggtcattagagtgcccaggcccaggctggaccctgtttgccaaggccttcctgcctcaccctgacagtggttcccaccatcctgggagtgccagagaagaatgccaacgaggaagtgactgtgaccatcaacaatcctatttccttgatctgtgaggctctggcctttccatcccccaatatcacctggatgaaggatgggtcgccctttgaggcctcaaaaaacattcagctcctcccaggtgatgcccctggggtgggctttgaaaggatagatgactcgtccctgagctgggtcaatctgagcacgtgtctatggtgaaaccctgtttgggataactctgtccatggatccccaagcaggtacccacggactacagatcctgaatgcccagaaggaagatgccggccagtacacctgtgtagtcaccaatgagctgggggaggcgacaaagaactaccatgtggaagtgctcagtgagcccccaccaccccggggacattggctggacaggcagaagagtgctgccacacttgagaccctaggactcctccctgtgactgtctttcctgagagtcacagacagccgaggggaggggaatctctgccatttaccaccctgccttgtgggaaaggaaggctagtgttaagactttggacatgttgcccccatgcctcccccagttctggctttctactggtatggacgtgcaacctggggtccctcagtttgatacctgggcctccaaaaggccctctagaggccaccacagaccccccccccccacgcctgcttcataacccctgtcccttagccctctccgaccctaagtaggtacaggttgtgttcctttctagaatcatatttacctgccccctcctcagggagctatccctagggccagtgggtcagggtctcaggaccccccaggcccactcctcatacagcctgtggcttttcagttcccccttccatctccaaagatgaccccttgggggaggtcagcgtgaaggaagtgaagaccaaggtcaacagctctctgaccctggagtgtgaatgctgggccacacccccgccctccatcagctggtacaaagacggaagggtgcgtgctggactccagacaacctaagatgctcgctcatctgtcagtctcactagccctgcttggacctttccagacagaagccctgaaagtacctagccccagagcaggccctgctcacccttcagtttttaatgataacaaaacaaacccttcccaactgttgagctcttctgtccactcttttgcttcttttctgcttttgagaacatgcaggcttggtttgatggagtcatagacaatcccatcactttacattatggtctgatttttatttattaaaatatagagtagggtgtctggtaggacatacttgtaatacctgcacttagaaaacttgatgtaggagggtcaagagttcaaggtcatccttggctacctagtgagtttgaagtcagcctgggctacatgagaccctatctcaaagcaaataaacagataattttgatttttcatcttgtccctcagcctgtgacccccagccaccggctcagtgtcctgggggaggggcggctgctccagatccaacccacacaggtctctgactctggccgatacctgtgtgtggccaccaatgtggctggcgaggacgaccaggacttcaatgttctcatccaaggtgcgtgtggtactactgtagggtgggctgggtgacagcaaccagtggcccaagacaggatgctgcctccaagtagaagggtgtgacacagggcagggacattagctgggcaccaggagccctctactccacataagcattctccacagaccatctgtctcaacatctcagatgaggaatggttctattttctgtgactgaggaatgcgtttcagaagatggtagctccagcctcaaatcaggattaagtggccaggaggcaggcagaaaaggcagagagaaagaaaagctagagagggtccaagggggctgaggagaggcagggagggaagctgggaggctgcaagggagactgggaggtagggaggctggaagagaggctggaaggctgcaagggaggctggaaagctgcaagggaggcagggaggctgcaagggaggcagggaggctgcaaaggaggcagggaggcttcaagggaggctaggaggctgggaggtagggaggctgcaagggaggaagggaggctgggagacagggaggcagagaggctgagagggacacaggaaaggaaacagggaggctagaggtcaagtcaaatgaaggaaggacaggttttgccacacagtacttggtagtgacctgacaagaatgcaccctttctcctctgtcacatgtggccctcaaccacctctctctgtcatcgctgctgtcttagtgcctgttctattgctgtgaagagacaccatgaccacagcaacttttataaggataacatttaattggagctggtttataggttcagaagttcagtccattatcatcgtggcgagatatggccgtgtccaggcaggcgtggtgctggagatggagtgcagggtgctccttctctaaaggagcttgatccaaaggcagcggagggaactgtgtcctacattaggcctaacttgagcttatatgtgagacctcaaagcctgcctgcccccagagacacatttcctccaaaaaggccacacctcctaacagtgctactccctatgggccaagcatgcaaacacaggactctatggggccaagcctattcaaaccaccacagctgagctgtatgacctgtgggccttggttttgtcctttgcaaaatgcaggtattctaagccaggcctggtggcacatgcctttaatcccagcaccccgaggcaaagacaggtggatctccgagagtttgaggccggttggggttacacagtaaaaccctgtctcaaagaaagaaaaagcgaaaggtacaggtgatctgactaaaggggccttgggccccttcaggtcttaactacaaagagctttgtgcctctgagtacagacgagcaaatgcaggctagccctggcaacagcctaactcccttcaagaagctctccatgttacaaagtcattgttatcttatttcattttgttcttctgagcaaaagtctttgagccaaagtcttcctgtaacccaggctggcctggcattgtggtcctcttgcctcagcctctaagtgctagggtgacaggtgtgcccctggtcttctctgaggccagttagatgtgaggtccacagaacaagtggcttttcctgaagctcatgtggcagcttcgcaggcagtccctaggggaacgaagagatgtcttggcctgactacagggagcggcttgtgtggcagggtgtggcagtgcctcctgggcagtttggcagtagtggtgagcacccttaaccctatattgtattcctaatggcttggtcttcctccgtgcagtgccccctatgttccagaagatgggcgatgttgatgcaggctttgagcccctgccccatgaggaggaggcccagggcagggtgacagagtacagagagattgtggagaacaacccagcttacctgtactgcgataccaatgccattccaccaccagagctcacgtggtacagggagggtcagcccctgtcagctgctgatggggtctcggtactgcaaggtaggtggatgctgcttgaaaggtgaccaccccagagcatccctgaaacttgcaaacagaggataacgattgcatggggttgctttctgtgcctagcttttaaaatgagctttccagcccaggccagagcccatatctggacttcaggatctccattgacctcgaatgctcagaaaatggtgtgattctctagggcggcggttttcaacctgtggctcatagccccttgtgggtcacatatcagataccctgcatctaagatatttacattatgattcataacagtagcaaaattacagttatgaagtagcaacaaaataacattttgcttagggtcacaacaggaggaactgtattaaagggtcacagcatgggaaaggtggagaactgctgctctagggagaggtggatctctttatgtaaagattctgaggcaggacagcaatggggattagaggctgagcccctaaagtacctgccagccaagcaggaactcaagttaatcctcagactcatggaaaagccaggagtgccagtacatgccataatcccagcactgcagaggaagaggcagaggcagaggcagaggcagaggcagaggcagaggcagaggcagaggcagaggcagaggcagaggcagaggcagaggcagaggcagaggcagaggcagaggcagaggcagaggcagaggcagaggcagaggcagaggcagaggcagaggcagaggcaggaggcaggaggcaggaggcaggaggcagaggcagaggcagaggcaggcaaatccctggggctcactggacagtcactctactcaaaaaaaaaaaaaaaaaaaaaaaacaagccagtgagagaccctgtatcaaaaaataatatggacagcttcagacggaaaacacttcaaaattgacctctggccaattacgatcccatgcaagatcttctctctggcttttgaggtctaatgctatcttcatagtttacagattacaaaatttttctactttcattttaccatttaaaatatttccttattagaggttttatcaattgtttaagtggaccttatttcgagatatcttttatgaatggctttgaaatggaaggccctggactgaggcttagagatgcctggcttccctttgcctgtcccgcccccaccacagactgttgctgttcaggctgcagtagctcccggggcaggagggtgccctggctcagcatctgcatggtggcctgccaggctcagccctgaagctgggctggggacaggaagtcagttacaacagtctctgatgagaagatgccgtgcatgtggaggttgtccatattggaaattcctggactgacctctaacctcctgctgacctcagaccgggaccccagactcatatcctggggctcagccctggggagatccctaatgcaggttccaaacacaagctgatcccagctatcagttaatccctgaccccagctactgacttggctctcatgttagcatggatcacacccactgctggcctctgaccctgctaccaaccctgagcatgttaaggttgagttcactatagatcctcgtcacaaatccagcccagacctcacctgagctccactgtggccttagcctcccctgcatagctctgcatgtcgagagaccctgtttctgacctcgatcaaaccacatccacagccttggctggtgactccccgacctggaatctttagcacacagtagccctacatatagaccaggttctgctcttggctgcctcctagtcacaaagggtcccacataattcctctcctgcccccctgctgccaccgtcctagaagctaaccttgcctctgagaatgccttctctgacctttgcccagttagccaactccaccctattgctaaccctgttggaagcttcatttttccatctgtgaaatgggctacttacagtactcatgctactgagcctgcatctgggacctggcctttaactgagcaaggacgtaatctttccttgacctaaatttcttcacttcccagaccaggcagggagcaatggtgatgtctcgggccctccagaagagaaacagtttccttgctctgaattcagggctcttcccctgagctcaggcccctgtcctgtgtccttgcaggaggccgaatcctgcagctgcctcttgtgcaggcagaggatgcgggcaggtactcctgcaaggctgccaatgaggtgggcgaggactggctacattacgaactactggtgttgagtgagtgtccctggtgaggagggacagggaggctctggtcccagagaggcctccttctgaagggccctgggaggcgggggcacaatccctctgggctcagaaggtttgtaatagggttgcaagcttgggctttgaagccaagcagaagtgaagtggctttgaagtcccagatggccactgtcttatatgtaactttgagtagaccataatctctcagaagcccaaatttcttagctgcttccagtcctgagagatttcgtgagatgagcacaagaacaccccagccagcatctgggactgacttgggttcaccccagcccaacacctaaaccatttctccttctctcctcgcacccagcaccaccagtgatcccgggagacacacaggagctggtagaggaggtgacagtgaacgctagcagtgctgtcagcctagagtgcccagccctggggaacccagcacctgctgtgtcatggttccagaatgggctgcctgtgtcccccagcccacggctgcaggtcctagaggagggacaggtcttgaaggtgagaacagatccctctcagagtaaaagcactaggaaccaagggacagtgtcatctgggccacataaaggccccttagagtatgggatgtcaccttcacagcatatggcatctgtgaggtgtacagctggtcatacagtgctcataagcatcagtcactcctggcaaatcaggagcacttgtgccacacccagggccagcccagggccagggcggcatccccttgcaagctcctgaccaccaggatctagatcaccacaccatagcttcacagactcccccagagataaacacagcaccccccccgccccatggccttcttgtccacttagttacagagaaccaaccattatcagtcttgcttcccaagataccacatagagccccagatgggcctcagagggactgctgcccgtcactgtgagcacctgcagcccacatgtctgctgtggggagacaggatgggggtggcgtgctctctggcagtgtggggattcactatggagtccctggatcctctcagagctgtcagccttggcatcacggctggtttctgtaccctcaggttgccactgcagaggtagccgatgccgccagctacatgtgtgttgcagagaaccaggcaggctctgcagagaaactctttaccctcaaggtccaaggtgagatggctgagaggggacctctgtgggttccttgcctctccctgaggttccctagcacctatactcagagttcagacacccagcctgggtgggccacgtcacatcttaggacaaagaacatttgtgagacttcaatcatgtttggaccaattaagccaggaacggcctgggcatggggtggggatgttcttccagggccttacatcatcattactgagcattcactgtgtacctgacatgtgcctaaagaacaccttccagcaggccctggaagatgggctggctttatgattataaaattactctaagaggtaacatgggtgatagggtctcaccaccctgagtctgctgttgacatctgtgttgccatgagcccagatgaggagatatctgttccttgaggatagattggataatcctcaaagtcacaaactgaagcccaaaagctatctaggttctgccactgttcgctgtgtggctttcggagaatggctagactactctgattaagccaccctgcgctcttgtgcaaagcagctctacctaataaggcttgctctccgaggtctgtgtggagatgcaccagggcttgctctgaaagcctagggccagttccttggtgtggtcccccctggtctgcgctctccacccatgtaactgtcaattttgtctccatccagtaccgccacaaatctcagactggaccaccagccagctcaccgccaccctcaacagcagtgtctccctcccctgtgaagtttatgctcacccaaaccctgaggtcacatggtacaaggatggccagcctctctccctgggacaagaggctttcctcctccccggttggtaaactggggctctgtgcccagtccaaggcttggctgggagtctgagatgttcaaacctgggacaggctatgcacattgaaaggactggggatggagagtagcttggggccctgaggctgctggtgcagggactgctgtcccacaggtacccacactctgcggctggcacgagcacagccagctgactccgggacctacttgtgtgaagccctcaacgccgcaggccgagaccaaaagatggtacagctcaacgttctcggtatgtcttgtccctcctgtgctcccttcaacttttcccatcagcccctgggaagcctttgtcttcctctagggatcctgcttacaaacagtcaccaggagggtgaattagtcttgagggttggatacacaagggtttgatgcacaggcttgctctgagaccttgggctagtgtctccccctctctgagccccagatgccctgtgtgtaaggtgacaatctctatgaagatgaggagagattgcagttcttggcttaccatgtagctcatcataagctttagtgccagtcaagttgagggggtagaacaccggtgaaccctaagagttaggctaggaaggtcagagattcatggcttgtagcctatgacagcactctccatcttgaaattcccttgggggaaagccagtctgcagtgttagaagtcaagattctctggaaagttcttttcagtcctgggggaaattcattcatttgtatatacacagctgtgccaggccctgagagctcacacctgtgtatggatgcctacaagagtgaacaggagtaccaggagctgagggaccccatagaaggctgtgtctaatcaggagatgctgggaaggggaaaaaaaagccttgcggtcagcaccttccctgccatgtctaggcaccagatcccattgccatagtaggctctggtaggctggcctgggttcacttcttccagcaaccctgggtcagcactaagctagacggttaggtccaccattcgatcgggtgagcctccctgaaccaaaaccagggaggtttggggatgacatggacaaggatatcgtgtctactcactgtgctctccgacccttagttccccccagctttaaacaggctcctggaggcccccaggaggctatccaggttagagcaggggacaaagccatcctaagctgcgagacagactcactcccagagccagctgtgacctggttcaaggaccagcagcccctagccctggggcagcggattcagggtctacaaggtggacaaacactggagatcctggactcacaggtcagtgactgtgggcagcttgggcaatggacacaacgcttcctgaccccataggcctggacctaagatgatgtgggggtgccatctccttaacccaagtagatacacacacacacacacacacacacacacacacgaaagtagctgggaaaggcctggggcaaccaagagcttggactccagctctgctctgcctcacagtaaccttgaacagaggccttccacactggagcaggtcaggctcccaagtgtttgttgaatgaatctgtgcccctcctctggactcctatcttctgacccagctccagccccacagtgaagggcagaccagggcatactgggccaagtctgctcccctcatttccagggcctcagagaggccaaacagtcctacctccctatagcttcccagacaaggcgactctctggggagtctctattccacacactaacaccatgtgctctgtccaggcatcagataagggtgtgtacagctgcaaagttagcaatacagctggagaggccatccggacctttgtccttgccatccaaggtaagccaggacgagtttggacctcaacattttgagaatagagcctttcatgacttggaagcgagctgatcctgggggagctggggtcccagaaaacctaatggccactgaagccacctcaaactagtagctttagggtacttgcctcatgaatttgaagaatgaaattcacagactctagagggtgagttttagagaggttattttacattcacaagtaggagagacagacagacagacagacagacagacagacagacaacaggcagaggaggccatgctcctgtatagccagagctcattcaaggaaatagggtaccactgaggggcagcacagacctttctaaaggacttatggcagaaactgggtgagacacagggagggctgagctagctggtaggtctggtccttctctgtggtggtcatgtcctcatatacagcttccaggtaagcgtgagtaaccataggaaccaggaaccagggctctctcctggcgttcctgacctaaggcagggacattcttggaacctctgctctggggttcctgccccacctggccagttcctagcttctgtctgtcacccctgcagctcccagggctgccaggaatgaggtcctaccatcaagggctaagtacacaagatctggagttttcaaaaccaagaaggaagttaggatatagcacaaaatcagggcccggtgcatgcctatagtcccatgggaaggaggtggaagtagggaatcgtgagttaaaggtatgtaagctacacccttaggtagacagctatctggagaccagactgagaccttgtctcaaaaacaacaaaaagtccacataggactctttctatggcatgctcgggaggacttagtgagataattctgttcctctgcctgccaagtttcacagaagagcagaacctgctcactgggcatactgcgcactaatctactgtatagatgagacaccaggcacgtgcctggcagctcagcatggggctgagagaaatcgaggcgatcagacacccatcccaaaggactgtgggtccctgggcgtccattccccatcctcaggctgagtgggtcagcggtggctttctagctccatctgtgcataaagcaactcctgcctccatcaatagagtgtaaaataaaaacccctaacctgcccaagaggaaggaactagagaacaaggaagagtgcagaaacctaccatcttcccgcagtgcctccaacatttgagaagcccgagagggagacagtgaaccaggtagctgggcggaccctagtcctggcttgtgatgtgtccggaatccctgctcccactgtgacttggctgaaggacagattacccgtgggtgagtacccatgtcctaccagccattttagtgcaaaataggtcggtcttcattcagtagagccacaatagaagtccaggaaattgtttggtattaatggtcctgtcaaagacagagggctcgtggaatgtggtggtttatgctcgaaaccctagcacgggaggcggagccccagggagccagcctgcctcagttactctgcatggctctgacgatagcgacttaaggaagaaggaacagactttggctgatggttccagagggagaagagcccatcacgccagtgagggaggagagcaagctgcaagcctggtgctaggagcaggaagcagagagagcacagctttaaccacagagaggaagcagagggagtgggaccaggctattaacttggggaggggagggcgcggggggtgggggagagagcgggtgtcaaatacctgagcctgggtcgctctctctctgtccctctgtctctgtctgtctgtctaaaaaatccttcctttcctccctccctccctccctctctccccccttccctcccttcctccctcaagttaggctgctctgtgatggcagccataccccccttttgcccttcactgcttttattggtcactggaatgcagtatcgggagccactcctgctggagtcctctggtgtctgtcccctccactcagaagacaagagagaggctcttcaggcctggctatgcccaggcttggggctgctctaagctgcccctcccctgtcaatcagctctgcacctgcttgaccatgggtcactccatcttagctctcctcctcacccttgaccgctacaccctgctagggtcagtcggtggatcctcagcctgtcagctggtaaatcctatggcacactccaccaaggctgtgccatgctggacatcactgccccctgccagttcctggtgagggcagcatcctctacctcccactcccgctggtctcaggcccacgctggtctcaggcccacgggtccctctagtacacaggcagaagattctgacagctcatcactgaggagttagtggcagctgtggagacctcaggctgtggctggacaatgtgttcccccaccccattcacatgtagacttttgcccaactcttcacattgtagctttagtgagctacaatttacatcctatatagtccagccatttaaagagtatcattcaaggcttttcagtgtatccaaggagtggagccactgccacaaccaattttacaatgtcatcattacccagtaaagaatccccacagccattagccatcccccatgcctcgcaacttcccacccacaacagaccatcagtgtccatgaaatgcctgccctgggcattcattcagatggcgtcacgtcatcctgtgaccttctgcatctgcctcgctccatttagcctgaacctttgaaagctcactgggcagcctggatcagtctgtctttttcagaaataaatttagttatttttttcattgttcctttacataatacctcatgtggctttgtaacccaggctgattgggccacttgctatgtagactagacaggccttaacctcacagatagctacccgtctctgcctcccacgtgctgggatggaacaggtagcaccgtttcttaaccagccttgggctgttgcgacgaggctgcggtgagcttgaagtacaggtgtctgtgggtgttcagggttctggggtggggggtgtttttgtttctcctgtgtggacccttgagttagcctggcatcaaagcctctatcaggcctctagttcttcacgcacgctgttccctgtctggaatgtctcgtggtcttgtctgcttgcatctgactggcttctgctcaagctttgtcccagcagcccccattgaggagcctagctcctcctcctcctagctcctcctcccagctcctactgcccctcccactcctctctggtaccctcctactcctcccctgtcccttccatcctccagctccctgacgctgagagagtggtacagctgtcagccctcggctgcactgtgtctttgtgatacatttcatgcttcttgaagacagggaccacggtgctcgcctttttttccccccgagctctaagtaggacacagggtggggctgatccaggcacgtggctctggaaggctgggcaggggtcaaggtggggtggaggtagggttgatatgattagaaataccttcaggacagatgtgcaagggagcattccaagatgttgagtggagtcccaggagcccaaagggtggggccattgagtggctgattcctcttgatcagcaacctagatacatgtagaaggtgtgggaccctaaccggagggaaggaggactgtaagaaggagaacagccacgggtgggttaaggaaagaggttaatttaattgttaacttgacttaggctcgggtcaccactgagagagcatcaatatgggagtgtctaggtcatgttgtctgtgggcatgcctgtctgggactgtcttaagccttaggtcaccactgggagagcatccatgtgggagtgtttaggtcacgttggctgagggcatgtctgtctgtctgtctgggaccgtcttaagcgtgtttcctggtgtggaaagacccagccagagaatggatgacacttttccctgggattgggtcctgagttagagaacgctagctgaacacaggtgtgcacacattccttctttttctgttgtggctgtgaccagctgcttcctgatgccactgctccctctcaaggactgtcacctgggatggtgggcctaacgacccctgtgacctctacactgcctttgtctgggtaacttttcacagcggcagaagggaaacgaggccagtagaaatctacgaaggtgcctcggacccactggtgcctcagtttccctgtcagtacaggaaggaagtacaagactcaagggcttcgcttcattccacagagagcagcgtggtacacggagtggtctcccgaggtggccgcctccagctgagtcacctgcagccagcccaggccggtacctacacttgtgtggctgagaacgcccaggcagaggcccgcaaagactttgtagtgtctgtcctaggtgcgtctgtactctacacgaccccctctttgccccatccccagcaacccttgctgctggcaggccctcaccatggcctgtgtgtgtcacagtgcctccccagatccaggactcaggcatggcacaagaacacaatgtgttggagaaacaggagattcggctgcactgtgaggctgaaggccagccaccaccagatataacctggctgaaggacggtggcctgttggaccagcacgtgggacctcacctccggtaaggccaggctgtgccacctgaggcaccagagctgccagcctgtgtgtgcctgccctcagtgacccctccccatgcaggttctatctggacggcagtaccctggtgctgaagggcctaagaacagcggactcgggtgcctacacctgtgtggcccacaacccagctggggaggatgccaggctacacacggtgaatgtactgggtgaggaactgaggctgaggagatgcagggagccccagtgccttgtaggaaaacctacaggattatgagtgggcagagtcaggaacctccagtcaagacctgatgacagccactctgcaggctccctgggccttcaggccttgttctctagtaagagtcacaagcgtcccctcccaaggttcagccatgaaaagattgggtgaatctgggtccaagacagtggacctcatctctccagggcatagccgagactccaaaatcctaactacaatggctggcagtggcataaggtcagggctgggtgctgccttccctccaagtccctcaacacttttaatctaccgccccagttcctcccaccatcaagcaacaagctggtgacaccgggaccctggtgagcaggactggagagctggtgaccatggtgtgccctgtccaaggatccccacccattcatgtgagctggctcaaggacggcctgccccttccactctcccagcgcaccctcctccacagctccggccgcaccctcaggtagggaagcccagcctctggtcccagatgacagtcactgatgcactcttcaggcaactctggctccaaatgcttccgtgtggatagaagaatacaaatagtgtagacactgaggttcatggtgactagggaaagcaagaagatcctgccacctagtggaaccccagaggatgcctcatcctgtggtctgatggagaaggcatagtccaagaggacacctgggtgtactggcctggaaagccaggtggaaagcaaggagggcttcctggagggggcctgagcaaagctagtggttctaaactccagcaagcaagagagtcttgtagccgaaaggaccaggtatagagggacagatagtaaggccccaaatcatgagctcaaaagacagtcaaagctggtcagggaaacacagggacatcagagcctgctgtggtcaaggctagctgcttacctcttactggtgctgaggtgtaagaaggtggagccaggcctggtttctatggagaacagcatccagacagagcaagtccacagggccacccccacccccacccccaagatgggagcaggacagaaagacaacagggacaggcagatgttacaggtcgggtcttgaggttcctaacaagcaactcttatcatggtagggtttctcctggcttctgggaatctcacaaatcaccagggatgcacactgagtcaccttgtcagcccagaaagggaaacttttaaaggcaaaatgagaattatacaggataccctgcaaccccagtccttaaccgcatggtgctggtgagactgaccctatctgaaggggcctggatcactgccaagcaggtgctcactgagcatttccacacgtgctcagaggtctgtcagacacacctttggtgacagccacattgggcagtcatgcacaagaaccctccccctcccctgccgccctcagctttactggctgtgtgagcttgaccaaagggactccatcttgcatctgactatcccgagcttcccgggcacctaggggagatgcactgtctacttggagcttggggagatagacactcagggactatcagcaccgtggaagattctggaagccagatggatgcaactatctgccacacatgggcaccatgtcctttggacttggaggaaggcttttggcagggacaggagaatgtggggaggctctgtgcaggaagggagattggccgggctctgacaccatgttcctctctggcccatcacaagagcagcccagaagaagctgggggctcaggagaaaggagactgaatggggccggtagatggagacaacccaggcagatcctaagtgattgccagttgggagaatgcctgctgggacagtgagctgccaacacttaggggacagaggtttgcctgaggcagtaaggactagagaaggtagtgggtgtggggctcagggaagaggagttggggccgtccccagggagcacaaggaggccaggaaagggatatgaagtgggctagagggttctccttacagaatcagccattaggaactgagataagaaaactcaactattttcccttttcccctccccctccccacccctctccccttccctcttcccctctccccctttggggagggggctcaggatctctcaggtgcagctggcagattcaggcgtcttcacctgtgtggctgcaagcccagctggtgtggctgacaggaacttcaccttgctagtactcggtatggggcagggcggggcagtgagtagacacaggctaggacagatgagaataaaatcccccacccggggctcatcagggtggctccggggagagccatgggacattccaatctaatttcttccattgtctgttcatttatcccccaagttgtgagcaggcactgcagcaccaagagctgacaggcataacttatggtaatgagcactgggtctgcgcccccagctccactaggtagacaagggggtgcaaggttggaggactcacctagagagggagttctaaagggtttatccatgaggaccataggccacagactgtacaaaaatcccgggtgagggccacctgctgtaggttgatgcagaccctgcctacgcctgtccccttcagtgccccccatcctggaaccagtggagtttcagaacaacgtgatggctgcccaaggctctgaagtagtccttccgtgtgaggcccggggaagccccctgcctctcgtgtcatggatgaaagatggggagcctttgttgccccagagccttgagcaggggcctggcctgaagctggaatcagtgagtgttggtgacgcagggacctactcctgcacggcagcaagcgaggcaggggaggccaggaggcacttccagctgacagtgatgggtgggtaccttgtcctcagcagcttcggtggctggagggtgaggtgggaccccggggatgagaaaaatccagtgaggaagaggagttccccagaggtttggggtcacctttgtgcgaagctgcagagagaggccttgctggcactgcctgctgagctactgtggctgagaagtctggttctcttcagctctattccaatatttttaccaccagacccttggtgtcaaaagcaaaagctagagctgccaacatgtagggacacagcctcacaagggagcccaaaagcctgcaatgaggggccatattaaaaacacttgcttcaactctgtctcctccccatgtaccaggtccttgttgagatcaaggtacaaataattgtcctgaggccatgaacctgtggtttctatatctaggtgaccgcccagcaccccccccccacctacacacaccatactctactgttttttggcccttcagcaataagcctcttgatggtgggggaggggagaaaagctgacccaaggtggacatcttgcagatccccctcacattgaggaatctggtgagacttcagagctgtcactgacacccggtgcccacctggaactcctgtgtgaggcccgaggcatccctccacccaacatcacttggcataaagacgggcaggccctgcgcaggacggaaaatgacagccaagctggccgggtgctccgggtgcgggatgtacaggtattggcatcgcccactaggggtgagttaggagggatagtctggccagaagttggggtggcattaggggtagacatgtggagccagaagcagctgatcttgccccgttcccaggtggacaatgctgggctgtatacctgcctggctgagagccctgcaggtgaagttgagaagagcttccgggtcagggttcaaggtagggagggggtatggggacagggaaagggggagcggcatggacctgcaagagtgagtccatccctcacatcctgtcatccctcagcccctccaaatgttgttgggccccggggtccccgctctgtggttggcttggctccagggcagctgatcctggagtgctccgtggaggcagagccagcaccagagattgagtggcatcgaggtggtgtcctgcttcaggtgagcccttcatctccagctgaggcctctgaccaaatgaccgcagggctctaagggtctgtctgtctggtgtcactccgagagtctgctctgggcacatcttctacctgatggtaccgtcactccgtgtcatggttgggcactgcagcaagaccaggattcgtacccggtgctctttccatcgtacccttgggttacactgaggcctttgtgacccacatctatgttgtttgtagctatggactgggagattgcgggtctgtgggcttagtgacagtgctcagcccctccaggttcctgggggtctccgcaaagtgaccctctgctgcagatctgttgctagcctaagatggagcagagtctcgtaagtctctcagacctcctggcctgatgcttgtctaggccaagactagatagatcaatagggaaccatgaagcagaaactatggagggaaggtcataccctgcaggtaggacccagagacgggctggacacttggctctgtctccaaggtatttcctcctaccccagcaagacaatgacatctcaggactcagttctgaacccatgagaccaaggccattgccacgtgccaataaagttccgtctctcccctcctccgggggctctgcaggcagatgcccacactcactttccagagcagggcagattcctcaagctgcaggcgctgagcaccgcggatggtggggactacagctgcacagcccgcaacagggcaggcagcaccagcgtggctttccgtgtggagatccacagtgagtgtccccctccccgcccaccttcccctcagagccacaggctcccagccctgccctcttcctctccccagcggcacccaccatccaatcaggaccgaacactgtgaacgtctcagtgaaccgcacaaccctgctgccctgccagacccacggtgtgcccacgcccctcgtgagctggaggaaggatgggatccctctgcaccctgggagccccaggtgggagccaggagggagggctttgggaggaccccgggtttaggctcctttcttccagtcacagagagaaactcctttgggtagttggagcagaaaagtgaccttacacaggatgtgggtggctctcggtgacaaggacaggcacaccactgaccttgtgatctgtttctctatggtgtcttctcatcaccctctttctctctctcctgcctctgtaagcatgacagatacctcctctccaccccaagtttacagctcccctgctcacacaacctggggaagcagcaagccctctataaatattaaacccaaattcctaaggcacacaatgccattggccctgcgtctgtgatgaaccatcttctgcccaatctactgcatccaagggcaggattatatagcacagcctggccattgaggccattctcaaacatagtgagcccgctgccccctggagcagcccctcttgacctctctggtagttgtgtaactttgtcagtctctcaagtgcaggactgacttgtaattcttttgtagggagagctgggaacagaagggagcccccagctggaagcacagtcaggggtccagcccctctcagcaccccatctgcctgtctccaggataacctctctttctgttccaggctagagtttctgcccgagggatcactgcggattcatccagtcctggcacaggatgccggacactacctctgcctagcatccaactctgctggctccgaccggaaaggcctagacctcagagtcttcggtaggtgggcggagaaaagcaccatcctgccttcagcatccgctcctgccaggggccaagggccaaaaacaacgatcctcaagaggtttcggccataaagctcaggagagaaaggttttacccatatgtagtcagaggacacatatgtcatacacccttccttaaaagcacaggacatcaaatgttccatgggagctggctcaaagccaccgaattgggtcctctgatcaagctttgcctcctgtggcagttttcctgccttgaaggactctgatcttaggcaggactgatggacagatgtcttggtagcctcattcaagtgtggagtgtcaggaaggcaccaggttcaggaagtcagaagacccaaccaatcccttgttccttgtaagctctccctggagaattcccctcccttagctccctgggatgggttgaagatggcagccagtgtcccagttgtgagcacagtctcagagaacccccacatccccaccccatgcctgtttctaataacctcttcccagagcccccggccattgctcctggcccctccaacctgaccctgacggcctacagcccagcctcgctgccctgtgaagccagaggctctcccaagcccttggtgacctggtggaaggatgggcagaagctggacctccgcctacagcaaggcgcctaccggtaacgaacggtccatctacggtgtagacatatgagagattggggcccatcacaccgagtgtggcagggttagtgaggagggtccaggaccccaggtgccaggggaaattgtgacatggaggcagagggatccccctggcaggagagaaggtgcttgaatacatggccccacggaaaaaacatgcatgacttattcagcacattgaaaacagaacatggggggactagaggagcttagtggcaggtcagttgctaggcatacaggaggcctgtagtggtaaataattaaagtctgctctatgctcccaatggctctgcacccgcccaagggctctggattcactaatgaaagacacgcacatgaaacctttatatttaatatgccctggctaggtcaatggctgggccactcttgaacctccatatggctaacacactcccctcagttattcctgagttaatacttgctaaatctatatagcatctctgctaccctgacccaatcaggggagtggcccctggggccgctttctccgattcttacatgttggtgggctctccctcccacactttttcctgtgtggtatgccctcctaatggcagaatccctctcctctgccgttcttgcccaggaatcctaaaagcccctcctccgttcctctgcccaacaattagccactggctctttattgaccagtcgaaaaaccaactgttgacagggacctgcagcagatgtgggaattcccatgcaagcacaagtcaaatccccatcagaagcctgcggttacttctgagagcttccagtgttgcccatgtatcatatgtggccagtgggaagtgaccatcagatgtatttgttatgtatctcatcgatgacacactgtccccaacaccacacaggaagaggaacagaatcaatgcacacgaaagtccacaagcccaatagctgagacttctaggactagaaagttctagaagatacttctttttcgtgcacgatgtttgtctgtgttgagtatatctcatgtgtgttcagcagctcaagaggcccgaagagtctcagatcccctggagctggagttactgcctggaagtgtggcagggcctctgagcctctgaggccctagaagatctgagtcatgtctagagatagatgcagggcaggcctggagtggggacacagctgtggctcaccccaggcccctcacttcagccatccctctgtccatcccaggcttctgccttccaatgccctgttcctcaccgctcccagccctcaggactcagcccagtttgagtgtgtcgtgagcaatgaggtgggagagtcccgcaggcgctaccaggtgaccgtccatggtaagtcctcgcagaggagggaaatgtgggtccgacaccctccctcctaggagttctcctgccagcagggacttgcgctagcttcaccccatgacttctgtgtgtcttaggacacctccttcaggaaactctcctggatcttaactcccaccactcagacatcttccaatcttcaacgatctaagcccaaatctgctccttcttcctcagctgcctgggccctccaggcagactaaggtctcagctggacctgcgaggtccctgtggtccagccccacagatggcacccaggttcagcttgccccatggcttgtcctgggatcagctatgcctctgcttgcctcaggatcttgtcacaagctgtcccctctgccagaagcatgcttccttcaccagaccaacacctacttttcctccagatttcaactctgtgtcacctctcccagaggccttctccaaagtcatcaggcccaaaaatatttgcagagtatgcagtatgactttgccattccctcagcttccgtctctgctgtcacctctcatgccacctcatgtcctagcctctcttcatgacagttctgtccccgaggtccggtgaccacctgtcccctctgcacctcagcagggacttgtcttgtattctagtgcctcccaccattgcggacgaccagacacatttcacggtgaccaggatggcacctgtgatcctcacgtgccacagcacagggtcaccaaccccagccgtgtcctggagcaaggcaggcacccagctgggagcaaggggcagcggctaccgcatcttgccctctggtaagttacgtcgaggagcagagatgcctctgaggagagaggaagctgcattaaggtgtggaagggctctggagagcaggaaagaagcaaggcttactcaccttgctgtgtaagccgagagaagacccttgccctctctgagcctcagtagcccttcctgtgcagtgtctgaggcccatcagaggaactgcggggatcctggaaaaatcaggggtttctgatgaaaggagaaatatctgtgggagtattggcaaagctagcttcacccaagagtgaaggccttcatgttaaagtcatgctcttgaccctttggtgtttgagagattctatccctgatggaatttggataatggatttgtaaaatgcctttgctgggctgagaacacagcccagttggtagaacactctcctagcctgtggaaagacctgggctccagtcccagcatcacataaagctggcttggtggtgcacactacgtattcccagaacgtgagagacagaggcaggagcatcagaaggtcaggtcattctcagctacataggaagttcaaggccagcctgggctacatgagaccttgtctcaagaagaaattccatttacttctcagatgtacaagtatacataaatgattatggcaatttcccaaatgagtgttcttgctaattaggaaaccctgctctcaagaccactgggcaagacagcccctgcttttcagactctctaggtgcaatggagctctcctgccattatagggttataggccagtgacctcactcccccccgacctccagcaggccccaggggtcccccaggtagtatctccaaaccactttgcagtgagaaggttaggctgaggctcactgcctgctaccctctttccacccggagagctgaggggagtcctgggaggcttctgaggggggcacactggaaagagcagaggttctcagcaaggagcaactgaccctgaggtcccatagccctgaggccctgcagcccatcttgtctgcttctcatcggggacatggagaaactgaagccagagagctggcatggtgggctcagaactgattcccatgccctctgtgccctttacccatgggcagcaaaggcagtttgaaggttgttggtaacagcccttgccccctccatcagtagggactcctgttcctaatcccatccctcctcccccaaccatgcctggcttccacccacaggagccctggagattgagcgggccctccctctccatgctggccggtacacctgcacagctcgaaactctgcaggggtggcccgcaagcacatggtcctcacagtgcaaggtaaggaccccagctgggcccacctgaggccccagggcaaatggagtggggggctggagacaggtaggactgggagtatgggggaggcctcgccccctgacacccccagcctaacttgaactaattcctaatttggtacctttgggagagagcaggctccccgcagccttgttgctgacatgaggcttcagagcccctgtcctcctagaattccctctcctttgatataaattcttgttggagggacctctgtcttctgtgcccgcagcctcccctgtggtaaagccactccccagcgtggttcaggttgtggcatcggaggaggtgctgctgccctgtgaggcctctggcatcccccagccaatggtcatctggcagaaggagggtctcagcatccctgaaggtgagacctcacagtggccagaaggaagggcaaggtggtcctccttcctgccctgggtaccccaccctcacccctgagagagatctgacacagcccagcctggacctgagacatggcccggcctcctgtcctatgagacgccagcaaatccaacagatcatctcaagccacatccttctgggtgcttctgccaccgcagacactagccttaactttatctatccaaacccaggagctcatatgcaggtcctccccagcggccagctgcggatcatgcacgccagcccagaggatgctgggaactacttctgcattgcccagaacagcgtgggcagtgccatggcgaagaccaggctggtggtgcaaggtgggcccagaagggacttgcaggagacatagttacccagagtttgagactttctcttcctagtctactccaaccctgactgacacaccccacctctctcctacccagcactgctgagggaactttgtcttgtccacagtctggatggctccaggcataatcgcccaccctctgccttctccatctcctcctggcgtgcttgcctggccttccttctctcattgtaacttggtgacagcagttgtttcccttgcctagaagcatctatatggctggcttttccttagtttgagccttccagtctgccaaatgtctgctcagccttcagagagtattcagtgaggctcagggtgggtgttccatccctgagggtatggataggatatctgggtggccacggctctatgactagggttgggtttgctgtgaagccagagcggctcctggctccatgcccctcccgaccctgcttgtccagcatggacacatgccaaccggatgaatgaaatgagttgcgcctggctgggcccttcactgtatccctagaatagtccttgggggagggaaatgtcccagctttgctgctcatgctctctgaggtttgtcatatcagagagcctgtgctaatggagccatacatggcctttgcccccaccacagtgctttgagatattgtgtgtgtgcatgcacatacacatacacctgtgtgtacacacctgggcacacagctatcacagggtcataacatagcccaacacagaatcctcagagcattcttgcccacaggcaataacctgtggcttggcagttagtaggagacattactaagggctgagtgctaaccaggcactggcacagagaagccaaacctataacagctcaacccagccccaaatgagcatccatctctctgcagtcccgcctgtgattgagaatggcctcccagatttgtccaccattgagggctcccacgccctcctgccctgcacagccaagggcagccctgaaccagccattacctgggaaaaggatggccacctggtatctggagctgaggggaagtttaccctgcagccttccggggagctcctggtgaagaactctgaggtgaggcccaggcccaaaatcactgagtgtggccctagtgtggcaaatagctgtggagtaccgcctgctagccaaggctatccctgagcccgttagcccctgggaacaaggaaggacagtgttgggatcccgcccacaaggataagccaaggttccgaggcaactggatatcccaagatagcttcagaataatcataataataattattattaatatttaataataattaataataataattcataatcagaattcaggtttgaaatgacctggatttgaaatgacacggccacatcccagggaagcacagtgacaactcagtgtctcccgagtggaccagctggtctcaaccaacctcagcactgaatgtcttcccagttccggaggaggtgttgagccgggggatctgaggtgccagcccccttgatcatcagtacagcaaacggagccactctttgaatgccctggcagccgtgtggtgatgcaggactgtgggggttatcagagcctcagactctgtccccaaagcagtgaggagcacactagtcctgcctcaaggccccctgtagaacttgttccctcagaacctcactgggttttctccataaaggtcccagtggtaggagccacctcttgggtgtttcaaacatgaataagttggcatgtgtcagcttgagcacaaggcccagcactcagtacgatgtcaggaaacaggacccttggctctggtcatgtgatcaaagcttgggtgattatttttttaaagtgggggcatggaggcaccctgcctagcctcaggggagttggcttggcctcctgctggctggagtggctctgcttctctggcttggaggcttcacaggaacctgtagagaatgggtctccaaggatgctctggcccaggctaggtgcagaggcagttaccatcctgaacctccccctccccacagggccaggatgcaggcacttacatctgcactgcagaaaatgccgtgggccgtgcccgacgccgcgtgcatctcaccatcctgacgctgcctgtcctcaccaccttgcctggggaccgaagcctgcgtcttggggacaggctatggcttcgctgtgtggccaggggcagcccaacaccccgcattggctggaccatcaacgaccagcctgtcacaggtctagatctcctggagtcaggggtgaccagaggtggggctggggaggtggagggggaaggagggttgagagtccagtgtggtagagcggagcggggtggcagatggtccttcgggccctgggtgtccagtctatacaagaaaacacagggaacctgcctgtgagcacgccctgagctgtatgttagagctaacaagaggccatctgaacagaagactcagccccagagacctcaggtcaggagggggatgccgtgttcttgcccctagatgctgctcccatgggagaactctgcctccccttctcggacccagcaggggacacaggggttcagagtacacagtaggtacttgacaaatgtctgctttgttagtggatcgctgggtgctgtcccctggaaatggcattttctgctgtggagtgcatcacccacgtgtaaggccaggtctactgagcactcatgtgcacctgcagacagggcttctctgtgcgccttacaagggagttgcagtagatgtcccagccacttctatgacacagagaaaagcacgggtaccaaggacaagatgacccaacccagcaatacacttggcatcccaaaaagattcccccacaacggcagtgtctgtcatggagactatgtctgacccacaggaaggaaaggcagtgtctacagaggacctgagttcgaattcacagcacccacagaaacaactgcatatagtggcatgtatctgtgatcccggaactgggaaggcaagacaggcataactctagggcctactggccagtcagtctagccaatcagagaattagagaattcaccgggttctttgtagcccaggctggccttgagctcctagacctactatcttcattcccaagcattcggatcttgggcctgtaattttttgtctgattatttatgttactagtccccctaaggccaacccttgactgtcacctggaaatcacaaaacaggcaaactctctggccagatcctctgtggcttgtgcccctctctccccccaccctcctacactcccaatcaggctgccacccacacagaatcaacctgtcgttcatctcttcgtccctgttaaggaccttctggatggacaggcctaggcagagtgaccaaggatggaggcccttattccagactaagagttgtggacatctctcttttcaccacagagggggtgtctgagcaggacgggggcagcacactgcagcgggcagccgtcaccagagaggacagcggcacatacacgtgctgggccgagaacagagttggtcgtgtgcaggctgtcagcttcgtccacgtgaagggtaggatgggagcgcatgtgatcttcctccatagccctcctgtaaccctcctcatttcctgctgtttgagaaaccagcttcctgccttctaactagtgactctttaacctgtgcgtgttgggagacccagggggactttatacactgccagggtccaagttctactctgtaaacacatccctggggggggggggtgtcagagcagaaaaccgtactttatactccatctcttgacagtcccagctgcagccggatagcatcaggggaggaggaggaggctgctggggatagagtatggccagtgcttaccagtctgctgttgtcccctcggcataggtagccctcagaacattggggcttttgcttagccttaggtgggccttgttggaggcagtgtaacccaaggcactgggtctgtgtggctttggatcacttcaatctcaggaactatggagcccagcctagagcagccagcagtgcctggagagttaattgagtccttagctctgtccagtggtgtcccagctgttcctacagttcttttccaaagtacctggcggtgtcatctgcagctgggaagatctatctgcatggaccgaccagtatggcagacacatataagacaaattccctcctgcatccactcaggcatcaccaatccatcaaagcacgagttcttgatgaccactgctggtttatgggcatcagcccatggcacagaagctgttggccctcccaatacatgggctatgcacagccatgctgggcagcaggggctctttttagcactcagcaggaaggcaggagctgaacagagtttggtggtgagttgatgaaatgatgggctgcaggggcgcttcattcctggctacttttgtgttggcccttgcagaggctccagtcctacaaggggaggccttctcttacctggtagaacctgtagggggcagcatccagctacactgtgtggttcgtggagacccagctccagacatccactggaccaaagatggccttccactgcccatcagccgcctccacttccagctacagaacggctccctgaccatcctcaggaccaaggcaaggcggggcccgttcctatgctttttacagtggtttagaagattgttaggttagcaccaccctccataatctagaaggaacttccctccacagtgaatgcaggaggctgatctgcctgtcccctataggaagctcccctcgcagactttacctgtaccccaccttccagcggcaagccacactgaaacggaccagtcagttctgatagcatgtcattatacgctttgcatctgcccagttaggaagcatgcaaactgtcattaaagataggtatagtgaggctggaacggtagctcagctgttaaaagcactggctgctccagaggaccagggttcaatccccagcgcccacgtggcagctcacaactgtctgtaactcctcatccaggagacctgcacagtcccggggacacctgcacagtcctggggacacctgcatagtcccggggacacctgcacagtacagggaacacctgcacagtacaggggacacctgcacagtcccggggacacctgcatagtcccggggacacctgcacagtacagggaacacctgcacagtcccggggacacctgcacagtacaggggacacctgcacagtacaggggacacctgcacagtcccggggacacctgcacagtcccggagatacctgcacagtcccggggacacctgcacagtacaggggacacctgcacagtcccggggacacctgcacagtcccggagatacctgcacagtcccggggacacctgcacagtacaggggacacctgcacagtcctggggatacctgcacagtcctggggacacctgcacagtacaggggacacctgcacagtcccggggaaacctgtacagtcctggggacacctacacagtccgggggacacctgcacagtcccggggacacctgcacagtcctggggacacctgcaacagttctagtagctcatattctttgagaaatcggcttttttgttattgttgttgtttgcttgctgtttgttgttattgttggggatgggggagaggttcaagacagagtttctctgtgtagacctggcttgccttgaactcagagatctgcctgtctttgcttcccaagtgctgggattataagcatgggccaccacttcctggctcttatagagactgggaaactgaatctccagagatatggtaatgtagtagtgaaggactccgcctgtgaggatctggcctccagatctccaccctcagcaggagctacctcttagatagatacctcctcaggacaggtggggtcttttgagtttaaagccagcctggtctacagagtgaattccaggacagccagtgctatacagagaaaccagagagagagagagaaagagagagagagagagagtttattttagttttgggggttgggggtgttttgttggtgttttggtttgtttttgttgagacagggtctcactatggagccttggctgccttggaactcactatgtagaatatgctggccttgaactctaaacattgcctgcctgtgcctcttgagtactggtattaaaggcatgtgtcatgttcttcttttaaaaataaaataaaacaaatctagcagcaatgacaggaagagaatgaaggtgtctctctgcatcaccgcagactagtcacggacagggccccgtgtgcacaatgtccttagccaccgagctattactgtgctaaagcccctgtgtgctggtgctggagaccccataagctgcaccttctagtgcaaacacctgagtcctaggctttaaaatgtaccaggcatggcctgcggagatggctcagtcagcaaagtgtttgttacggttccagaagactggcgtttgaccccaggaatccagctctaaaaagctgagtctgggagctcaaataatccaagccctggggaaacagacaggatggccctttgccccctgacccaccaagcctagctgacttattgagttccaggccaaagagaacaaggcagatagataggagctaaggaatgactcccaaaggtggcctctggcctccacgtgcttgaacatgtgtacacacacacacacacacacacacacacacacacacaccacaagcacgcaggcatgcacctaataaacaataaatacataaatgatttttaagtgtgctcatccaaatccctatgggcaaaacactaataacagttcgcatagacagtctggaaaaggaaaatccggaacgtactctgcccagggcaacaaaccctgcccttcctcgcctctggcttccgagtgcagaggggttggattctctgaatagctgacgaatggcctcaggggctctcgctgctttcaggattcttgtttccctgtccaccatccaccttacaccccttcctggccagacaagtctcagtacagttacctatgtgtgcccaactgaccctcctcctcacctaagcacccgcaccccccccccccgccacctgcagatggacgacgtgggacggtaccaatgcctggccgtgaacgagatgggcaccgtgaagaaagtggtgacagttgtgcttcagagtaagtttcagctctgtccctagcaggtggggaatcaggtgatatgggcatgcagggccagctgcggctgggtatggctgggtacggttcattatgtggtagaagcccagtgaaacatttctcatgtaacccaggttcaggctgacacaaatgttgctgttatttttattgttctttctttctttccttccttctctttctttctctctttctttctctctttctttctttctttctttcttttaaagatttatttatttattatatgtaagtacactgtagctgtcttcagacacaccagaagagggaatcagagcttgttatggatggttgtgagccaccatggggttgctgagatttgaactcgggaccttcggaagagcagtcagtgctcttgaccactgagccatctctccagcccttattgttgtttccaatcaagactcaaaactgcctttgaggctaaagtggcagttcttccactggagacacagctcagagcttgcttagcactatctgagcctcaggatctcaggaattttacaggaagtattttgtgtgtgttggggagggtgtggggggatgctcactcatgtatgagaatgtgaggccagaggtggacattaggggtcttccactcttgctttccagctttctgttctgaggcaaggtcctccagggaatctgcagctcactgttttaactggattgcctggccaaagagtgcgcacacagctacacacacatacacataatttaaaataaatcttttaaaaagaaaaagaagtactcctctgttacaataacgaagttgtgcaagcaggaccactgccctacagggcacattcctatcagcctggggaccgccctgcctgtggtcctagtctgcagactagccccagccccaccagtggcctgcttggtgtttctccagatttcctcttctggaactttcacaacaatgggactccaggcagtcttcttggttctggtttctttgagctatgaattctctttctcccagtctacagcttgtctgtgctttttcttaacaaaacctttcgagaaaggctaaaatgtaaaattggggacagccccatacttaaccaactttgtacttcttggattatatgtttaccttttttttttttttaagtcctcaggggactgaggcaatgaaatagtcaataaaaaacttgcatgaaggcccaaatttgctcccaaggagtgacatttaaaaagtccagtgggggctgctgaggtggctcagtatatgagagacttgctgcccagcctaaccacctaagttcaatccatggactttgcccagcagaagctgagatttgactcttacaagttgtcttctggcctacacacacacacaccacggcagacacatgggtaaatgagtaaacaaatataaaaacaatgttagaactcagtgtgtggcatgcatttgtaaccccagtgctgggcaacggcaggacatgaatgcccaggacttgctgaacaaccaggccaacctaacagacaagctccaggccaatgaaaagtccctgcctcagtaaacaaggtggacagcaactaacgctgatctctgagcaccatgtgcatgcatgcatgagcacgcgcgtgtacacacacacacacagctgtctatcctagattacattttttaattttatgtacttttgtgttttgcctgcgtgcatgtctgtgagagtgtgtcaggttcctgaaactggagtcagagacagttgtgagcagccaagtaggtgctgggacttaaacccaggtcctctggaagaatagacaagtgctcttaaccactaagtcagcccaccttagattgtatttttgtctacaattttcataactatggttctcacatggggcctatgatccagagtgagttaatttttaagtgaggtaagggtgtagtcttcaatgtgtttttctttttcatctggactccagctgttctgggctgtttcttagtttctcaccggatgcagaatggtggttagaccaagcctctatacttgtttgctaaactgatcactaagtatttcttattttgcctaaaattgcttgatttgggggctttcattgctagtgtggatattaacggatgatttaattgggtgggggaggtcacagggccttgaactcacaatctttctgtctctacctcagagtacaggggttacaggcctgctccaccacaatatattctgcttgggagattgaacccaaggctgtttgcatgctatgctaatgaagcattctaactgcgagctacaggcctgctgagggtgagctacaggccggggcggctataggcccagcccttggaagtcagagaacaaatttggggagttggttctctctctgtcttgtaagctctaggctgactggcctgcaggcttctagctgatctcaccagaggaatgctgggcctgaggctgatgtaatgtatcaatcctgaggctctgcacttctcctcagcccgccctgggtttttataacttgatcttatgccctgtggcctcactagcttgttttgttgttgtttggttttttggtttttcaagacaggctttctctgtggccctggctgtcctagaactcactctgtagaccaggctggccttgaattctgagatctacctgcctctgcctcctgaatgctgggaccaaaggcatgcgtcaccacctcctggctgacagcttggttttgaattctggtggatttcacgtagcttctgcagggttgtcccggagtgggctcttccgtgtgtcacatatgaacagagttctcttctttcctgtccatcctttggcgactgtgcctcaccctgcttgctgactcagtagccaccctagaaagccaccgtcctcaccagcctacctaactacagttttggtggagagcatccatcctgtctgtctgatgtgaggacaactgtctgtcctgcccagggctccctttattctcagtttgtcaggctcttttgtgaaggatggggtagacctgataatagacgaagctgagtgtgtcccatgcttactcagaacagccagaaaccttcatatggcagcagaaaaaaaaaaaaaaaaaaaacctgaagggaatagtaagggagactgaggctctcaggcccaggcccaggcccaggccgtgggcacctctactgactgtcaggtgcggctgagagttatagctatgatctcacaaaacataaccgacaggaagcccaacaaaagctccttctcttttctccaaccaaaagaaagactgtaggatggaggagatggctcagggggtaaaggtgggttgccatggagatgatagtctgagttcaattgctaggacctgtgtggtggaacctacatacacacacacacacacacacacacacacacacataagcacactcacgcacatgcgcgcgcacacagtaaatacacatacaacatatacacatgcactctcaccactaccaccacacaacacacacacatatacatgcacaacacacacacacacacaacagacaacatgtacacattcaccatcaccactaccatcacacaacatacaacacacatcacacacacaaaatatattttaaacatttaactctgtgtgtgtgtgtgtgtgtgtgtgtgtgtgtgtgtgtgtgtgtgtacagtaaaggggctgtagagtccagagtgggagtttacaggcagttatgagtcgtgtgaattctgggaaccaaacccatccctctgcaggaacagtttgcagccttgaccactgagccatctctccagcccctaaataaatgaatgtaatttaaattaaaattttaaaccagggaaagaatgagcagaggatgaggcaggaagataaattgctaggacagtcatcttgctccagtttccgtgggaatcactatgtacagcctgcaccatgcatagatgagttccctgataccctgaacagggaccatcactgtccccagggtcaggcctaatgaggacacaggactagccccacttctctcatgagggaaccctctctctacggttagtgggagccctactgggaatcctgaagaccccagctgcccaactatggtgctgagcccctctagtgttctagggtgtcaacagaggcctgcgacgagcaggcctgacagtgctggctatgtcttctctccccgtggaggagggaggctggtgcgagaccacatccattacacgctgctggagtcatgctgtttcagctgcaatgggaactctctggctcaatcaggaaccaggaaatgatcagcctgaaggcacagtgacagccagcccacacaggagagagcacagacatatgactcagcagccagaaggtctgaaactacttcatcagacattgtaagcatgacagaagacctggagctgaatttcagcctcatgtggctgtagagtgggtcactgatcatccatctctggtcttcctctacccacatctttccctctaccagagctgaagggagcggccagcccacgtctcctccacaccctccttgctgttgttaaagttctgccaggttctctggactcctcagccaggctctggagtggccatttgactcctccggttttcttcccctgtgtacttcagcccctggaattgtctcctctgccaccgacttgcaggggggccctggttatagaaagctagtggctttcgcagctggcctgtggggatgccatgtgggatgggggtgaggagcagggtaagcagagccctgggcagtccagcaggctgacactgttgtcagccacggttctggaaatctgttgtgtgtcgtcggatctttggctatcttcttgggccctgaaataatatttgtcaattccgctgaagtttcatactttctgagggaggagggcttgtggaggaccgctttactcagccatggctgccgggtgcttccacactcttgtttcattctaattttttaagatgtaaaacgttttattttatgtgtgagaactctctctccagcccttgaccttcatctaaatggaatccaggtgctaggacaagcttggtggcagagcacttctctagttgagtatgttgtggcccagggttctacctccagctccactaaaagcagaaagaagctatgactgggaccgtgttaccgctccggtccttcacacagcactgtgacaccgtccatgctgtcacattgctgatgttgcttccgtgctccccagtggattctttccagtttgggggattttgagcagcttggcagggagattcatattgctgaggagcacacctgcatttctgttgggatgaatcccacagctgagttgtgaggtcacacagcacacagctttcgtagaactggctgtagtgagctgagaccctcaggaagttctcaggagtctagctctttatccccttcagacagggtctgttactgaaactggagctatactggcaggcagcaagccccgacaatcctcttttctctgccctccacagcgctgggttacagttacaggcaggcactgccatgactggtgctttttaaaataacactttaattctttgagaatttgatccaatgtgtcttaatcatgttcccccgctcctcctgctaactcctctgagatcaccttcccacccactcctaactttgtgttctttttgttttgttttgtggtttttgttgttgttgttgttttgttttgtttttgtggagtttttttgttttggtttgttttggtttggtttttcaagacagggtttctctgtgtagccctggctgtcctggaactcactctgtagatcaggctgaccttgaactcagaaatcctcctgcctctgcctcccaagtgctgggattaaaggcgtgcaccaccactgcccagtgttctttttgctttttatacgccacagagtctaatttgtgccatacgtatactatagtcctgggagtggggtatggggccacctgatggagcaagatcgtcctactggggccacatctttaaagaaaacttattctctagaagccatcagctgtcaacagctcctgggggagggggcttgtaaactcaccctgggtctgtgttcaaatattgaatggtttgatcccattggggtcttagaagcaaccgaggactggtgaaagcttatgacctcagcagtcctgtcaaatccagaacacatgtttactctggctctccctgacttctggcccttacagactttctgccctgtgttctgtgatggtccctgagccttggagtgggggtgtgggggcagtatggatgtctcacttttgtctgattaaagtgtagagaataagtacccgtggagtgcacacctggcatcttaaacataggtggtgagaatctgaattcaggtcctcatgcttgcatagctagtactcttactgagccacatcccaagttcttagtgatatcatcttggagtgggagtggagggcaccatcaaatgtgaggcagcatcatggaggaaaagcagcagtgttggcacataacggtggtctcctgggaaaagcatgtccctcatgtgtaaggcagtgaagaggccaccagctgtggggcaggaatgtgtgtggctctcacatccttcccaccttctggtgttttctaaatgagcacagatcactggaatagacaagactctccctaaaacctgccccactcctccctcaggtgccccagtgttccaggtggagcctcgggacgtgacagtgaggtccggagtggatgtggaactgcgatgccgggccactggagagcctgtgccgacaatcgagtggctacgggcaggcaggccgctacaggctggccggaagctccgggccctgccagatggaagcctgtggctggagcatgtggaagctggagatgctggagtgtatgagtgtgtagctcacaatcgtctgggctctgtcacagccaaggcgttgctggccgtaagaggtaaggagcgtccctgcctgggcctccagactgagtctagtggatgtgtcctgcttagcagagcctagaccactgccctgcaggcttcctggttcttcacgcagttaaaacggagcctagggcagataggaaatctatgcgttccatcctgtctgaggaaactgaatctcagaagggctaagcctttaccatactcaccttaaccagagaaccaggctgttctggtcatgtgacattggcccacaccctccatctgggcaccccatgacctcaaggaaagggcaagatcaaataagattacctatgatgcccttgaggactttgctgtgaacatctgtgaactagtggtcaccccaagtctcacacagccatggtagggcatcgaaaggaacacagcttactgacattactgacccccactatctagagattccttaatcagcccccttctccttagggtcaggccaaacttaatatcaaaaagtggtgtcctgagcaaccactgtaaaaacaattcaagccaatataaagaaaagtcacagaatatcgtttctggattgtctgcctctgcaccaaatacctcatgggcatgggtgtgtatctcatgccaatggtagacatcaccaatccatttccacacacagtgtcagaatctctgtcccttctctaatcctgcctatggcagacatcaccaatcaatttccacctagagtcacaatctctctccttagatctattctccagccagcggtacctctaaagaaattgagatttgacatttgtcaagcagctgtaggaacctttctgatccctagttcccttgtttgtaagaagaggcaaattgctaacagatgtacccagacatcagtggttcttggatacccagaggaagttgctaactcaagggtgacgtcaggcctgagggactttcctctgtttcagaacttggtcctaactcttcccctctcctggtgacaagctcccagttcaaaccacaaagctctgtgtaggtctctatgtcggtttctgaggtggacgtaatgaaatcccatagtctggggcttaattcacagacaccatctttcagtttgagaggttgttaattcaaaatcaaagccttggaagtattggtccctcctgagcctaaggaggagattctgcccatagcttctggccatcactagcattccttggcttctggaagagttgcccatctttgctgtattgttgtgcggcaatctccctgtgagctcccatctatgtgaaagattgaatgaggtggggcccatacgctcattcctttgaatgctgcatcccggttgatgaactgctcagaggattagaaggtgtggccttgttggaggaggtatgtccctggagggttgggctttgaggtttcaaaagccagcaccaggcccagcgcctgtctctcagcctgctgcctgtaaatcaggatataaagccctcagctactgctccatgcctttctatctgcttcctgccatgataatcatggattaagcctctaaaactgtaagcaagacccccaattaaatgctttcttttgttaggattgccttggtcatggtgtctcttcacagtaacaaaaagaacagtaactaaagacagcctctaattccacgttttgatactgtcaccgggtaggcatcctggacaagggctcgtcctgatgacctcattttgatgtgctgttctctgtgacgatcccgtttctaaatgaggtcctatcccgaggtcctggggttagcgcatcaagatgtgaaagaggaggtggcgtggggaagaatttaccccaacaccgctccttatttaataatggaaatgacaattttctttcatatatgctaattacggaaagggcagagaaaacagaagtctggaatcagaaaactagttattacccataattcattgatcagaacgtgcttaggtgattctttttatatttttatttacgtgcactgggggtggtatgcatgtgacagccatgggtggtgtcagaggacaactttgtggcgctgcctgtctcttcccatgcttaggtaattctcagtaatggtttagctccattttgtaacattctaactctgtagcccaggctggccctagaactcacagccatcctcctgcctcagtctcatccgatgctggcatttcaggcacaacccaccatgcctgacttcggctttttgtttgtttgttttctctccaactgtaaatctctctgcttcctacacaaggttaggctagctttaaaacctaccccttttctgcctggcttgggtgacatcccatgataatctgcctggagacatatctttttcagtttcatttcattacatgtgtcatttccatctcttgtctgtgagagacaaatagcagcttcctgtttcagtctccacacccacaacggccaccttctccatgtggtgggcctcaggatttaagttccttcaatggttttgttgtgtaaagggattttgaaaccctctctctctctctctctctctctctctccctctctcttggttttgtgcgtgtgtgtgtgtgtgtgtgtgtgtgtgtgtgtgtgtgaatgtgttgtgtgtgaatgagggggtgactgtgtatgtgtttgactatgtgagagtgtgtgaatgtatgtgtgtgtgagagagagtatgtatgtgaatgtgtatgtgattttgtgtgtgtgtgcgtgtgtgtgtgtgtgtgtgagtgtgtgtgtgtgtgtggtgtgtgtgtgtgtgtgtgtgtgtgtgtggtgtgtgtgtgtgtgtgtgtgtgtgtgagtgtgcgtgtgcgtgtgtggtgtgtgtgtgtgtgagtgtgtgagtgtgtgtgtgtgtgtgtgagtgtgtgtgtgtgcgcaggtgaagaaacagagttgacactgagtgtcttactctattgctccccaaccttataaggagatttatttatttttttttatatatgtgtatgtatgtgtgcctgtgtgaatttatgtgcactgtgtgcatgcaagtgcccacagaagccagaaaagggtgttggtttccttgaaacttgagttacagatgattgtgaactacctggtacagatgctggacactgaacctgggtcctctgcaagagcagtacgtgcattctcctaactacttagccatctctccagcctctgtccttactttctgtttgagccagaatctctcactaacccagcactcaccagtctcttaggctgtctggccagctggccccagggtctgcctctcttgcagccctttctccccagcattagagtcacaggcacacagcttttatgtgagctcaccctagaagaggtcttcctgcttgcacatcacgtactttactgccatctctccagcccctgtttcatgttgtttttcatttgtttggttggccttggcttggcagtcctggggaccaggacaaccagctaggtaagcactgaatctcctgccctgactacagacctgtccctcctccctgctgttttattctttctgcctcatcagtgtaagagtgtgtcctaggcctggctgtttgttttttttcagggatgggcaacaagaggctgagactcctaatgtctaaaaagtggcctgccattcaagggctcagagcgcctgtggcctccagggatctgggtcagacttgtctccctccctgcaggagccagctccctccctgtgccctgttgtgaaacaaatatggatgagaaacattccagatgggcatcaccagaccccagatgagggctgcacttcctagaacctgacattaacccgtcttgattgaccatttaagaatctggccatggaatgttctgtgttttgtttttttgtttttccgggttgttttttgatagttcatctgcagtttgctgttaatttccctggagggctagtgagcagagagccagactccctctgtattgtgccccctggaaggccatctgcccaaaagagtcagctggttcattaggcagaggaagcaggggccctgtgggccgatgtcatccattgagtttgtgcaaaagaacggctgcttggagtgcctggcagcctctgggcagccagcccactccagccagagcagctgcagaccagctggagccaaggccactgatggaatgaggatgctctggtgataatactcagttcttggcatggcgccctgtccctatagcatgcaacctctgccatcatagctcttggcaagttttagaccaacaggtcttctgtgtgtctgtagacccacctcctcattttataaacaagccaacttgatgtgatctagggacatgacttgcctggctctatgtgtatgtgtgcacgtgtatgtgcaggtgcgtgtgtgggtaggtgcattgtacatacatgtgggcaggtgcatgttggcaggtgtatgtgggcaggtgcatgcgtgcagatgcatgtgtgtgcatgtatataggtgcatgcatggatggatgcatgtaggtcatgcatgtgtgcaggtacatgtgtgtgcatgcatgtgtgcacgtgcatgtatgtaggtgcatgtatgtgtgggtgcatgtatgtcatacatgtgtatgcaggtgtatatgtgtgcatgtgcattgtgtgtaggtgcatgtgggggtgccttgtgcaggtgtatgtgtgtgcaggtgcatgtggatatgagtacacctgtgtgcatgatgtgtgtatggttgtatctgtgtgcatgatgtgtgtctgggtgtatgtgtgtgcaggtgcatgtgggtgcaggtgcataaggaggccagatgacaacttgtgtcgctccccaggagctgtccatcttgtttttgagagaggatctttcactgagcccaggttaagcaggttagctgatgagccccagggttccacctctccctctgctgtctctgcctcgccagcaccaggaccccaagcatataccactatggctggcatttctatgtgggctctggggaccaagctcaggcactcgtgcttgcacgacaagcacctcactggctgagccctctccccagacagagtctcctttatttttgagccaagatcttctgtgcttttgagtctgttacctattagctgtgtgtctttggacactgtgcctttctgagcctcaatctccaatttgatgaaaaagtagcagtgctgatacctttgaatggggcctcagagtgggtagttagcatgtgtcactattgtttgtcttctgctccacaggggagccccggggcagccggggcagcatgactggagtcatcaatggtcaggaatttggaatggctactctcaacatcagtgtgctacagcagggcagctctgaggctccaaccatctggagcagcatcagtcaagtcccagcaagtgtgggtatgtggggagggggaggggcgctgggacacctgctggacctagaaaaggcttgttcaaggcctagtacctggagataggactaccttgaagagccaaagccctctccagctcacaggctcccacccccactatcaccaaacaaagtcactgcatttaaaattagacagggagagggtgggtatgagcagggtactgcatcaggagctcagaggacgatggggatgacacttacactcggggagcccctcaccgatggaagccgatagaaaagtgaagaattgattaacagacacgagctggaggggacagacagcaggaaagattcagaattccgtcatctaataagcaggaggcagcctggcgtagtggcacacggctttctttaatcctagcacttgggacgctgggcagaggcaggtggatctcagagtttgaggccagccagatctacagagtgaattccagggtactcagggctatgcagagaaaccctgtctcaaaaaaaaaaaaaatcaaaaagaaaggagaaggaggaggaagaggaggaagagcaggagaaaaaggagggggaagaaagggaagatgaggaggaggaggaggaacagagagaggaagaggaggaggtagaagaggaggaggaggaagaggcatgcatctgctttgaatcacagatttaagaaacaggatgtcttgagcagagaatatgcaggtggctcacaggccctgtcttggcaagcctgcgtaaaggacccaaggcccctccccttccaaggacccagtgcaaggaaaggcagagataagttctcactaggagcagttcttcagagccacacatggcctcagttgttaacttgttttgttttggttttggtttggtttgtttggggggaggggtttgctttgttttagaatcatttgcttttattttacgtgtacaaatgttttgtctgcatatatgtatgtacaaccatgtgcgtgcctggtgcctgcagaggccagaaaagactgtcaggttctacaactggagttacagatggttgtgagccactatgtgggtgctggaagttgagcccagattctctgtaagaaaaacaaatgcccttaatggagacatctctccagccccaggtcaggggctttacctgccagacttgaagccgctgtctgtcgacagagactaatttaaacaaaatgccgcctagttgtggccgctgcttccagctgtgggagccatggggaaacgtctagacccaggcccagtgagcttgactgtaatgggacagaggctctgaggagctggacaggttctgttgcccacaagggctctagctccctcctgtcaccccattaggtgccaccactgtccctgaccctgaggaagctgtgagtgggcggtgcccccctgacccggtctgtgacctctcctagccctaagaggtccagatgttacctagggcagtcaaaggctcagaacactccttcctctcccaggtgcttgcagaagttgtccacaagttagttgatcatcaacccagccagcacatagtgacagcctgtgccccccaccccccagagccatggggaccatctacctggttctgttgaacctggctaaatatcacatcccatgcatttctttataatatttgcttttctagctgctccataaagtatattttgctatctcctggggtctgctaaacaactggcatgtgtagtcgccaggccaagcacggccagggagggaaaggctgagagaagggggagccacagagggatcgtgagcagcatcgctgccccgagactccagtcctaacatggcctctgtgttctgctacatccagggcctctaatgcgggtgctggtggtcacgattgcccccatctactgggccctggctagagagagcggagaggccttaaatggctactctctgacgggtggcagcttccagcaggagtcacagatggaattttctacaggtgagcatggtcttcttgcagacggctgggggcagggcctgagagagcccaggctgcccctgtgctgactccgggctgggtggggacggcttgcaggggagctgctcacaatgacccaggtggctcggggcctggatcctgatggactcctgctcgtggacatgaaaatcaatggcatgatcccagagagcctggccgacggagatctgcgagtacaggtactagctctgggctgctccgccaacccaccctaagcaaacaggccctccttccgtcctcataccccaggaggcagttgccatgggtctcgagaacatcacaggcacggtgccacccccgactgccagttcttgagcagaagagacttgcccagtcttcacgcagcaccccagcatcctcctggcttctctgaagtgggaccctccctttcccccaggacttccaggagcactacgtgcagacagggcctggccagctatttgcgggctccacacagcgtttcctccacgacagcctcccagcctccctgcgctgcaatcacagcatccagtatgatgagacccggggcctccagccccagctggtgcagcatcttcgggcctcttctatcagctcggcctttgaccctgaggcagaggccctgaacttccagcttaccacagccctgcaaacaggtgaggccccactgtcccacttccaccctaccagcgaagacggccagagtcccaaattctggccattcacaccgagcacaggctagggagcagtctatctcctctggccccgcccattccagcctggctccgcccactctagcagggccagttcagctcctcgggccactcctgcccagacctctgaagccttttcctaggcaggagaaatactccacactccaagtctaaaccacacccactcccttctcccaaggtgcctgcaccaaaggccccgtgggtgcaagctctggtgacccacctgaacacatcatagagtcacagctgaggaatgctttaaaagtatcttttcattgcttaagatccagagaggaatgctggaaggagcaaggctctaaaggcaaggcacaccctaattcagagcctatctgtgctgctttccggctacggacctggtgggaatcccatggttcctagctgcacagtggtcatgaactcctagcttccccgaggctccaggccagcagtaaagactctgcctctacaaccctaactggcccccagagtccaccttgctaagggtgactgtccctgcaattgctgaggcagtcccatctccctttcttgctggccgttgaccagcaatcacaaccccctgtacatgactgttgggctctgctgagcacagttttgcgctcgtgatctcaaacagtctacttctctctagtggtctctcttgagttctcctggccttaagagcctccccacccccaccccccacccccaccccaccccccgggcacagctacaagaccaggcatgtccccacaactaccacctcccacaagcctgggcccggagccagctggttgtctcgctgtcacatgtctggttcaaagctgaggctgagctcccagccagggcctactgcctggcccagcccaaagaacaagcccgggatgccctggggaattggctccctcagggtcttcatgcttccattacagaggaaaatgaagttggctgtcccgagggctttgagccggatgtgcagggagcattttgtgtgggtgagttattcccagccagtaggaacaaaggtgacctctccttctgggatgtacaacccaccccagccagctggcaggagagcctgtgaacagagtctcatgtctcccacccagacaaggacgaatgctcaggaggtcccagcccctgctctcatacctgccgcaatgctcctggtcatttctcctgctcctgccccactggcttctccctggcttgggaccacaggaattgtagaggtgagcagccccggggaagtgtggctccagcccggcccaagcctgtagtgggttcctcagggcccagattccaaagggaagcacatgcctacggaggggtcattttttggaagataggaggtgttggggtggtgtggacccccagagacaaacatgtggtccctgcgtgttcctcaagcttgtaagatctccccacagcagcttcaaggctcagtagccctgttctgattttctgatccatggctgaatgacaggtctcaccctgattgtaacctgtgtctttgcctgtcactgccagcagtggggcctggccctcccaagtctctcttggctttctagctagaatccaaggggacatggtctaaaccttacataagaactatgggctgggagaccttcatgtcaggccttctaggctatgagtggggccaggccagggcttaaggatggcagcaggaaggcaaatattcacactgtccaccccctcccatcccctacacacacacacacacacacacacacacacacacaccccttgtgctctgcccccagatgtggatgagtgtgcgggcgacacccacctctgccaggaggaacagcgctgtgtgaacctgcttggatcctataactgcctcgcttcctgtagacctggcttccgggtaactgctgacggaagcaactgtgaaggtgactagggcaccaggcggggccagtcaaactcccaagagaccagagagtgtcactgggattcagggcatctagaactttcttggcagaagcccagagctgggtcctatctttccctttcaacctctgcccacttgtgtttgatggcgttagggatagaagtcagagacagcaggaatgccacttccttccatggctgcccccacatcatggtccagactagagccagcctctgggtccttctcaacacagcttctgggcagtcactgggcatcagtggcaagtggcctttgtattaacatccaagtgctgtcccttgataggagacctttacacattgtatggttttaggcactgggtctatccatgtcatgtggtgtttccctgggcagacttgaacatctattcatcccacatcagacaccagcaactgactaaagaaacaactccatagagtctagcatagcgagccagtgagtttatggactgcttacggagtcaaggtgaggggctgcttgcaaggacatagtgactcgaagacagatgcatcctggaggagccccaccccagcctggacagcagcttgaagggcctcctcttccttggcaaacgttactgtttatatagccccaagggaaagatttgtgagtctatgagtttctggagctttctggatcttaagagattcttttcccttccctgcctccctcctttttacctttacctcctccctcttccctcctccctcttccctcctccctcttccctcctccctcctctttcctctttcctccttcctccttccttcttcctttcctcccttcctccctccccttcttccttcctacattcctaccttcatctcttcctatatcccaggtccttaaaccctgcacacatctgacccctcaccaatagggccttttcttacacacgaggaacttgtgtaaaaggagtgttgcctacccagagcctagaatgtgtcagctccgctggaacccacattctaagtcccttcttttctttggagtctggaccctgttgccttctaaccttgcatggttctcaaaaatggaggttgtaaagtagcagtgtgcagccttgtacagccgtggttagaaaaggagtcaggagacaggcgtggtggcacacacctttaatcccagcactctggaggcagaggcaggcagatttctgagtttgaggccagcctggtctacaaagtgagttccaggattgcaaaggctacccagagaaaccctgtctcgaaaaactaaaaaaagaaagaaagaaagaaagaaaagaaaagaaaagaaaagaaaagaaaagaaaagaaaagaaaaggaaagaaaaggaaacagacatagccttactgtggagggggaggggctgtcctcagaggaggcctctgggctgaacctcttccatgaccatgcctgtgaccacaccgctgcctccccagatgtggatgaatgtctagaacagctggatgagtgtcactacaatcaactctgtgagaacactccaggtggccaccactgtggttgtcccagagggtaccgccaacagggtcacagcctgccttgcctaggtaaaggggacagcagaaccccctctgggccctgggtctcactcagctctggctcaggacaaggagtgtttatggtctggagattctgaaaatgactaaagcagtagccaagacctctcactagatcctgcacagggcacttctgtggatgtcagaaggggaggaggtgacaaccaaggcaggagaggtatggggtagaatgaatgactgtcactaaggattgggactccaccgcctgggagttaggccctaactgcagacctagggtcagagactatgcaggtaccagaatcctcatgaggccagcttgaagggaaaccctgtgtatagtgtataaggcattgaattctgggaggatgacagggagaggcagctgagccaggcatagagggacacagctctcatttcagtattcaggagacagaggcacattccaagcaagactgcctcaaagtaaaaagaaaaagaagccaaagggcagctggagcacctgcaggccacagagcacctaccctcctcacaccctgccgctctccctctacagacatcaacgagtgcctacagctgcccacaccctgtgtctaccagtgtcagaacctccagggcagctaccgatgcctgtgcccaccaggccagactctcctacgggatggcaggacctgtatccccctggaacggaaccgtcaaaacattaccattgtcagccaccggagcccatttgggccctggctgcggtctcgggtacccaggcccagtagttcctaccacacctgggtctccctccggcctggttctggggccctgaatagtgtgggccgggcctggtgcccacctggcttcataaggcaggatggcgtgtgtgcaggtaaggcaggccttaggcacacacactgtggtcctgggctcttaggctgggcgtggatctgggcaaactcagaaacccagcactcacgggcaaagtggggtggaggcaggggaaattctgcaagtgaggggcagcactgtggctgtgcggatggacaaaggggatcccaagagagagactggggtgatattcaaaccgtttgtctttgggatgtttttaggaggccctcctaaaatgatgcctgaggaacctcctgccccccactccattaagaaacactgctcttgagggagggaagtttgcggggctgtgaaagaatattccagttaggcacaaagctataaagagggactgtaggagcagagggtacaggtctgtaacctgtggaccctgtggaagctgggctggctgcagaggggatggactctgtcagtagagtggcccctgttcttgccttggtgatggctcccactcttcaccagccagagactcctcctgcagcaggcctgggtgaagcaggcaggggaggggttgcctggagcagagagcttccctgaccggtctcagagcacatggccatccggcaatctgactcagcatctctctgccctctgtccccacctggaccagaccttgatgagtgccgtgttaggagcctgtgtcagcatgcctgccaaaacacagagggtagctactattgcctgtgcccctctggctaccgcctccttcccagcgggaagaactgccagggtgagccagccagagccaatccacacctctcccaggattagggacacacaagttctgctgtgtgtccctgggctattccatctgaaccttacccatgataggaggaagtccctccaagccatcccctccaagacatgcccctgggagatggagaggtgttggggagggtctctccttggggctctgcctcagaaagctggtctctttcacacggcctcctctggtctccctctcccctgttctatcttcccatctcctaccgcaccctaccgcccagacatcaacgagtgtgaggaagatggcatcgagtgtgggcctggccagatgtgcttcaacacccgaggcagcttccagtgtgtagacacgccctgtcctaccacctaccggcagggctccagccccgggtaaggaggggccaagctgtcggaggtacaggggcgggcacatgagtacagggctttttctccagcttgcccatgcctggacacccacacacacacacacacacacccacacacattcaggaaggcacctcaaggcaaggggaagttgccctgccagacatcctgggccagagctacgtgctgggacacctgggacacctgtacccaagcagggacaaacttggctccatgccactacatggtgtgtgctctctgggacacccctcccctgtacaaacataacctcagacagaaagcacctccaaacataggaattggggaactctcacaaactccaggactcagcacactatgttcattaagaggcaccaggacctcaggacctggggaaggcttctggaccagaccttgcaaaggggagtgaagcaggcggtgggggagactctgacaaggctgaacaagagtctttgaacctctcctgcccctgggagtccagacatatgactcagtccctaggctcctcacttctaggcccctctcagtgaacctaagcgtctgagttttatcgtgttgtgtgtttgctgagctaccctgggctttgggcaaggaaaggaaaagaggtggggggcggggggaagacatgctaaaggggaggaaaacctctgtttggcttctctgggcctcagtttgtggatctctgaaatgaactaacaggggcatatgcaggcaaggtatttggggagcttggggatgagctggggtgcaccggatggcggcccaacgagcttgtctgtgtcaccctcaggacctgcttccgccgctgctctcaggactgcagcgccagcggcccgtctacactgcagtaccgcctgctgccgctgcccctcggcgtgcgcgcccaccacgacgtggcccgcctggccgccttctccgaggctggcatccctgccaaccgcacggagctcaccgtgctggagcccgacccacgcagccccttcgctctccgccagctacgcgctggacaaggcgcggtctacacccgcagagcgctcacccgcgccgggctctaccgcttgactgtgcgcgcagcggcaccccgccaccagagcgtctacatcctgctaatcgcagtgtcgccttacccgtactgaggccagagctgcagatccaccctgacctcgcagagaggaacagagtggcccttgcccatgacacctacagtgacagagaacatcctcttctcccgcccccgtgcgtcagtgagatctttggtaaacactgctgtgcgcagagccttgaccccagggcagagaccgctgcccctttgatggcaaagccaatgggtcaggcctgagtcccgtctttcctcagatctcagcggggagctgggcaagatctcagtggtccaggacagacccagtaggggtggaagcgactggcactgtcctgaccacatggaatgtgtatagtataaaaaaaaaattttttttactgacttgatgtctttgctgagttattttatcttactgaggaggggcctgggaggagcctgggagggaccagtgctgctatgatctgagctgctgggtcagcagacctacatccttaggaatcataaggctctgtccctggctaggatgtttggtgtaaaacagagcagtaaggcagaatcgtctttcgtccccgtagtgatgcgggagaattactgagaactaaatgttcttcatagacaccgacgggtggtaccaaaaccactgtatattaattctcaagaacaatttaaaattgccagggatggtggcacacacccttaatctcagtactagagaagtagaggcagcagagtccagagtttaaggtcatcgtggctgatagccagctccagattagccaggactacaagaggccctgcctcaaaacgatagcacaagaaccctgcttcctagtgcctgctgcccttctgtttctcccttggcccttgtctaagtggcaggcacaccagtgactctatttcttggttattggtgaatcttgccactagaacatgaggccttgagccccaggttggttttacagtttcttctggctggcgcctaaagagggctccctttatctttggccagtgggtgaatgaattagcttacttaaaaaatgaaaactttaaaaaaatgtaaaataaataaataaataaataaaattttaaaaaaaaagaaaacttagaaatgttcattgcaaaaggactaggtgattttatgtctgtgggatgttacagggaccagctgaggacttgacatcattgggaaatgtgcttgcctagcgaatgcaagcttgatccctgcaacccctgtactggcatgggggccccagcttgtaacaccagcactgaggagacagaggcaggtcgatccttgccagtcaagtgagtgctcccatggctgggagaggctctgtttcaaagattagaaaagtgcttgccatccatagcctgagtttnnnnnnnnnnnnnnnnnnnnnnnnnnnnncctctgaactgtgcagaggcgccatgacacccaaacacccctcccaaataataataataataataataataatagcaataataatatttaaaaagtggacagtgtccccagggaatacccatgtttgcacacatacaaacatgcacatatgtatgcaaggcagatgcatgggagtggaagaggggcaggaaatggggcagcgtaaggtaaaagaaatagagatatggttagatatgagatataaatgccagagagctggggcagtatctaacaggattgggactgagtagattccagatgctcttaccccctcccgagagagagagagagagagagagagagagagagagagagagagagagagatcattatatataaacccagtcagcctccatatcgaatggagctaagctgcaactccaacgcctctgaggcagttcttaacaggctggtggaagtagacctcactggacaggtgacctttgagcagatacctgataaagggatgggggagggagggagggatcgagctgtgggaacggcagggggtcgaggtcctgaaagggaaagagtctagcagtagaggaggggattgctcaggaaaagtgaggggagcctcgggaagttcctgtggggtctctgggatgggtcggggatgtggctttgtgtgctggggggactgggcaccctgggtgctggagggactgggcgccctgggtgctggagggactgggcgccctgggtgctggatggagggactgggcgccctgggtgctggatggagggactgggcgccctgggtgctggagggactgggcgccctgggtgctggatggagggactgggcgccctgggtgctggagggactgggcgccctgggtgctggatggagggactgggcgccctgggtgctggagggactgggcgccctgggtgctggagggactgggcgccctggatgctggagggactgggtgccctgggtgctggatggagggactgggcgccctgggtgctggagggactgggtgccctgggtgctggcccaggcactgctttcctgctgccttgcctttctctctaggtaggcaagcccctgcctcagtaccctttttgccaggtgcccccagacatagctatggaaaggctgtctcttgtggagaagatttgggggataattcatttctctctgccaccccggctaacctcgaccacgacctatcccaaaataggtccttttctcccatctaggtctcagagaaagcagtgagacagggccttgttccgtagcccaggctggacttgaactcatcacaattctcccttggtctcccgagtggacctacagatgtgccccagcgctcctagatatctaggctagaagtggagttacaggtcgttgtgaagcacccgctgtgtgaatgctgggaatggaacccaggtcctctgaaagtcgccagtgctcttaaccaggagccgactctccaaccctagattagaaggtacccatacagccaacagagtgtacccaaggacacatctactttctttctgatttttgtttgttttgttgggtgtttgttgaagtagggtctcacgtagcccaggatgaccccacactcactgcgtagctgaagataaccttgagtgtttgcactccaggcacgtgcctccacgtcccgtcagccttctactttcaaaacagatttaagtgagtccaggcttctgcacacttcttcgtaaaggacaagagagtaaatattttttggtttagggacatcttgtttctgatgcaactcactccctgtgctatctgagtgccaaggcaaagctagaggccacaggcagccatgagtgtgtgttgctctactagcaggggctgagctagctcagtggcagaaccctctcctaagaggtccccgtccctcccacctcaaggtgggggaagggctcctcctgatactcacatttcgaatgtgttattttcaccctatgaaattgtcttctttcaaccatttatgacatggaaaaaaaaaaagccccacctctgctttaagtcgctgattggaactgcaggctgggggagggaggaaggcatatggtgagagagaggggtgtctgtccgaagcctactcatgagaatcttgagatgaactctcctcctgaaaactcaggggtcaggaatcagacagagcctgggctgtttctgctaggctgttaactttttatgaactttgtaaccctgaagaggtcagggcctcacactggtgctgaggaccagcaggggtttttcttgcaagctggatacagctctcctctctctgctgcagtctgcccactgcttcctgagtctctctcaccagagccctctgggttgtaaagctactgtctggtgcatctccagctattccttaatgagctccagtatatttactctcccagaggttcccaaggcaagaataatatccccattacacagatgcagcagtggaggctaagaggtaagcatgtcgaagcccacaaggcttctgagctgctgtaggtctctgtgttatggctcagcagcaggctgagaagaggaagtcagaggtagatggagaggaagggctggaggtaggcagtgaggcgtgtcccttccgcagggccactccttgctttttctcctctggtccctctgaggctgtaaaacaggctactaagcaaagagacattgcagcatcgttggccagttagtggggaccaagtttgtcccaggtcacgcacagggactgttggctcataaaggagaagtctccagaggtgtctctgctggcgctgcagctggatccagccccacaagaggtgttttccacagctgcctgtcacctccagctactattggtcacagccccatctagccacccagcccctgtggcacctgacctctgaggctctgcccaccatccacctagcaggtcactcattaaactccctgatgcagcttttccaagaggtcaacagccggactctgtgtccctctgggtgggaagggagagccgaggtctggcctggaggtcattctccgttctggccattctgcccaaacccgggcagtggcacagtggcttctggtgccaaacaagaagctacagaacaaggaccttgagtacactcccagctcctctgtccacagctgctccagagccatcatgctgtcctctgggtggcaggggacaggagacaagaagaggcctttccacacttatgagcataagctaagtgtctgcatgcccataggctgtaggggatgtgggatcacacagactgaggcccttcagtacaagtgaccacagcagtctgagcctacatgcaagagacacctggctgccacacatgcagaggggtgaggcagaggtggagaggtaatggtggtggtgtagaagcgaagacacgacagaggggccaggggaagggactggccttcatgttcttggaatcagcctactggggacatcaggcctctgtcacatgctaaaacgacagggatatctgtgcataggcgctcaacagataatgcccaagaggagggcactggcatgtcactgtgatctgaggagaggtggggactgtcaaagtctgtttaagaagccatgccaaaaaaaaggctggagagatggctcagcggttaagagcactgactactcttccagaggttctgagttcaaatcccagcaaccacatggtagcttacaaccacctttagtgggatactcacatatataaaataaataaataattcttaagaaagaaagaaagaaagaaagaaagaaagaaagaaagaaggaaagaaggaaggagaaagagagagaaagagatcatgccatccattcaggggactggagcaatggatggctctgcacctactacattgcatagtcctgaagaagagtttggatgccagcacccacatgacaagccgagaatcccctctctgtagccccagttccaagagagagctaggggatgtgagaggagcactcccagtgatagaggaagatgtctaacgagagaggagcacttccagtaataaaggaggactactagtgaggaggacacccaatgatagaagagcattcccagtaatagaggaggcctcccactgagagaggaggcctcccactgagagaggaggactcccacagggagaggaggactcccactgagagaggaggactcccagtgatagaggaggcctcccactgagagaggaggactcccactgagagaggaggcctcccactgagagaggaggactcccacagggagaggaggactcccactgagagaggaggcctctcactgagagaggaggactcccagtgatagaggaggcctcccactgagagaggaggcctcccactgagagaggaggactcccactgagagaggaggactcccactgagagaggaggcctcccactgagagaggaggcctcccactgagagaggaggcctcccactgagagaggaggactcccactgagagaggagactagctagtgatagtggaggatgcccagtgagagaggaggactcacagtgatagaggaggacatgtgacactctcttctggactctgcaggaggatccacaatatattgtacatatattcacggagacatatactcatgtgagtgtatgtgtatatgtgtgtgtgtgtttttttgtgtattactcataagtcctaggctaggcccaaattcactgtataacttaggtggatcttgaactcctgatcctcctacccccacctcccaaggaccgagtttacaagtatgagccaccatgagtggcttgtgtggtgctggggactgaatccagggttccatgcatgctagttgatcactgtgcctgagctacatcctcaggcctgtagctgaaggtattttataaaacccaccttgttcactttggggtcttgctacctagacagcatttctttgtcttttgaaacggggtttcacagtgttgccctgcccgtgctcaaactcaattttatctggtctccgtttcccaggaaatggggaccacagacctatgccaccaaacccatcttagcccacatgtttaaaatatcattgcccagaagtccatgttcaacacagggagcttcccgactctcaggagtgtctacttcaaggcctgagctcaggtggtagtgcacttggccgggatgcacgaagccgtgagttcaatccccagcactggcgaatggacaaataaattaatgaagtgtagctgggtgatgcaggttgtaacttcaacactcagaggcaaaggcaacagaaccatgcaaatccgagtccagcctgggctacgtggagagtgctaggttagcccagaactgtgtaatagatcccatttcaaccccatccgccaagagtatatacattgttgtttcttggacacatctctagtttaaactagaggcctaaactcccccatagggaagaccacatcaggatgtcaactcccacagactgaaccaacacatttcatacatttcttgttgcttacactgtaacaattaatattttaaaaaatatttttaggctttttttgtgttaaggaaaattaagaagttacaaagagatatagaaacccatcatattcatggactggaaaatgcagtcttgtctgctcgcctaagatgatatgtagatttatctatatagatttgcagggaagaggggtttagccttgggtttggttgtcaggaccacatgcaaagcacaacaggtagggaacaggaagctggcctcaaactcacaaggtaaccaaggatgcccttgaacctgatgctcctgcctctacctctcaagtgttgggattacaggagtgaaccacccagctagtcacatgatgctagtgatggagcagggagctttgtgcatgctgggtaagctctctcccaactgagccccagcccagcccagcccagcccagcccagcccagcccagcccagcccagcccagcccagccccaggagactttttacagactctgacaggctgtttctgttattttatggaaatgccaaggacatgaacaagttagccaaacggtcatttcctaaatttcaagactcactgtaaagctactagaatcaagacatcgtagaagcagcatggtaagagataaataacatgacagaacacaggcgcaagaaacagacccacactaacacagtcctttagagcagtcgtaggggcagtgatgagtcaccaactccccgtttcttttatttgtcccttaggggttcacatgtgtccctggtgcccatgtgggtgtcaaaggacaacttaaagaaatgggttggtccttagccttggtaacaagggccttcacctgttgagccatcttgctggcccatccaagacctttaagaagggtgtgtgtgacctgttctggtttgtactttctggaagcttctgacctccttatagaggaagggccaggggacaaactggttatgcagggaaatgagaatggaaattggagcaagaaaagtcctgtggtctgagtaaaccaaagatgtggagagtgcgggggaggtgaggctgctcagaagccaagagttcaaggccagcctggtctacatagctcttctaggctagccagggatatataggaaagttgttctgttttgcttttttaaatcgctaacctagattcttaaggagccctgaccttgtcgtaggaagggggaaaggtgaagtcaaaggtcatggtgactcatttccaggggcaaaccctcttgggtcatgttccacccaatccagaagtagtttgcagagtgaggatgggtgggactcagtgtccaccgtgaaggtggaggaatgcagagaacatagctggtccaggagtcagctgggcccctgcacttcacctccacctctgggggctcataagtcaactgctggcagtactggcccctctatccccctgcctatgtgtcagtcctctgggctggagtcatttctgtagtagggggtaaaggttccccctgttcgtgattcctgcctgaaccagttcagttcaaacctgagttagagcagaggcttttgggcttcggggcccaaattctgctatgctctgggcatgctgtgtggccttgggaaagatgcaccctctctctgtgcatatatttcataaaggtaagatggaaagcttctgggccagccctaagaagccgagtcagcaaatggggaccaatggcctcaaagtggctcaaaagttgctggcatgttcttttcattgacctcactagtctcctgtctgtgaggaaggtccagagctggtccagtgacgcccgaaggtcagctgttctagtgtcacttagcagagagatgcctcaggctgtcccctggacgtccgtccccacctggctctctggagtttctaaccagcatgggctacgtttagcttggaggacagggccaggagcacaaaagaatcctgcagctaaagtttgtaaatgtgtctggcaccttctccctcctagaagcccccacagctgctgtttctgaccttgaacaaaaatcaggagaccgagtaaggggcttggctggaccccagagggcacccagagtctcagggcaaggcagtagtaaggaaagctgggtaaaacatgggcatggagccgtctgaggcttggaatctaggcctgcctgggggatatgatcttgccgtaatcctgggtgttgaggttcactggggcaggggctgtcctgtgtgttgcagggctcaggccaggctgggaagcctctggcacggctttctggctcatgtgggccacaacccccgggttcactttacaagccagcagcttcacctctgtgaacctcaaccttccccatcttctgatggctcagcagacagccaggctttgattcaccatttactgggagcccacggcgatctgggcaggtgccaggccaggacgttaaaatggcatccccagccatccttggccaactcgtttgcattttcttgtgaacccttagctctggcttgtgggctagcatcagggaaagcaagagcctctgaggggcagatgcttcagtctttaaatcgagtggggctacacagcctctgaacctaagcaatttgcatcttcactcccgccttgcagcgctttcaagggttcttgcaagacagctgcgatcagccttgctagtcacgcgggttccaacctctgccgccctcccaggcgccaccagcgggtcaggatcaggggacctaaattgcaagagcccacgcccgtgcgcccccgggaggtggtgcgggcgccaagggaagagggaggggccagcgggagagagcgcggggccacgcccacccgcaggtggcctcgagccctgagaggctcggagcgggggccgggcccgagggcggggcctttctcgcgcccgtccccacgtgtcccaggttcctgccccccccaggccctgtgcttataaccctggatgcgcgcctctctcagccctgctccgccgtctgccactgccgcctgggctcactggtaagaagttccgggcccttcttggtccccactctctatccagggtctcatgaccaaggaatcccagagggagcgagcagctgcagggggtgggctcagggcagcccccgagtgaccgcgcagttagtggaaggaaggaggctgatgtccggggcgctgtgacgcacacgttcctcctgcctagggaacccatgtaggagaacgggtcccaaggtctccggagcaggaggactatggaggtccccctctggtttttcacgatcctctgtgtgctgcgaaggctccaagtagagtcccggagagtccagagggttgggggcttccgaatccctctccctggatcagattcgccgatctatgttcaggcttgtttctcaaagtaagcaaaaggtccagcccctctttgc

SEQ ID NO: 161 - DNA, 5913 bp, Mus musculus
atgcccatccctggggccctgccagtcccccctcaggtgcagcctggccctcgggtcctgaaggtactggctggagaagcccttgacctgaactgtgtggccgaaggcaacccccaacctcagctgaactggttcaaggacgggatggccctgatgggcgagggagcccagggctctgtccactttgctgctgtcaagacctctgatgctgggctgtaccgctgtgaggcctccaatagcgctggcacagatacctggaagctggagctccttgtgctcgggactccaaagccacgaatcacatggcggaggggcccatcctcagagcccctgaatggccggccagatgtggcggtgctggatgaagggtcgctgttcctgtcctcagtctctcttgcagacagcggggagtacgagtgccaggccaccaatgaggtgggctctgcatccaggagagccaagctggtggtctatgcaccacccaccatctggggctcgaatgagacaggtgaggtgactgtcctggagggccacactgcacagctcctatgtgaggcccgaggaatgccatcccctgccatcacctggtacaaggatgggaccctgctggcccccagctcagaagtggtttacagcaagggcggccggcagctgcagctggtgaaggcccagccctccgatgctggcctctacacctgccaggccagcaaccctgcagggattacgaagaaatccaccagtctggaggtttatgttccacctaccattgagggtgctgacggagggccatacctggtgcaggctgtggctgggagacccgtggcactggagtgtgtggccagaggccatccaccccctacgatctcctggcagcatgaagggctgccagtggtggacagtaatgggacatggctggaggcaggaggtgccctgcagctggagaacccaggagaggcatccggtggcctctacagctgtgtggccagcagccccgctggagaggctgtactgcagtactcagtggagatgcaggacgtctcctggttcaagggtcgccagcccatctctacccagagacgggtgatagtgtcagctgatggaagagttcttcatattgagcgagtccagctttctgatgcagggagctaccgctgtgtggcgaccaatgtggcgggcagtgcagggctgaagtatggcctacgggtcaatgtccctccagcgttcccctcaaaggagccctacactctcactgtgactgagggacagaccgccagactgtcgtgtgactgccagggcattcctttccccaagatctcatggaggaaagatgttcctcctcaggtcactggcctctgggagcccctcacaacagtctccgtgatccaggatggaaacaccaccctggcctgtaatgccacagggaagcccctcccagtggtgacatggcagagggatggtcagcctgtctcggtggaacccggcttgcggcttcagaatcagaaccacagcctacacgtggaacgggctcaggcctcccacgccggcggctacagctgtgtggctgagaatacagctgggcgtgccgagaggaggtttgcactgtctgtgctggtgccccccatcctggaaccagtggagtttcagaacaacgtgatggctgcccaaggctctgaagtagtccttccgtgtgaggcccggggaagccccctgcctctcgtgtcatggatgaaagatggggagcctttgttgccccagagccttgagcaggggcctggcctgaagctggaatcagtgagtgttggtgacgcagggacctactcctgcacggcagcaagcgaggcaggggaggccaggaggcacttccagctgacagtgatggatccccctcacattgaggaatctggtgagacttcagagctgtcactgacacccggtgcccacctggaactcctgtgtgaggcccgaggcatccctccacccaacatcacttggcataaagacgggcaggccctgcgcaggacggaaaatgacagccaagctggccgggtgctccgggtgcgggatgtacaggtattggcatcgcccactaggggtgagttaggagggatagtctggccagaagttggggtggcattaggggtagacatgtggagccagaagcagctgatcttgccccgttcccaggtggacaatgctgggctgtatacctgcctggctgagagccctgcaggtgaagttgagaagagcttccgggtcagggttcaagcccctccaaatgttgttgggccccggggtccccgctctgtggttggcttggctccagggcagctgatcctggagtgctccgtggaggcagagccagcaccagagattgagtggcatcgaggagctcatatgcaggtcctccccagcggccagctgcggatcatgcacgccagcccagaggatgctgggaactacttctgcattgcccagaacagcgtgggcagtgccatggcgaagaccaggctggtggtgcaagtcccgcctgtgattgagaatggcctcccagatttgtccaccattgagggctcccacgccctcctgccctgcacagccaagggcagccctgaaccagccattacctgggaaaaggatggccacctggtatctggagctgaggggaagtttaccctgcagccttccggggagctcctggtgaagaactctgagggccaggatgcaggcacttacatctgcactgcagaaaatgccgtgggccgtgcccgacgccgcgtgcatctcaccatcctgacgctgcctgtcctcaccaccttgcctggggaccgaagcctgcgtcttggggacaggctatggcttcgctgtgtggccaggggcagcccaacaccccgcattggctggaccatcaacgaccagcctgtcacaggtctagatctcctggagtcaggggtgaccagagagggggtgtctgagcaggacgggggcagcacactgcagcgggcagccgtcaccagagaggacagcggcacatacacgtgctgggccgagaacagagttggtcgtgtgcaggctgtcagcttcgtccacgtgaaggaggctccagtcctacaaggggaggccttctcttacctggtagaacctgtagggggcagcatccagctacactgtgtggttcgtggagacccagctccagacatccactggaccaaagatggccttccactgcccatcagccgcctccacttccagctacagaacggctccctgaccatcctcaggaccaaggcaaggcggggccccacccgcaccccccccccccgccacctgcagatggacgacgtgggacggtaccaatgcctggccgtgaacgagatgggcaccgtgaagaaagtggtgacagttgtgcttcagagtgccccagtgttccaggtggagcctcgggacgtgacagtgaggtccggagtggatgtggaactgcgatgccgggccactggagagcctgtgccgacaatcgagtggctacgggcaggcaggccgctacaggctggccggaagctccgggccctgccagatggaagcctgtggctggagcatgtggaagctggagatgctggagtgtatgagtgtgtagctcacaatcgtctgggctctgtcacagccaaggcgttgctggccgtaagaggggagccccggggcagccggggcagcatgactggagtcatcaatggtcaggaatttggaatggctactctcaacatcagtgtgctacagcagggcagctctgaggctccaaccatctggagcagcatcagtcaagtcccagcaagtgtggggcctctaatgcgggtgctggtggtcacgattgcccccatctactgggccctggctagagagagcggagaggccttaaatggctactctctgacgggtggcagcttccagcaggagtcacagatggaattttctacaggggagctgctcacaatgacccaggtggctcggggcctggatcctgatggactcctgctcgtggacatgaaaatcaatggcatgatcccagagagcctggccgacggagatctgcgagtacaggacttccaggagcactacgtgcagacagggcctggccagctatttgcgggctccacacagcgtttcctccacgacagcctcccagcctccctgcgctgcaatcacagcatccagtatgatgagacccggggcctccagccccagctggtgcagcatcttcgggcctcttctatcagctcggcctttgaccctgaggcagaggccctgaacttccagcttaccacagccctgcaaacagaggaaaatgaagttggctgtcccgagggctttgagccggatgtgcagggagcattttgtgtggatgtggatgagtgtgcgggcgacacccacctctgccaggaggaacagcgctgtgtgaacctgcttggatcctataactgcctcgcttcctgtagacctggcttccgggtaactgctgacggaagcaactgtgaagatgtggatgaatgtctagaacagctggatgagtgtcactacaatcaactctgtgagaacactccaggtggccaccactgtggttgtcccagagggtaccgccaacagggtcacagcctgccttgcctagacatcaacgagtgcctacagctgcccacaccctgtgtctaccagtgtcagaacctccagggcagctaccgatgcctgtgcccaccaggccagactctcctacgggatggcaggacctgtatccccctggaacggaaccgtcaaaacattaccattgtcagccaccggagcccatttgggccctggctgcggtctcgggtacccaggcccagtagttcctaccacacctgggtctccctccggcctggttctggggccctgaatagtgtgggccgggcctggtgcccacctggcttcataaggcaggatggcgtgtgtgcagaccttgatgagtgccgtgttaggagcctgtgtcagcatgcctgccaaaacacagagggtagctactattgcctgtgcccctctggctaccgcctccttcccagcgggaagaactgccaggacatcaacgagtgtgaggaagatggcatcgagtgtgggcctggccagatgtgcttcaacacccgaggcagcttccagtgtgtagacacgccctgtcctaccacctaccggcagggctccagccccgggacctgcttccgccgctgctctcaggactgcagcgccagcggcccgtctacactgcagtaccgcctgctgccgctgcccctcggcgtgcgcgcccaccacgacgtggcccgcctggccgccttctccgaggctggcatccctgccaaccgcacggagctcaccgtgctggagcccgacccacgcagccccttcgctctccgccagctacgcgctggacaaggcgcggtctacacccgcagagcgctcacccgcgccgggctctaccgcttgactgtgcgcgcagcggcaccccgccaccagagcgtctacatcctgctaatcgcagtgtcgccttacccgtactgaggccagagctgcagatccaccctgacctcgcagagaggaacagagtggcccttgcccatgacacctacagtgacagagaacatcctcttctcccgcccccgtgcgtcagtgagatctttggtaaacactgctgtgcgcagagccttgaccccagggcagagaccgctgcccctttgatggcaaagccaatgggtcaggcctgagtcccgtctttcctcagatctcagcggggagctgggcaagatctcagtggtccaggacagacccagtaggggtggaagcgactggcactgtcctgaccacatggaatgtgtatagtataaaaaaaaaattttttttact

SEQ ID NO: 162 - protein, 1814 aa, Mus musculus
MPIPGALPVPPQVQPGPRVLKVLAGEALDLNCVAEGNPQPQLNWFKDGMALMGEGAQGSVHFAAVKTSDAGRCENSAGTDTWKLELLVLGTPKPRITWRRGPSSEPLNGRPDVAVLDEGSLFLSSVSLADSGEYECQATNEVGSASRRAKLVVYAPPTIWGSNETGEVTVLEGHTAQLLCERMPSPAITWYKDGTLLAPSSEVVYSKGGRQLQLVKAQPSDAGTCQNPAGITKKSTSLEVYVPPTIEGADGGPYLVQAVAGRPVECVRHPPPTISWQHEGLPVVDSNGTWLEAGGALQLENPGEASGGSCVASSPAGEAVLQYSVEMQDVSWFKGRQPISTQRRVIVSADGRVLHIERVQLSDAGSYRCVATNVAGSAGLKYGLRVNVPPAFPSKEPYTLTVTEGQTARLSCDCQGIPFPKISWRKDVPPQVTGLWEPLTTVSVIQDGNTTLACNATGKPLPVVTWQRDGQPVSVEPGLRLQNQNHSLHVERAQASHAGGYSCVAENTAGRAERRFALSVLVPPIPVEFQNNVMAAQGSEVVLPCERSPLPLVSWMKDGEPLLPQSLEQGPGLKLESVSVGDAGTYSCTAASEAGEARRHFQLTVMDPPHIEESGETSELSLTPGAHLELLCERIPPPNITWHKDGQALRRTENDSQAGRVLRVRDVQVLDTRGELGGIVWPEVGVGVDMWSQKQLILPRSQVDNAGTCLAESPAGEVEKSFRVRVQAPPNVVGPRGPRSVVGLAPGQLICSVEAEPAPEIEWHRGAHMQVLPSGQLRIMHDEDAGNYFCIAQNSVGSAMAKTRLVVQVPPVIENGLPDLSTIEGSHALLPCTAKGSPEPAITWEKDGHLVSGAEGKFTLQPSGELLVKNSEGQDAGTYICTAENAVGRARRRVHLTILTLPVLTTLPGDRSLRLGDRLWLRCVRSPTPRIGWTINDQPVTGLDLLESGVTREGVSEQDGGSTLQRAAVTREDSGTYTCWAENRVGRVQAVSFVHVKEAPVLQGEAFSYLVEPVGGSIQLHCVVRGDPAPDIHWTKDGLPLPISRLHFQLQNGSLTILRTKARRGPTRTPPPRHLQMDDVGRYQCLAVNEMGTVKKVVTVVLQSAPVFQVEPRDVTVRSGVDVELRCRATGEPVPTIEWLRAGRPLQAGRKLRALPDGSLWLEHVEAGDAGVYECVAHNRLGSVTAKALLAVRGEPRGSRGSMTGVINGQEFGMATLNISVLQQGSSEAPTIWSSISQVPASVGPLMRVLVVTIAPIYWARESGEALNGYSLTGGSFQQESQMEFSTGELLTMTQVRLDPDGLLLVDMKINGMIPESLADGDLRVQDFQEHYVQTGPGQLFAGSTQRFLHDSLPASLRCNHSIQYDETRGLQPQLVQHLRASSISSAFDPEAEALNFQLTTALQTEENEVGCPEGFEPDVQGAFCVDVDECAGDTHLCQEEQRCVNLLGSYNCLASCRPGFRVTADGSNCEDVDECLEQLDECHYNQLCENTPGGHHCGCPRGYRQQGHSLPCLDINECLQLPTPCVYQCQNLQGSYRCLCPPGQTLLRDGRTCIPLERNRQNITIVSHRSPFGPWLRSRVPRPSSSYHTWVSLRPGSGALNSVGRAWCPPGFIRQDGVCADLDECRVRSLCQHACQNTEGSYYCLCPSGYRLLPSGKNCQDINECEEDGIECGPGQMCFNTRGSFQCVDTPCPTYQGSSPGTCFRRCSQDCSASGPSTLQYRLLPLPLGVRAHHDVARLAAFSEAGIPANRTELTVLEPDPRSPFALRQLRAGQGAVYTRRALTRAGRLTVRAAAPRHQSVYILLIAVSPYPY

SEQ ID NO: 163 - DNA, 102790 bp, Homo sapiens
  misc_feature (1)...(102790): n = A,T,C or G
ggctctatgctggctgctttagtgccgcacctcatttcatcccgcagggcgggaggggttgtgatgagggggaactgaggctctggctggagcagggtcccttggctataaggagctgaaccaggattggagccacctccgcacatgctgcctccgaaccttgcttagccattataagtcgacccctctgccttgcctcagtttcccctgtgcactgagctggatgaatcccaagtggcgcttttttttttttttttcttagacggagcctccctctgtcacacaggctggagtgcagtggcacaatctcagctcactgtaacctccgcctcccgggttcaagcaattctcgtgcttcagcctccgagtagttgggattacaggtgcgcgccaccacgcccagctaatttttgtatttttagtagagatgggtttcgccatgttggctgggctggtctcaaacgcctgacatcaggcaatctgcccacctcggcctcccacagttctgagattacaggcgtgagccaccgctcccagccccgagtggcgcctcttaaatgatgtcaggcacattggcgagggcagagggatatacaagctcagccctaagggttgagtctttcaggagtgcgtgtgttcaggtgaaagaccggagctcactcactttgggggagtccacgtgaggtgtcccaacgtcttttcctgccagcctttgattgtgctccatgacaattttgctggttggtgacatctgagatgtggcttgggcctgggttctgggaccctctcgcctgggtcccccaaccttgatacccctcctgtggcccctcagtcccccctcaggtgcagccaggccctcgggttctgaaggtgctggtgggagaagccctggatctgaactgtgtggctgagggcaacccagagccccagctgagctggtccaaggatggcgtggtgttgcagggccgggggcctcagggctccgtccacttcgcagccatcagaacctctgatgccgggaggtaccgctgtgaagcctccaacagcgccggggtggatgcctgggaggtggagctcagggtgctgggtgagtctccctggccccagaacctgcttctccccagctctcccagccacagcctggatttgggaggtgctcgtctctgttccgggctctgtgcctgcccgttcccttccttcgtgggacagatagagccctggccctttctgggaccttccagccccacagctttggggctatcctgtgtccaggagcctttgtcagtccttgggtatggaccaggtggtcctcagagctcccagcagggattccctgtactccttacccttgggtggtgacctgtggggcccctgagtacctgggtggacagaggcacctggagcagtaaccagggagtggcactggacccagggccatccagacaaccataggccagtcacctacactctctgaccccggttttctcacctgcaaagtgggtccaatagtatgtggggggtccatgtgagagagtgtgtgaagcacctggcgcatagaaagttctggatcagtggtgctagcagtttcactattaggaatttaaaacaagcttggggctgagtgcagtggctcatgcctgtaatcccagcaatttgggaggccgaggtgggtggatcgcttgagcccaggagttcgagaccagtctggccaacatagtgaaacccccatctcttaaaataaataaataaataaataaataaataaataaataaataaataaataaaagcttggaaagccactgctgagagggaccactcatggccccttgtgtctgagggtacagctcagcctccccagcatgtggggctcggccctggtggctgcaccatggggcctccctgcagggtgagccagtacccctggccctgactggacttgccaggaggctaggggctgggattctagaaggggacaccctccccattggccctgggttccttggaggcaggggttgaggggtgccaggctttgggcccgaggtaggagtgtggccatgttgcctccctacagagccaccacactggggggctgatgagaccagcggcctgctggagcgagtggccggagagaatgccagcctgccgtgccctgccagaggtgaagctgcgtctggggagggactggggaggtggggtgggctggcttgggaggcgtccccactcatgttccagtgccctgggttgcacgtggcaggcccacggggcacatgctccttgtcagcagcatgccaggtggttcatcccattgtcaaccctgcaggatggtgttattgccccttttgattaggggcaatccaggcccaagggggttaagtgacttgcctgaagtcacacagccaggatgtgactcagaatgtggacaagtgtgacccctgccctgcccccctgtgcccatcagcatctgggggtgtgatcgccagggctgaggcagcccggggtccttgtgggttggggcttcgtggtcagcccgcctctccccatgcccctgactttcccacagaggatggattcagtggttctggccaaagcagcttttctgggcttgtctttggggcaggagcacggtgtggggccgatagccaccatgggtcagctgcccagcgccgaaccctgccctggcccttcctggttttgtaactcaggacagtttctatctcctttcgagcatcagtttccctgtctgtacagcgggggttgtaccagcccctctgcatggagctgctgtgggaactcagtgggaccccacgcgtgcacagggctggcatcttaggagggctcaggaaatgtggtggatgcctggcttctgcctttttgtgaaccccacggccccacccagaagatccctcctcagcccccgccactgcctcagttgcttctttcggcgttgggctcctgcatggctgggagcaccgcctcccctctgtggggctgaggttctctggagggtgctgtctggtgtctggtagcaagtggcaggtcaccaaagcctgacaggagcctggggggcgtctctagtcttggttgttgctctgtgagccacaggacgccctggaaggccccagaaaaggactcagggagaggcaggtagaagcagggatggcacccacctaggcaaggggaggacctgggtgggagctctgggagcccctctggatccccaggtgcagagctgccgacctgcccacctggccccccgaccctccccgacccaggtccccggcccttgactatggcgccaccttgcgttggattctgctaacagcaagcagccgttctgcgcttttgggaggtgggagacagtggaaggtgggacccacccagcccctgactgccacacacagccctggtcagtcagggaccagtcctgagcctgtcagcctcacccaaatcccctctgatagcactgcctctccccaccaggcctgccgcctgggctgccccggcctccttcctggtcaggagggccttgtttcacagccctgtggccttgggctcggagcgctctgagggctacagggttgggactgagcccagcaccctcatggggactccctgggccctgcagtgacaccatctgcctcttcctcgtggggtggggtggggcgtgaaggcccagagcctggacacccacttggtggtgtgtgtggtgtgtgggactctgcacagtggggagggggcggcgtgagggaccctgggcagcagctggtgcccggggatctccttgtcctccttgtcacagagcttcagggccgtcctgcactagagcactttaggctgagattgtggtaaacaaggttccacagcagaaaccatcacccctcccgacctgcagctcggaaggcctggcccccggcgtggcgggaagtacaggggctctcaggggaaagctgaggaagatgagaggggggtgtgcatgtgtgtgagtgtgcgaatgtgtagtgtgtgtatgtggtgtatgtgtacatgtgtgggatgtgtgtgcatgtatgtgttgctgtgtgtatgtgatgtgtgtatgtagtcatgtggtgtgtgtgtgtggtgtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggcaggttgcactgtacacccccacttccctagagagacccccacggagacagtatgggggaagcacctggaattccatcagtgtctttgagattggtctagaggtgaaggcattttaaaatgaccccttggctgggcatggtggcttgcacctgtaatcctagcactttgggaggctgaggcaggagaattgcttgagcccaggagatcgagaccagtttgggagagagagaccctgtctctacataaaataaacttaaaaaattatttttaaaaatgagcacggatggcagtgcagagccccagagcccacctcctggttaaaactgttacccctggtctcttctcacattcttgtcctcagcagggagagcgcccacccccacatccagggtgctatgtgcagaggaaaggaacccctccttaacacgggcagtgtgggtgggctggggagtggtctctgtcggcaggatgaactggccccgcttgggcagttctaccagctcctaacgccacctgctgcttccccaggaccagctgctctggctagccctgtaatgacttgctcaagacatttgttacaaaagcgtggccaggcctcaccttcagagattctcactcagggggaccctccctggtcactgtgacaccaggttgggtgtagaaccagatggatctaaggggactccagcaccttgcaaagctgagagtcagaaagggtgacacctgggcctgggcacgactgggggtgtgtgggtcccagggcaaggctgctgcggccatctgcaggtccacaggaccctttgtggctgggcggacggggacaggcagaccttctccaaccccagtgacgaaggggagggaatggcccagatgaggtcccttcggctgtggctctaagggggcagggaagcagctcctcggctctccttgcccccaagtgccccccagcatccgggaggacgggcgcaaggccaacgtgtcgggtatggccgggcagtccctgacgctggagtgtgacgcgaacggctttccagtccctgagatcgtgtggctgaaggacgcgcagctggtgggtgtccccctagggtgggcggggtatgggtgggatttaggctggggacaggtcttctggatgggcatttctgcgtgtgccaaggtggggcagggagatgtgacaggtgtctttggtggtgctctggggttcacggcagtggaggatagtggtcatgtagtgaagcctggcaggggctgcgtggcagagagcatggcaccgttctggccactggccacctctcgggcctcagtttcctcattactgatgctgggggtggtggctggatcccctcttactggctccctctggcctctcctacccagattcctaaggtgggcggccaccgcctcctggacgagggccagtccctccacttccccaggatccaggagggtgattctgggctctactcctgccgggcagagaaccaggctggcaccgcccagagggacttccatctccttgtgctcagtgagtgagacctgagccctgtaactcccaagtgtgtctggccctgtagccccaactcttgcaggcacaccgggggagagggtagactttgcctgcggagagcagggggcacagagggacccatgacagacccaacccccatcctcacagagctatcaggcttgggggacagacatcagacaggtgaatagcaaaatcattactgtcacaagtgctaccaaagaacagtctgggtgctgagggctccagagcaagcccttctggccagggttttggggggcttcccaggaaggtcaggtaggaggggggcccaggctggggggtctgcacagacaaaggccccgtggtaggcggggcttgcagggtttgaacagtttcccacccctcacgccttctcacccccagcccctccttccgtgcttggagccggggccgctcaggaggtgctaggattggccggtgcagacgtggagctgcagtgttggacctcaggggtccccacgccccaggtggagtggaccaaggacaggcagtgagtgcccccctccccgaggatggcgtgtggtggtgcccagactcagcctgctggatgtgggggttggggaaggttgaactcttcttggggagctgacaggcatggcatgtgccacccagggcccagactgagggctgtaggggcgcctcccacccagcaggagattagccagggagaccccactcttacctcagcaaagtcttctcatctcttagcctttccttttttttttttttttttttttttttggtgacagggtcttgctcagttgctcaggttagagtgcagtgtgcagtggaacgatctcagctcactgcagcctcaaactcctgggcttcttgggctcaagagatcatcccacttcagcctcctaaatagctgggaccacaggtgtgcgctaccaacaacagctaattttttaaaaaatgtttgtacagatggggtcctgctttgttgcccaggctggtcttgaacacctggcttcaagcaatcctcctgccttggcctcccaaagtgctgagattacaggcatgagccaccgtgcccagcctctttttttaaactcactttttctctaagtaaaattcacataatgggctgggtgtggtggctcacgcctgtaatcccagcattttgggaggccaaggcggccagatcacctgaggtcaggagctatcagcctgcccaacacagcgagaccctgtctctgctaaaaatacaaaaaaatacaaaaaaaaaaaaaaaagaaatagccaggcatggtggcaggcgcctgtaatcccagctgcttgggaggctgaggcaagagaatcacttgaacctaggaggtggaggttgcagtgagctgagatcaagccactgcactccagcctgggtgacagagcaagactccgtccaaaaaaaagtccacgtaacatacaattagccattttaaagtgtacagtgggccaggtgcagtggctcacgcctgtaatcccagcactttgggaggctgaggtgggcagatcacgaggtcaggagatcgagaccatcctggctaacacggtgaaacctcgtctctactaaaaatacaaaaatatatatatatatatacgggcatggtggcggtagtctgtagtctcctgtagtctccgctccttgggaggccgaggcaggagaatcacttgagcccgggaggtggaggttgcagtgagccatcgtactactgcactccagcctgggcaatagagcaagactcagtctcaaggaaaaaaaaaggtgtgcagtgtagtggcatttagtacatttgcagcatggggcaactttcacttctatttagttcctgacattccatcaccccaaaaggacaccctggacccatcagcagccagtcgctgtccccttctccccagcccctggcaaccacaagcctgctttccttctctatggacgtgcctgttctgggtacttcacatcactggcatcatagagtgtgtggccttttgtgtctggcttcttccactcggcatattttccaggttcatccatactgtggcgagtgtcagaattgccttcatttttgtggctgaataatgttccgtggcatggacggaccacacgttgttgatccattcctcgcttactgggcctttgcattgctcccacctcttggcgctaatgaatggcccagcctcgctttttacaagccacacactccctgtgtgcagcgtgtcccatccagcccctcggccttactggcgcttttcccttgcccgtctctccaggcctgtccttccgggaggccctcacctgcaggtccaggaggatggccaggttctcaggatcaccggcagtcacgtgggggatgagggacgataccagtgcgtggccttcagcccagctggtcagcaggccagggacttccagctccgagttcatggtgagcccccacgccttctgggaccccgccacaggctactcaggaagcttcccacccagctgcccgctgccttagagggagagtgagggctgaaatgggggacctggtgagtgatccctgagtccaagaaagctgggggctggggtcggggttggggtcagggtcaggggatagaggttatctggcccagcattttccaaatccgtggtttccatcccagctctaaaaatttactacttatgttttttttttgagatgaattctctctctgttgcctaggctggagcgcagtggcaccatcttggctcactgcaacctccccctcccagattcaagtgattctcttgcctcagcctcccgagtagctgggattacaggtgcccaccaccacacccagttcatttttgtatttttagtagaggtggggtttcaccatgttggccaggctggccttgaactcctgacctcaagtgatcctcctgccttggcctcccaaagtgctgggattacaggcgtgagtcactgtacctggcccaaatttactacttctgataccacttggaattatgatttacttttctttaaatgagtcacacttccttacactgaaacacatttatttaaatatcccttattcttataaaggatatttaatatcgaaactgtaagcagaaaaccagtttcgcttggctaaggaagctgaaaaaacaaacacaccccatagagcaatgttgtaaattctcgaggcgtggactccgcagagggcacccagcctgcatctgcactctctgtgctaaaaagcggagagtagaaagtgctagaaaggttagggacatgcatagtagcaccaaacggagcctttccttgctgtaacccggatagaaggagatttgggaggggcgtaaccattccattctgagatgcagttatttcatgctgtgcccatgtgcccctagcattgtcctgggtagcatcggtggtgagtgaccagccctgtgtgaagtcctcatctagtccagcctctcatttcacagatggggagactgaggcccagagaggggaagtggctcacccctggtcttccagtatgttagagcagagcagggcccagaatccaagcctgtggccccgcccccacctcctgcaccttccacaccagcatgtccccatgctggcctctcccatctgtccccagacccctcccctccttgtccaccatgccttccctgcccccgcaatggaagcctgtggtgtgtcttgtggcccaaaggcatgagtctgctgccctggggaagatgccagaggcctcagcggctgcctgtgaccagccccacctctttccttctcagcgccccccactatctggggctccaacgagacaggcgaggtggccgtcatggaggaccacctagtgcagctcctgtgtgaggctcgaggagtgcccaccccaaacatcacctggttcaaggacggggccctgctccccaccagcaccaaggtggtctacactaggggcggtcggcagttgcagctggggagggcccagagctccgatgccggcgtctacacctgcaaggccagcaatgctgtgggggccgcagagaaggccaccaggctggatgtttatggtgagcagccaggggccacggcagccggggtgggcagtgggagggactcagccatggtggcccctgcctgtctccaaaggaaggctaggtggccacttggagtggtcagaggcaaaaggataatgggaccaagacattatctagggagaagggtcctcccagcttatgtgacttccctcatacctgtaaggaaactgaggccaggagtggaagggcctgtctaggaggccatggcggagctaagtgtagaatccaggtctcccctcatggtgtggggcttttcactaaaccatgcccagaaccctgtgaccaccacaataattaactgccctcagctcatcacttctgtaagctagaccagaggggcactttgcagcatcagctcatttgatcagctggcaaagggacttgagctctcatgtccccagttacagatggtcgcagtgaagctctggagcagagaggtttccccaggttcacacccctaggaggtggtggaacccggtccttacgcgggcagatctgactccagacctcatgctgtgaacctcagcatcagctcagccctgaggggcttggctctggggacttttgaagcagaactcagaggaaagggtgtcggtggctctggatgggtctgagcagggccccggtgaagtgtgagagggcagcgtgcaagctgataggggtcagcctggccccccgtggggagtcacttcgggagctctggcttccaaagatgcaaagggcttgggtactggaacctcaaagggcagctgagctgcatgggctccacggcagcctctgaagatggccccgccgctagctcagggagtcttattttgggacccgaggtcccccaggaaatgaaatagaaaatgtgtatgtgtatgttttcattaaattttcaaagggtcttacacccaaataaggttaagaagcatctcccaggccacggttgccccttgtgccctggtaatggcttcatcagctcagcaacttgagggtctccttgagggtaggagagaaatttcccctttggcgtggccaccatgggctccaagcatagttaacatctggtccccttggccatcgctggctaagttaggagccccccaatccaagccatctgggctcaggtctgccccagtcttctgcctcctgagaccagggagggaggggacttccaggagcagagctctgtcccggccctgggggtcttatttgagtccagcagacactggacctgctgtgtataggcactggggatgcaagtaggccggccgtctttccactcatgctgggcttgccggggtagcagcggggatggagaggcaacagtcagcacccaggggtggggtggcgcgcccaggggctgaggagggtgagaatgctgccccggggtctgagcaaggggttcagccactggaggtgagggaaggaagtgtttcacatggagtggggtcggtgaggggcttcagcgggcctgttgggctgagatgagagcaggctagcgtccagctgtggtccccaagccgccccctgcctcttttccagtcccacctaccatcgagggcgccggtggaagaccatacgtggtgaaggctgtggctgggaggcctgtggcgctggagtgcgtggccagaggccacccgtcccccaccctctcctggcaccacgaggggctgcccgtggcagagagcaacgagtcgcggctggagacagacgggagtgtgctgaggctggagagcccgggggaggcatccagtggcctgtacagctgtgtggccagcagtcctgccggggaagccgtcctgcagtactccgtggaggttcagggtgagcccggcccaccccactcagagctgcctgggctgtggacgtctgcccaggcctgctgcgtgcttgtcccgagagagctcctggagtggagggagggtggggagaagtaaccagtgtccccacattgcatgacacagatgaggacgctgaggcctgggctgtggggccggcagggctaggagtgggcagggtggagccccaggatcaagggtccctgactgtgcccaggaccctgggctgggtcacccaggacagaggacctcgttctgccttctgccaatggaatggccctttacggagactttcctaaggccggcttgtgggtatggtcccagcagggcgggtggggccttcgcctgctcttccatccattgctgaagcatctcaggtcctagtgctgtgttgaccccaagcggcactggaaatgaagctgggaacaaggccaaccggactcctgagccctcagtctgccagggaggcagatgttaaataattaggcccaagcctttggggagcccggggtgtccccttacccgccttgggtggccctggaaggcctcctggaggaagggccactgatagggagacgtgagggtgaggtgcagctgggcctcgcttggaaggctctggggacttgggagggtttgaggccagtggctgctcagctccaaacacccaggagtgtgttctgcctgcagtgcccccacagctcctggtggctgaaggcttgggacaggtgaccaccatcgtgggacagcccctggaacttccctgccaggcctcaggctccccagtacccactatccagtgagtctggggtggtggaggccagggctgggggtaggcagagagcgtgtgctttgcggattgtggggggaagtggacaggagagaggcttcctgtttccaggagtaggaaagaggcctggagccacggctggtgagagcaggtgggaggaacttctaggtttcctgcttgtcctgcctggcctggccttccctggtctcaggttgacacgcccccctccctactcaccttaggtggctgcagaatggccgcccagccgaggagctggctggggtgcaggtggcctcgcaggggaccacactgcacattgaccatgtggagctggaccactcaggcctcttcgcctgccaggccaccaatgaggcgggcactgccggggccgaggtggaggtgtctgtgcatggtgagtgggcgcctggggttctggagctgtgggcagcctgagatgccaggggtgggtggagcctgggctgtggcaggcctggaagggcacggggctggtctttgctggatggcgtttctgggctggacttcccagttccccacagagacgcaggtgtgagaggctggccgggccacttatcacacttatcctcagtcctgaccagcccctaggcctcactcctctccccagcttcctctctgtccatctgctgaacttcacttagttcttttaatatatcaaccctctttctctcgtcttcgtctacgtttgctgttccttctgcccagaactttctccctcctctttgcctgcctagctccttatctttcaggcatatcctgaaatacttttcctccaggaagccttccttgattctaccatgtttctcatctgcactgcccagcctctcaatgccttagccctccaacaactacattgggattgcttatttggttgtccatctccactgtccacctctgtgagctttgagagggcaacatggtagctgcctttccctgactgtgtccaggggcccagtatagttctggccacagagtagatgctcagcacacataaggatgcatggatagatcagtgggtgggtggatggatgggtgggtggatgaatgggttggtggatgaatgagtggacagatagaagggtggatggatggatggatggaaaggtggagggatgggtagatagatggaagcatgggtggatagaagggtggatgaatgggtggacagatagaagggaggatggatggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacttctctgctggctcccagtctagagctctttcccctaagccatgcgtctaggggatatggtgggcagaagctagatgctagcctttggccagcccttcaagggcaccttctcacccccaggcatcgagggggttgctgggtgcccactgtactcctcctgattctgactcgggctcttcctgactctttcccttcccagagttcccatcggtcagtatcattgggggtgagaacatcacagctcctttcctgcagcctgtgaccctccagtgcataggggatggggtgcccaccccaagcctccgttggtggaaggatggtgtagccctggcagcctttggggggaacctacaggtatgtgcaggggccccagggctggcaagccagctgggcacaggtggaggggctgctctgggggcttcctggagactctgagcaaatcccagcaggctgggcataggaagggcccagagccctctcagcctgaaagggtgagcctcagcctcttccgggtcctaggagcttcagttgtcagagggagaaaatgtcagtgggggggacagggaatggtatgcctggagatcggacgaatccctggaatccaagtgcttggctcataactctacctccagagccaaaagtgtccccatgcctcactgctcctgcccccgggctcggcagcagcctggccactcgccatgtcccgtcatcacttggacagccctgtggcatactctctgccccctcccctccagattgagaaggtggacctgagggacgagggcatctacacttgtgctgctaccaacctggctggggagagcaagagggaagtggcgctgaaagttttgggtgaggacgtgggtaaccagcagggcccaggccagcatgttgggtgatcccttggggacccttggggctgaagtgtgtggcgagggagggggaggaggtttttcagtcatagttgtgcacttaacttcagaggaagtagaaagccctgaaatgaaagtgttagcaatagctgtgtagtcccttttggcgggatttttttttttttgagatggagtctcgctctgtcgcccaggctggagtgcagtggcactatctcggctcaccgcaagctccgcctgccgggttcacgccattctcctgcctcagcctcccgagcagctggggctacaggcacccaccaccacgtctggctaatttttttgtatttttagtagcgacggggtttcaccgtgttggccaggatggtctcgatctcctgacctcgtgatccgcccgcctcggcctcccaaagtgctgggatcacaggcgtgagccacggtgggatttttagtggaagaccttgcccacattcatatttacgtttgcttattttgggggtttatttgcagggaaatcctcgtccttgtcccttcccctggctgtgctggcgtcggctgtcctggggtgggggctgggtgctgtatgattgccgtaaggatggcagcctgttgctctttgttcttgggcttgcttccaggagtggggttgcttagtctgaggacatgagctgttttagagcccttagtctaggattttctatggggagcagggagcagcactgctgggatggctgggattagagctgcccagagcttgcacctaccaagctgggtctctccttgtctccccctagtgccccccaacatcgagccaggcccagtcaacaaggcagtgctggaaaatgcctcagtgaccttggagtgtctggcttcgggcgtgccccctcctggtaagacccctcctcttggctgaaagctacttccagcccaatttactgtctaatgaggctggcgagtgacccagggactctctgattggacataatggggagaaatcatcaggtctttcccccccgtttctctcatgttcctctcttcctcttcaacaatgtccttcgggccaaggccatgttagggtccagagccagtgtgaaacaggcctgcaggacatctactcacagtaagcttcacagggctgtccggggctaggggcgaggatcaggacctcagagtcaccatctggtctgtagggtcctcccctctagaccagaagtggaggaaagggccgggagctgggggctgggtgtgggtgtttgcataggggactgggtgaggcttacggtggcccaggaggaaggcctctctcctgctcccatctgaactaggcccaccctgctttgcttgttgcctgtgagccctggggatatttgccccctctcgtggggatgcctgctgagttccggggacatgtcccggcaggatgcagggaagctgcagatacacgcggtccagcctggctttgaggctgctgctttgggctggtccatgttctctaatgccccctaggggacggggtcttctggtagggggagggcagggctgagtttgactctctctgctcctggctgcctcagcctctgcccacggggcttcttctccacccttggtcctgtcttgggcaacattgcccggttccatcccggttccctttcctgaatgaagaactctgaccttctccaatgcctgaaaaaatagtgtggtcaccctggaagtttctcttgggtgcccaccacaccagcagagtctgacgggctggcagcacccttgcttctctcttccattcccccttgcatctctcttcctttcccccttgcatctctcttcctttcccccttacttctctcttccattcccccttgcttctctcttcctttcccccttgcatctctcttcctttccccagatgtctcctggttcaagggccaccaacctgtctcttcatggatgggagtgacagtatcagtggatgggagagttctccgcattgagcaagcccagctttctgatgctgggagctaccgctgtgtggcatccaatgtggcaggtagcacagagctgcggtatggcctacgggtcaatggtgagcttccctgggcctacaaggtcccttgtccaaaaagttgtcttttcattcatttgtctattagtctgtccatccacctgtccactcatccatccatctaccaccccatccatccgttaccccatccatccatcatccatccaaccatccatccatccatccatccatccatccatccatcccacccatccatccacccatccacccctccatccatccacccatccactcatccacctatccacccatccatccatcaactcatctatccatccatccatccatccatctctcatccatccatttatccacccaaccatcctttcattcatttatctacccacctgtctgcccacccatccacctgcccatttgtctacctgtccaccctcccatccacccacccatctatccatccatccatctactacccatctacccattcaccatccattcagtcattcaactacccattctttccttgatccattttctatccaaccacacttattgagtccatgctctggggcggagactggacctagagccctagataagacagacctaggagctttcagtgtagtggaggacacagcaatcagatcattccccagagtactacttgatgtcaattgtgatagcagctggtgaacatgaggtgcaacggagcacctataacagggcactgacttggcctgtggagtccaggaggcatctttgacacttggatacctacactgaggtctctgccaaggcctgaggttatgaagatctggggaatttgagaaactgaaaggaggccacggggcctgggatttacaacactgagaagagggccaggatggtgctggtggccatatggaggctggacctcttgggcctcatgggccatgggagaggttggttctaagagcagtgggtagctgggcagaggcctgggaccctgggcatcatggctggtgcctcccagatacaatggaatcttctggctattttctgccaaaaggggactgcctgtaatatggtatttcatctcacacccctgagttaggaagtagcactgtccagggacccttggtcccctccccatccccataataaatgaccttctgctgaccagaggcctgagtgcgagtgctgcttcctgggtggtcagccttgggcaggtgacttcccctctgtcagcctcagtttcccatctatagaagcctcatggtggtgttgaaaggatggaagtagcagccttgggggcagtggagtggctcagagcccgtgtctggatggctgtccttgtgcttttgctgtggctgtgtgctcctgcaggggtgcccagccaggggccctgcctgctttgccccagtggggctcagcctgtaccccatgtcacccctgccctgcagtgccccctcgaatcacactgccacccagcctgccaggccctgtgttggtcaacacccctgtccggctgacctgcaatgccaccggtgcccccagccccacactgatgtggctgaaggatggaaaccctgtgtcccctgcagggacccctggcctgcaggtcagtagggctgggtggccccggctcaacctccctgcacctcccgtagatgctgggaacagaggtcaggccctgggaacttagggtgagggagaagcagcgatagcccagggccgagggctagagggaggtgggactgaacagagaggctggagccacactgcccaatggtaacgatacattccatgaacatgaaccacctacatcattgtaaatgttcttgtggccacagtaaactgagtaaaaagaaacaggtgagatcaatgttaataatacacgttagttaatccaatatatccaaaatagcttcatttcatcatgggatcaatacaaaataattattgagatattttatattcttcttttcatattaactctttgaagtccgtggcatattttgtacctggggcctctctcaatttggcctggccacatttcaagggctcactggccatgtgtggcgagtggacagaggggctctagaggactcttcctgaggtccagtgtcattgccagctggcagaggtccggaggcccagatgcaaccctgggtttccctgcatcatgaggggctctgagtctggggcaggctgtccaggcgtgctcggcagcaaggccggcttgggcaggtggggttctgccccttggggcctgcaacagcaggacagttgcctaatttgggcttccccctggggtcacaggtcttccctgggggccgggtcctcaccttggctagtgcccgggcctccgactctgggaggtactcctgcgtggctgtgagcgcggtgggcgaggaccgccaggatgttgtcctgcaagtccacagtgagtctcagactgggaaagccatgtggttcagagcagcgggggagatggggtggggggcattcccagtcacttccaaaaggagagaggctgggtggatggaggagtgtccacctgagaacagctgccttccagtaggaatcagtgagatccagagacctgccctagagtatgagctcccgcaatgggtgggagggtgggcaggtggccccgcatagccaggagctctgccccatgttcagggagacgcggaaggggtgtgaagtagcaggaacagcgtggagtggtggttaggaaagccggctcttgagtgtcaccgacatggggttcaaaccctgcctctgtgactttgagctggtcactttgcttctctcggccaccatttcttcatctgcaaaatgagaagaatagcactcacctcaaaggtcaccatggggactcactaagcctctgagctcatgaagctactgtaaccacagtagcttatttttaaatgtcctcctctgggtttttctggggctctgtggaggtataagaaagaatgctgggagctgggcatggtggctcacgcctgtaatcccagcactttgggaggctgaggtgggtggatcacttgaggtcaggagttcgagaccagcctggccaacgcagtgaaaccccgtctctactaaaaatacaaaaaattagctgggtatggtggtgcgtgcctgtagtcccagctactcgaaaggctgaagcaggagaatcacttgaacctgggaggtagaggttgcagtgagctgagatcatgtcactgcactccagcctgggcaatagagccagactctgtcaaaaaaaaaaaaaaagaaagaaagagagaaaaagagagagagagagaaggaaggaaggaaagaaggaaggaaggagagagggagagagaaagaaaaagaaaggaaaaagagagaaggaaggaaggaaagagaaagaaaaaaagagaaggaaggaaggaaagaaagaaagagaaaggaaggaaggaaagaaagaaaaagaaagaaaacgaatgaacgtagtcttgggcgggaggttataggaaggattcgattctagctctttccctttgctggagtgaagatggtggttaacacatattgtatgcccaagagccccacctgtgccattggattgaacctcatggcggccccatcaggtggggattttcattatccccactttacagacgaggagactgaggcccaggagtgcaagtggcatccccagggcctcgcatggcgagtgagtggtggagggcaggattccaccccatgagttctccccctggaccctgcgttccttcctgcaaagctgcactggttatttttgcttcaggggcaaaaggtggttctgagacctgcttaaaaaaatttttttaaacaaaaattttaaattttagaaagttttgagataactgtggataattatagattcacagacatctgtaagaaataacacagggggaccctgagcttccttccccaatttccctcggtggaaacatgctgcagagatctgggatgtggatatcgtgacaattttactcagactggctcctccgaagcaggactgaaggcagaggaagggtggtcactcctggctgctgcgagtagctaggcctgacccagggtgtggcccctccttgccagccccacccatgtgcctgagggagcccttctcctgccccctcctgcagtgcccccgagtatccttggagaagagctgaatgtgtccgttgtggccaatgagtcagtggccctggagtgccagagccacgccatgccccctcctgtgctgagctggtggaaggacgggcggcccctggaaccacggcctggagtccacctctccgcagacaaagccttgctgcaggtgtgcaggcccctggccagccaagcaggcctccacctcggcccaagggcagggtggggcctgcaggtgccccagctcagtgacctgcaagcccctttcccctcaggggatggaggacaaaaccccaggactggttcctcggggcctccctcagggcccctgactcagctgagtggcgccagctgttgggttagaaccttcctcacctgtctgctcctcctcccacccccctacaccttgtgatatgatcattcccaactcagagcactgccatttggtttcccctccttccgttcattcttcaaagccacagcctagccccagcaaccccatgtcaggatctgagccctgaggacaggtcccctgcaccccaccagcctcattcctccaccttctcttcgggtctgttttcttgagctttccaaagaggctgggagctgatgaaatgcaggagcaggtctgagccagtcacatgcctcccccttagcagatctgggccatgaagtttgggaggctggcaggactgccatcgagggggcccttctcaggcccaccacaggcacgtgcttctggaaacttcccggtgcagctggtggggagatgctgtcactgccccgtgctccaagtgggcagcttgggggctcagcaaggtcacgtgacatgtctgcagtcacacagtctgtccagggctcacccatctctgtgcgtcccctcccatggggtgtctttgctctctgccaggtggacagagccgatgtgtgggatgcgggccattacacctgtgaggcactgaaccaggccggccgctcagagaaacactacaatctgaacgtctggggttgagggtctcccaggctgggcaggggggagggggctgctgccttgattgcgtcccaggacacagtcctcctccaggctgccttagccttgctcatnnnnnnnnnnnnnnnnnnnnccctcctccagcctgccctcgccttgctcatcccctccccatctcagccccacccccactaaccctctctctgctctgactcagttgctccagtgttccccttgagggaatcccacaccctgactgtgagagaggggcaccctaccagtctgtcctgcgaatgccggggtgtccccttccccaagatctcctggaggaaggacggtaggattgctgccctcacccagccccacctcattgccaggcacaaggaggctatgcccagtccccactggttacccccaccccagagcctagctgagatgggggggtcttatacctcgagggggtggggatgctggttacagaagtggtgcttcccccagctcctctctactcagtccctgagcctgcaggagcccctggtcctgctctgccagtaagagctggattgaacttcaggcctcacttcagacgtcccttcttccaggaagccctccctgactgccaggctgggacagagcctccctgatgcagtccctgtcacttgtcatgtcacccacattagtctttctgtgtgtgctcctccattagtctgtgacccctgtgaggcaccatgttgaccaccgctgaattccaagttcagtgtatggtacaaaaaagatgctcaaaaaacatttggaattcacttcaccaattttttttttttttttttttttttttgccaggctggagtgcagtggcacgatctcagctcattgcaacctccgcctcctgggttggagtgattctcctgcctcagcctcctgagtagctgggattacaggcaggtgccaccatgcccagctaatttttgtatttttagtagagacagggtttcaccatgttggccaggctggtctcgaactcctgacctcaggtgatctgccacctcagcctcccaaagtgctgggattacaggcatgagccacagcacccagcccatttaaccaatatgtattgagagactgtaccaggccctgttctaggcactggaaatatagcagaggataaaacagatccccaccctcacaatgggggcagtcagataataaacacacagttagtaaatgactctgtaccttaggtgataaatgctatggagaaaaataaagctaggaagcgggaaagatgttctggggggttgtaggatttgcagttttaagttgggtggccaggaatgctcgaccaagcggacttgaaaagctaagggctgaacatgagaatatcacagggaaatgcaccccaggcggaggtaagggtaagtgcaagggtcctggggcaggaatgctggttggatgggggaatgagaggaggcagggaatcagggatgatggaggagagtggagctgccattaccgagatgggagaccccaggggcagatatggtggaaagacctagcgtttggggtgaattaatcttgagacatctgctaaatacctagtgaggtgtcaagtggatggtgagagacaggtgtctggagctcagaggagaggtctgggctaggaagcagcctgggagtagcaagacaagctgaggtcaccaggacagagagggaggaagcaatgccaggtggccactgggtctgcttccctgatgggacatgcgttgagtcatgacccagcccagaggtctgcttctctagaaacagaggaggaagggtttaatccagtaggtcgaggttgacaaatcctcttcctccaaggggtcttcttgatgccaggtctaccagttgcctggtcaccctcctcaggccactgtagctaagtggatggtcgttccttcagtagcctttattgagccttgctgtgtgccaggccctggggagccactaaggatcccagggggaggctggtcgcggtggctcacacctgtaatcccagcactttgggaggccgaggcagtgggtcacctgaggtcaggagttagagaccagcctaactaacatggtgacaccccgtctctactaaaaaatacaaaaattagcagggcatggtggtgtgcacctgtaatcccagctactcgggatgctgaggcatgagaatcacctgaacccaggaggcagaggttgcagtgagccgagatggtggcactgtactccagcctgggcaacagagagagactctgtctcaaaaaaaaaaaaaaaaaaaaaagggatcccagaaggaaattgaggcagagtctgccattccggagggctcaggccagagtaggattcagatggggcacctgtaggcagatctgtgatgcagagaagcctagggggatggggggagttcagaagaggcaccaggaccagaagtggcactcatggaaggcttcccggaagaggtagtgtctaaatggacacctgaaggatgagcaggaattggcaagaatgggtaggaggacaaactttccatgtggaaagacatcacgtccttgcaaatgccctggaccaggagtttcttttttcctgcacccaggtcaacccctccccggggagggggctggcctccagcacgtgtcggctgtggggaggctgttgtacctgggacaggcccagctggctcaggaaggaacatacacctgtgaatgcagcaacgtggtggggaacagcagccaggacctgcagctggaggtgcacggtgggtgagctgggcgggggctggaagggtctgggatcatggactggctgggcaggcgctgccctgaaattggagcaaatacggggaagtgatggtgtgtggtgcaggctttctcctccctcacgttcctggtgtgtgagtccgttctcacactgctctaaagacactacctgagactggctaatttataaacgagaggcttaattgactcacagttccacatggctggggaggcctcaggaaactcacaatcatggcggaagatgaaggggaagcaaggcacgccttacatgtcggcaggagagagagagagccaggggggaagcaccagacacttatcaaacaaccagatctcctgagaactgactcactcactcgctatcaatcacaagaacagcataggggaaaccgcccagatgatccaatcacctcccaccaggtccctctctctgcacgtggggattacaattcgagatgagatttgggtggggacacagccaagccatatcacctggcattttaactgcccctcccacacagcttctcactaacccaagcattgggggtgggggcagcagcacagtccctaagggccccccagtggtccagaggagaaaagccacatctgaaacagctggaaacccgaaagaagcatgagtattatgtgaagctcctatatatgatggaaacctaaagccctatctactggtcctgcagtgatgaaatgaaatcccccagcctggtaaaaatcctgctagaaaataaaaccaggaacagtgctgttcaacatcttgaggagaaacccacccgtagaataatttcccacccctaaccagtcccaacaactgttgaaactccaggaagtctctggtttttgaggaagaaaacccatcacacttcctgaaagggctgttccccacatagcaggcctgcctgtgactcccaggctgtagtagcagtagggtgctgttatgaccccattgttgggaaggaaaatggaggtgaggtcacgaggtcacacagccagcgatggcaaggggagagggtgtgtccctattgggcccggggtaagtgtgtggtgcctggtggccccagcagctttctctgatgggctttctccccaccccaacagttccccctcagattgccggtccccgggagcctcccacacaagtctctgtggtccaggatggagtggccactctggagtgcaacgccacagggaaaccccctccgacagtgacatgggagcgggacggccagcccgtgggggctgaactgggcctgcagctgcagaaccagggtcagagcctgcatgtggagcgggcccaggctgcccacactggacgctacagctgtgtggccgagaacctggctgggagggcagagaggaagtttgagctctccgtactgggtgaggaccggcagctgctggaggagttgggctggggcagattagagtgggcaaggtgggttcaatctccaggcacggccctcaggctgtgatcctggggtcacacctgttctttctggagtcagggctctaatgagagctgctggtggggggagccaccaacactgctctcaaaatcaggactggtcccaaatggccccaatttcccccaattcgcctctcctccctccctctctccctcttgggtttactcttcctctactctgttctgggcactgggaaagtaagcagtccctgtcctgcatgactggtatgtgatggggagaattcaggggcttgtgagagaccaggaaaaccttgaatactgttggggcaggtcagggcaacctcccagaggaggtgccttttaagctggaccataaagggtgagtaggagttaggcagctgctaggtgaggggaagcacgtgccaggcagagggtggctggggcagcctcatgcattccatcatttactgagctcctactgtatgcctgaaggataattcagggtggagacagggagtggtaagagatagggtgggagaggtgggcggggatcagtttagggagggcgcccctcactgttgctgggatctcgagcctcacccagatatccccaacacccccacccccctgggtagagagtggcttccttcaggaacaggttccttcagaactgcagcgttgccacttagcttccacacctggatttaggaagcacatctggcttcgcctttgcactaattccggtcctactggctcagcgcttgctctgcccagatactggactgggcactttcacgtattcctgttgaatcccccagcatcccgctgagggcttggggagactgaggcccaaggagcctgcccgactccagagcccagcctgtggcgccatgggctccctcctaggtgtcctcactttagggggagcagctctgctctcgtcacttctgctcctcagactctcccaattgggtggagttggggggcagtcagtggggctggggaaggagcatgaagcacacagcccatatctgcaccctgaatgtggcttcttctttgtgtccagtgcccccagagctcattggagacttggacccgctgaccaacatcactgctgccttgcacagccccttaactctgctctgtgaagccatggggatcccacctccagccatccgctggttccgaggggaggagcctgtcagccccggggaggacacctacctgctggcaggtaagataccagctaaggttggatcctgggaatcaggtcgggctctctgcctctgactctatccattacatgcccatgacctctgactctgagctgccaggcctggttggaataatcattccagctgctggtccccaaagaatgcagcccaaaacactagtcaggtgaggtgctccaggaaaatatcatggatttagataaatttggaaaaggcttcctgctctgcttatctagagaaccacaatgaacatttgcatagcaaaggttctgataagtcctgcagaaaaaaaaaaaaaacaaactttggcacttatatataacatcccacagaacagtaacaagttttggatgtgctgatctaagcaccttctcctctgaatatttatcctcctcataaaatgggtttgtgaggttcttgctggtatacaaatgaggaactgaggcccaggagtctctgtcccatccaaatcctgcaaggacttcaaggcccctgaggctatgcctcagtcacccattggttgttccacgcagcccatgatgagatggcaaatacatttcctcttgggcatcacttctgagcacttggtaagaattgccgggtgcattctgtggataggaattcagagactgcattgggcccagtggaaaggaatgtggcaatcagttagtaatgtcggctctgggtgcagtaacagcagtggtgtcctgtgtcctgtgtatctgccctccacacactgatcttgggagacccttgggttcctctgagaggagctgtctctccctgagagatccttgggaggagaagcccttttaccatgtctgtcagagtagagcagaggtctgctgggccaggactacataacccattgctctcccttcagctccagccaatccccagagccaggggtggccagggtgacagatacttcttgctagagcagggtcctcagatttattctggtacgtgtctaatctccaggcagttccatccatttgtttaccctcctgggcctcagtttgtggatctgaggaacaggacacaatgggagacagacatgtacacgcctaattataatgccttttcctgctgggcagcagggggctcggcttgggacagaatgctgctcagagccatgcttggggcccacgcccctccctccccaggtggctggatgctgaagatgactcagacacaggagcaagacagtggcctctactcatgcctggcaagcaacgaggctggggaggcacggaggaacttcagtgtggaggtgctgggtgcgttacaaccccattctcatgggtgccctatgaactcttccccactgcctgggagctcccagaggcaggtccccagactcatggctcatgctgtagcaggggcccagcacagagaaggagggagaagctaagccctgtacactttgcctcatcaaaaacctttgttcaagcctgggcagtgtggtgaaaccctgtctctattaaatgtacaaaaattaacagggcatggtggtacacgcctgtagtctcagctactcaggaagcagaggctgcagtgatcgtgccactgcactccagcccaggtgacaagaaacctctgttctcaggccaccatggaactttccagaaacagcagggacaatcgaaagtggaagggggcaaatatttttgacaccactaagactgcctgcctctcatcagagtcttcttctgagacactggtacttccatcaggcagcaggaaatgtttcttaaactcaccaccctatggaaacaggcatgggatggggaaactgaggcacaagaaacggtgggctcttggcttcttgttctgtgattgtgtagcctgggtgggccagccccccccccccaccccatcactagccatttgtctccctgcttctcccagttcctcccagtattgagaacgaggacttggaggaggtgatcaaggtccttgatggacagactgcccatcttatgtgcaacgtcacaggtaagggccacatgatgtgatgggctgggagaaggggcgggaaggcaccttcagaaaggaggggatccctggggatctgcccacctgccccagccccactcctcctgactggggtctctctacatcttggactcggcaccaggtcccagctcatctttgcatgtgttcttccatcccaaacactcttccctctccccacctcactacagacctcagctttcaggaccctccacagggagtccttggctggcccctaaggctcagtgggccatctccactgggctcccacaaaccccagtgcttccctgtcctagcactgacccacattggaccatagtggccttgtggcatctgagcttcttgaagacccagctgctgccttgtcaccatggtttccccagtgcctggcagagtaggctcccattcgtgcttatgggttgaaggatggatggatggatggatggatgggtgggtgggtgggtggatggatggatggatggatggatggatgaatggatagatggataggtaggtgggtggatggatggatggatggatggatagatggatggataggtagatggatggatggatggatggataggtaggtggatggatagatggataggtaggtggatggatagatggataggtaggtggatggatagatggataggtaggtggatgggtagatgaatgggtggatgaatgaatgagggttggatggatggatggatgtgtggatgggtgcatggatggatggatggatggatggatggatggatggagaaatttgtggctgaataaaaggataggtgggtaggtagatggttggatggttgggtggttgggtgggtgaatgggtggatggttgggtggatggatgaatggagaaatgaatggatgattggttgaatggagggatagttgggtaggtagatgaatggatggttggatagttggatggttgggtggatgggtgggcggtgggtgtgtggacgaatagagagatgaatggatgattgattgactggaaggataggtgagtaggtagatgaatggatggttggatggatggatggattggtgggtggtgtgtgggtgggtggatgaatgaatggatggaaggaataccttgtttttctgtcttgcctgtctatactaagccatctctagccattcctcagtaaggagaaggcagccaaatcacagaggaaggggcacaggctgctgctgcttcttcttgtgcttcatgggcctctgggccggaatggaaaattcacatcccctgatccatctgggagcagcctgtgacccctgggctgccctagtcaaagcctgccaaattgtctcattctctgctctgcatacaggccacccacagcccaagctcacatggttcaaagatggccggcctctggctaggggagatgctcaccacatctccccagacggagtcctcctgcaggtcctccaggcaaacctgtccagtgctggccactactcctgcattgcagccaacgctgttggggagaagaccaaacacttccagctcagtgtcctgtgtaagttttgggcatctcctggccaccgcgggtgctggagggagggagaagcaaggtgactggctccttacagacaacttcccacaaaccattctactatttttcttctaattctccgagtttgacaacaaaaatcatatagcgactctattgacggaacatttattatgggccaggcatttcaacaggcctgattgaatcttcacaatgacactaggaggtgggagatgtgcttgtccccatgtcattgatgaagccctgaggctcagagaggtgacaagagttattgccaggccccagggtggtgggttcacaactaggcatctctccatctcctgaggacaatacatacctactattctgtaagcctggagaaacagagcatctatcaaatgagaggggcacagaccagcttagaaaaatctgtttctaaaatgctggcagttaaaaggagagtcccctgcgggggttgaaagaagaaatcttgggaccaatgaaagcaaagctactctactcagcggggaacaaagcccccaactcccactcccccctcaaacagaattgagaagcctctggttaattggtagagaggctggatgttgagaagctatggggaaatggaggcaaaaattattcagctttcccttgtagtattgcttagcgtttggagagccgggctctgagtcacccaggcctgagttcaagcctggccaccccgggcatgggcttctctgagcctcagtttcccatctctgtaatgtaactgacagaagtaccgaggccaagcaccggggtctgaggctttcctggtccttagtctagggtcagggatctctgctcataactgcctccctggccccccatcacagtggctcccaccatcctgggaggggccgaggacagtgcagatgaggaggtgaccgtgactgtcaacaaccccatctctctgatctgcgaggccctggccttcccttcccccaacatcacctggatgaaggacggggccccgtttgaggcctccaggaacatccagctgctcccaggtgacgccctctggggggaaaggagggagggaacaggtgacatgtcatcagaattggaggagaggacctgtgagcctgtcctcatgcctggcatgaggctgcagatttggggtgaccctggccactggcccccacacaggtacccacgggctgcagatcctgaatgcccagaaggaagatgctggccagtacacctgcgtggtcaccaatgagctcggggaggccgtgaaaaactaccatgtggaagtgctcagtgagtcggggaccctggggcacagccgggtgggcagaagaccgcccgggaacctaggggcccaggcacctgagccacccttggtgctccagggagtctccatgtggcatatgtcctctgacagtcaccgggcagctagggcgggctccagaggacacaatgaggagagaacagtgagttagggcttgtgccacttgggctcccagacccactgcagtcctagcttcctcctgccacttctgctttggagtataaacagaggctctgcagattgagactggggacccccaaggaagtcctctgaggtgaccccagaaattcccttgcctcagacctgccccatcctataactcttgcagacaaatgctctctcccttaagtggacagccaggagcaggctggcttccaggatccctgtgtctcttgggccggcccccatttctgaggctacccccaggaccagggtaagctcagggtttcagcacccatcccccagctctgctctcagacccctcgtgcttttcagtccccccttccatctccaaagacgaccccttgggggaggtcggcgtgaaggaggtgaagaccaaggtcaacagcaccttgaccttggagtgtgagagctgggctgtgcccccgcccaccatccgctggtacaaggatggacaggtgagtttgggaccccctgcgcagcttctggctctcacctctgcttccggctggttctgcttggaaccttccagaaaaggcttcccttaaagcacctagccctagagctggtccgggccccagtcaccctttatttattttatttttattttttttgagatggagtgttgctctgtcaccaaggctggagtgcagtggtgcaatcttggctcactgcaacctctgcctcctgggttcaagcaattctccctgcctcagcctcctgagtagctggaattacaggtgcccgccaccatgcccagctaatttttgtaatttttggtagagatggggtttcaccgtgttggccaggttggtctcgcactcctgacctcaggtcatctgcccgccttggcctcccaaagtattgggattacaggcatgagccaccgcacccagcctttattttattttatttttttatttttatttttgagacagagtctcgctctgtcacccaggctggagtacagtggcacgatcttggctcactgcagcctctgcctcctgggttcaagtgattctcctgcctcagcctcctgagtagctgggattataggcgcccgccaccacgcctggctaattttttgtatttttagtagagatggggcttctttatgttggccaggccgatctcaaactcctgaccttgtgatccaccaaccttggcctcccaaagttccgggattacaggcctggccactgcgcccagccatatttttaataaaaagttgaactctttgtaaactttaaactctactattttcacccatgtgtggcccttctcatctttaggctctatggatttggttttataaacgtctcagggtgttcttgtcactttatgctgcatttttggagaatgtattgagaattaagcacatttgtcttgctgctcgtggcccctcatttctgatctcccttcccctgaccccctcatcctcctcacagcccgtgacccccagctcgcggctgcaggtcctgggtgaagggcgactgctccagatccagcccacacaggtctcagactcggggcggtacctgtgtgtggccaccaatgtggctggcgaggacgaccaggacttcaacgtgctcatccagggtgcgtggcgccagtgggccaggggtggggcgtcagccagtgtgaggacattgtggggctggccctccgcaggcccccaccatgtgtcctgcagctcacgcgccacccgtggcatctcccactggctcatctcagcagcccagaacggcaccctgccccaacccctctgccttgagggaccaaagtcaagacatgagggctgtggccccaaaccacagaattgagtggtggagcctggaatggtctggttgagccagaacgccacactcttagcccctctgccagatgcctctcgtgttgttagggaaacctggggatttgcttcagaatctctggtcgagagtaagctgagtggcggcctcaatggttgaaactgcctgtgggtacctggggctcattatattcttctcttgcttgcgtcagtgtttgacgttttcctttttaaaaagtgaaggaaggaaaggagggagccgggagtcagagaaagctgggagggagaggctgggaggctgggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggagggtggaaggtaggaaggggaggctgggaggcagggagctgggagtgggaggctgggatggggaggctgggaaagagaggctgggagggggaggcagggaggtgggaaggggaggctgggagcgggaggctgggaggctagaatggggaggcggggaggcggggaggcagggaggcaggaggctgacaggcaagctgggcgatggataagtgttcagaaccaggttttgctacacaatgcccatggagtgtcctggcaggaggaacacctgctctgggctgctcataccctttttcatctccggtgcttctggccaccagtcctctagctctggctctgtcatgaactggttatgttacctggggacaacctggggatgacacggccccctccaggccttaatttgatcctttgtaaaatgcaggtgatcagagcaggtgaccttgagggcccccctccatttctaaagctgatgattttgtgcctctatgctctgatagacaaacatcggctgaagcttagtatctggcttccaactgtgaaaaatatttccatgttacagggagtctttagcgtccattagacatgagctgcttagggaatgagccttatcctagtgcccagcacatactagttgctcaataaacaccggtttagggagtgagggaatttaacaaatgccctgacccaagggaatggctcaagtaatggatttccgcttgggagaggctgggacgagaatctccgtgagcagaggtgcattccccacccctctgctgtgcttcctaagggctttgtctcccccacccagtgccccccatgttccagaaggtgggtgatttcagtgcagccttcgagatcctgtcccgggaggaggaggcccggggcggagtcacggaatacagggagatcgtggagaacaacccagcctacctgtactgcgacaccaacgcgatcccacccccggacctcacctggtacagagaggatcagcccctctcggccggggatgaggtgtctgtgctgcaaggtgggtcaggggtgcgtgaagaaagtgggcgctttgagctctcctgtgtgctgcctgctgtgtgaccttaagcagagcacacaaccactctggaccttagctgcaatttgtaaactggggctacaagttctttgcctgtgtgaaggcaaagactggattgccttttgcctctggtttatagagcagagcctcctatcatggggcatgcccttctgggcttcaagatctgtaatgtccttaaatgatcggcagaagctgccactttctctgcagaggcagctggcttctttgttaatcgtcaacaaagctcatgaccccaaacgctgacgaagctctagctgggcattgaagggcacactgtggtggctgaactcatgtcttttgtgtctgggttttttttctttttttttctatttttattttttgggacagagtttcgctcttgttgcccaggctggagtgcaatggtgcaaccttggctcactgcaacctccacctcctgggttcaagtgattctcctgcctcagcctcccaagtagctgggattacaggcatgcgccaccacgcctggctactttttgtatttttagtacagatggggtttttccatgttggccagcctggtctcaaactcccgacctcaggtgatccaccgtctcggatcggcctcccaacatgctgggactataggcgtgagccaccacgctcagccaggttttgttttttctttcaccaccttaagtggtatttgtttatttaaggtaatttaatttttttaagtaaaccttttattttagaataattttttgtaggtgattttgacttaaaaggctccaggggtggggcttagaaatgcccggcccacctggctcatgagggaagcgtgggtggtctctctgtttgagattcgaactgtgtcctgccagagatgggccggcaatggggctggttttggggagaagtggtcagttgcacaggtctccaatgagcagaatcagaccaggatttctactttggtgcttgcaagaaaaggaggtggctgggcgccgtggctcacacctgtaatcccagcactttgggaggctgaggtgggaggatcgcttgagcccaggtattcaagaccagcctgggcaacatcgtgagaccccgtctgtacaaaatattttaaaactagctgggcgtggtggcatgtacctgtggtcccagctactcaagaggctgaagaaggagaatcccttaagcccaggaggtcaaggcttcagtgagccgtgatcacaccactgcactccagcctgagtgacagatcaagactatctcaaaaaaagaaaaaaaaaaaaaaaagaaggaggcctcttgcagatccaggagtgcaactcttactgaacactgttagttcctattagaaacctctggacagaccccttaacctggccactgaccactgatcctgaccccaagtcctgggtgcacagtaggctctgtcacctgctgatcccgatcagactctaaccatcagctaatcccaaccaatagctgaacccagaccacagccaccaactgccccccagtcctgcccacttacctccaaccctaccactcacctctcaccctgacaactgacctctaacctctgttctctaatcctgagaaaataggcgtcatggtcacggctgacctgaattcttaccctgaccttacactgacctcaaacatcaactgacccctacaatgccactgctgcctcaatcctggccactgggctctgcaggctcttaacctggtcaagctacccacagcccgggccggccagccccagcctagaattctgagcacacagtaaccctaaccaggcccccactggagaccaacgccagcccccatagatgccaggctctggccttggctggctctttttttttttctgagatagagtctcactctgttgcccaggctacagtgcagtggcagtcttggctcactgcaacctctgcctcctgggtttaagtgattctcctacctcagccttctgagtagctaggattgcaggtgtgcaccaccacacccggggaatttttgtatttttagtagagatggggtttcgccgtgttggccaggttggtcttgaactactgacctcaggtgatccacctgccttggcctcccaaagtgctgggattgtaggattgtaggcgagagccactgtgcctggcccctggctggcttttgatcacagagggtcccaggcgatgcctccccagcccctacccctacttctacccccgccaaccaccacagccccaggagttgcctcccttgcctcctgagtctctgcttggactctgcccttaccaaggagctgggctcagcacaacagcagagctgagccagcaaccactgctgtcacgcccagcactgccatgaaggctcaggtttgccatctgtaagatgggagtgacaacagcgtgtgccccacagaggcactgtgggacaggccgagaatgtgcagcccagggcctggcacgcagcgagtggtggctgtaccctgacttgactccactccacccgtgagctgggcaggacaggccgattctcctcatttcacagatgaggcagggacagtcacatgtcccaggtccactccagaggagggggcagcgtctttgctcttgggggtgactctcgtgcctgagcccaggcctctatcccgtgtccctgcaggaggccgggtcctgcagatccccctggtgcgggcagagaacgccgggaggtactcgtgcaaggcctccaacgaggtgggcgaggactggctgcactacgagctgctggtgctgagtgagtggcggggcctgcaggtggggattcccgggactgcaagcgccgtaagggcctccctcagaaggggccgaggcaaagtgcacacagtcttgctgtactcagaggttgaaattggagttacatgctcggcctcaaagaatcatgcaggactgggcgcaggttccaagtcagaagcttcctagctgtgtgacattgagcaaatcacaaccctttctgtgcccccgattccttagctgcatcagggattgggagggcttggagagaagggcatgaggatcccgaccagcacctgacaccaagtgccactctcgcctccacggccacccccgcccccagggacctgtgccagcccctcagccccctctcccccacccccagccccacctgtgatcctgggtgacacagaggagctggtggaagaggtgacagtcaatgccagcagcaccgtcagcctgcagtgcccggccctgggaaaccccgtgcccaccatctcatggctccagaatgggctgcctttctccccgagcccacggctgcaggtcctggaggacgggcaagtcttgcaggtcagggcagccccctgcacgggctaggggcagtggctgctgaggcccagcaccacttgtctgggagccagggaggggtcattatctgcaaatgaggctctttgctgggaaccatgctggagcccagccaagaatcacctgtgaggaggcatgctgggccagcacaggcctgtgcacggcatccagagcttcaggagacacctagcaaaggatgcacatgggtgcgggacccagagcccagcaccgcacacagcagccttccgcgggatcaccagctggcgcgtgcagagccgtgcccagcactcagacatcaggcagccccctgagtcaccccatgtgcagacacagagctgcggggaccctgggagcccaacacacacagcacggccctccacaggggtgggggggggctcttgtcacatctggtttgctacagagaaccacccaacaccaacctcacacgcccgctcctgagcgccacacaaggccctggatggaggaggttccaggtctccatgagctgcctggtgcctgcttccctggcatgggatgggagggattcctcgcagtcattcctgggggtggtggtgtccaaggggtctcaggtatctcccaggcatggctccctgcacccacaggtttccacggcagaggtggccgacgccgccagctacatgtgtgtggccgagaaccaggcgggctccgctgagaagctcttcaccctcagggttcaaggtgagctgggctgagcaggcagcccctgtgggttccttttcccttcccagggggcactgccttggggcttccagtatcctgggctctgggtcctgcaatcagagttcagggatcccagctggccccagccacatcccgagacagagagcatttggggggccctgatcactactgggccaaccccaggtggttttaagcaactttggagatggccaggcattaccaccaccattactgagcacttactgtgtacctgacacgaggctgagcactttccctgggctgactccttccagcagagctaggttagcccacccagctttgcagctgtgggaggagactcagggaggtcgccctcagagaggagtgggattgggggggtctcactgccccggagcctgcactcctaacctctgcaactcatgacgtacaccgcactgcagtggctgtgagttctgtctccagatggtcttggagatggaggaagatagtgttgagccctcaaggtcatgggctcaaacctgaattgatatcttagctctgccactgaccagctgtgtggccttggaacagtgactctccctctctgatcccctacccagtgtccttctgtgtaagagagtcatggcaaatggaggtttctgaattatttgaagttgtgccgaggtgaagccccaggagctgggtgaggctcagggtttctcttgggctccgtgctcccctgctggtgtgattctcatgcctttctctaccgtggtggctgtggggatagtcccgccacgaatcgcaggcctggacttggagcaggtcactgccatcctcaacagcagcgtctccctcccttgcgacgtccacgctcacccaaaccccgaggtcacgtggtacaaggacagccaggccctctccctgggtgaagaggtcttcctcctgcctggtgggtaaactgaggtgtccggcccagctctaaggttacatggggagagagttgctcccccgacctgggacagggccgtcagtcgtgcagggatttaggactgggggctgggctggaatgctggtgtgaggggctggcttcccccggcaggcacccacacgctgcagctggggagagcacggctgtcggactccgggatgtacacatgcgaagccctcaatgctgccggccgagaccagaagctggtgcagctcagtgttctgggtatgtccatgtctgtccccaacttgtactgtccccactccttcagtcacccctcagcccatactcccccagagaacatagacaggagagggccaggaggcacagggggaggctgggacgcccgcacagagcagctctgaggagggggagcagtgggacgggccccaagagcctggctggggaaggggcctccccaagccttgtgtggtgggggaagcctgtttcacagtggagcctgtttcaaggctcgtggtcttcagaatcctcttggggaaaagctggcccaaggtgtctttagcaaggactcgctggaaggttctttctagccccggggctggtccattcacttgcacgaacaccagccagacactgcgctaggcctgtgggctcacagccatggggaaggagggcttctacattggttcactggagccacaggggctgaacgggcctcgacagagggctgtaacccagctggggcctgcccctgtaggaaaaagcctgggtgggggcgggcgacagcatctcccccatctaggaggctgaggctcagagaggcaggaggctgtccctggtcactcagtgggtccttggcgtgctggcctggttctcttcctccacctcccctgggtctgcgccagcccccggggctgggtctgctgtgtgaccctggtgggtttccactggcattttccctgtggctgagtggggagggcgcagggacagctgcagcacctcactctgctatctcctgcccccagttcccccggccttcaggcaggctcccagaggtccccaggatgcggtcctggtgagggtcggggacaaagctgtcctgagctgcgagacagatgcgctccctgagccaactgtgacctggtacaaggatgggcagcccctggtcctggcacagcggacccaggctctgcggggtgggcagaggctggagatccaggaagcccaggtgagcaaccctgggggcacgggcagccatgagcgctgcaggaaagtcgcctcccagccctggcgagctgcggggaggaaggtgggcaggatgtgagttgctgcctccttggcctgtcagaccccaaaccgagtggattagcagcttccagggtggaagacatgggcggagctcagggctctggagtcacgttccagacccagccctgcagtcatggcatgagcccttcctgcctcggtttcctcagcatctagatgcttttatctggtccgctccggctgaccatctgagactcctgggagtctgccctgccctccctccctccttccgtggagtggattagatgctcacagtgtttgttggatgaatgtttgctgtccccctcgaaatccattcctggccaggctccatccccacagcaagggggacctcttcctgccagcttggcccagggagggaggtccccagagcctgtgtattcactgttgaggggcccttctgcttcttgaggctcttggaaaaggccagagcgtcctgattccctttggctccccagtcaggaccagcatatttgggaggcccctgctctggaagttttgggggcctagatgcttttggggagccctagcaccccacttccagctccagcacacagccactgtgtgctcttcctctttcaggtatcggataaaggtttatacagctgtaaagtcagcaacgtggctggggaggccgtgcggaccttcaccctcaccgtccagggtaagccagggaccagcctagccaacgtgactgtggagcccctagcaacacccagggctgccaaggaggacaaagacaatagctgggcagaggcagtgctgccaagtgctgaaggcacaatgactagaatttgtgtacctatctatatctacatctctttctttttgtagagatggggcctcattatgttgcccaggctggtttcgaacccctgggctcaagcaaacctcctgcctcagcctcccaaagtgctgacattacaggcgtgagccactgcacccagctaatttctagaatttaaaaaactaaggttagcaggctccaaatagaactctgccagtgacctgcttcatggagcttagtagagtgactttgtccctcagagcctaaggtttaccttcagtgaatgagtctaaaagcagtagctgcctgccaggcacagtggacctgccatggatcccatggaccgccatgacagtgtctataaagtgctgggcacagggcctggcatgtgggcactaagatgaaggagccctatgagatcagacacacaggaggccacgttacctgcatcttgatccccaggggggcctgtcccatccacccaaggatggagcacagatgctgtttgattggacatgtggctccagctggggtgaggaggagcctatttacactgtccaggaaacttggccagattttctggtgctcagatgtcatgttagttagaatagagacttagccgtgccacaaaaagaccccaaaatatagttgagtaaatgagagagtttaactcttattcaaaagcccagaggtgggtgtctaggctggtgggtagctcggctccatgcggtagttaagggacccgggttccttccctcctgttgatcttccatttcttagggtgttgttcttgtgcatatggttgaaactgggacacggcatcgtgtcctggcccacaggaagcagaaaagagcagaagtggtgggcaagcatttatttcatacagaagttgcacctgtcccttctgcgtgtattccattagtgagcgctcaggcagctggctgcaggggacactgggaaatgtagtttctgctagagtgatcgtgggctcagctaaaactctgctatgcacagtgggaagaacgggctgatgggacaccagccatctgccacagatgccaaagccagtagcctcccaaccaggtgagcggtgggcacatgcaaccctgagccatacacaacacaatcgttgaaaaggactgacaagatggagtgcaggggctcatgcctgtaatcccagcactttgaaaggctgaggcagggatgatcacttgagcccaggagtttgagatcagactgggcgacatagtgagaagcttgaatctacaaaaaataaaaaataaagtaacaagaaagggactgacaccaggcttgctgctcaaagctcccagccctttctgatggctacattgatgaacagtggaaagggggaatatctggtccctgagggcaaaggcatttcatcttgagcctggttgactctgttccgctggtggtgtctgcctggggtgtgtgacttcatcctggcggagcaggagagagtgttgggatcgattagtgatgtctgccctggcacaggttaaggactgtgggtgagtgagcctcccatttaccatccttgggctaaggagaccccgctggagctttgctttgtatgctttaaaatagccaggcactggttctatttacatttgtgaataaaacatagaatgggaactcctaactaccaggaagggcttcttaggcctccctgatctgcctgaggggaaggaaattggggaagagtctcagaattctgacagtctggctttcttcctgcagtgcccccaacatttgagaaccccaagacagagacagtgagccaggtggctgggagccccctggtcctgacctgtgatgtgtccggggtccctgcacccacggtcacttggctgaaggacaggatgcccgtgggtgagcacatctgtccttgtctgtttcgcgtaaagcattcctttctttaataagatgacagcagaagcggacgaaggaagttattggttgttgatgatcttggcaaaaccagagactggcagtgccgtgttgccccccccccaccatttgtgtttgagtgaagcgttgtttattggcccttggaatccaaacataaagagcgtctcctgtgagggtttggaagctcctttgcatccacgtcctcagtcagctcccatgagacagcagacgtgggctctccattgcgcagggcaggtgctgagggccatggaaagcccactggctgacactgggctcagcattggcccccagagctgctccttggtggtgactcagctcggtcctagctgggccgttggtcaaccccatcccccatccaggcctccccattctggccgctgctgtgcccaccgttcctccgcatgacggcagaagccccacatggtctcctgggcccactgtgcctctcacgcaggctccacgtggggcagaaaggtctgaaggtacagctcggagctggtcccttgtctggtggaaatccgtccacagcaggggccggcactgccagccacctctccctgcccctccatgcgctaaacgtggctgtgctggctcctcgaacctgcccctctctctcagtaacagctttattgggatataattcacacactatataattcacccactgaaaacatccaattcagtgatttgtagtacagtcacagagttgtgtgaccatcaccacaatcaaatttagaacatttttatcaccaaaaggacacccgtatccattagcaatcactccccgttttccccccatttcttcttcccccagacccaggaaaccacaaatctgctttctgtctctgtggattggcctgttctgggcatttcacattaatggcatcatagagtgtgtggccttttgtgtctggcttcttccacttagcgtgttttcaagtttcatccgtgttgtagcatggatcagtacttcattcttttttttttttttgagacggggtctcgctctgttacccaggctggggtgcagtgccacaatctcggctcactgcaacctctgcctcctgggttgaagcgattctcctgcctcagcctcccgagtagctgggattacaggctcgcaccaccacgcccagctaatgtttgtatttttagtagagatggggttccaccatgttggtcaggctggtcttgaactcctgacctcaggtgatccacctgcctcggcctcccacagtgctgggattataggcatgagccaccgtgcccagccagtgcttccttatttttaaaaattaaatttttctcttcattcccttctgtggctgaatattccattgtgtggctgtgtcgcgtgttgtgcatccactggtcagttgatgggcatttggggtggctgcatcttttggctgagatgctcagtgctgctgtgaacctccgtgttcgtgtttctgtgtggacctgtgtcatcgcctctcgcgggtcaggtggctgcaggccccacctccctttgcgtccagctcttggcacatgtgttccctgcctggaatacccacccaggctcccgtggtcacctctgctccccccggctgactactgctcaacattcacgtctcagcggagattcaccacctctggaagccctcccccacccttcctgtcccccaagttccccggctccatcaggggctcacagggcttgtcagcactgggtccccttgtttcatggcccccacccccgatacattgtgaactccttgaggacagggactgagctgccctcatcttgattcccaggctctgcgctggacatggggcagttgctcgtgtctttgtgttgagaggctggctggatccatgaggatctgggcaaggagatcgtcctgggctggggccgtgagagatggctttgggcaggggtgtggctggagagaatgaagggggaggcctgaaggccgggagtgggaggagcccgagcagaggcccagggggaagccccagtgtgacctgtgtagggtcagtgaggggctggtttgacttgagcagaaaccttgatagacaggggtagaggggcagggcatggagggagaaagcaaaagcagaaaccttgattgatgggggtagaggggcagggcggggagggagaggatgggagctgagagctgggcctgagagcaaatcctggacactgaagggagggggtcccttgggaagagctgtctcaagtggaaggaaatgaggaaggcttctaaggaacagagactgggctggggaaggtggggacatataagaaggcgcctctgcctctgtggggctcagtttcctatgagcacaagaaggggctgggggattcaggggacccctctgtcccacagagagcagcgcggtgcacggtgtggtctcccgggggggccgcctccagctgagccgcctgcaaccggcccaggcgggcacctacacgtgcgtggctgagaacacccaggctgaggcccgcaaggacttcgtggtagcagtgctgggtaggtctgcgcctgcaccctcctgtcccactcccatggcagcccctgccatcacccagggcctcactgcacccctgcctcagtggccccccggatccggagctcgggcgtggcgcgggagcaccatgtcttggaagggcaggaggtgcggctggactgtgaggccgatgggcagccgccgccggacgtggcctggctgaaggacggcagcccgctgggccaggacatgggcccccacctccggtaagacttggcccatgccctccccagaggcggtagggcccatgttcccttacgcctctgccctgggccctccttccctgtggcaggttctacctggacggcggctccctggtgctaaaaggcctgagggcctcggacgcgggtgcctacacctgcgtggcccacaacccagccggggaggacgccaggctgcacacggtgaatgtgctgggtgaggagccccagggcatctggagggtgatgcgtgggcctgggcacgggagataaggcgacatgtgagcaaagcccacactgtgtcctgggccacgggtctcacttccctgggcctccatggcccatcctcaaactagaggacaatagtgccagcccagggtatagcggagattcgggaggtgagaagagagtcagggagtggctgtgtcccccatgcagcgggcctcatccttcacaagggaccactgtggttgctggcggcagaagtccaggtctccacttctgggatttccctgggaggagcccaccttcctcccaagacctccgcactacccctcttttttctacccaccctcagttcctcccaccatcaagcagggagcagacggctcggggaccctggtgagcaggcctggggagctggtgaccatggtgtgccctgtgcggggctccccgcccatccacgtgagctggctcaaggacggcctgcccctcccgctctcccagcgcaccctcctccacggctctggccacaccctcaggtaggggagacggtggacaggccttggctattccactcagagtggacatgtggggattgtcagcaaatgggaggtgctggaagccaggactggctgcaacacccactccccaccccacagcgagtgtggactgcgccccagatgctaatgctaggatgggtctcagggacccagggaaggggaggtggtgggggtaggaggagatgcaggagaagtcaggtttcagggaaggagagaccaactgggccacaggagacgaggcctgaggacggactgttggctttggtgctgtgcctgtcactggggactgggcaagagcagctcaggaggagtggttggggcgaaaggggctgagagaaagtgggaggacagagagtgaagccagtgagctgagatgactccagtgagctctgagggcaaagagggctgcgtagaggaaggggagccaagctgtccatatgggacgtggagcttcccgaatttgggaggcaggaggtctggcttcagaatgagattggttggagcaggcagcaggggtggaggcagctggaggctttatcctgggggcaccgggaacccaggtaaagagtttaagcaggccgggtgcggtggctcacgcctgtaatccagcactttgggaggccaaggcgggcagattacaaggtcaggagatcgagaccatcctggctaacacggtgaaaccctgtctctactaaaaatacaaaaagttagccgggcgtagtggcgggcgcctgtagtcccagctactcgggaggctgaggcaggagaatggcgtgaacccgggaggcggagcttgcagtgagccgagatcgtgccactgcactccagcctgggtgacagagtgagacaccatctcaccatctcaaaaaaaaaaaagaaaaagagagagtttaagcaaaggctgggctcagtcaccccgccccctctggccagcaagctcttgggagacaaaggttggaaaagggaggaagtctttccacgcagccagcctctcctgtctctctccctttctcttcctctctctctctccctttctcttgtctccttctccctctcctctcgggggattcaggatttccaaggtgcaattggcagacgctggcatcttcacctgtgtggccgcaagcccagctggcgtggcggacaggaacttcaccttgcaggtgcagggtatggagcagggggtggggcaagggggtctctggccttggtgggtgagaatcaaggcccttggcccccctgcccttctgggtggaaccaaggatgggccctgggggcgtcgaggagagcggacactgcggctcagtctctgactcactgtattgctcgtttgtacctcacaagtggctgtgggcactctggtatgcccaggataggcgggggcagagaggcaggaagcagctcagtaaagagacaatcacaattccagggaactagtgacaccaggggatggagaggatgctgtgggagcacagaggagggcacctcacctggccttgggggaccagggcggcttcctggaagaggtgatgtctaagctgagtactggagatgagagtcctggaataaaatggttcctgcccacctttctgccctccatagtgccccctgtcctggagccggtggagttccagaatgacgtggtggtggttcgtggctccctggtggaactcccgtgcgaggcccggggcgttcccctgcctctcgtgtcgtggatgaaggatggggaacccttgttgtcccagagcctcgagcaggggcccagcctgcagctggaggcagtgggagctggtgactcggggacctactcctgtgtggccgtgagcgaggcgggggaagccaggaggcatttccagctgaccgtcatgggtgggtcctctggcctctggccagcttctctgggctcgggggagagggtgggactctaggggcaatgggaaggacagtgagggaggtgagtcccctggagacctgggactgccacctgggagcagaactcagggaacttggttctggctgggatgcctctctcaccttccttgcctgcggggagtgggtggccgggctttgattctcccagggctgtgctcctggtttctttccaccaaaccttggtggcagatgcaagaacaagggccaccaaaatgtgggagcagagcccctggactcagcacagtgttttcaagtgcggtgctgtcccggaaatgtgtgtcaattgtgtgttcccctccatggtggcttgcagagccccctcacattgaggactcaggccagcctacagagctgtcgctgacccccggcgcccccatggagctcctctgtgatgcccagggcaccccccagcccaacatcacctggcataaggacgggcaggccctgaccaggctggagaacaacagcagagccacacgggtgctccgggtggagaatgtgcaggtaccagtgccgccgccatggggcgaggctgggggttgggggagaggggagggactgcaggttccccagacccagtgggcagttgacaaagttgggctgaagcacctcctctgtgtggggtgtgagggtgtggaggtgacccaccttggccgtgcccttgggagctgccagcagggtcagggcccaggctgatgccaaaaccaggtgaccccatctaggccagaggagggctggtgcagttaagggggacttctgggaagaggcaggcatcacaccagccctaaagcaacagtgagatggagggagagggcgtgggttggctgggaggtggatggcagacctcgcagggctgagtttgaatcctgggtccctcgatgcatgagaaagaaaccagattgggaggcgggcagagaggggccaggggcagctgctcaacccgctccatccccaggttagggatgctgggctgtacacttgtctggctgaaagccctgcaggtgcaattgagaagagcttccgggtcagggttcaaggtaggtggtgggggtggggtgggggcagggccgggaggcaggacgggctcgcggcaggggtgagtccccctctcatatcctcttgtgccacccccttcccagcccctccaaacattgttgggccccgaggcccccgctttgtggtcggcctggccccagggcagctggtcctggagtgttcggtggaggcagagccagcgcccaagatcacgtggcaccgagacggcattgtgctgcaggtgggcgccaggcagggccccagggtgctgccttctgtcccgctcaggcctcagacctgacctggccggatccaagatccagagcgggtgccaagggcccgctctgagctgcactttgcaccctgttccccgggtgtcataccccccgccattgtcattgtcactcccattttatggatggggacactgaggcaaggctcaggtcactcagggcttccgaggcccacccagtattctccccctggctccttcaagctatgcttagcagctgtgtggcctggaccggtgaccaaggctctccgtgcccacccctcaaatggggtcagtttgcggctgtggattcagggttgtggatgttctgacaggaactccagagaaaggggatgcatttcctcccagaggagtgcatttccttagagggtcctcggcggggcacagtcagggcctgcggtcagcctggaagtacagagccactgtccagcttcaccagttcctcagtcttccacatctgctgccgggtggcctgacgcagctgggcactgataagggtctgtccaccctggcggggctctccaggaggacgcccacacacaattcccggagcggggcaggttcctccagctgcaggccctgagcacggctgacagcggcgactacagctgcacagcccgcaacgccgcaggcagcactagtgtcgccttccgcgtggagatccacagtgagtagggcccgccccaccccaccctgcccaccttaccccaccctgcccacccccttagagccacagctcccagcaccactccctctgtgcccctccccagcggtgcccaccatccggtcaggaccacctgcagtgaacgtctcagtgaaccagacagccctgctgccttgccaggccgacggcgtgcccgcacccctcgtgagctggcggaaggacagggtccccctggatcccaggagccccaggtgggagagggaaggggtgggcctcagggaggctctcaggtgccactttgtgggttgcaaatcaaactcacttgggcaattggagcagaaaagtgactttatcatcaggacgtggggtgtctcagaacacaaggacaggcccaccactcatgaaggtctcttgcttgtttaacttgatcagaagccttgatagatggggcggggtagaggggcatgaatggatctcatgagatctgatggttttaaagcttctctcagcttctctctgtgtaggcttcatctctttctctctcttaccttcttccttggtgaacatgggagaaacacaccccctgacaaccccgtggcccccagccccaggtttacagctcctcagctcactagcaagttgtctgtgaatcccaactctaaattcccagggcacagaatgccattggcccagcctgagtgatgtgtccatcccccatccaatcaactgtggccaggggcgggattgcacagtacagacatggcccttggaaagggcatttttcagatctaggggctgctctcaggaagagcagggtgctgcgccttctgcgtctcaggagaggtcaagcccaggagggtgctggagatgcccaaagcagcccttctctccatctttccaatgttggcttgggctgtggggagctgctcatggctctgaccccctgaccttggcctcacagatgcaagactctgacctccaaagttagcatctgtattaggccattttcacgttgctgataaagacatacctgagactgggcaatttacaaaagaaagaggtttattggacttgcagttccacatggctggggaggcctcacaatcatggtggaaggaaaggaggaacaagttacatcttacgtggatggcagcaggcaaagagagagcttatgcagagaaacttacgtttttaaaaccatcagatctcgtgagacccattcactatcacgagatcagcacgggaaagacccgccccccaattcaatcatctcctaccaggtccctcccacaacatgtgggaattatgggagctacaagatgagatttgggtggagacagagccaaaccatatcagcatcctctcactgggaaagtgggggcagagggaagggtcttgctagagacagccttgctccagaccccactggcttgctcatctccagggcaacccccatccattctaggtttgaaattctgcctgagggttccctgagaatccagccagtccttgcccaggacgccggccactacctctgcctggcatccaactctgctggctccgatcgtcaaggccgtgacctacgggtcttgggtaggtggcctggggaaggccttcagtgtccagtccctgtcggggtccagtccttcttagtttctgagtcaccccagctgtaggggccaagagccaatggtcttcaaatgtttttgaccatgaagcccattagtaaaaagttgtgatcatgcacactcaaaggacacagatgtattttagtgcatatattacgtaacagaacagcgattcgattaagtaagaaaccatgtacaaaaggtaaaacaagtctgagaggccgaggcaggaggatcacttgatcccaggagtttgagaccaacctgggcaacatagtgagaccccatctctacaaaaaaaaaaatgtttaaattagccaagcatggtggcacgtgcctgtagtcccagctacttgggaggctgaggtgggaggatcacttgagcccgggagtttcaggctatagtgagccatgatcacgccactgcactccagcctgggtgacagagtaagactccgtctacaaaaaaaaaaaaaaaaaaaaaaaaggtgaaacatgtgaaaggataaaattcaaaatcactagaatcagatgccccagtctcctccccctccaacagatcagcttgtgagaggttgctgtggtgggccctggcctcaggtgggggctgatgggagtggaggcctggaggcttcagtcaaggaaaggcactgagggggtgccaggctcagggatggggaaagcccaaaacaccctgctggaagcgctgtctcggggctttctcctgccctctccctctgtgctccctcagggatgggtggaagacagtaggcagtggctttgcccctgggcacagcctcagagagcccccagcccctgtgccccctgcacctgtctcctgaccactgtgctctccccagagcctccagccatcgcccccagcccctccaacctgaccctgaccgcccacaccccagccttgctgccctgcgaggccagcggctcccctaagcccctggtggtctggtggaaggacggacagaagctggacttccgcctgcagcagggcgcctaccggtaacgagctggactttgcggtggcttcctgagacgcacagggcggggaggcactctcttctcacgggggcatggggcagggacggggcggggtgtgctcaggtctcaccggagtcaggaccagaacttgtgtctcaactttggggatcagagagtcttcacactgagataggggtgagggcactggggatatacagctaaacagagacatctgggctttatttatatccaccagagtcactcttgtctaaaaacaaaacatgaactgggtgtggtagctcacacctgtagtcccagcactttgggaggctgaggtgggaggattgcttgaggccaggagttcaagaccagactgggcaacatagtgagaccccatctctacagaaaatttaaaaattagtagagtatggtggtgggtgtctgtggtcccagctacctgggaggctgagatgggaggatcccctgagcctgggaggttgaggctgcagtgagctgtgattgtgccactgcactccagcctgggcaacagaacgagactgtctcaaaaaaaaaaaaaaaaaaaaagaatgtccatttttaaaaattggaaaaccaatgtacagagaaacagggatgaaaacgaaaatcactcaaaaatccaccagctagacctgtggggcagaaacttctagaagacatttctagagtcagggctggaggtcagatacaggaaggggaaatgggcgtgagacccccacagccagaaagccacagctggtctctgtcagcccagcagccacttggccgtctgtctgtccaccccaggctcctgccctccaacgccctgctcctcacggcccccggcccccaggactcagcccagtttgaatgcgtggtgagcaatgaggtgggcgaggcccacaggctctaccaggtgaccgtccatggtgagtcggggcagaggtggagggggacacctggggtgggggcagcgccttcccgctcttgggtgctctccctgccagcagggaattgtgtggctttttcctgtgctgcactggacacctcctccaggaaggtctctcagatcctgctgggccacactggcataaccccagctccagcacagttcctggcacacgggagctcacaggagaggcccctcgcaaatccagaatgttctaaactcaaatctgaccttgtcatcacccccgttaaaaatccctccctccacagctgcccgctgcccccaggatagaatgcaacaattcagctggacacaccaggtcctgtgtggtctggccctgccagattcagctcacgccagacctgcctcattccagggtctaatcaagctgctcagcttcttgtttcttgcctcaaggggtttgcacacgctgttgcctttgccgggaacactcttcccctcactcagcaaacacctgctttcccttcagatcgcaggttaaatgccacttcccctggaggtctcctctggcctcccctactccaagtgggaaacccacgagtaaccccctgtgaagttactaggccagggtctctatagaaagctgtatcccactgggtgcagtggcatgtgcctatggtcccagctactcaggaggctgagacgggagggtcgcttgagcccagggagtcctgagctatagtgcactatgctgattgggtgttcgcactaagttcagcatcaatatggtgacctcccgggagcgggggaccaccaggctgcctaaggaagggtgaacctgcccaggtcagaaacagagcagatcaaggctctcatgttgatcagcagtaggatcacacttgtgattagccactgcattccagcctgggcaacatactgagaccccatctctgaaaaaatacacttttttttttaaagaaaaaaaactatagccccgtgcccagaaggatgtgctgagtgggcaaatgtgacttctccctctgttgccacctccctccttggccctttgtcactgatgtcaccttgtgtactagctttaccccctggccctgtggccgtgagtgccctgtgcccgccggcagggcctcaagccttgtcttgggttttagtgcctcccaccattgccgatgaccagacagacttcaccgtgaccatgatggcacctgtggtcctcacatgtcacagcacgggtataccagctccgaccgtgtcctggagcaaggcaggcgcccagctaggagctcgggggagtggctatcgtgtctcaccatcgggtaagtaagggtaagccacagagagaggcagctgaggggagactgggagagcaggcagagggggtgaaaggtcacatggcggaataggatggaactatctggcctggcactgcctctcctggctgtgtgacctgggaggaccctctcgccctctctgagctccatattctcctccatgctctgcagtgttgagacccatcagtggttccccaaggccctctggcatacaagtgctatttcatggcaaaataagaaaaataatagctccctgggagtttttgtaaacctggtttaatcccatcagaaagatcctcctgtattctgaagttatctttggtgttgaaacttccttttcttgatgatattaagataatagtacatggtgattttttttaagatggagtctcgctctgttgcccaggctggagtgcaatggagctatctccgctcactgcagcctccacctcccaggttcaagggattctcctggctcagcttcccaggtagctgagattacaggcacctgccatcatgtaggcatgatttctgtatttttgtagagatggggtttcactatgttggccaggctggtcttgaactcctgacctcaggtgatctgcccttctcagcctcccaaagtgctggaattacaggtgtgagccaccatgcctggcctaacatggtgatttttaaaatgtctttgcctgtcaaaataaaacgttggaagctttatggagagtctccaaatttatttgttagttcgttagcgaaacactaaagtctaggaaccagaggccaaacctgtgattttcaaactgcttctgaagcaatagaacttccttccaggccaggcgcagggactcacgcctgtaattccagcactttgggaggctgaggcaggaggattgtttgaagccaggagtttgagaccagcctgggcaacacagcaagaccccatgtctacaaacacatttttaaaaattagctgggtgcggtggtgcatgcctgtggtcccagctgcttgggaggctgaggtgggaggattgcttgagtgtaggagttcaaggatgcagtgagctatgattgcaccactgtactccagcctgggcaacagagtgagactctgtctcaaaacaaaatacaaaacaaaaacttctttccaataagtgtaataagtggtaacagcaaagtccaacaagtgaaacaaaccacagttctggttccatctggggctgggacaggggctgtgggtgggccagagtgccgtgggccttgcttccttcccccacccagcaggcccccaggggcccacggagcacaatttagaaccctcgtcacttgactgccaaggtgcagcctgcagtctgggaaggttaaaatggtgttcactgagtaaccaaggctaaggccaggaggataaagggaggagaggaggcagtaatcctgggaggcttcctagaggaggtgagtttttagcagagcaaggtgagaatgacaggatgtggaactgtgagtgggggattacaggcaggggagtggcagatcctggaacttcacagcctaaagggtctagagaccatcttgtctgattcttcattgtgcacatggggaaactgaggtccagagagtggaaggaactcgcccatgtctctgctttgggcagggcacagaggcaaacctagatgtcaggttcccatacagtcacatcccccagactgtttgtaaatgggcaaaggaggcaggttgagtgaccagagacagagtggggttgtgtaggagccctgccacctccatccctggggacctctgtcctgatcccctcaccctgattcccaccaacaggcgccctggagatcgggcaggccctccccatccacgcaggccgctacacctgctcagcccgcaactctgccggcgtagcccacaagcacgtcttcctcactgtgcaaggtaagggtccgtggtccagaccccagagttcctagggccaggggagcaggtggagagccagaggcaggtggggctcaggatggaggtgaggccccgggtctcagaggccccgacctgtctcccatgggattctttggcaggaaaagaatcagccatggcgtccttgttgctgtggccgatgtttctagaacccccgttctccttagaggcctctctctctgatgctccgaggcccgctggttggaggagttgtgttaaggacattctcagggccctctgcacccccgtcctttgtagcctccccggtggtgaagccgctgcccagcgtggttcgggcagtggcagaggaggaggtgctgctgccctgcgaggcctcaggcatcccccggccgaccatcacctggcagaaggaagggctcaacgtcgctactggtgagggcccctggcagccagcctgggaagggaagagaagagcgtgggtctgggcagggggggagtcctgcttcctgccctgggagaccccgcagacctgctgagaggtcctggaaagcccctggcctgcccagatacgcccccacccttgctctggcctccccctccccaacccttctcctgtcaccatggcctgagatgccatccgagcactcggtggctgaggtgggaggtcgggagggggcagctgagctgggctcaggctcaggcttcttggctccttctgtcccttggtcattctgtgaccccagcaagtcatttgctgcctgtgagacagaatagcccaatctgcccacctcgggggtccccagtcccagttcccaggcccccgattttcttcttcctcgttcaggagtgagtacccaggtcctaccaggcggacagctgcggattgcccatgccagcccagaggatgctggaaactatctctgcatcgctaagaacagtgcgggcagtgccatggggaagacgcggctggtggtgcaaggtgggagtgaggacggggccgaggtgggccctggcaactgaggggctttgaggcttctgcaagcttctcccttctctgcctggcagggcacactgcttatagttctagaaggaattaaggggaaaacatctctcattgtgcgcctgagttctggtttcagacataaattcccatcccctctgccttctctctggccctgtggaacacaagtctagcatccctcattcattctggtttccagtagctgtagcctctctggccctgctctggcacacacacaattacatgtgcccttcccttagtttgatcaatcattggcttcaaagatcaggtggcatcactggccaaaaatctgcaaagtctgctgggaatattcagtatgggccggtcatgtcttggccccagtggcctgctttgtggtatctcagtggccatccccgcccgcagctatgtagggctggagtcagactctggctgtgaactcagaggggctcctggctccaggattcctccgcttcttgtccagcgtgctcctctcccctgggacctgtagcatcgctggtcaccagaccagccagacaccaagccagtgaccctcactctgcccagcatagctcctccgcagggatgctctgtgacagctgccctgcttttgttcctggaggtggcctagtacaaggtccaagtggaccctgcccaaggcctctgtcctgcggcttttagtcttctgtgtgtgtgcgtgtatatgtgcatgcatgtgtgtgtgtgtgtacacgtgtgcacaggtgcaatggaatcaccgtcacagctacaccaaactcagggagtccccaaatcatcctgagcacgggcaatggcctatgactagggagttggagggggcagctgatggccagggagggctgaagggctgggccaaaggccaagggccccaggatggtgtcagccgcctccctgagccccggttccgagtgggcctccctctgcccgcagtcccaccagtgatcgagaatggcctcccagacctgtccaccaccgaaggctcccacgccttcttgccttgcaaggcgaggggcagtcctgagcccaacatcacctgggacaaagatggccagcctgtgtcgggcgccgaggggaagttcaccatccagccttctggggagttgctggtgaagaacttggaggtgaggcactgccccaaggggcacagcagggaataatggctgagacccctgtttgtcatgctctgcgctgagcactatgcagcctttaaccctgggagcctggggaaatcagtgtcaccatcccgggtacagacagccagaactgaggctcaaagtgtacctagttgtccaccattgccaagaggcagaacccaaatttgaacctggacctcggtagccagctcctggggaagggagggaactcggactagggctcagggatacggtgatgactttgtgtcctgaaagtctacccagttgttgtcaaccatgcgttggcattaaccgtcctctgggttttggggagtgttgagccaggggtatgggtgggacccccaacctccttcccctcagcactcatcatattctgcaattttatgatgagaccctctccagatgggttcagtggacacacctagaggggtcagaggcattggacccggccacccagggagcctgggggtgcagtggtgagcgcaccggccctgcttgaatgcaccataaaactcctcctcttggagcccctgttgggccctctatcagggcaccaaaagcaaggcctgcagtgcaggtcaagttctgaggacagggcagcacacagtaggtgtttggtaaacactggctattgcgatcatgcagtcagggctggggttatgaagcagtagagcatgtgaatgctgcagggctgggcaggggcacggtggtgatgctgacccgtttgctagctgtgtgaccttgggcaagtcacttcccctctctgggctggatgctccatgagaaccttcaagggtcaggggcatcctgacctatgccgaggtggggcagttctccggccaacccctttctttgctcacagggccaggacgcaggcacctatacctgtaccgctgagaacgccgtgggccgggcccgccgccgcgtgcacctcaccatcctggtactgcctgtgttcaccaccctgcctggggaccgcagcctgcgccttggggacaggctgtggcttcgctgtgcagcccggggcagccccacccctcgcattggctggactgtcaacgaccggccagtcacaggtctgggtctgctgggcatgggtgggacagagagccaggacaccgggaggttaagaagggagggcaggtggggagacccaacctagtggaaaggaagaggttgtcagccagccctgttggttctgggtcttccaatgtggccctatgtagggggacagggcaaacccagctgtggccatatgtgacaagccatatatcagagctggcaagaggccacctgagaagactcaacccagagacctcagggccaggaaggggaggcctgtgttctagtccagagctgctgctcccattgtgggaccctcagcaaacccgttttgctgggggcccgtggggactctgtcctcctaccggaaacccaggtgatgtctagggagacacagggcctgtggagtacctgctgggtactcaatgtttgctgaattgataaattgctaagtcccctccactgcaaaatgatactttcctacattaggatatgacatcacacattcctaactctgagtccccaggtgtggaatacccgtgctcacctgtggtgaaggctttgctcggctccaccacttcctggggagggaccttgggcaggtataatagttcagcctgtctgagcgccgctctccatctgtcaaatggacataaccaggggtcctgaggacagaatgacaatggaggggccgtgctcggcacaggcctggcccggagtagatgcccaattgatggtactgcttgtctgtattcctctcctagaggtgatggcccaccccaaaggaaaagttcattattagaatccttctctcggctgggcgcggtggctcacgcctgtaatcccagcactttgggaggccaaggcaggtggatcacctgaggtcaggagttcgagaccagcctggccaacatggtgaaaccccatctctactaaaaatacacaattagctgagcgtggtggcacatgcctgtaatcccagctacatgggaggctaaggtaggagaatcggttgaacctgggaggtggaggttgcaatgagctgagattgcgtcattgcactccagcctgggcaacaagagtgaaactgtctcaaagaaaaaaaaaaaagaaaccttctctctagaaatcatggcagtgtttcagtaagtgtcctgtgctgagaggcccccaaaaacctgcccttgaccgtttatcaaacacacagtgtgcactggaagatggtagaaggcaggttcattaaccgcagcctccagtgtggcctgtgcctcccaggaacgtgtctgatttgatcaaccttcacccgggactcccatctgtttctgcatttttattaagttcctgcaggtacccaggcaccagggaagtgtttagggcaggagttccctgcacccgacttctctttctccaccacagaaggggtgtctgagcaggatggaggcagcacgctgcagcgggccgctgtctccagagaagacagcgggacctatgtctgctgggcggagaacagagtgggccgcacgcaggcggtcagcttcgtccacgtgaagggtagggcacattccccaggtggcttctctctcaagacctccagtctattgggacccaatctattggtttcctaagaacccagcctcctgtcctctgaactagtggttccccaccctggctgcatgttagaatcccctgggggactttaaattctgaagtccaggttctacttccaactctgtaaaccagcctctctggggtgaggcctaggcatcggtatttttgacactcccaagacgaccctggctgcaggtagaattggaatctgaccaattgccctacagcactacctgcagctggatggtgccagggtaggaggagagcatggaggccagggcatcctggcagaaaaatgccagaagcttgccagccagccagttgtcccctatgacctactcatccaccaggagtagcacaggagccctcggtgacaacgtgtcttagtttgcacaacctcaggatgggtggggctggatggggggaatgagcagccccaggcaccaaaagagaactgcagcttttggtagatccaacctcaggaaaccaggaaggatataagccagtccagagcatcgaagagtgttttgagattagcatgaatctcatagcgttgctttgtacaacagaggtgtctagggttcttgtttttttatagttattgatttccaaagtacctggcaggtactccgctgctagtgtaatccatctgtgaaagagagtatatgacacgcgtaacactgccttcctgcctgtgcccatctcaggcatcactaatcaatcacagcaccattctcattcagcttcaaatgcttctcagcacagttcttggaaagtctttgccagtctttgtgacttgacccatgacatgaacactgtttgctgtccctgatgcactgactaaacacaaccatgctgtgctagcagaagcctctggaggcccctggaggcaggagttgggcagtcctttggggtttatgggaggctgagccagcaggcaacctcttttctgacaacttgctcgatgtcaccccatgcagaggctcctgtcctacaaggggaggctttctcctacctggtggaacctgtaggaggcagcattcagctagactgtgtggtgcgtggagacccagtgccggacatccactggatcaaagatggccttccactgcggggcagccacctccggcaccagctgcagaatggctcgctgaccatccacaggactgaggcaaggcggggcctggcaccttgggtggggccactgaggacaactctacgctttttctgattgttcaagagggttcttcctattgccccctctgcttctgcagtgtacaaagcacctccctgcccattcctcagatatcctcccactaccaccaatattgacctccagccaactgggcttttccattcctccgtcatccacccattcaatggagcgaattagttctacctcataggattgtaattagaaatcagtgagatgtctcatacccattatttaagagtgatctgtgggtaatgcctccaaaatgttgttattaacaacctcagggggtagggtaggcaggtaatagtgctccctatttacagacgaagacactgaagttcagagaggcccacaaccaataagtgcaggaggcagcgcccccacccccaggtctcctgcctcaggccccgtgctgtttccaaagccttgggccctggggcagcccctctcaacttcccttttgtgtctcaagttctggtgattgtgcagaaatccccaagtcagtcctgactcaagttcatcttaggggccttgatctcacccatttgggagcctttctctgggtagtaatgataataggactagtaataagagcagtagtaagagcagtggtaataatggctcctgttacccaagtactaactgtgggccaggcacggggccttgcacttagcaagcattattccatgtgatgcttataagatcctagcagttatcactcccattttacagaaggggtaactgaggctccagaggcatgaaaatgtcctaagtaatgggctgagggcagtaagcagtggggctgggattcagtcccatgttggtctgacctccaaacctacactcttaactttgtgccatgctatcccccccagtcccttgggtgtggccccccagataccatcttctgggagtggacgtggcctcaggctgccccaggcccatctgatggtggcgctgccactcagaagtgatgtgagccagcgcgccacctgagttccatcacatatccatgggtcacctgttagggaaacgctgcaaacgatctcccttctggaagactcactttgcacactggcacaataaatgccctgagaggtcctgcagttcagactgccatcctgttcatacaacagaggtgtctcatgttcttgttttcctatagttattgatttccaaagtaccataacatgttgtcaactcaatgtctcccaaacttacttgaccatggaaccctgttctccaaggagtctcaaataatgtgccatgggacagtaagatttcaacgtacacagtttggaagaggtggatctacaccatgcttttccagcaagttgttccacctaaggcaacaaggaccgtagtcacagccccctgttttcgggtgtgaaaaggggctggattctctttgcatgtctgctgacaagtggtcacagaggcccttctgatgctctgcgggggatcaggtgcccctggctggttcacagcctaagccccttgctggctggctgccctcagtcccctacccaactgtctgagccactcatcttcttctctgagcaccatgcctcctctcctgtgcccacttgcagagggacgatgcgggacggtaccagtgcctggcagagaatgagatgggcgtggcgaagaaagtggtgatcctcgtcctgcagagtgagtctcggcctcagcagagtggggacgtgggaagtgtgctcggggacagcggtggcgtgtgcagcctagagggcagacggcagggctgggacttggaattctttcattaatacttacttggaacacacactgaatcctaccaaatgtttcccaaatgtggggtgactgagactcaggactgagctaaagaaaacctggcaacctgggcctgggggagctgggcatttaaaactcagaccagccgtcaagatcaccgcgacagctctcgcatgtgccaagcagctcgtagtttaccaggcgctgtttgagcctcagaataacactgtgaagttgtctcaatagggattctgtagaaaatgttttattgaagatgaacacctgtggagaagagccaggatcctaagtgcagagctcatgaatttttacaatgcgaacccacccagttaaccagcaaccagatcaaagaaataggacagtgccggctcccagcctccagcatgcccacctctgcttactgccccctgccccaataatcactgtcctggattctgcctctttaaaaaaaaaaaaaacaaactttattgagttataatttgcataccataaaattcacccgttcatgcaatgcaatattatttaaccttaaaaaggaaggaaattctagggctgggctcggtgactcacagctgtaatcccagcactttgggaggccaaggcgggtggatcacctggggtctggagttcaagaacagcctgaccagcatagtgaaaccctgtctctactaaaaatacaaaaattagctgggcgtggtggcacgcctgtaatcccagtcattcaggaggctgaggcaggaaaatcacttgaacccaggaggcagaggttgcagtgagccaagatcgtgccatcgcactccagcctggttgacaggcaagactcaatctcaaaaaaaaaaaaaaaaaaaaagaacaaaaggaatgcaatgcaattctgacacaggctacaacatagatgaaccttgaggtcattatgcgaagtggaaaaagccggtcacaaaaaaacaaacactgtatgattctgtttatatgaggggcctagagtggccaaaagcatagagacccaaagtagtatggagcttgccaggggctgcagggaggggagaagggggagttagaatttaatgagtccggagtttcagtttagcaagagaaaaaagttctggagattgtacaacaatgtcaaatactcaacactactgaagtgtacacttacaaatggttcaatgataaattttatgtaatgtttttttttacaactattattgttactaatattttttgagacagggtctggctctgttgctcaggctggagtgcagtggtgccatctctgctcactgcaacctccgcctcccgggttcaagcgtttctcctgcctcagcctcctgagtagctgggattataggcgcacgccaccacacccggctaatttttgtatttttagtagaaacggggtttcaccatgttggctaggctgctcttgaacttctgacctcaggtgatccacctgccttggccccccaaagtgctgggattacaggagtgagccactgcacccagggcttgtgctcattcttaaatggagttgtttattttactagtgagtttctagagttctttacatagcatggatatagccctttatcagatacatgatttgcaaatatttctcccagtctgtggcttgtctttgcattttcttaatggtgactttgaagagcaaaagtgttaaaatttggtgaagtccaaatttatccattgtgtattttttgaatcatgtatttggggttacaccttttaaaaatctttgcctaatctaaggtcgtctttttcttttcttttcttttctttctttctcttttttttttttttttgttttaatatttttggggcagagtctcactctggtgccaaggctggagtgcagtggcaagatctcagctcactgcaacttccacctccaaggttcaagcaatccttgtgcctcagcctcccaagtagctgggattacaggcacgcaccaccacacccgactaatttttgtaattttagtagagacgaggtttcgtcgtgttgcccaggctggtctcgaactcctggcctcaagcaatccacctgcctcggcctcctaaagtgcggattacaggcatgagccactgggccctacattttcttatatgatttttgtagttttagttctcacatttaggtctgtgatccattttgagttaatctttgtgtggggtaagggtctaacttccttttctgcatacggatagccaattgttccagtaccatttatgttgatcttgaatttctttcagtgatgttttgtagttttgaatgtactggtcttatatttttgttaaattgattttaagtctttttattattgttgatgctattttgggtggaattgttttctttcatttttggatttgtaattgctaatatgtagagatacagttgaattgatatcatatcatctatgaatagggacagtttgactatctttctttcaaatctgcgtaccttgaagttttttgctttgccttattgccttggttggaccctctggtacacagttgaagcagcgagagcagccatccttgcctggttccctggtttaggtggaaagcagtcagtctctcaccatggggcgtgatgttagctgtgagtttttgtggatgccctttctcaggctgaggaagttccccttttgtacctagtgtgttgagagtttttgtcatgcatggaataggtttgtggtccagacaagatggtatagatgcacttctccctatttctcttgctaaggacagctaaacaccttggactttatatagaagcaaacataaagagcctctgaaaagtagagaaaagaaggaggatagactaccgatcttgggacctgaggagcagcatggtggtgaatgccctggtgtttctttttgtcccttatatcctgggccgcatacttgagaagccaacaacctggaaccaccagtgggctcagacacacgcatgtgcacatgcgcacacacacgcacacacacacacgggggcatgtgcacctcaacaagagcctgtcctctcttgcaaaggactaggaaagggacagcatagtaagaaagaaaacttgtaaataacaacccctaactgggtgtggtggctcgtgtctgtaatcccagcactttgggagactgaggcagccagatcgcttgagctcaggaatttgatatcatcctgggcaatatggtgaaaccccatctctacgaaaaatacaaaaaaaaaaaaaatagctgggcatggtggcgcacacctgtaatcccagctacttgggaggcaaacaccatgaaaaacacccctgccccatcatcacaccaactgggagcctctaacttccaccctcgcccctgtaccgaggcactgctctccccacactggagcaggatgctgtcaggtgacacctaatgaggagacagaattgtcaccactgtcatctactgagtgggaagctcctcccccgtgtggccaggtgggcagcgagggtagtgccagcagaggcccggtgtgggcgtgcctccacccatccacccatgctcagcagtaatgaggcacccctccctgttccgggctgaccatggaagcctcatagggaacctgggcttccacgctgacctggcggaagtgagtggcaccactttttcttggcagttttatagctctgccaaaaacggaagatttaaataaaaatccgagtcttacaatactgaaactcacttacacaccaggaacaaggaaaagctcaacttacacaccaggaacaaggaaaatctcaatgaaagcagacaacagatgcctactgagatagtacagatatcaggtaatctgataaggacttttttttttttttttaagacaaggtctgactctgttgcccaggctggagtgcagtgacatgatcagggctcactgcagcctgggctcgggtgatcatcccatctcagcctcccaagtagctgggactgcaggcacgtgccaccacacccggctaatttttatttttatgtatttattttttgtagagacagggtctccttatgttgcctaagccagtctcaaactcctgggctcaaatgatccacctgcctcagcctcccaaagtggtgggattacaggcatgaaccactgtgcctgaccaagactgaactgtcaccactgtcaccactgagtgggaagcccctcgcctacacaggccgagtggggagcaataagcagtgcccctctccctcccagccaggatggtgccagcagagccccacttgaagcgccaactcccaccgatccccagcaataatgaggcaccctccctgttcccgggtgtccatggaggccacgtagggaacccggacttccactctcatctggcagaagtgagtggcacctccttcccctggcagtgttccaggtctgctaagatggaagatttaaataagagcccaaatcttatcatactgaaactcacttatcataccaggaacaaggaaaaatctcagcttgaatgagaactgatactcaacagacaccaactgagatagcacagatgtttgagtcatctgataaggatttcctttttattttttgatggggtcttgctctgtcacccagactggagtgcaatggcacaatcacagctcactgcagccttgacctcctgggctcaagcaatcctcccacttctcagcctcccaagtagctgggactgcaggtgcataccaccatgcccggctactttatttattttttgtagagatggggtcttgctatgttgcccaggctagctgacagggatgcttctgtgagcagttgtcaacatgcttgaaacaagtgaaaaaaacagaaaatctcagcaaaacgtggctgtggagtaatttgaagttcaggcagttttcaagttggcctcggtttactgtcctttgtacccctcaggtctcccctgcacaggtgcatatttcccacgatggccagggattgtggggagccaatccagcctgtccgtggctccttcatttccaggttctccccgttcagttgctggctgggtccctgctcttctcagccagggccatgccgcaggccagcacagcagccatttcccttttggctcctaccagttttgccccttttcctgatgatatttctcagggcatactttcatcctctactgcacatcaaggcagcccccaggggtggcaaaagctgctgtttttcacagccatccctaataaaaccactgtgatggtcacggtggggtagggatgggcacagccccaggcaggaaggccaaaggcttccactgttcttatccaaagttctagaggctttatttatttatttttttttttggagacagagtctcactctgtcacccaggctggagtgcagtggcgcgatctcggctcactgcaacctccacctcccaggttcaagagattctcctgcctcagcctcccaaatagctgggattacaggcacccaccaccttgtccagctaatttttgtaattttagttgagacagggtttcaccatgttggcccggctggtctcaaactcctgacttaaggtgatccacccgcctcggcctcccaaagtgttgggcttacaggcgtgagtcactgcgcctggcctcgaccttcatttaagtggaatcaccccacacgtgctcttgcgtagactcttcttttgcacatcataatttgtggcattcgtccatattgttcacgtggaattagtttattggttctcattgctgtgtgtttttctgctacatggatgtaccacagtttattcatgtattccactctaggttagtttccagtgatgggcggttaagaacagggctgctgtgaccttacgcacgccctccagtgaacacgcacacacacctgtgctggggtattcgtccaggagcagaagcgctaggtctcacagtacacatgtgttccactttaggacacactggctgtggtagtatctgatgaatggcctccaaagatatgtccaggtcctagtccccagggcctgtgaatgtttccttacttggaaaaggaatctttgcaaatgtaattaagttaaggatcttaaagtgagcacattatctcggaggcccctaaatgctatcacaagtgttttatttatttatttatttatttagagatggattctcactctgttgcccaggctggagtgcagtggcgcaatctcggctactgtaacctctgcctcccaggttcaagcaattctcctgtgtcagcctctcaagtagctgggattacaggcacagaccaccacacctggctaatttttgtattttttagtagaaatagggtttcaccatgttggccaggctcttctcaaattcctaggttcaagcaatccacccacctcagcctcccaaagtgctagggttacaggcatgaaccaccatacccagctgcaagtattgttataaaagagagccggggccggacatggtcgctcatgactataatcctagcactttgggaggccgaggagagtggatcaccagaggtcgggagtttgagaccagcatgatcaatatggcaaaaccccgtctctaccaaaaatacaaaaattagccaggcgtggtggcacacacctgtaatcccagctactcaggaggctgaggcaggagaatcacttgaagccgggaggcagaggttgcagtgagctgagatcgtaccactgcactccagcctaggtaacagagtgagactccgtctcaaaaaaaaaaaaaaaaaaaaaaaacgagagagacagagagctggggtggtgtggcaggggagagagagagagaagagaaggtaaagtggagacagaggcagaggatggattgttgcagcctcaggctaaggaatgctggtggggcagaagctggaagaggtgaggaatgggctctcccccagaacctctggaggaagcagggcaccttaactttggcccagtgaggctaatgtgggcctcctggcctccacagtttctcctgtgtttctgcagcttgctgcagcatctgcaggaagcgaacacacaggcacacagcgccccaccttggctgaagcacgttgcatttccacctcagtgtgtgcgagttctgcttgttccgcagcctcaccagcactgggcctttcccatcctttccatactagccttccaggagggtctataatagtaagtggacaggaagcatcatccccatatttcagatgggaacactgagggtcagggagtgacttggtgagagccacccacagtaggtgacagagcacgagtttgcccatttcattggcatcaactagaggcagttctgacagatggccccccacttcattggaagcagtctaactgtcctataggagaggcttcatttagccaatcccaatacagtcaggcaatagaagactacctagccactaacaacagatatgtaactgcatggaaaggtagttacgatctattgcagaggaaaaataaaagcagatggccgggcgtggtggctcatgcctgtaaccccagcactttgggagactgaggcgggtggatcacttgaggtcaggagttcaagaccaacctggccaatatgacgaaaccccatctctactaaaaatacaaaaatcagccaggtgtggtagcaggcgctcttgggaggctgagatgggaggatcgcttgaacccaggaggcagagattgcagtgagctgagatcgcaccactgcactccatcctgggggacagagtgagactccatctcaaaaaataaaataaaagcagatacggccatatgatcatattttcataaagaaacagtgtctagagggaaatattcaggaacgatgactgggtggaaggatcctatgcagttcttattttcttctttctgcttctctggatttcccagtgtgtctaaatgaacatatcccacttgaatatgcaaaaataattaaatgttcctaaaagccacctgggcctcccacaggtgctccggtgttccaggtggagccccaggacatgacagtgagatctggggatgacgtggccctgcggtgccaggccactggagagcccacacccaccattgaatggctacaggcgggtcaacccttgcgggccagccggcggctccggaccctgcccgatgggagcctgtggctggagaacgtggagactggggatgcaggcacctacgactgcgtcgctcacaacctcctgggctctgccacagcccgggcgttcctggtcgtgagaggtatggggcatccctgtctggaccttcgtggacagaggcaggatctcttgccgatggggattgtgtggtgcttatgggagacctgtcccctgccttgccagctccccacctcttccctttgcttcatcacaagcccagaatgaacccctaccctgcccgtttacagttgggtaaactgaatcttggaggtgctgtttgctgctcatcttggacagggaacacaggttgttcctgcttaactggcacaaatgcatgtcctctgtctggacactgcacagcccctggaagcaggcagaggaagacaagggcatccccggtgccctcgggggctgctgtgaaaagtctgtgcatcagtgcatgtcccaggcatcacacattgcctggccgtggcaggtggttggaaaagaaatggcttcctggtgggatggacccctgccatctcgattcctcaatcagctcccttctaccttgggtcagaccaactttaaaattaagaaaagatctatcctgagaaaccacagtaaatggattcagacctgcataaaggcaagtcataagatattatttctgtggcctgtgcctctgaagggaacactccatatatgtggggatgtgtccccttccctgtacctggcagacatcactaatctatcaccacatgggaacactccctatgtgtggcgatgcatctccctcgctgtccctggcagacatcactaatctatcaccacatgcgttggcagaatctttctccaatgagccctcccaggcagcgcctctcagctaattggaattgggacttgacacttggccacctggaaatccacgtgaaacccactgccaaccaaatgtgggaccctttctggccgttgctctcattatctcccacaggccggggcagggtaccaacctatgcagctctgaaagttcagcggttctctgaccccccagccagagatgcagtctcagagttagccttgggtctaagcagacccccatgtatttcagggcttcgtcccacttcttttttttttttttttttttttttgagacggagtctctcactcttgttgcccaggctggagtgcagtggtgcaatctcggttcactgcaagctctgctccccgggttcacaccattctcctgcctcagcctcccaagtagctgggactacaggcacccgccaccatgcccggctagttttttgtatttttagtacagatggggtttcaccgcgttagccaggatggtgtctatctcctgacctcgtgatccgcccatctcggcctcccaaagtgctgggattacaggcgtgagccaccgcgcccggcccgtcccacttcttaccctctcctgttggcaggccccagtcccaaccacagagctatgtacatggcctttgtatttgttctgtagggctactggtaaaaaaacaaaacaaaacaaaacaaaacaaaacaccacaagctggaggcttaagccacactgattgtctcatagttctggaggctgcaaatccaggatcacactgtcagcagccctggtttcttctgaacactgtggggaggatctggtctgggtctctctcccagggtcttggtggtggtcctcggcattctgtggcttgtcgaaacatcacccccacctctgccttcatcttccctgtgtgtgtctacacttccctatttataaggacacagtcatgttggattaggcctgccctaatgacctcattctaacttgacttactctataaagaccctatcttcaaatagggtcacattctgaggtcctgggggttaagacttcaacgtatgaattttgggtggtgtggtagcattcaatccataacccagcctccttatttttttttaatagaaacaaatattcttcctttatatatgttaactgtagaaaggccagatactatagaaatctgtgaagaagaaggtaattctctcccataattcagtgacccaaagtagcttaagcaattatttggggagatacattcttccacactgttttctctggatagaggagatacacttttctttttacaaatgtcaaatttacaccctctataacctgccatttttacttcctctatcttggaagacatccaattatgatacacatcggtccacagctttttgattggcttcgtatcattccatgggaacgttttttatcttcgttcgtgttggctttgtcaaatgagcaacgtagtttattttcctagtttccattccccaaagccacaccgtgctgcgtatctttgtgtgtggccctgaagatttctgtgggacgatttccttaaggggcatgggtgggtgaagggagttcagggtttgggagcttctaaacctgttttccctcctgaaaacctgcttttcctccttccccatcagcctggcaggtcccaatcctggccttgtagggggacaagaggctgctacgtcactccatgtctgagagagctggcggtggcttgcctgccgtgcctgggttccatttcctgtccccttccaaagctgcgcgggtcacactccagccttctcatctgcagctcccgatctcttcttcactcccctattaaaaggccagggataggttcacggcccttctcctgtccctcccatgggccccagagcatcggatactgatgagaaacatcccagatgggcttcaaatctcatcaaaccccagctatgggctgcaggaaatggccctgcttcctagaaccccaaattaaccagccccttgattcatccatttaggatcctagcacttgagtgttttatgttattttttgacagatcatgggcaatttgttgctaatttcccctgagagctgctgagtggagaggcaggctaacttctgtctctcgccccctggaatgccatctgcctaaacaagacagctggcgcattagtcagaggaagcacccccctgtgcctgcatcatccgtttgattagcgctaaagagcatctgctcacagatggcctggcgggcagcggctaggaaaccagcccacccggccaggccagctgcagggcagccagggccagcagcactgatggaatggggctgttcaggtgatggcacccggctctggctcggtgccctggctccttcagtgtgccagccacgccatcgtgggctcccggcatttcagagacccacaggtcttctgtgagtttgtggtcccgcctcctcattttacaggtgagccaactcaggtgtggcttgggggcctgaggtggccaggttttaaggaatggcagagccagaattagaagccagctccgccctgagcccagggttcctcctaacagcctcccttcccttttagagccaagatcccctgggcgttgagtccatgaccccttagctgtgtgtccttggacaagtggaggtgaactctccgagcctccatttactccttcacgaaatgggaatgacagcctgcttgtgctgtgggccccggggtggatagtcagtggcactgtcattctttcccttccttacaggggagccccaggggagctggggcagcatgactggggtgataaatggccggaaatttggcgtggccacactcaacaccagcgtgatgcaggaggcacactccggggtcagcagcatccacagcagcatccgccatgtcccagcaaacgtgggtgagtggaaggcagagcatcacctgcctctgggttattgtcacagcccagcgagcatcctccagaacatgctggacctaggaggcgcagagcctgtgccccgagacttgctcaaggcctgatgaccagagcacgtctgaccatctctcaaagctgagtgcaatccaaagtggactcagatgcaggcaacttcctgtccccctcacaacctcccaaaaacaaaggaactgcatttacagtcagaccaagagtgtgtgaaacggtcagtgttctgggggtgcgggcgctcagattgtggtttcccaagccaccgatggctccctgaggcttttccccatttaagttaaagctcaggctgatggaagtggagggatctccagtcatgagtgaggggtgcaggctggaggtgacgggaagcgggaaacatggagaattgaattgcctagaaaacctagaggactaagaagagtcacctgcacacagagctctcatgtacggtgtctgagcgatgaatgctctgagagacttgcagagcttgtgacagtggacgtcactgtctctcccttcccaaggaatccctggcccctcgtgggggtccaggaggggcagtattcatggagtcttcactgaaagtagctcctctgaagctgcccttggccatggtcccgcatgagcagtgtggggtcaggggattttgctggggaagtcactctgagctggctgtcagcagacagcagatgaagcgagacgctgcccagacatggctgcttattctagctgcaggagtgtgaggcctggagaagcatctggccccaagcccgtggaccaggctttgttccatgaaacagacgcacagagaggctgggaaggtggtgcccatgcacaggggcctggccagctcctgtgaaccttgcaaagctggcaccgtccctgactcagagcaagtggggagcgggtgtgttccccttgcccagtccatggccccacctggtcctgcgtggagggcggggcatcacatgaagaagatctgagaatccacgtccagggccattttttggttcttttttcaaacggtttggaacaaaccggggctggtccagaagggatctgcaagttagaaaagttggttcacttcaactcagcaaatatataatgacagtctgtggagtccctggctccgtggtgacccggggccctcaatcggtatttgttgaactgagttaaatatcaacaaggtacatgcatttatttcttcttttttttttctttttgagactgcttctcgctttgttgcccaggctggagtgcaagtggtgcagtcacagctcactgcagcctcaacctcccaggctcaagcgatcctcctaccttagcctccccagtagctaggactataggtgaatgccaccacacctggctaatgtccatatatatatatatatattttttttttttttaatttttttttttgagacggagtctcgctctgtcacccaggctagagtgcagtggcatgatcttggctcactgcaagctctgccttccgggttcacaccattatcctgcctcagcctcccaagtagctgggactacagacgcctgccacggcgcccggctaattttttttttttttgtatttttagtagagacagggtttcaccgtgttagccaggatggtctcgatctcctgacctcgtgatctgactgcctcggcctcccaaagtgctgggattacaggcatgagccaccgcgcccggcctgtccttaatatttttattttttgtagagacagagtctcactatgtcgcctagcatttccttgtataaatttattaatttcagttactccaggaagtagattatttgcctccaccagatccctgattctggttaaataattggcatggcagtcacaaggctgagtatggacatcaagggaaggggctgagctctcctgggggcagtggggagccatgacgggaccttgaacaggaggtggctgccctgaggatcagctctaacccggcctctatgccctgccccacccagggcctctgatgcgggtgctcgtggtcaccatcgcccccatctactgggccctggccagagagagtggggaagccctgaatggccactctctgactgggggcaggttccggcaggagtcacacgtggagtttgctacaggtaaacagggcctcccccaggtgggccaggtaggactaaagcctgcgcccaggacctcccgtggtgactctgggctgggtggggatggtttgcaggggagctgctcacgatgacccaggtggcccggggtctggatcccgatggcctcctgctcctcgacgtggtggtcaatggcgttgtccccgagagcctggctgacgcagatcttcaagtgcaggtcgggggtcaagccctggggtgtgcagacagggtaggtgagagagacgaaggtgcccggctctcaaccacccctgagcagccaggcccactctcccttctgacagcgctgcagggctgggtcacagtctagccttggacttagggtaggatgagcagttgtaacaggctcaagttcaagcgcttgaagggatgctctgagccctgcgacttcagatcagagtattcttgttcaaaagcacgagtcctgaagagaggtgagctgcctagagcagcccagctggttagaagaggctctgggaggctcaccccatctcctcccaaggctcaccccatctcctcccaaggctcaccccatctcttcccaaggctcaccccatctcttcccaaggctcaccccatcttctcccaagcctcctcaagcccctgagttggggtaagggtctcaggctgcttgggagttgaaatctcagcattttcctcctccccttccaaccctgacccctttctccctctcccccacccctcctcctcctcccctcctcttcatcctgcaggactttgaggagcactacgtgcaaacagggcctggccagctgttcgtgggctccacacagcgcttcttccagggcggcctcccctcgttcctacgctgcaaccacagcatccagtacaacgcggcccggggcccccagccccagctggtgcagcacctgcgggcctcagctatcagctcggcctttgatccagaggccgaggccctgcgcttccagctcgctacagccctgcaggcgggtgaggcccctctgctttgttccacccccactgccccagctaaaacctgccagggggcccaaatgcacgtggctggaatccacccctgcccctaacatccactgaccatgggccagagacttcagactgagacggcccggctggcctactcacctggcctgtccccactcccatccatccaccccccactcctcacagggacacagctctctaagccacccttgttccaacctctggatcctttccccaggccccaaggtgaaggtccaaccaccccaggctgatgttcaggaactgagtcaccccgccctcttctcccgagggcacctgcactgaggccacacccaaggagccaggaaccactgttggaaccctagagacccccaggaacatgctttctgttcacccagtgaatgctaaagatacatacgttcacattatttgaggtcccaaagtgttttgaacattgaatgagagacagtgctaagagcaccgctttgaggtcaggcagaccccagttcaaatccgaggtacaccactttctggctgtgggaccttgggggcaatgtcctggtcctctcggagcttcagtgttcccatctgcaccgcgggcatgacatcgcctgccttgcagggtgtcgccgtacagatgttgtctctaaaaccctagcctggcacctagtggctgcctcatcaaggctggctgtccctacaatttatgtggaccaagcttgtccaacccatggcccacaggccgcatgccacccagaacagctttgaatgcggcccaacacaaatttataaactttcttaaaacattatgatattttttgtgatttttttttttttttttagctcatcagctatccttagtgttggtgtattttatgtgtgacccaaggcaattcttcttcttccagcgtggcccacagaagccgaaagataggacacccctgatttagactgccttgtgtccttcctgcctccagaacccagctcacccctcccctgcctttgcttttgctgcccgtctgacgctatcctctgcccctccgcacggtctctgtgcattgctgctatggtctcaggagagccgttttgcacgtgttgacctcctgcgttttattttaatggttttcctggggctgcctgactcactggccagccccactgggagcccttcaggacacatttccttgactgggcgtgccctgcagtcatcgcctccaacaggcctgggcaggaaatgggcttgctgactctctggcaccgtcttggctctgcctggctaagctggcagtgggggagctgtgagcctgggctatggccagggcagccttgggagaggacaccctcatgtccttagagtctatcctctttgctttgcagaggagaacgaggtcggctgccccgagggctttgagctggactcccagggagcgttttgtgtgggtgagcgcccccaaccctggcatggatgtgggaggcctctcagcctgggatggatggcttctcccagccagctggcaggagggcctgggagcggagaccaccagaccccttcctgccccagacagggacgagtgctcaggaggccctagcccctgctcccatgcctgccttaatgcacccggccgcttctcctgcacctgccccactggcttcgccctggcctgggatgacaggaactgcagaggtgagggagctgccgggaggagggaggagacgcgctcctcagacctgacccaggtgtgcagaagggtccccagggccaggaccctggctggggacacagacctgcagggatggccaattcttgagggttttgatgtcagcctgggggtcccaatgctatgtccccaccaggctccttcttgctatgggagctgcagatgaatgaggcccaggtatcagggggtgatgggcagccccagagacatatgggcggctacacatgctcaccgcattctgaacctgaacaggcctcggaagctctcccaacactcagcatcatttccaattgactgagactggcaagtgagttgtccccctcagcaatgttgctggatgacaaatctgacctcaggtgatggtgctgacgctgacccccagtctgcatccctgcactcccaccgggagggcctggtgctgccaagtctccgctgggctccaagccgggtgcccaaggggacgttgtctgcagccttgcattggaagctgcaggcccaaggactcgggtcccttggagtgggccctatgttttgggatagggagcaagacaatggaaagagctagcagaaggggtggggaccttcctgccagtggctcctgggcctgcggacgaagcctctgtggataggccgggccagggtcaggtggcgaggcacgcctggggatcatgttcacacagccgtctgccctgatctgcccccagatgtggacgagtgtgcgtgggatgctcacctctgccgagagggacagcgctgtgtgaacctgctcgggtcctaccgctgcctccccgactgtgggcctggcttccgggtggctgatggggccggctgtgaaggtgatgggggcacagcatgcggcctgtccatactcctggaaacccagaggttgccagggatcagctgacagggggctgtgtgtcactgggctctgggcttccaggaagactgggactcttggcagaaggagtacagcaaggctggggacaaagcctgcgccaggctctggaggtctgagccctcccctggctcctggcagctggcaccttctttgacaggggtgttttctttctgcacctcagcatcttgtctgcttgataaagagggagccaggtcagggatggcaaacacatgctccctctgctgccatccgttctgttcccccatatgaatcaaggcccagctagagaccacctctgaatccttcttgacgcagcagcccctgcagccacagtggaacaggttcagtcagcctttgagataaaacttaggtgccacccctggacgggtgacctcaatggtccttcctgctctaacagtctatggctgtaggaccgtgggtccacccggctcctctgagagactgcacggtggagagggaagcatggtggagcctgacccaaggggatcagccatcgcacctctgtggcccccagggcccttggagtgcccgacaactcaccgggctctcctgcctgccgcccttcctgccgcctttcctcctttctcaccactttcttagctcttcccacataccaggctcccctcctcaccacgaccccatgaagaggtcacatctttaccctctttatggatgaggaaactgaggctcagagagggagagttccttgcccaagggctagaatatggagagctcagcggaacccaggactctgcccacaaagggcctttcagccccttcctttctctgggacctggaaccctgttgacctccaacctggtataactgggggaggtgctgtgagggcggccatgcagcctggtggcactgaaactggagaaggggacagggaggaggcccagatatggagggggatggtccgtcccttgggggaggggccctgggctagacctccccaccaccgaccatgcccctgcctcccagatgtggacgaatgcctggaggggttggacgactgtcactacaaccagctctgcgagaacaccccaggcggtcaccgctgcagctgccccaggggttaccggatgcagggccccagcctgccctgcctaggtacggggacacccaccctctggccacaccgctgcagctgccccaggggttaccggatgcagggccccagcctgccctgcctagttacggggacacccaccctctggccagcacctcagctcaggggctgagggtgtctaaggcgccagtgctgttgagttctgagaataaccaaacagcagccgacactttgcactcactgggtgcctgcctgtgcaccaaaacctcagcctgaccctgtggggtcatcttccggggaatttcaggagggggaggactgtggaggcaagtgggtgtatctcagagaggcttaggagagggaatggatctaactggggcactgaagggctgagggggagctggagtctgggacgaggctgagagctggggaggctgggcctctgggagctgtaggtggaatcggagaggaggctggagttggtccgggagagggggatgcagcgtggctcacatgcagcatgggagtggctggattctagggaatgccaacaagagagaaggcagggccaggcaatggctgcaggctgcaggggaacctgggccacctgtgcacacacctgaccccacccgtctgcagatgtcaatgagtgcctgcagctgcccaaggcctgcgcctaccagtgccacaacctccagggcagctaccgctgcctgtgccccccaggccagaccctccttcgcgacggcaaggcctgcacctcactggagcggaatggacaaaatgtgaccaccgtcagccaccgaggccctctattgccctggctgcggccctgggcctcgatccccggtacctcctaccacgcctgggtctctctccgtccgggtcccatggccctgagcagtgtgggccgggcctggtgccctcctggtttcatcaggcagaacggagtctgcacaggtaaggccaggccctgaccatccacgggacactgccgttatgggctcttgggcccctagggtgggtgtgcaggtgtcacccaccgagttcagaaacccagaccttccaggcaagtggggtgagtggtgtggtggatggtggcttctccaatgcagggtgtctcagagccttggctgtgctattgggcagggggcttccaagatggtgtggactattttttaaaccatttgacttcaggacactttgcccagagggagggcatcctaggcaagtggtcctgggaaccccctttgagaaacactcctcttagcactcagagggaaagcagtcagggagggagattttcaggggtgaaggagaatgttccaggtagacatgagaatgtgacaagggactgctgggtagaggggggtgggggtgggggatggcccctggaccctgcagagagggacaaagaggaggtggcctgccccagggctgatgcctcggcattcccgcctggacggaggggtctgcggggtggtgctgcttgctccttctatgccttggtgagcacggggtaggtaaggtggggctcctccctctcagcaagcacagggactcccccaacccctgaacctgggctgggaggggcaggacagggagaaggagcagggcagctccagagcccagcgggcaggtgtgtggccacgttggtgtctgtggctcagtgcgtctctctgcccccatcccccacctgccccacccccatgcccgggccagaccttgacgagtgccgcgtgaggaacctgtgtcagcacgcctgccgcaacactgagggcagctaccagtgcctgtgccccgccggctaccgtctgctccccagcgggaagaactgccagggtgagccgggctcaggccgccgcccaaacacccgtggggctagggcaggcagcgtgggatgggacatgtggcatcttacctactccgttcactccagccccttcacaactatcctgtgaggtggggcggggaggcaggctcagaggggttctgtgaacaccccaggctcccacagccacgccagggcccatgctccaaacaggagctctgagatcacgcgggcaggctctgaaagcagccctgcaaggccaatcctagcactgctgtgtgtccctgggaaactcacttcacctctctaagcctccggcctcctggttaaatggggctagcacagtcccccctcagatagctgggatgagagctgtggaggttgagcacagagccgcacagctgctgctgctggtatagtaagtgcctctaactcccaaaccgggcacagtttccctggtgtgcacaaacggggctggggccggtcatgctgcttcctccactctaaagaacaggaaccatgcctgccctgcctgtctctgtccctcatgctgccatggaggtcactgaacatcctctgagaagggtggggcttccactgaggaagacaggatcaggggctctgcccgtgggcagtgggcactctgggtcttcgggcaaagcagccacccagggaaagccccatctctcccaggccctcctacccagcacttgctcaggaggcccccacggtgcccacctacacgccctggaaagccctggccccccgagggagatgagaaggtgctgcgggcctccagctgggtggtcatgggtcagactggctggggacaaagggagaagggctgcccacctcactggtcccccaaaggtacttctccccacgcactccccccttctcctttgctccatcttttcatctccctcccccgcttcaccaacttccccatccagacatcaacgagtgcgaggaggagagcatcgagtgtggacccggccagatgtgcttcaacacccgtggcagctaccagtgtgtggacacaccctgtcctgccacctaccggcagggccccagccctgggtaagggctgagttggcagggcctcgtgccctcaggaaaagcacatttttcagtcactgggggtgcaggctggccctgtcattgtcactccccacacaagtgatgcaggcaggaacgcacagagccctgggggcagggagaggccagagtgggagagaacggggacacaggagcacacacaccaaaccccagacacaggaccaccatgcagactcacacaaccccaggacaaaactcagacacgccagcaccaaacccatctcctccacgccactcacagcggccacggacactcatcaagacacacggagacatggggaccttaggggtggcagctgctgccctggaaaggtttctcccggcgggtgacctgccccaggccttacaactagaaacgtaggctggggttggaagcagatgcccgcggcaaggctaagcgcagtctccacctccaaccccgcccccgcagggcaaatccagactgggtgacttggcccaggggcacatcgctcccctgtgtctgctgggcttccctggggcatggatcccgaaagtccgctggagggaccatgaaagggcaggcctctggcttctctgggcttcagtttgttgaactctaaaacgggctagcgtgggagcctgcagagaaggcgtgtggggctctgcgggagaaggacgggcagcgcgtgggcggaactgcaggggctggcagggaggtctgagttacgcggatgggccacgctccgaccgcacccccgagtccgcctgtccgtgtgtctgtgccgcccgcaggacgtgcttccggcgctgctcgcaggactgcggcacgggcggcccctctacgctgcagtaccggctgctgccgctgcccctgggcgtgcgcgcccaccacgacgtggcccgcctcaccgccttctccgaggtcggcgtccccgccaaccgcaccgagctcagcatgctggagcccgacccccgcagccccttcgcgctgcgtccgctgcgcgcgggccttggcgcggtctacacccgtcgcgcgctcacccgcgccggcctctaccggctcaccgtgcgtgctgcggcaccgcgccaccaaagcgtcttcgtcttgctcatcgccgtgtccccctacccctactaaacgggagagggcattggcggccgccctggcgtgacccccgaggaaggggtcgaggagaagcttggtccacgccacctgctgtggcaagcggagcgtcatcgtctcccgccccgtgcgtcagcgagaccttgggtcaacacgaccctgcgcacagccttgacccccgacagcgaggacctgacctcacagagggaggcgtccagggcggcccttgggtggccagtcccgcaggcagggcccggggaagcccggatcagacctccaggtctgatccgcccctcagtgggagcgggacagggacacagggcacctggacgcgcgggagagggggcagaccccgcgttaggggtggcagcagctgtcgcccggccacacctggtggtgtcattctgaaccctgttgcaatataaagggatttttttttaaccaacttggtttctttgtctaattattttgctttgtagggaagggtttgggctgggaaggagaccatgccttctgttctgatccaggagcactgcagtttgagtctaccagcctcctctccttaggagtagggctgcctcaggcacctcctggcctcagttttccgatccataaactcttgcagtagggccctcccttcccccatagggctgtggggctattaaatgaggagtaaatgtgttgcaaagacagcaacagccggtggcaaaaaaaataattcttactttttagaggcagggtcttgtcctgtcgcccaagctagagttgcaaatgacatgatcgtggctcactgcagcctcgacctcctggcctcccgatcctcccgcctcagcctccagagcagctgaaactacaggcacatgccaccatgcctggcctttatattaattattaatgttttgtatatatgtaaggcatacaacgtgatgctttgatacacataatgaaatggttactatagtcaaaccaattaatatatccatttggattttgtgtgggcttgaaaaaattaaaacatacccatcatcttgtatatacttatttttgtggcaagaacacctcatatctactcccttaggaaaataccagtgtgatattattattattttgagataggatctcgctgtgtcacccaggctggagtgcagtggcgtgacctctgctcacctcaatgtctgcctcccaggctcaagcgatcctcctacctcaacctcctgagtatctgggaccacaggcatgcaccaccacacctggctaaattttttttctttttttttgagttggagtttcactcttgttgcccaggctggagtgcaatggtgctatctcggctcaccgcaacctccgcctcctgggttcaagtgattctcctgcctcagcctcccgagtagctgggattacaggcatgcgccaccacgcccggctaattttgtatttttagtagagatggggtttctccacattggtcaggctggtctcaaactcctgacctcaggtgatctgcccgcctcggcctcccaaagtgctgggattacaggcgtgagtcaccgcgcccggcctaattttttaaatgttttgtagagatgaggtttcattatgttgctcagtctggtctggaactcctgggttcaaaggatccgcccacctcagcctcccaaagtgctgggattacaggcatgtgccactgcacctggcttaccccagcctatttttatcttctaactcttgtcgctttccagtcatagactcttacagcgggcttctttatggcttgcttgtcatcttgtatcctttgcagctcacccctggctttcacttgcagtcctcttctgagctatctttttcctgatagcatctccccttctgggggatggattattgaaggcaagggccatttctaggccctggccttaataattcatctaattcatctacaggaagggcctttgttggacgaatggatggatggaagtgtagtgcaacaattcctaagtagtcttttttttttttttttttgagacagagtctggccctgtcgcccaggctggagtgcagtggcgcgatcttggctcactttaagctccacctcccgggttcacaccattctcctgcctcagcctcccgagtagctagtattacaggcatgcaccaccatgcccagctaattttgtatttttagtagaaacagggtttctccatgttgatcaggctggtctcgaactgctgacctcaggtgattcacccacctcagcatcccaaagtgctgggattacaggcgtgagccaccgcgcctggcctaatttttgtattttcagtagagacggggtttcaccatgttggccaggctggtctcaaactcctgacctcaagtgattcactcgcctcagcctcccaaagtgctggaattacagatgtgagccgctgtgcccggcccctgggatagttttaataggcggtcagggcaggagaagaggggacagcaagtgtcagggccctcaggcaggagggtccagccaggaggttggggaggctggagatgaatgaggtgggagaaagggaagacagaaaggtcaagggggtggggtggatcctgtgaggtctttgggccaccacagggactttggctttgatgagtgacctatacaagagcacatgtataggtaggtgtggtggtgcatgcctgtagtaccagctacctgggaagctgaggagggaagacccttgagcccaggagtttggggctacagtgagctatgatttggccactgcactccagcctgggtgagagagcgagaccccatctctaacgaaaatggtttttaagaaagtcaatgcatatctgcgtgttggcctatctccagtgtgctgggtctcgggaggagtgtaggtgaaacggagcttggctgtttatccttctcctcccattcctgcccttctccctgggctggcagcagcccctgcctggtggcctctttgttgccagctgcccctgacacagcctctgggagagagaggttgtcttttgcatatggttctgaagaaaagagtgcctctctccctgttcctcctacttagtgtgacatggtcagctccccctaattgtcccctccctctcatctgggcaatgaggaaagttgtctgagttagttccttctagagatgaacgacaatcaggctgtcttaacagagctgttctgggtacacagagaaaaaatcgctgtgtccattttacagatgcagaaaggggggtacagggagggaacatgatccagtcacttgactgaggtgtgactggttaatggtcaaactgggactcttgattcccacctaacagccccagtagaaccttctccaggatgcttcttactgtaggtttccttcaaaccagtctgcaaagtttttctgttaggggccagatagtactttctgctttgcgggacattcaagctctgtcaaaatgacttacctttgccattgcagcgcaaaagcagccccggaggacccatgaacagatgggcacagctgtgttccaataaaactttatttgtggacacttacatttcaaatttattatcattttcatgtgccatgaaatattcttcttttgatgtttttcaaccatttacaaatgtaaaagccattcttagtttgcacgcaggctttacaaaaacaagttcagaccagagtttgctgatctctggtttaaaccacagaaattactgatgatggaagtccaggctgggtggagagattagaggaggcgggaagaagtgcgggaggggcttcccaggccctcctgtaccctattcgtccagggtccacctgtgagggccttccttgggccgaacgcccctctttgtgcaacgccaggggtcaacgggtcagaactggagcactgctcttcgctaggctgttaattttttatggagctggggactttgtggaggtgatgcagaggcggagacccacagaggggaggtgccactcctctctcacccctgctgtctcctgcaggccgctcccagtctcacgcaggccttccatgtttgtgaaactactacttgttaagtctttgtccagtgtcttacagacttgaggttttttttttttttttttttttgagacagagtctcactgtgtcgcccaggctggagtgcagtggcgcgatctcggctcactgtaagctccgcctcctgtgttcatgccattctcctgcctcagcctccagagtagctgggactacaggcatccgccaccaaccacgcccagctaatttttttttttttttttgtagagatggggtttcaccgtgttagccaggatggtctcgatctcctgacttcgtgatccgcctgtctcatcctcccaaagtgctgggattacaggcgtgagccaccgtgcccggcaacttgggtttacttagtccttccaggagctccagagccaagaaacagcatccccatttcacaaatgagagaaggagagctcagagaaggaagccacttatctatctcacacagcctggaggggaagagaaggactcagcccaggtccatctgactccagagtcctgggctctgaccaccaggctcccctgcctccactttccaaggaagggggaagagagagagggccaggggcaggctgaagacaagggcccttggcaattcaagatgtgaggagctaaaaagggagtgtctattcagccccctgcctccccacttttccctccttttccatttgaggctatggagcggaggccgggggaaaggagtgacttacccaaggtcacacagaaagcccaaggcagaccaggccttggaggtagattctgacccagtcccttcctcccctacactccaactgcttaccccgcccctaaggaaggttaccgagcagaggaggcccctcccaagcaagccacagccagagccagagagtattttccatccaaaaagggtgtttgccacttctttttctctagctgccagctgtcattggccaagactctgtccaagctgcccagccccctggtgccacctgacctctgcgagtctgtttgcaccatcaggggtggaaaacaggcctgcaggtcaggcattgaactccctgatgtgggttttccacgaacccaacaactggactctgtgttcctgtgggcgaggactggcaacctagggtctggcctggaggacactctcttttcccagggccaatgcccaggcttgggcagtggcaaagtggcttctggtgccaaccacaaggaggtttcagggtgagatccttgaagtctctacacacccaggccccttcatgcccagcaggtccagagcccttgggtggcagaggcgagaaacggaggcaggaggaagcccactccagggctctgtacacaggctgtatctatgcctttaggtggctgggggcattcgatgaggtcacatccattaagcttgccctgtagccactcagacaagtggccaccaaagttagagctgaggccaggcgcggtggctcacgcctgtaatctcagcactttgggaggccgaggtgggcggatcatctgaggttgagttcgagaccagcctggccaacatggtgaaaccccgtctctattaaaaatacaaaaattagccaggtgcggtggtgggcgcttgtaatcctagctattctggaggctgaggtagaataattgcttgaacccaggaggcagagattgcagtgagccgagattgtgccactgcactccagcctgggcgacagagcgagacttatctcaaaaaaagaaaaggtcagagctgactcttagaaaagcccccagctgcaatgtggagcatggagcagaggggatggtgagcacaggcaggaggataggtgaggtgtctcctgcagaggtgcatgtgagaggtcacagtcatccaggctaagataagagcagtggggagagacagcaggaaccagagcgctcacattcttccattttcttgctggaggcctcagccctctgctctgtgccagtatcagagcttatgacaagcaactgatctggtgggggagggaaaggataagaggcatcactaaggagcagtgtgtggaaagaccacatggcaaaaagggcttgacacgttgaaacaaccacagccaggccggcagcagcagtatagtgggtaagggcagaggaggaagtacagccattgagatttgatcctaagagtcatggggaccatcaaaaccttgcttcagaaaccattttattcattaatattgcagtacatagctctaaaactttacaaatctttcaataaaaatataactacaagctgggtgcagtggatcatgcctgtaatcccagcactttgggaggtcgaggtaggcagattgcttgaggccaagagttcaagaccaccctgggcaacatgatgaaacccatctctactaaaaatacaaaaattagccaggtgtggtggcatgtgcctgtagtgccagatactaaggaggctgaggtgggaggatcacttgagcccgggaggtggagctgcagtgagccaagatcgtgccactgcactccagcctgggagacagaggagaccttgtctcagaaaagaaaaataactacaatatcattattattacacctaaaaaatcaatagtaattctgtcttgctgttattgaatatctcatcagtgttcaaacttccaactgcttataaaaatatttcttgctgggcgcgggggttcacgcctgtaatcctagcactttaggaaggcaaggcaggcggatcatgaggtcaggagatcgagaccatcctggctaacacagtgaaaccctgtctctactaaaaatacaaaaaattagccgggcatggtagcgggcgcctgtagtcccagctactcgggaggctgaggcaggagaatggcatgaacccgggaggcggggcttatagtgagccgagaccacgccgctgcattccagcctgggcgacagagcgagactccgtctcaaaaaaataaaataaaataaaaataaaaataaaaataaaaatatttcttttgcacttaaaagaaatcagtatctaaatgagatctaaacattgtgatttattttattttatttttgagacagagcacgttttgtgcccagattggagtgtgcagtggtgcaatcttggctcactgcaatctctgtcttggctcactgcaacctctgcttcccaggttcaagcaattcttgtgcctcaaccacctgagtaggtgggattacaggtatacgccatgacacctggctaagtttttgtattttgactagagacagggtttcactatgttgctcaggctggtctcagagtcctggcctcagcaatctgcccatctcagcctcccaaagtggtgggattacaggcataagccaccacacccagccttgattttatcttttatagctcttttaacccaaagattccccttctgtttcttttttttcttaaaaatcaatttgagatataattttttccaggaatgcaaggttggttcaacacctgaaagccaatcaatgtaacacaccacatttataaaataaaggagaaaatcatatgatcatttcaataggtgtagaaatagcatttgacaaaatttagtacctatttatgtaaaaatctttcaataaataaggaagaaaagtgaacttcttctgaccaaaaaaaaaaaaaaaaaaactatgaaaaacctacagctaacattgtacttaacggtgaaagactgaatgaatcctctgccctaagatcatgaacagggaaaggataactactcttaccaattctattcaacattctactggggatactgaccattgcaataaggcaagcaaaaaaggtacaaaggtaataaaggggaaagtaaaactgtttctattcatagacaacattgctgtctacctagaaaatcctaaggtatttacaaaaatctactagagtcaataagtgaatttaaaaagtttgcagaatataaacctaatttacaaaagttgattttatatgccaggaacaattggaaaataaaaatatcatgtatgataacatcaaaaaattaaaattcttagaagtaaatttgatggaagataggcaaaacttatacacataaaacattgctcagacatctaaaccaggatggatctcttggtacctccactgaaattgaagacttaccctgatttgatgattacacattgtatacacggatcaaaacatcacatgtacccccaaaatatgtataactaagatatatcagtgaaaaataaaaaaaaaaaaagaaagaaaagaaactgaggacttttataccacctatcaaagatgtctcaacctaccaggtcttcctctccactgtatggaagacttaggcctttgcctgggcacaggcctccaccaggccagtcatccaaggtgtccaataaattagtcatctcagagctgggccctggagtacccatacctgtgaccccaagaaactatctcttaaacaaacaaacaaacaaacagaacctctctggctgttggggaggaaatgttggaggggcaactagggtaagtggaggagccagcaaagagacttaagtaagaaattataatggtctcagtaagagaagatggtggccctgtatggaggaagtggaagtggagagaaaggggcagacttgatatatttagaagatatgaatgttgttgggcacggtggctcacacctgtaatcccagcattttgggaggcggaggtgggttgatcacctgaggtcaggagttcaagaccagcctggccaacatggtgaaaacccgtctctacttaaaatacaaaaattagcctggtgtggtggcgggcctgtagtcccagctattcaggaggctgaggcaggagtattgcttgaaccggggaggcagaggctgcagtgatggtgccactgtactccagcctgggtgacagagcaagactccaaattaaaaaaaaaaaaaaaaaaaggaaggtatgagtgtctcagatcccagtgcctttgtttctctacctgctcaggcctaggtgctgctttgtttttaggaatgccaccaagatcacttacctagaaggtgcaaaggctcctggaggacccctgacctaggtgtgggcagggggtaagatgaaagtcaaaggccatggtgccccagtctcaggtgggggaatccctttgggccacgccccactttggccctcagcactgctctgcagggtaagggccagggcagggttgaaggtccccctggccgatggaggggtccaggcagaatggggctcattcagaagctggccagtcctccctcaccttggtctctgcctctgggcaaccactcaccctgctgttggtggcaggacggtgggggtggggggcggggtgctgctggcagtttgggcccctgttttcttctcaggagcgctgtgacctcactgtccctcatgtcactggtgcatgtgagttaggaagggtctgtcccctaggctggaaccatttctgcggcaaggagtaaaggtcccagcagcctgtgaccctgggactgtgacctcagttcagctcaggctggagctaaagcagagggtttgagccagagcttcagacactggattctagctccgctctgccactcacatgctgtgtggccttgggaaagatacaccgtcattctgtgcagcaggtttctgcccataccattgagataacaatcacaggtacttcatacagggtagtcgtgaaggtgaaaacagaatgcttgctctttccagggcgaccctaccaatgagaaaacaggctgcagtggggagtgaccgccccaaggacacacaactgctgcaagggtgtcattgtgtaggtgttcctcacttgcctcctgctagtgtgggaggcccagagactccacgagacccccagctgctcctgtgagagggctgaggggggccagctgtgataccgcctcccatctagaaggggcctcaagccacccatgtacacccagccccacgtggctcaccaggggcccctttgccatcaagggccacatcccaggtttaagtgtcagagaactaaggggcttaagagagaatcgagctgtggctttgtttgtgaattggtttgatccttttttccttctagaaggactcacagctactgttgcttgccatgggcttgagggggtggtgggggctgactggcagaggggctgagagtggatggtgattaaaaggagcactgactccagggtagcggctgggcaaggcttggggctcccacctcccccaggttcagagccggctgaggaccgggagtcctcccttctggggtcagtgctcactatggagcaactgccttggatggggtcccaggacttgctcttttactggggctgtggttgcag

SEQ ID NO: 164 - DNA, 10976 bp, Homo sapiens
gcagtcacgtgggggatgagggacgataccagtgcgtggccttcagcccagctggtcagcaggccagggacttccagctccgagttcatgcgccccccactatctggggctccaacgagacaggcgaggtggccgtcatggaggaccacctagtgcagctcctgtgtgaggctcgaggagtgcccaccccaaacatcacctggttcaaggacggggccctgctccccaccagcaccaaggtggtctacactaggggcggtcggcagttgcagctggggagggcccagagctccgatgccggcgtctacacctgcaaggccagcaatgctgtgggggccgcagagaaggccaccaggctggatgtttatgtcccacctaccatcgagggcgccggtggaagaccatacgtggtgaaggctgtggctgggaggcctgtggcgctggagtgcgtggccagaggccacccgtcccccaccctctcctggcaccacgaggggctgcccgtggcagagagcaacgagtcgcggctggagacagacgggagtgtgctgaggctggagagcccgggggaggcatccagtggcctgtacagctgtgtggccagcagtcctgccggggaagccgtcctgcagtactccgtggaggttcaggtgcccccacagctcctggtggctgaaggcttgggacaggtgaccaccatcgtgggacagcccctggaacttccctgccaggcctcaggctccccagtacccactatccagtggctgcagaatggccgcccagccgaggagctggctggggtgcaggtggcctcgcaggggaccacactgcacattgaccatgtggagctggaccactcaggcctcttcgcctgccaggccaccaatgaggcgggcactgccggggccgaggtggaggtgtctgtgcatgagttcccatcggtcagtatcattgggggtgagaacatcacagctcctttcctgcagcctgtgaccctccagtgcataggggatggggtgcccaccccaagcctccgttggtggaaggatggtgtagccctggcagcctttggggggaacctacagattgagaaggtggacctgagggacgagggcatctacacttgtgctgctaccaacctggctggggagagcaagagggaagtggcgctgaaagttttggtgccccccaacatcgagccaggcccagtcaacaaggcagtgctggaaaatgcctcagtgaccttggagtgtctggcttcgggcgtgccccctcctgatgtctcctggttcaagggccaccaacctgtctcttcatggatgggagtgacagtatcagtggatgggagagttctccgcattgagcaagcccagctttctgatgctgggagctaccgctgtgtggcatccaatgtggcaggtagcacagagctgcggtatggcctacgggtcaatgtgccccctcgaatcacactgccacccagcctgccaggccctgtgttggtcaacacccctgtccggctgacctgcaatgccaccggtgcccccagccccacactgatgtggctgaaggatggaaaccctgtgtcccctgcagggacccctggcctgcaggtcttccctgggggccgggtcctcaccttggctagtgcccgggcctccgactctgggaggtactcctgcgtggctgtgagcgcggtgggcgaggaccgccaggatgttgtcctgcaagtccacatgcccccgagtatccttggagaagagctgaatgtgtccgttgtggccaatgagtcagtggccctggagtgccagagccacgccatgccccctcctgtgctgagctggtggaaggacgggcggcccctggaaccacggcctggagtccacctctccgcagacaaagccttgctgcaggtggacagagccgatgtgtgggatgcgggccattacacctgtgaggcactgaaccaggccggccgctcagagaaacactacaatctgaacgtctggggtcaacccctccccggggagggggctggcctccagcacgtgtcggctgtggggaggctgttgtacctgggacaggcccagctggctcaggaaggaacatacacctgtgaatgcagcaacgtggtggggaacagcagccaggacctgcagctggaggtgcacgttccccctcagattgccggtccccgggagcctcccacacaagtctctgtggtccaggatggagtggccactctggagtgcaacgccacagggaaaccccctccgacagtgacatgggagcgggacggccagcccgtgggggctgaactgggcctgcagctgcagaaccagggtcagagcctgcatgtggagcgggcccaggctgcccacactggacgctacagctgtgtggccgagaacctggctgggagggcagagaggaagtttgagctctccgtactggtgcccccagagctcattggagacttggacccgctgaccaacatcactgctgccttgcacagccccttaactctgctctgtgaagccatggggatcccacctccagccatccgctggttccgaggggaggagcctgtcagccccggggaggacacctacctgctggcaggtggctggatgctgaagatgactcagacacaggagcaagacagtggcctctactcatgcctggcaagcaacgaggctggggaggcacggaggaacttcagtgtggaggtgctggttcctcccagtattgagaacgaggacttggaggaggtgatcaaggtccttgatggacagactgcccatcttatgtgcaacgtcacaggccacccacagcccaagctcacatggttcaaagatggccggcctctggctaggggagatgctcaccacatctccccagacggagtcctcctgcaggtcctccaggcaaacctgtccagtgctggccactactcctgcattgcagccaacgctgttggggagaagaccaaacacttccagctcagtgtcctgttggctcccaccatcctgggaggggccgaggacagtgcagatgaggaggtgaccgtgactgtcaacaaccccatctctctgatctgcgaggccctggccttcccttcccccaacatcacctggatgaaggacggggccccgtttgaggcctccaggaacatccagctgctcccaggtacccacgggctgcagatcctgaatgcccagaaggaagatgctggccagtacacctgcgtggtcaccaatgagctcggggaggccgtgaaaaactaccatgtggaagtgctcatccccccttccatctccaaagacgaccccttgggggaggtcggcgtgaaggaggtgaagaccaaggtcaacagcaccttgaccttggagtgtgagagctgggctgtgcccccgcccaccatccgctggtacaaggatggacagcccgtgacccccagctcgcggctgcaggtcctgggtgaagggcgactgctccagatccagcccacacaggtctcagactcggggcggtacctgtgtgtggccaccaatgtggctggcgaggacgaccaggacttcaacgtgctcatccaggtgccccccatgttccagaaggtgggtgatttcagtgcagccttcgagatcctgtcccgggaggaggaggcccggggcggagtcacggaatacagggagatcgtggagaacaacccagcctacctgtactgcgacaccaacgcgatcccacccccggacctcacctggtacagagaggatcagcccctctcggccggggatgaggtgtctgtgctgcaaggaggccgggtcctgcagatccccctggtgcgggcagagaacgccgggaggtactcgtgcaaggcctccaacgaggtgggcgaggactggctgcactacgagctgctggtgctgaaggagctggtggaagaggtgacagtcaatgccagcagcaccgtcagcctgcagtgcccggccctgggaaaccccgtgcccaccatctcatggctccagaatgggctgcctttctccccgagcccacggctgcaggtcctggaggacgggcaagtcttgcaggtttccacggcagaggtggccgacgccgccagctacatgtgtgtggccgagaaccaggcgggctccgctgagaagctcttcaccctcagggttcaaggcctggacttggagcaggtcactgccatcctcaacagcagcgtctccctcccttgcgacgtccacgctcacccaaaccccgaggtcacgtggtacaaggacagccaggccctctccctgggtgaagaggtcttcctcctgcctggcacccacacgctgcagctggggagagcacggctgtcggactccgggatgtacacatgcgaagccctcaatgctgccggccgagaccagaagctggtgcagctcagtgatgcggtcctggtgagggtcggggacaaagctgtcctgagctgcgagacagatgcgctccctgagccaactgtgacctggtacaaggatgggcagcccctggtcctggcacagcggacccaggctctgcggggtgggcagaggctggagatccaggaagcccaggtatcggataaaggtttatacagctgtaaagtcagcaacgtggctggggaggccgtgcggaccttcaccctcaccgtccaggtgcccccaacatttgagaaccccaagacagagacagtgagccaggtggctgggagccccctggtcctgacctgtgatgtgtccggggtccctgcacccacggtcacttggctgaaggacaggatgcccgtggagagcagcgcggtgcacggtgtggtctcccgggggggccgcctccagctgagccgcctgcaaccggcccaggcgggcacctacacgtgcgtggctgagaacacccaggctgaggcccgcaaggacttcgtggtagcagtgctggtggccccccggatccggagctcgggcgtggcgcgggagcaccatgtcttggaagggcaggaggtgcggctggactgtgaggccgatgggcagccgccgccggacgtggcctggctgaaggacggcagcccgctgggccaggacatgggcccccacctccggttctacctggacggcggctccctggtgctaaaaggcctgagggcctcggacgcgggtgcctacacctgcgtggcccacaacccagccggggaggacgccaggctgcacacggtgaatgtgctgggtgaggagccccagggcatctggaggggagcagacggctcggggaccctggtgagcaggcctggggagctggtgaccatggtgtgccctgtgcggggctccccgcccatccacgtgagctggctcaaggacggcctgcccctcccgctctcccagcgcaccctcctccacggctctggccacaccctcaggatttccaaggtgcaattggcagacgctggcatcttcacctgtgtggccgcaagcccagctggcgtggcggacaggaacttcaccttgcaggtgcaggtgccccctgtcctggagccggtggagttccagaatgacgtggtggtggttcgtggctccctggtggaactcccgtgcgaggcccggggcgttcccctgcctctcgtgtcgtggatgaaggatggggaacccttgttgtcccagagcctcgagcaggggcccagcctgcagctggaggcagtgggagctggtgactcggggacctactcctgtgtggccgtgagcgaggcgggggaagccaggaggcatttccagctgaccgtcatggagccccctcacattgaggactcaggccagcctacagagctgtcgctgacccccggcgcccccatggagctcctctgtgatgcccagggcaccccccagcccaacatcacctggcataaggacgggcaggccctgaccaggctggagaacaacagcagagccacacgggtgctccgggtggagaatgtgcaggtaccagtgccgccgccatggggcgaggctgggggttgggggagaggggagggactgcaggttccccagacccagtgggcagttgacaaagttgggctgaagcacctcctctgtgtggggtgtgagggtgtggaggtgacccaccttggccgtgcccttgggagctgccagcaggcccctccaaacattgttgggccccgaggcccccgctttgtggtcggcctggccccagggcagctggtcctggagtgttcggtggaggcagagccagcgcccaagatcacgtggcaccgagacggcattgtgctgcaggaggacgcccacacacaattcccggagcggggcaggttcctccagctgcaggccctgagcacggctgacagcggcgactacagctgcacagcccgcaacgccgcaggcagcactagtgtcgccttccgcgtggagatccacacggtgcccaccatccggtcaggaccacctgcagtgaacgtctcagtgaaccagacagccctgctgccttgccaggccgacggcgtgcccgcacccctcgtgagctggcggaaggacagggtccccctggatcccaggagccccaggtttgaaattctgcctgagggttccctgagaatccagccagtccttgcccaggacgccggccactacctctgcctggcatccaactctgctggctccgatcgtcaaggccgtgacctacgggtcttggagcctccagccatcgcccccagcccctccaacctgaccctgaccgcccacaccccagccttgctgccctgcgaggccagcggctcccctaagcccctggtggtctggtggaaggacggacagaagctggacttccgcctgcagcagggcgcctaccggctcctgccctccaacgccctgctcctcacggcccccggcccccaggactcagcccagtttgaatgcgtggtgagcaatgaggtgggcgaggcccacaggctctaccaggtgaccgtccatgtgcctcccaccattgccgatgaccagacagacttcaccgtgaccatgatggcacctgtggtcctcacatgtcacagcacgggtataccagctccgaccgtgtcctggagcaaggcaggcgcccagctaggagctcgggggagtggctatcgtgtctcaccatcgggcgccctggagatcgggcaggccctccccatccacgcaggccgctacacctgctcagcccgcaactctgccggcgtagcccacaagcacgtcttcctcactgtgcaagcctccccggtggtgaagccgctgcccagcgtggttcgggcagtggcagaggaggaggtgctgctgccctgcgaggcctcaggcatcccccggccgaccatcacctggcagaaggaagggctcaacgtcgctactggagtgagtacccaggtcctaccaggcggacagctgcggattgcccatgccagcccagaggatgctggaaactatctctgcatcgctaagaacagtgcgggcagtgccatggggaagacgcggctggtggtgcaaggtgggatgatcgagaatggcctcccagacctgtccaccaccgaaggctcccacgccttcttgccttgcaaggcgaggggcagtcctgagcccaacatcacctgggacaaagatggccagcctgtgtcgggcgccgaggggaagttcaccatccagccttctggggagttgctggtgaagaacttggagggccaggacgcaggcacctatacctgtaccgctgagaacgccgtgggccgggcccgccgccgcgtgcacctcaccatcctggtactgcctgtgttcaccaccctgcctggggaccgcagcctgcgccttggggacaggctgtggcttcgctgtgcagcccggggcagccccacccctcgcattggctggactgtcaacgaccggccagtcacagaaggggtgtctgagcaggatggaggcagcacgctgcagcgggccgctgtctccagagaagacagcgggacctatgtctgctgggcggagaacagagtgggccgcacgcaggcggtcagcttcgtccacgttctccccgttcagttgctggctgggtccctgctcttctcagccagggccatgccgcaggccagcacagcagccatttcccttttggctcctaccagttttgccccttttcctgatgatatttctcagggcatactttcatcctctactgcacatcaaggcagcccccaggggtggcaaaagctgctgtttttcacagccatccctaataaaaccactgtgatggtcacggtggagccccaggacatgacagtgagatctggggatgacgtggccctgcggtgccaggccactggagagcccacacccaccattgaatggctacaggcgggtcaacccttgcgggccagccggcggctccggaccctgcccgatgggagcctgtggctggagaacgtggagactggggatgcaggcacctacgactgcgtcgctcacaacctcctgggctctgccacagcccgggcgttcctggtcgtgagaggggagccccaggggagctggggcagcatgactggggtgataaatggccggaaatttggcgtggccacactcaacaccagcgtgatgcaggaggcacactccggggtcagcagcatccacagcagcatccgccatgtcccagcaaacgtggggcctctgatgcgggtgctcgtggtcaccatcgcccccatctactgggccctggccagagagagtggggaagccctgaatggccactctctgactgggggcaggttccggcaggagtcacacgtggagtttgctacaggggagctgctcacgatgacccaggtggcccggggtctggatcccgatggcctcctgctcctcgacgtggtggtcaatggcgttgtccccgagagcctggctgacgcagatcttcaagtgcaggactttgaggagcactacgtgcaaacagggcctggccagctgttcgtgggctccacacagcgcttcttccagggcggcctcccctcgttcctacgctgcaaccacagcatccagtacaacgcggcccggggcccccagccccagctggtgcagcacctgcgggcctcagctatcagctcggcctttgatccagaggccgaggccctgcgcttccagctcgctacagccctgcaggcggaggagaacgaggtcggctgccccgagggctttgagctggactcccagggagcgttttgtgtggacagggacgagtgctcaggaggccctagcccctgctcccatgcctgccttaatgcacccggccgcttctcctgcacctgccccactggcttcgccctggcctgggatgacaggaactgcagagatgtggacgagtgtgcgtgggatgctcacctctgccgagagggacagcgctgtgtgaacctgctcgggtcctaccgctgcctccccgactgtgggcctggcttccgggtggctgatggggccggctgtgaagatgtggacgaatgcctggaggggttggacgactgtcactacaaccagctctgcgagaacaccccaggcggtcaccgctgcagctgccccaggggttaccggatgcagggccccagcctgccctgcctagatgtcaatgagtgcctgcagctgcccaaggcctgcgcctaccagtgccacaacctccagggcagctaccgctgcctgtgccccccaggccagaccctccttcgcgacggcaaggcctgcacctcactggagcggaatggacaaaatgtgaccaccgtcagccaccgaggccctctattgccctggctgcggccctgggcctcgatccccggtacctcctaccacgcctgggtctctctccgtccgggtcccatggccctgagcagtgtgggccgggcctggtgccctcctggtttcatcaggcagaacggagtctgcacagaccttgacgagtgccgcgtgaggaacctgtgtcagcacgcctgccgcaacactgagggcagctaccagtgcctgtgccccgccggctaccgtctgctccccagcgggaagaactgccaggacatcaacgagtgcgaggaggagagcatcgagtgtggacccggccagatgtgcttcaacacccgtggcagctaccagtgtgtggacacaccctgtcctgccacctaccggcagggccccagccctgggacgtgcttccggcgctgctcgcaggactgcggcacgggcggcccctctacgctgcagtaccggctgctgccgctgcccctgggcgtgcgcgcccaccacgacgtggcccgcctcaccgccttctccgaggtcggcgtccccgccaaccgcaccgagctcagcatgctggagcccgacccccgcagccccttcgcgctgcgtccgctgcgcgcgggccttggcgcggtctacacccgtcgcgcgctcacccgcgccggcctctaccggctcaccgtgcgtgctgcggcaccgcgccaccaaagcgtcttcgtcttgctcatcgccgtgtccccctacccctactaaacgggagagggcattggcggccgccctggcgtgacccccgaggaaggggtcgaggagaagcttggtccacgccacctgctgtggcaagcggagcgtcatcgtctcccgccccgtgcgtcagcgagaccttgggtcaacacgaccctgcgcacagccttgacccccgacagcgaggacctgacctcacagagggaggcgtccagggcggcccttgggtggccagtcccgcaggcagggcccggggaagcccggatcagacctccaggtctgatccgcccctcagtgggagcgggacagggacacagggcacctggacgcgcgggagagggggcagaccccgcgttaggggtggcagcagctgtcgcccggccacacctggtggtgtcattctgaaccctgttgcaatataaa

SEQ ID NO: 165 - protein, 3409 aa, Homo sapiens
MEDHLVQLLCERVPTPNITWFKDGALLPTSTKVVYTRGGRQLQLGRAQSSDAGVYTCKNAVGAAEKATRLDVYVPPTIEGAGGRPYVVKAVAGRPVECVRHPSPTLSWHHEGLPVAESNESRLETDGSVLRLESPGEASSGSCVASSPAGEAVLQYSVEVQVPPQLLVAEGLGQVTTIVGQPLELPCQASGSPVPTIQWLQNGRPAEELAGVQVASQGTTLHIDHVELDHSGLFACQATNEAGTAGAEVEVSVHEFPSVSIIGGENITAPFLQPVTLQCIGDGVPTPSLRWWKDGVAAFGGNLQIEKVDLRDEGIYTCAATNLAGESKREVKVLVPPNIEPGPVNKAVLENASVTLECLASGVPPPDVSWFKGHQPVSSWMGVTVSVDGRVLRIEQAQLSDAGSYRCVNVAGSTELRYGLRVNVPPRITLPPSLPGPVLVNTPVRLTCNATGAPSPTLMWLKDGNPVSPAGTPGLQVFPGGRVLTLASARASDSGRYSCVAVSAVGEDRQDVVLQVHMPPSILGEELNVSVVANESVECQSHAMPPPVLSWWKDGRPLEPRPGVHLSADKALLQVDRADVWDAGHYTCEALNQAGRSEKHYNLNVWGQPLPGEGAGLQHVSAVGRLLYLGQAQLAQEGTYTCECSNVVGNSSQDLQLEVHVPPQIAGPREPPTQVSVVQDGVATLECNATGKPPPTVTWERDGQPVGAELGLQLQNQGQSLHVERAQAAHTGRYSCVAENLAGRAERKFELSVLVPPELIGDLDPLTNITAALHSPLTLLCEAMGIPPPAIRWFRGEEPVSPGEDTYLLAGGWMLKMTQTQEQDSGSCLNEAGEARRNFSVEVLVPPSIENEDLEEVIKVLDGQTAHLMCNVTGHPQPKLTWFKDGRPLRDAHHPDGVLLQVLQANLSSAGHYSCIAANAVGEKTKHFQLSVLLAPTILGGAEDSADEEVTVTVNNPISLICEAFPSPNITWMKDGAPFEASRNIQLLPGTHGLQILNAQKEDAGQYTCVVTNELGEAVKNYHVEVLIPPSISKDDPLGEVGVKEVKTKVNSTLTLECESWAVPPPTIRWYKDGQPVTPSSRLQVLGEGRLLQIQPTQVSDSGRYLCVATNVAGEDDQDFNVLIQVPPMFQKVGDFSAAFEILSREEERGVTEYREIVENNPAYLYCDTNAIPPPDLTWYREDQPLSAGDEVSVLQGGRVLQIPLVRAENAGRYSCKNEVGEDWLHYELLVLKELVEEVTVNASSTVSLQCPALGNPVPTISWLQNGLPFSPSPRLQVLEDGQVLQVSTAEVADAASYMCVAENQAGSAEKLFTLRVQGLDLEQVTAILNSSVSLPCDVHAHPNPEVTWYKDSQALSLGEEVFLLPGTHTLQLGRARLSDSGMYTCEALNAAGRDQKLVQLSDAVLVRVGDKAVLSCETDALPEPTVTWYKDGQPLVLAQRTQALRGGQRLEIQEAQVSDKGSCKVSNVAGEAVRTFTLTVQVPPTFENPKTETVSQVAGSPLVLTCDVSGVPAPTVTWLKDRMPVESSAVHGVVSRGGRLQLSRLQPAQAGTYTCVAENTQAEARKDFVVAVLVAPRIRSSGVAREHHVLEGQEVRLDCEADGQPPPDVAWLKDGSPLGQDMGPHLRFYLDGGSLVLKGLRASDAGAYTCVAHNPAGEDARLHTVNVLGEEPQGIWRGADGSGTLVSRPGELVTMVCPVRGSPPIHVSWLKDGLPLPLSQRTLLHGSGHTLRISKVQLADAGIFTCVADAGVADRNFTLQVQVPPVLEPVEFQNDVVVVRGSLVELPCERVPLPLVSWMKDGEPLLSQSLEQGPSLQLEAVGAGDSGTYSCVAVSEAGEARRHFQLTVMEPPHIEDSGQPTELSLTPGAPMELLCDAQGTPQPNITWHKDGQALTRLENNSRATRVLRVENVQVPVPPPWGEAGGWGRGEGLQVPQTQWAVDKVGLKHLLCVGCEGVEVTHLGRALGSCQQAPPNIVGPRGPRFVVGLAPGQLVLECSVEAEPAPKITWHRDGIVLQEDAHTQFPERGRFLQLQALSTADSGDYSCTARNAAGSTSVAFRVEIHTVPTIRSGPPAVNVSVNQTALLPCQADGVPAPLVSWRKDRVPLDPRSPRFEILPEGSLRIQPVLAQDAGHYLCLNSAGSDRQGRDLRVLEPPAIAPSPSNLTLTAHTPALLPCEASGSPKPLVVWWKDGQKLDFRLQQGAYRLLPSNALLLTAPGPQDSAQFECVVSNEVGEAHRLYQVTVHVPPTIADDQTDFTVTMMAPVVLTCHSTGIPAPTVSWSKAGAQLGRSGYRVSPSGALEIGQALPIHAGRYTCSARNSAGVAHKHVFLTVQDVVKPLPSVVRAVAEEEVLLPCEASGIPRPTITWQKEQVATGVSTQVLPGGQLRIAHDEDAGNYLCIAKNSAGSAMGKTRLVVQGGMIENGLPDLSTTEGSHAFLPCKRSPEPNITWDKDGQPVSGAEGKFTIQPSGELLVKNLEGQDAGTYTCTAENAVGRARRRVHLTILVLPVFTTLPGDRSLRLGDRLWLRCARSPTPRIGWTVNDRPVTEGVSEQDGGSTLQRAAVSREDSGTYVCWAENRVGRTQAVSFVHVLPVQLLAGSLLFSARAMPQASTAAISLLAPTSFAPFPDDISQGILSSSTAHQGSPQGWQKLLFFTAIPNKTTVMVTVEPQDMTVRSGDDVRCQATGEPTPTIEWLQAGQPLRASRRLRTLPDGSLWLENVETGDAGTYDCVAHNLLGSATARAFLVVRGEPQGSWGSMTGVINGRKFGVATLNTSVMQEAHSGVSSIHSSIRHVPANVGPLMRVLVVTIAPIYWARESGEALNGHSLTGGRFRQESHVEFATGELLTMTQVRLDPDGLLLLDVVVNGVVPESLADADLQVQDFEEHYVQTGPGQLFVGSTQRFFQGGLPSFLRCNHSIQYNARPQPQLVQHLRASAISSAFDPEAEALRFQLATALQAEENEVGCPEGFELDSQGAFCVDRDECSGGPSPCSHACLNAPGRFSCTCPTGFAWDDRNCRDVDECAWDAHLCREGQRCVNLLGSYRCLPDCGPGFRVADGAGCEDVDECLEGLDDCHYNQLCENTPGGHRCSCPRGYRMQGPSLPCLDVNECLQLPKACAYQCHNLQGSYRCLCPPGQTLLRDGKACTSLERNGQNVTTVSHRGPLLPWLRPWASIPGTSYHAWVSLRPGPMALSSVGRAWCPPGFIRQNGVCTDLDECRVRNLCQHACRNTEGSYQCLCPAGYRLLPSGKNCQDINECEEESIECGPGQMCFNTRGSYQCVDTPCPAYQGPSPGTCFRRCSQDCGTGGPSTLQYRLLPLPLGVRAHHDVARLTAFSEVGVPANRTELSMLEPDPRSPFALRPLRAGLGAVYTRRALTRAGRLTVRAAAPRHQSVFVLLIAVSPYPY

SEQ ID NO: 166 - DNA, 90351 bp, Mus musculus
  misc_feature (1)...(90351): n = A,T,C or G
agccctggctgtcctagaactcaatatgtagaccaggctggccacaaactcagagatctgcccgcctctgcctcccgagtgctggaacttgaggtgtgtgaccctgctaggtcttgtcattcacccttgttcctcttctccctctcccaactaaaacataaaggccaatgaacgtctctccattgttgctatacttgatcttagccaaaaggccaaaagccattctccatcgttgctgctgtaggaaattaataaatgtgcgcgagtagtcagtgagtgaataagagtgcgagactattttggagagttgttcagagtgtggtaaacgtggaggctgccgttttcagagacaatgatcgtgacaccagctggctcctccctggtcatggccatgctagctctgcattgtcatccttgagcaggatcccatagtgtctcagcctctctctctctctctctctctctctctctctctctctctctctctctccacaaaaagagtaaatctgaaaagtgtactttgttgtcatgcttagagctgcgtcatttgccactctgtccagcttgtatggtggcttgcatgtgacaagctctggctggagaggcataaggtgttggtgggtccatttatagcccacccagcccccccccccaaacttcactaaagtcatttcatacatccacagtaggtggcgctatcacaaaaaccaatgacctgaaatggctgaggcttcaggctggctgggtccgaagcagctctctgctttctgtgtatgtggcccggaacacatgcttagttccttggactctcagattcctcatctgtagattatacaaatggtgtctgtttggaaaatcgaggagagtttaaaggtgatgagggtcatggcagctgctgccttgacagctgccatgtctgctgtgttccctgattctacttacccggtgggcacaacagcctgtttgcagagatgctggggtgagcaatctcacacctgcagtcaggacagccctagggatgtgtccctgggctcagctggcaggaggaatggagggagctgctgttaccgagtgagggttttgtctagaatcttctgtcacctggtagtcgtatgataaggacttgccagctgagccctgctgaaggagtctatcatgtgtctgctgtcacttggcaggtgatcgagtatattgcagttggttccagattctgagtcaggtgccatcccagccactccatagttctctctggaagcttgctcattcattcattcattcattcatgcactcatcactgggctctacatgcattcagaaactgttccagctctcagggatgtgaataggtcagaatagaccgaatctccacattttaaagtattttatttttaaatgtgtgtgtggggggggggctggagagatggctcagcggttaagagcactgactgctcttccgaaggttctgagttcaattcccagcaaccacatggtggctcacaaccatccttaatgacatctgactccctctcctggtgtgtctgaagacagcgacagtgtacttacataataaataataaataaaatcttaaaaaaatgtgtgtgtgtgtgagacagagagagagagagagcgcctgcctttgtgtggataagcacacttgagtgcagtgtcttcagaggctaggaaagggagtcagatctggagctgagattaatggaggttaccgcatgggtgctgggaagtgaacttgcatcctctccaagagcagaactttctgtaaatccctcatcgtctcttcagccccatcctatatgccctgtatctccacagggggaaggagacaatagacaagaaactatgttttgggtggtgtaaagtgtgaatgagaaaatccccatgtccccaagcctatgtcttgattttaatttgccagatatggaagttctaagcaacatcatgggcgcagtggactctacacttgttactggcctcacagtaaggactcccaagcaaaacaggactctcagcattgggttctcctggacttggactccggcctcgatgctcatgactgactacacatatgccttcctgactcccgtggaacaggaaagcctacaaccccatgaaaggttaaaagtctgtgctttgccgggcagtggtggcgctcgcctttaaccctagcacttgggaggcagaggcaggcagatctctgagttcgaggccaggctggtctacagagtgagttctaggacagacagggctacacagagaagccctgtctggaaaaaccaaaaaaaaaaaaaaaaaagaaaaaaaaagaaaaaaaaaaagtctgtgctttgacagacacggggtagttgtatccctaatctatttctaaggaggctttgcatccagtttaagcacacaacctcaactgcaaatctccaatgggcattggcttactcccatgagtcaggactgtactagttaaaagaggctttatggaggataagaaaacccacagagagccaggcagcagtggcgcatgcctttaatcccagcactcgggaggcagaggcaggtggatttctgagtttgaggccagcctggtctacagagtgagttccaggacagccagggctacccagagaaaccctgtctcaaaaaaccaaaccaaacccccccccaaaaaaaaagaaaaaaaaaagaaagaaagagaaagaaaatccacagagtgagaaaagatcacgtgtgtgtctgtgcctatatgtgtgtgtgtctctgtgtatctgtgtgtgtgttcatgcatgtgcatgtggggtggtgtgtgtaggactttgggtgttcgctatcatcctccagtatctacctttgagacagggtctctctcactgaactggagctgggctggcagccagcaaaccccaagggttctcctgactccattcctccacggcgctggctttggatgcaggcgctgggacttgaactacgcttctctttcttgtgcagcaagcagttttgtcccactaaagtctcccagaagggttctgtgtctggcggtaactgcacacagagtgcaggttctaaccgcagcttggcgctgaaccctgagtcagagccaaacagcatctctcctgctctaagaggaagacaacgaagcctggatttccagggcttttgctactgacaaagaaatcaatgcacacaggcttaagctgggaaattctggctcaaccccagtagtgccttggaggagatcagggtttgcacgtgtgtgcagcatacacacacacacacacacacacacacacagacacacacacacacagagagagagagagagagagacagagacagagacacagagagacagagacagagagacagggagagagagacagagagaggcagagagaggcagagagagacagagagaggcagagagagacagagagagagagacagagagagacagagagagagacagagagagagagagagagagagagagaagtaagtaaacgtaataaaaccatttaaaaacaatgcacttgtccgacagtggtggcctttaatcccagcacttgggaggcagaggcaggtagatttctgtgtttgaggccagcctggtcttcagagtgagttccaggacagccagggctagacagagaaaccctgtttcaaaaaaacaaaacagaacaacaacaacaacaacaacaacaacaacaaaaccaaaaaaacaacaaccccccccaaaaaacaacaacaaaacaatgcacttgtcaaataaacatgagtgtcatcatatgtggcctcagtactggtttcctttggtgaccagagctgtctgggaagctggggtcagattctgggatggttttgctgtcctggctcttcccctccttactgtaagcagtacttgtccccagccttctgcctgtgctcactgctttcctgaaggaagccagaaagggaccaagcactcttcagcccatgtggggcccttgatgtctgctgtggcagtggggcacatcccttgatgtctgctgtggcagtggggcacatcccttgatgtctgctgtggcagtggggcacatcccttgatgtctgctgtggcagtggggcacatcccttctgctttgaggcacagaggacaggccccaaggcactgtggacaccgatgggcaaggttcctgccagtattgagagacacatggggcatgtccctgttctggggtgtcccagtgtttgaggagtagacagcctgcattagagctctgatgggcagccttggcacgttcctatcagctgagctgagctcttctggtgtgcaagctgaggataataatggtgaagttggtacaagtggttgggagagcggtcggttaatttagaaagggctctgaccaagctgggaggtggtggcaaacacctttaatcctaacactctggggacagaggcaggagaatctctgtgaacttgaggccagcctggtctacagagtgagttctaggacagccaggactacatagagaaatcctgttctgaaaaagcaaagatcaaaaccaaacaaacaactaaacaaaaaaggaggtactccagtcctacctggcaggagtgtgatttttttcaatctgcagccttggcaccttagctgaatgtttggcccttcatggagagtccacagaagtagcagctgccagccctgggaatggcatggtccagctgcctcctggcctgtatgtgagacctgcattcaacctgcatcccagaaaatagcagcaacgcggtgaggcctgttccatagcgttaccctgggtccggttccatgactggtaggctcgtgggccagcctttcccagtctctcagtcgtctcggcttttcatgccaccgtgtcaccgcgtggagatgaagtgtgctgcgacgtggtcttagcaggcaccacccgtggaggaactatgtcctgtgggtcagcagctccttgtcacctcctggaaggagtgggaagggtttcctctaaagtggaagaaaggatagctagtgtccattgccaagctgatctggacccggagcaacaaaggacaagcacagtggtcaggacaaaggacaccctctctctgtctctgtctctctgtctctctgtctctgtctctctccctctgtgtgtttgtgtgtgcgtgtgtttgtgtgtgtgtgtgtttgtgtgtgtgtgtaaaggttaaaggtcaacctcaggtgtgcccctcaggagccctctgctttgtctctggtcagggtttccaaggagagcgggcgctcacaatggagctaggttgtcagggctcaccggtgagcatcggggatcgccctgttcctgcctccagtgttaggattacaggggcacagagtcatacgtggctgggatgagctcagcccttcacccttgaaagggaaccactttacagaccgagttatctccctgggctgcttcccttctttctggcaagagcccagcctggactcgatctcacagtcctcctgcctcatcatctctagacctggggtctctcgcccatcaggtgcagcaccaccctgggctgatggatgatgtagaatttcttattcctgtttaagtctgcaaagagagtccaggaggctgatgcggggaatgtttgctaggaagaaaggcatggccagtgtgcagaaaaagtttaccctgtggggtggtgccctaggcacacaggagagtgtgtgtgtgtgtgtgtgtgtgtgtgtgtgtgtgtgttgattcttggatcccaggtttgatggagggtggaagagtggggacagctcgcttttgaccaaggttctgagatctaggtcatcaggctttgaccaggttgggtggggccagagggaactgcctgtacccctgggtccaaggcacccctggcttggctcctgctcctcaggcagatggaatgagattttgcagtcgaagatgaggtcccaccttgctccgaaatgtgtatgtcagcagaattcttttctttctttctttctctctctctttctttctttctttttctttttctttttctttttctttttctttttttattgccttggagacatcaggggctggggtcagaatcgcctctgcaggatatgaagtggtgtaccagatgaaaatgtcttgcccaggctgggaggccagcagcagagagcagcttccagacacaatgacacccctccattccaggcccaggtggcccaggtgtggaacagcctggggggatcgcattacactgtggagcctgtgctgggtgccctggcagggtgggggtggggaaccagtttggggctgaggctgatgtgggtcagggcctggctactcaggaagtccctggaccaaggctggcctggggtggggactgggggacaagggggagctggcaggggattgagggatagatgaacattaatgctggctggggtcctcctttcctctcaggccatggctgtttgatgggggctgtctttcttgctcctctgttcactgtggagcactgtggaaaatttgattcatctgaactgacagaagcttcttcttggtgggttttcctcttggtgggttttctgttaaccagatagcaactaacatttaccaaggatgttctctgtaccccatgcacctggcaggtccctttccatgggggtgagggtggggggacgacacgcagatcctcaagcaatcttgggaggatcccagtctcccatttgattgatgggaaaactaaggcaggagccagccatttttactctcacactgtgcacagctggaagaaccaagacccaggctgccacttcctccccacaaggttgtccccagacatcctcaaagccttctctggggcgacctggatgctccaggggcgtctgtcctgcgtgtttgttctgtcacttaggaaacagctgggtgaggtcttggggacacctttgggaaaggaagtgcagaagcatcctccctccccccagggtttgactgagagataatggggtggaaggagttcagaggggatcttatctctggggtcttaggaatgagaaaaggtggcctctgggaggtagggacctgggagaggggcctggggagaaaggggtggcctctcatggtccacctcccccccccattggccttttaggttaggtctgggtgattaccatttacccaatagacacttgatgaggagataactgctctgtgtgtgtgtgtgtgtgtgtgtgtgtgcactcacgccgcgagtgtacgtgtgcttctgtggtgggaagaaggtccccacggagagcctctttctggcaggccttcatctggtagaggagcccagaggaacccctgacaaatgagtgtttcccatatgcaaactgacctgctcttccctttcgaagccccccacttgctccctgttggctagggagatgctcccaaagatggagggtggatttgaactaaggcttctgtgggcagcacaccttagcctgatgtcagcctagactttaggaggaagtgcctgtagaggctttagcagaggcctctctcgggcagggctggggctggcttagctcttgacactgctctgtggacaaatgcggtttggctgggctcttcttgatagttttttttttttttccaggaaaagctttccttctgaagctgtctgtcccacctgtcatttcatctgtgtggcccagtctctctgtggagactcagtggcccacggctttgtttcatggacagaggacaaggtggttctcctgtcatggctgccgtccatgcataggtcacacatccctcctctacccaaggctagccaggtgccctatctctcccttcttcggtgcctcctccgactgggctctgacgcttctcagagagaagcaaagggaaagactgcttgctacccttctgttccggaccttactgaaggtccttagtgtttccaggggcccaagaaccaggtagccgtggaggttgccatgcttgcctgcccactcacccaacgttctcctgcctggcctgtgtgtggcacccatgcaggccacagaaggccacacacagccttcaggatgagggcagggcccctttgtttattcaatatcaagaactgtaacatggtcaccggaggtcatgtctccagctcgcagcctgcttggcctcagatcacccaccacagcaggtccagggaggggcctctcaggtctgcactggccagggactcagtactggtggcatccaaggcctgggctaagacctgcatgtctcttttagcccctcagacagtcacatcacctaaaattcctaccaaggagccctgagagacctaggtagttatctctgttccaggaagcctgaaagaccaggcttcccatctcaccctaggacttcaagagggaccccctactcaaggcccttccccagcccctacttgccattttaccacccctgaaacgcttggcttgtcgcccaccttcagcaaagcaggaagcctggctcaccatccccactcactcactgccattctgggtgaaggctgctttgctcccatttttcagattaggaaacggaggctccaaagagcagcaatccactgagagacccagtatctgtctgggacgtttcctcctgggaggagagggaggctagtcctttgagacaggaaaatgcagtcgggagctcttctgaacttgggtaccaactgcctactcctcaggccctacctggggctaggggtggggttgttagacagtgaggtaccaaaggactcatgtcaggaccccgcccccccaagagaggaggggggtgggaacattctctagtcccagatttcacttatgtactctgtagagctgcagcatctggggtttgaaggctttgggttaaaagatacttgggaaggaaaagccgagaagtacctgggcccggatcccttgggtgctggacttgaggggaggtgtgtgtgtgtgtgtgtgtgtgcgcgcgtgtgtgtgtgtgtgtgtgtgtgtatgtgtgtgtgtgttgggggagtgaagtgtagaaagaactttatctccacattatctctgccagtcctggaaggttcccagaggaagtggcacccgaggggggaggggcagggagagaacgttccccgaggaacaaaagccaggatagcagaggggcaagcggtgggggtaccgagggggttttgcatgactggagcaaatggagtgttggggggggggcggttcgaaagatgagccaggtccaagagtggccacctccgaggagccttctcggattcctgcgctccctcccggatgctttcctagcacagcccttagttgctacactttggccacttccaagtgcgagtcccgagagagctgggcagattgggattcttctctctgggtccctgcggcgtctgtcccagtgccggacacccggtgggcactcggtaaatatttgtagagcgccctgggaggaatgaatgaagccattgggccaggcttggggagggcggggacaggcgcaggtgggaggcagcgggagcgggaggggcggggaagtcagtcctcccgctcctcccccgctccccggccccagcgcgcccaactccggggctcccgaggcggcgggcgggcgatccgggcgcgcagggcccttgtattgggcacgcgggagatcggaaaggggtttgttgctggtgcccgcgggcctgagcgcgatcagagcgggaggagggagctagggttcgctcagcgcccagctgcctctccggcactcgctctccggacttgtaggtctgcaagctgctgctcctcccaccccggcccgcctcctcgctctcttgctcgctctctggagttgctgtgctagccttgccgtgcgtcctggcgagtgcgggccgaggggccccgggccagaactgagtaaaggacaggggcgtcccgggcaaagcgcagccggccggggagtggccatgtgtggcgaggccgccttgaagctcgcctgcagcaagtgacctcgggtcgtggaccgctgccctgccccctccgctgccacctggggcggcgcgggcccggtgccccggatcgcgcgtagagccggcgcgatgcacgtgcgctcgctgcgcgctgcggcgccacacagcttcgtggcgctctgggcgcctctgttcttgctgcgctccgccctggccgatttcagcctggacaacgaggtgcactccagcttcatccaccggcgcctccgcagccaggagcggcgggagatgcagcgggagatcctgtccatcttagggttgccccatcgcccgcgcccgcacctccagggaaagcataattcggcgcccatgttcatgttggacctgtacaacgccatggcggtggaggagagcgggccggacggacagggcttctcctacccctacaaggccgtcttcagtacccagggcccccctttagccagcctgcaggacagccacttcctcactgacgccgacatggtcatgagcttcgtcaacctaggtgagtggcggtgggaggggatatatttcagactggggccactttgggactgggagagggtctctgcttacagccactgtggtccacctttccatttgcaaagcatcagtgcccgccagagactcttcgccccggggtcttagtagactttaagctctgtgcgtctcggataagtcttgctggctcggagggtttgtccgggctatccggagggtgcacccccagccctgagtctctgcctgctccgccgcgggttcatctcactcaggggcgggaggtcccggctcggcagcggcttagttcaaagcgcccggctgggtcatgtgagctgaaccggcttcagcggcccgcgctacctggatttaaagggcccttgtgggcaaagctgccttcccgcctttcctctgcccctctgaggccagcttggttctgacatcccgcgcatccccttttcttcccctctctgaccctacctgtcccattgcggagcgctggtttcggcgtgcgctcggagtgccgcggggctcctcgcctagccgccagtcgcccacctttggactctcggctggagccggggaaagaacgttgccattgcgagttttctattttaaatgtttaatgataggtcccgggcgggcagaatccattttcagcgtttatcacgtgtggcgcgcaaaccacgggttttggcgattgggtggctggggacctcggaacagaggccgccatggaatggctggggaacccgtttccctgctggagttccagccaacccagtgagtgatgcgaggctgggttgcggctggtctgagacagctccccctgcagctgtgcgcgcacacgtattcaacttgctcaaactaacccccagccgtgcgctgtggggcagatcatcaaatatttggctttggtgataacaagtcctgatagtgccgtttcctgtgtcgcttttattctgcttgtggaagttgctgagaaaaccccaggtcaagacaccaaacgcaccatgggctcccgccgtgtcaacttggaaataatgaagcttgaagaccacccctccctcgctgggcacccggggctcggaagggatctctgtgaagacagggtcccagttaatcctctcagctctagataaaaagccctggagcttctgggagatattgtctggctccattaaaggtcaaaaatataaaataatgaatcaagggtcagggtgtaaaagctggcgatagagctgccaaaataatatagagcaaattctaattatccttagacacttgttaagaaaaggccctgctttggaaaggcctctaggtcctgagggaaggaaaggccaatcgcagagagattttcctgggggtagggcttcggttgctggcagatggagggtgcctttcactgtgtccgttcttttttttaatatgtggatttatcaccttaaactagagtagagtcctcaatagatgcttagcagcatgtggtcagcatggatctgtgaggccatcccgaagccaggcttaacaaggccctctccctgtgtgagggtcagagcttatggcctctcctgctctctcctgtgatctccagcaaggcagtgggtcctagctgacaattcagcgccttgcctggctcatcaagcagcaatagataatccctgactttggtgccagtctctgtgtttcaggtctggcagtatggccccagctggccgcctgcatcccaaagggccaggtggcttccagggcggctcccagggccctgctgggaacctggcgggggcggttgctccccccctggccttgggtacaagctggggcatgctggggaggccacagctgggtggcttcctctggctgcacacacacctttcagtccgttctttctttcatgttgaaaggacaaagcctagcttgtctgagcctctcaatcagcgaggctggctttgggcttttgtgggaccgtcctgactttctcaggcctggctctctggatcatcactcctaattagatagcagagtggcttttaacagaacccatgaactgggtcttgttttctttctctctctgtcgctaaactagaggtaattaggggaagcccaggactgtagctgctaagagcttcctgtaggtgcatctttaatctctgctgggccacagcacaggcaggaacctcctactcctgctggtgtgacttgggggatggcagctgggctggagaagcgggtagtgactggaaacttattcccacactgagtctgctgagaaagcatggtcagatcagaaatagacaagatttttagaatgccaagttcactcttaccctttgctcccgaatgagaaaaaacgttcctgtcaaactgccccattgtcaccctaagagcatttggtgttggtggcagagacagactgcggcacacctccgccaccggtccccctcagttttgcctgcctggggactcctgcttcaaccctgagggcttttgcagacctttattgtcctgtctgcagccaaactggtttttgttcttataagttgttctccctggaatttgagcagtttgccaggcctagtgggatctacactagagggaaatttacaacaaaaccaggtgctacgtgtgaagacttgactgtcccagatgacaagaccagcctgaaccataaagtccctgggaaagccagagacttgcggcttgcgtgggacacccatcctcctggctctggccccaaagttcaatggcaagatctgtaaactggtttggattaacaagccccctactcctctgggtagacttcattttggaattcaaaacaggccacactctctcaaacagtccccaggcaaagttgatcctgcagagaccgagtctcgccattaaccccagctactctttttttttgggggcgggggagaaaccgaacaaccctgttcagaatcttctagaaagccaactgtcttagggagggtgtgtgtgactcccgtttatccctcagccaggttaggaaggaatgaaatttgtttaatcttcgaagctgagttagaaagagaaccctgtcattattgtagccagcgcataaaagtggcttttgttaacttgttctgctaagcagaagtgaggcctagcagtttggtttttcgctttacccccatctggctgtcctttttggagacaagtgtttggcgttaagatctctcctttagccctccgaacagaccctaccactggggagtggtcgggaaaggttctgttacaatttaaacacggcctttggggagtgcgccacagagcgtggctgcaggcgcctgcagctgtaagctggcccgccttagaatttggaaggggctccttcacattccagccttttctggttagcagaggaaggttaatagagatgtcacatggcttttccctttgccttctttccctctcctctcctctcctctcctctcctctcctctcctctcctctcctctcctctcctctcctctcctctcctctcctctcctctaccacagatcaacttcaccataggggtgcaccaacagctgtgttttcagtaaccttttcaaagtcacttttaaacctcattttcctggatctataaatcaaagatttccccctcccctccccttttcccaaggatattatgtgacccagatttgaactgtgttggatcttttgtgtgtatttcccttctgcaatcaaggcaggctaaggctgggccctggatggcagctcagatggctgctttggatttttatcccagggcggtcatttgggtctgaggttcccttagaaggtgggaggtggtgcggaggggactggttaattgttttcctgcactgagaaaagaaagtgagaccctcagagaccgagctccagagaactgggttgaggccttacctcagtatgccaccttagatagtggcagccaacaagcctttgcctagattaacgcagagggtggacggtcccctgaccactggcatgcctgtggtgtgagcacatgtcagatgcctctgaactggaagacaggatgatttcatcccaggcagaggcccgtggaggttgattgatgaccctgtcgctttcatatctcgcccaccccacttactaaggtcatatttggccctcatcgagcctcatagtgtcctccggctgccttctccacccttcccgccctgcccctccgtgtagctgtggaatggagaacacttcccacccagcagcagtctggtgctccgcggtgctccgaggccatggctggggcccatcgacacacaggggaggtggctggggctgcacagcctgccttcgagagcgagcgagcaagcgaacaagcgaacgagtgagcgctctgctgtgtctctggggtcagggcgcaggcagggatgtataggatctgtcttgttattgtcagaaggaatgcacgcagggattagcgggagagcaaggtggtgggagggagccgcagctgtgtacacttattataaaagatttaagtcccactggtaaaatcaatatattgaattgcacagccctctgcttttaattagtttaaatcaaacgcgcccatgctgttttgcctccccttgcctccgtggggtgaggaaataccaatatttacatagaaactgataacactttcagcttcacacactcctatgacccaggtttgatggatcccagatcgacctggggttggaagggatgatgtcagtgggaagagggacatcggtgggtgacgcctaggacttggaccctgatttaggatgcagagggtgtgtgtttagagatggtgttggtgaccttggacttttaacaaagaagccagctttttgtataggcagtcaaaaaagcggagaattcaccaattcaccccctagaacattcttgccaaaccattcaggggctccaccgccagcgtgtggggttctttgtgcggggggggggggtcagcttggggcacttgctttatttattccagaactctctttcctagtccctgcaagtgtttatagaggcaggatggcttgcactgtaagctcgcttgctctcatgcaccaccatggctattatgtgagccggttggtattagctgtgtgctcagctgggattgaattccccgggttttgcagcaaatggcatttgacaaacactatttgacaaaaaatgtgacttggtatttcttaatgtggaacagatatttcacggttaacctcccccgggtgaaaaaaatcgctcgacccccaagtgcaatggcggagcagatgaacaccagggctgggctgggaaatgccccccccctttccaggatgggctgtttatgatttgggggatgtcaggagtgcacagagcccgacacgccccgttgtgaagctcgagtagcgtgtgccaggctggcctttcaacatttgtgtcggaaggcatcgcggggagcggcgcaaagcctctgctgatcctctaggagtggatcgaattaatgaggcctctgcgaacaccagggtttgagaaactactttatcgtttgagaaccagagtgcttataatctggttcctgtaccaacatgtttaacgtgtgttaatgcatttccaaaccggagccgctcagcacagttctgcttttcattaattgatgtcggtagcatggtacagtatttcaaagggccggccaagcataaactgtgtttccaatttccttcctttcctgtgtttgggatgccattgttaatttgttcccatgcaggagccggggctgccaaccggctttctataaagggcttcacagtgaaggcttccagccctcactcgtgctcgggccgcctggcccagtttcctgacactttgcagttaattctggatgatctatggggtggggggttgggggcttccctgcgaggaacggaagttcttggtgacagcggtgggtgtggcttggcaagggcgccctgaggaacatccacagtaattctttttagacgcggcttaaacccatgcgtctgtttccaccgtagaatagcgtctgtgtgaccttgggcgagctattttaacgtctccgagtctgtccccacactccgtaaaagctggggaatagtcctctccttaaaagagtctcaagaaaacacaagtctcatcatcccagaaataggtgcataataaatatacttcttgttgttggggtggataaagctgtattcattttggtatgttagtctaaatttcagttaaaaaatttattacatttatttattgggcaggacgtgcacctgtggcacatgggggttagaagacaacctgtggcagccagtttcccccttccaccatgatggttttggagatcaaactcaattggtaaggcttggcaggcagcaagtgtctttacctgctgagctattatttattctgtgtgtgtctgtgtgtgtgtgtgtgtgtgtgtgtgtgtgtgtgtattacccaccgaggccagaagaggatgtctgatcccttgagttggagtccccggcatttgtgaccctccttgtgtggttgctggggtcacgactctgagcttcatgattgagccccaagcggcgagtcatctcaccagcagaaatttctgtttctgagtggctgactgtaaatactgagatcaagtgctggtgtgtagcttggttagcagagttcttgtctagcacacaggaggccctgggtccgaaccccaggccacacgtcaaatcagatgtgcaatgccagcacttgggaggtagcgagaggaagatcaggagtgtaaggctagccttggctatggaccactttcaaggccagcctgggctacacattaaaaataaaaaccacacatatacagaaactgagatcaagtatttgaaatgtaagaaaatgtccagagttaagtttcctccttttttcagagatgtagaaactgactttcgctatccactccggcccgatcagcgaagactttgtgtcgctcctcatgatgccatctgacacaaatgaggacacccacctcaccagaggggaacagaataaaatgctgactctttctctggatattaacatctgtgtttttttttttttttttttaaatcactacctgggagaccaaaatggaatgaagggtctgtatagaaacttcaaataaaaacttattccaacatgaaaaagtttaattaaaaaggaaatctcattaccgaagtatttcttcccacccctttctggaagccagtcaaagtacaaatagtctttcccttcgggggagtgacaagcccagggccctcattaactaagcctgcagcttcccacttgtgattggagcaggtgcgaaggggcccctgactcctgcagctggctctgtgcagacaacatcagtaaagcctggttggattccttagaggccaaggagctgagagatcatgtcccaggcctgaggcagatgtgggcgccctccttccagggccccacaaatttccttcagctctctatgccatttggagagttcaacgtggtgtgtagacttctcagcatctcggagaccacatgttctatctcatctttatctccccgaagcatttgggcttccctctctgtagtcatgcttaattaaatttgtcagcgagtagggtcttgtgctcttgagtgtcccgaagccctggtctaaggcttgtgcattcttactgtctctcagcattgtcactgttgctaaacggttaagtggcactaaacattgtctgtgtatttgatgggccagtggctcacctgcctggtgacctcacacaattgtgcgcatgcaaatgcacatccaggcgtgcacatgcagacacagagacaagcatatgtttgcatgcataggcaaagagcacgtgtgtgcctgtccacacatgtgcacatgtaatacatacagcctgcggtgtctggttgctttggcttttgatgaaggactccagccctccttgctgccttgcacaattcccagagtgcaccaggtgttggccggccagttgtctgtgtctgtgcgcgtgggaggggtgatgacattccaggcagagttctgtacatgtgtctgatctcacggtctccccctggtacattttgggtatttagcctatgtagaagcaaagtgcgtagtaagtggcatgttgggggatttttttgctttatgaaggcatagttgagactaatagggttaacagggccccagagaggaaaacaactcaggtcttcccgtttgtttattatgagaagttgcatgtgaactgtccccaccagctctcgtgtttgagcacctggtgcccagctggtggcggtgtttcgggacattgcggaactgtttggtgacgtcgtatgatttatgggtgagttcctggtgatgaggacactgccgctgttttcccagaagatactggctgtcccttgtccccaagacttggcctgagtggagagttctgtcttctcaggcaatagaggcagtttctcactccccacaggactcctgtggctgaacctagacgaagattcagggtcttaactaaccctctctgaaatgggtcaggatgaccctgtagatttagaactagctctctatgtagccatttaattaggcatcctcctgcctcagcccggctctcccccctttatctctcagctttctgcagggtaagtgacattgggcagccatatcgttcctagtaagcgagggccgtgcctttgtgaatgaacacaaacctcgctggcctgggagcaggcacggaggaagatagtacactatacctgaaaatagatgctaggccttgatcttgactctgtggtgccttctgatgggtaggagaaggagaagcagactctggctctccatcctgattgttataagacctctctctctgccattatggcagggcaaagggcctgtgtggcataagtggggccccaacagatgtgtcagacctcacgacgctgtgtggacaagtctgtggaaacagccttaacctgtgcccagagcttccaatagcagtttgttgtgatcaggagagtcacctctagatgccctccaatatgggttcagttcctttcttgtgtgtgtgtgcacacatatgtgtgtgtgtatgtgtgcatgtgtctatgcatgtgcacacacgtgcatgggtgtagatgagaatgtgtgcatgtgggtgtttgtgtgtatatagatgcatatgcatgtgtgtgtgtgcgcgtgtgatacgtgtgttgtggggaacactctgggaacaaatggagctgtgcagttcgaatgcaaagtctgtatccgggatgacttagaacatgtctggagagacagtgaggagcagagggtggttaggctcagcacacaggctcactgggcacgaggaatggctgcaggctgtaggcttctgcataccatggtgaggccctgggcacggggaaggactcgtgaccttcagggcgaacctgctgattcaggttcagcagcgcactagcgtgactctccgttctgacacaagcctgtgtttctggtccacacttacatgggaaacctgggtaaagggcacagatagcagctctacacaccagctttgagattcccttgtgactctcgttattccaaaataatttacccgacagaatgtcacctctggtgggcacgtgggtacccggcatgcttgtctctaccgtatgctatgtgattaaactttcctcaagcctggatacaccagacaaaatcctactggagatgttcaccaggtatagtctatatcaggtctcaaggttttgaggccaggcggctcctccccgctgcctctctctgtggtagcatgcctctggtcagtaaccaatcagtcagacccattagcacaaagggggcctagcgagcaactggagactcagtggggcagtgcccagagacatttaaagctcccttgcctgtcctgaaaggcgtagaataaagcagacatttgttcacagggcaggggctgtctggggtctttcccccttacttcttggtcttgaactttataaaacaccaacccccaacccctgctccttccccttctcaagttccattttctgactcacttgaccttcacatttgttgagagacaagcccttaaaaatggcagcggggcctggaaccttccagggccagtaaatgtttataggatggaggtactggttggtcattcccctcaggaggaaacaataaacgaagtgacttgcctttcacccattcagcgagctctgggttgtcttgatgtatcagtgggggttgggtaggtgacgaggagggtggggaaggggatccaggaatgttgtgggcagtgtggttcaataacctgggagcatggagggcttttttgtagatagtagagagctgctgcgtgtggtctgtggggtcactctgctctgtgcactgtgggatatctaaccatttcttaagcctccacacactggatgctaggaggactgtctgtatcacaagttgtgacactcaaatgtcacccccagacctggctaagaatctcctgggtgagggcaagcctcccccccccaccccccgccccagctggagaccactgactccgagtgattttttttggaagtttagagaaccagctacaggcttgcagcagccaagctataagggatacacacattcttggggatgaatccccttcggactgtaagaaagactgcaaccacagtgggacctactcctggatcctgctgccttcctgagagatgcccctgagaacaaggtggagagggataccccgagggccctagggttctctctctgctgcccaaatagatgtccctttccccactccctacaggccgacggtgcttaaatgtacacctgggcctattcatgagctgtcttccagcttcctcagcaggaggctgagtgttttagcctgggtaatggagaagatgggcaagccagcttcctgtgtgcttcaaagctccacaaagcacagagaccgccttggaccttagctggcttcagatcgtaacctgaggctcagcctagctactgactgtgtttccctaagagcacgtgttaaatagtcacaagtgacaattacccaccacccaactgacagggatgctaaataaatgtcttgctcacacacaggctgggtgtgtgctccgacatttatagtatatagtggcccaccagtgtggctttgtcagatgttgtggtggccaaagcctgagtgtctcctgcctgccctgccatgatcatttgtggacccccccccccagatcctctgttgatgactgcctgtgacagacattgtctgagtacattatccttttgcagggacctccttaccctactcagagtacctctttcctggttttagttggacctctgtctcctctgatgtgactctccctacccccaccccaagtcagtactccacaccaccttgcccaagtggtctctgtctcatccctgttgaagaatatctcataagcagtccagccctgaggcctactcctacctcttggtagatccaagacctcttttttgggctcagagacttggttccatctctagagttaaccctgcttcctgactctggggtgcccagttggtgggagcagagaggaggtcagcatgtatactcaacaaccaggaaccccagctgcagtcttagtgcaggctatgaaggtagtcagcagccaccccccccagacatggtgcctcagccctacatctacggcactggatggaggtggcatgcctgagcagaaagacactggctcagacagaagcttgcctgtgttgacagggcacgaggcaaaacaggaagttggcattatcacaccgggctgatcctgtttcactagaaagttatctctctgctgattaagatctgtcattggtcagggttttttttttttttttttaaagaaacagagctggggaccagttggaggagtgccctgaacagagtacgcataacctctcctccgaggttgcctagaagactggcttacaagcaagggcaggaaggtgtgctcgatgtggttgtctggagccgtgttcagtggattaaaatgctctccccctcttgtggtttcctacattgatacctgtatttagggaggcatgcataggtaagtagagcccaagctagcttccaaagcctgcagacacagcagtgtaccacagtacatgtgaacagaaggctggccacctgtgatggttgttttgtgcttattggtactggggacagaacccagggccttaaaccttcaggccaatgctccacctccaagctgtgcccccagcacattgcttgttattaatcaaaccaaactctgcagtccacaggctgctgatagattcactttaaccccagtcccaaagatctgaccttgaagacccagcagaagttcagcatttgttagtaacaggaccagtggaccccttccagtgtcctgcaggggcaaaagctcttgaccgtgatcaaaggaggtcagaagttctgttccctaggtggaagcagaacttgatggagctccgcctgggtcctgctcagggacccgtggcagctgtgtccctggtcagagcctacacaaggacaagatgccttgagtgttctcagagtctggtccacatttaagctgtgtggagaaggccttctgcctgagagctactggtgagacttgaaccctggcagaccttgtcatgggtggggtctagcctcaactctgctgcggcttgttcccttgggggatgctgggacagggcctgggtgcttcttctgatagacagtggggcaggaagggtagggggatatttgtaggataatttctggccagtgtgcatctgctgggaacaaaagctcgtctgtcagagctctctagtcgtgggcatcacagctcaacaatgagtagcttatgtggttgggggagatctgcgccttcctgagtgttaagaatggacatactagccaatctctaccaagtcctggagagggtgcaggatgggtttaacagaggttcccagcactgtcagtaggcagactataagccctccatgctacctggcccatcatagtaaacagggcacagctcttgattacaggataggctccaagctccgccccgtctgcttgctcagcttcccttgcagctcgaaacagcctcgggatgttatgctaattagcagacaggacaggaaacccgctggttgtacctaatgtgttaggaggtggttcaggaagaaaaaaaaaattggcttcctgctgagtgactgcaaagcaaacacaactctgtcttctccctttccttgtcttgagtgtggttctctgaagactccatgcttggttctgtggcagcccttttgtgaccaggaggctcagggattcgaagtcactgtgtaaacggaggcaaagtggcagaaaagacggccgaggcaagttaatgaggcttgatcgtgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggtcccccccccaccccccctcactctagagccccaggttctcacacccagtggtcatcactacctggctctccttcaaaataagagtctcctgtagagctgatctcaggccccagaccaatcgtggacaactgagagctccgcttcatggaaaattatttgccagtcccttttgtaatggcagattgcaggagccctgtatgggaagggtgctcggagcttggagcggcatgaggctgtctgtggcttggtgtgcatctgcggtagaaagagcctcttcctcagtccagactgagtccccagggtctcaccacgtagccctggttggcctggactcagcagagatccctgtgcccttgtctctgtctctgcttcgaatgctgggatgaaaggcatgcgtgtaactgccatgcccaactctacaggcagtttgaagagtgtctttgtagtccagaccaggagtttgtgtgtcatgtgaacttgaggaagtgagtgagggccttgaagatttccagttttcaccaaactgtctccagctgccctgacatggtctcccaagtacctccacagcagcagtgaagcggagctctcagctgtccacgattggtctggggcctgaggtcagctctacaggagactcttattttgaaggaggagttggagcctgcttctctctgaggcacctgcatctctggggctaatgagtttagcttgatggaacccagaccccaggaaggattataaattctcatgtgatctgactcgctgctgagtgcctgaaagcagctgtgtgtgcccagctgacctgcagccccagctgcccggggcggtctgggtctccccttgcccagtggggaaggaggaggccacggcctcactcccacctggctggccgttgggcctgggcccctgccctgctggctgtgtagtggttttgccatattgcatgctggtctctgttggtgacacttttctctacagtcccataagtaggggtcttggtgtggctttgtgtcacagggggaaactgagctttctagagatgggttaacttgtcctgagtccctgtcagtggcaggcaggggctgtgtcccactggacttccaggcccctggggtcacactcagctttttttcctgagtggaatggggcatgaagtggagttctaggcactgtggggtgttgctcatgccctctgatgccttcccagagaagctgctgagcggctgactgatgggtgctgggcagagctgaggtgaacagaagagagatggcagccatctttgaagacttttgaatgtactggaggctccacagatgtcatgtgtcccagcagttgtcaaagtggctctgtaggcagcactgtcatccttgggactagtctatgtccaacctcgacgtttgtatggtgacagtctgcatctagagggatcagtcttgaccctcccatggctcaggtccttgggtctggagcaaaagccacatacccaggatgtggaggctcactccagctctgacccacagtagaagttgatgtttggttcctgtggtaggaaacacatgagtagccatgttctagatgggacatgatggagaccacatgaggttagtgataagctgtgcatgccgggctgatttctgcccagttgggtaaggaccagggaccaagggccaggtgagtctggggcagagcccagcatgtgtcacctaggcatgtctgacaactgtccatacaatggcatcagccgcatgtatagtgtgagcaccagcttccgtgaaccctgtcgtctgagcaggggtctttctgctggctgtgcaggcagaaccagaactatcagaccccaagttctgtagtggaggagtgtgtgtgtgtgtttgttgtgtgtgcgtacatgtgcacatgtatgcgggtgcgtgtggaggtcaaaggttaatgttgggtgtggatctctttcccgtgtgcttctgtagcaggccctttacccaccaagctatccccatagtcctccagtggaattctgacatccataggtcttctcacctgcaagcctcctgtctttgaagatagtcatcttgtgtgtcctacacacgtgcctcctcctctcttgtatccaagttgactgatttggagccggcagcaccgggtgctgcagagagctgagcagatccatcacgctgaagatttgtgtctgggaagagtccacaggccacaagtggctatttaagtttaaactaactataacaacaaatcaaagcccccagccacagcggccacatgtggcccgtgcctactgccacgggcggtgcccgtggagagaggctcatcctgagccacatggaggtcaagttggtggatgctggcacatctgtgtgacatgacccactggaagagcaagaggacttgggagtgatgaaaggcattggggtcccacccagctggctggcagcccagagagggaccaagtccagcatccttgacctcttgaggtcctgctagctcagagcctctcaacaccacacaataacatctgggaggcattgggaaacacgcctgcactcctagcgcttgggagatggagaccagaggatcaggagttcaaggttaccctcaactacacagcaagttcaaagctagcctaagccacaagaaattggggcttgtctggggtatgactaaggccctgggtttaatcctatctttgtaatggattaataaataaagaagaaagaaaaggaaaaaattagagtgggccttaccattttactgggctgtctttgaacctgtaggtgcaagtgaactttgtttgtttgtttgtttgtttttttaagatagggtttctctgagtagccctggctgttttggaactctgtagactaggctggcctcaaactcacagaggtctgcttgcctctgtctcctgagcattgagattaaaggcaaactttcccagtcgctaggattccaggcacgagccactgttaatccccttttgcttttctgtactttggagccgtgcagtgcactgtggggtgtggcaacattatgacctcatcctacttaactctaataaccctgcccacctgtgcgatacccacagaccaatccaagtgctgctcaagagtggccaggagcagaaggggtcggggacaaagctgccctgactgggagagactggtttagcggactgccatcatgactgatattgttttccagggttcttctgttagatgaggatgggactgggaccagatagccctgggtatctggatccccatctgggaacgtgaacgacaggccaaggcagaccaccggctcgtgagggaggaaggccctagaccagagaccagtctttgctctcggctcttttcattctgggtctttttaggcaaacaactggcccagccctggagagataattagacccatctttcccccttctccacccgagcccaaaccctcagcttcatccagtttacaatgatgacattgtttgagctgtgctgtgcacatgtggacattgaagtgtttaatcttgcagcggagacttcattctcagccctgcctctgtcctgacatctctgtaggctgcaggcttaggacagaatgaccctgcctcccaatgccagagcagaaagacacccccccccccaatgcacagcagaacgcccccttccaatgccaacagccctgtgctcagaaggaggctttgtctccaaagaccctgttggagagctgctgtggggactttggcggcctgatggttaccacaagtactcggtggccttccaaagctgaagtggcagtgaggtggatgggaactttcggggagctccaaaggttctgcacatctgggttccctgctcagatgcctccccagtacaaggctggctgtgactcggggtggtgggggcttggccctggcctgtgggcctccaggtctctgtggctgcagccagagacttcatactgagctctagtgttctcagctgtgagacacaccggccttggagcaggagtcttctaagcatcaaagatgggacgtgtgggatagaggtggggtatccaggccagagaaagagagagagagagagagagagagagagagagagagagagagagagagagagagagagagagagagagagagagagagaaagagagagaggctgtgtatatgtgtggagtgtgtgtgtgtgtgtatgtggggggtgtttgtgtgtgtacatgtctatgtatggtgtgtgtgtgggtgtgttgtatgtgtgcatatatgtgtgtatagggtgttggtgtgtgctgtgtgtgtctggtatgtgtggtgtgtatggtgtgtgtggtgtgtttgtgtgtatggttgttgtgtgttgtcttgtatgtgtgtatatatgtgtggatagagtgttggtgtgtgctatttgtgtgtgtgcggactctctgtgtgtggtgtgtgtgtgtgtggtatgtttgtgtgtatggtctttgtgtgtatgtatgtagagtagggggtgttttatgtgattgtgtgtgtaaggtgtttatgggtgtatatgtgtatatgtggagtgtgtgagggtatgtttgtatgtgtatgtgtgtagggtctgtgtgtgtctgtctgtctgtgtatatatgtatgtatgtatgtatgtattaagactggaggttaacctaaggtatcatgtctcagaatctgtcctttttaattttgaagacaaagtctctcactgtgacctgaaactcagcattaagttgagcaagactgactggccagtaagctacacagaccacctgtctcacctccctagtgctgtggtcacaggttcatgtggctgtgtctggcttttccacattggtcctgggggtggtccttcctagccgagaaggtcctgaagacagtggctgcccacctcacacctgtcagctgcagtggccgcttgctaacagaatgaatggaagcagtctctggtgacattcccacacccattatatccttgaggaatctcaaggacattgctgagtggatgagccagtcacaggacagactctgatagggggtcctcagaggagttcgccatgacgggaagtcacgcagtcctcagtctctagggctgaggaagttgagaatgacgtgagcatttagggggaacagagtttcaccttttccagatgaacagttctagatacagccgagtgtgactgtgtcccgcacaactgaatggctggcttacaggtggtgaggcagtgctttgtcacccacatcttcccatgtgaacattaaagtcgaacgagcggctgttgaggactagagagatagccgagcagttaagaacactcactgctcttccacaggatccgagttcacttcccagcgcccacaaaccacctgtaactaactccaggtccaggtagatccaatcaacaccttcttgcctctacagagtgcataggcatacacacatatggcatacattcacacacacacacacacacacacacacacggacaatctttaaaaatcaccaactgtggttttgtgttgcttggactagaggccacctcagaaaagatactgaccagccagggcctcgaatacaagcctaggcttccgagagccttgggttgactgatgaggtgggcatggaaactgtttcctagcaaacctgtctcctccctcccccaggacaatgtggacatcctggcctctcccctatggcgccgccctgttaaaatgatttggggactgacctgtcattggtctgtgaggcctacaggctcagaggagacagccaggtgcgagagaaaccatgattgttggtgtgtgtgtatgtgtgtgtgtgtgtggtcatttatatgcagacctttctctatgttggagccatgagcgtgtaacagtcttctgtagatggggtcttttgcatgcaggaagtcatcggtctgtgggctgcgatctggtcctgagtagatgagctctccagggaggctgcagaacgtgaggaagccaagcttgagtgtagggaattcttgcaaggtggtcagaagagggcagggcagctcagcagttaggaccaagaagagatgactgggagtcaggagggcccctaacagttcctatgagggagaaaggaaaggtggtatccaaaggcaagagtcatgtgttcagtgctacctcctggaggccaggaagatatggctggccatttgtgtcccagctggttgcagtatggtctttttgaccttgcttgggtagagatattggtgtgtgcactggaagcgccttcctgaggtggtgaaggcacaggaactggctgcccatagaagtactttcaggccgtgtgtcttcctcctgagcctcagctcctgtgtagctccgtgcttccctgtttccttcataggactgacctcctgtgggtcatgttccatgtgctaccttcataaacctccctggcgctttgggagaaagagtattatcttagagtttctattgctgcgatggaacatcatgaccaaaataactgggggaggaaagggtttatttgaattacatttccacatcactgttcatcatggaaggaagtccagacaggaactcagacaggcaggaacctggaggcaggagctaatgtagaggcatggaggagtgttgcttattggcttgctcagcctgatttcttacagaacccaggacaactagcccagggatggccccacccgcaatgggttgggctctcccacagcagtcactagttaatgccctctaggcttgcctacagcctgatcttcccattgaagcatcttctattcattcattcattcattcattcattcctttgtttgtttgtttttggaagcttttttaaaaaaaattgggatcccctcctctcaaatgactttagcttttgtcaagttgacacaaaactatgcagcacaagtctgcacacactgctaccatcaaaaaaacgcactctcggtgtcagagaagaggcagaagtggtggatctctgagtctgaggccagccagatctacaaagtgggttccaggacagccagggctatacagggaaatcatgtctggaaagatcaacaacaacaacaaaaatcctggtttggaggatccccctctcaggacccatagaacagggattcagatgtaatcgaactgtggcattttatgcagccatgagcattcactgtaagagagaagcattataagcacacaaaggaagtcagatgcagaggaacctacaccatgctgtcattcctgtcagagtctagaaacaggcaaaaccagcccccggctggaggatctaggctaggcaaggctggtgcgctctgctgatcatccagaggggctcccaccaggagtacttgtgtgacagtcccctgagttacatgtgtgattcatgaacacaacacacatatgtacacatatatacatgaacacaacacacataagtacacatgtatacatgaacacaacatacatatgtacacatgtatacatgaacacaacacgcacatgtaaacatgtatacatgaacacaacacacatatgtacacatgtatacatgaacacagcacacatatgtacacatggatacaaggtgaagtctgttaaacaagcaagtatagctctcaccaaacatctcaccaaactgttctcagcacggatgtgttggcaaaggtctccagtttggcaggtcctggtttgaatcccagctttgtcactccaggcaggctcttagacaccttgggggtctctggtgcatgtttgcccattgctgggtcacgctcccctcctaaagtgacttgggcatgtgggctggttaattttaactaccaatagacactgcctggaatcacctgtgagttggcctgtgagcttgtctgtggagtactgtcttaattgctaattgtagaaagaccaagtcctctgtgggtgttggcattccataggcagggagaccctgcctacagaagaatgtagaaagccagcaggcagtgagggtacattcattttctctgctcttgtctgtgacccagctcttgactctgacttccctgctatgatcgactgtaacctggaattgtaagccaaataagttgctttgtgtcaggttgtcttctcagcaacagaaatgaagctaggcaggatgggaggaagtagcagatgacagggactatcctaagcttcctgccttgcctccttatcctggggtcaccccgctagctccccacgtgcaggagactgccttgctcagcagctgctgcaaagggaacttttccttctctgttctgtcaggaaacccgagggcctggtggcatcccagactcctctctgacatgtgcaagctggtctttcccgtgtgctgatgtagaaggggtgtgctccttgtgggatgaagagtgggcaggaggagagctgacatcagaggggtttctggggacttctctctgagcagctcttgatcccttttggttcggggtcgggtatgagctgcgtgctgtggctgctcatggcgtatttctcttcccacctgtgaggtcgatgcctccgtgttggccattgaactctctctcaatggtatcgtttacaccataggaattggcaagcccttctaagagccggcaatatcaccagcccgctgtgaccagacacctttaatttttaaaagcatattcagtcattcttctatgcagccagggctgaggaccgcactgtcagacactgtcccaggacaggtctagcaaggcctgtgttcaccggtgacagttacctcgccataacattatcagtcgcttatgtaaatgtggtctcattttccatttggtggaactgagtttcagatgggatgtcttgaatctttcttctgacacagctactttagtggccgaggctgggtttgaacccagtcctgagctgctaggactccagtttagtgtagctgttctatggctgtgcttggtctcacccagcagggtggatacagagccatgctctttttgttgaggatggctttggggtctgagcctgtgaccataaaatccaccgtgtgcctacatgggatggaagcttgtcacggaggctgccgtaggcagtggccacccacttcgggtcaatggcatggacagagaggaaccggacactaaattgttttggtgctggtgtgttttcttcccctccagtggaacatgacaaagaattcttccaccctcgataccaccatcgggagttccggtttgatctttccaagatccccgagggcgaagcggtgaccgcagccgaattcaggatctataaggactacatccgggagcgatttgacaacgagaccttccagatcacagtctatcaggtgctccaggagcactcaggcaggtgagttctgcacctgtgtgggagcggcatgctcagcttcctgtagctacagaggaaggagtgggtgacgggtgagggtggggggcgggacatcctgtgccttcccctgttaggccctcgtccagatgactcttaatggtgtgtaatgtgtgaatgtcccttcaaaccgttaccccatgcaaacttgggcagggatattgggagtctatgtgaatgatctaggtacgatgtgttcagagaaggaggaggctggagggctggtattgatggtccttctattcactgatccaagccctggatgatgtcagacagccaatgaaagtagccatttatagtcaaatgccaagggcagaaaaagaaaaaaagaaaaaaaaatccaaacctaaaagcaaacacctgaagaactcttggctatccaagaattgctaggtcccgaaccaaagtctgttttgaaagacttatttctggagaccctctcacctcgcagcctcgagaaaggtaaggagcttagagatgatggcggccagcccctcaagtacactccgaagttccgagttggagccaccaaggtcacctttctttgtggctgggcttttgtactccgagacagtgggacttgtgttgtccccacagatgctgtggcacggaagttagtgggagaatcttcagctaggacaaggaagcccggttctggcattgctgtttggtggcttatctgggcggcgaaggaaacggagtttctgtggtgtttctagtgtcttgaacctaggcgacatttcatatacacgcccacacttagtaacaaatctgggaaatggacactatctaatcactatagaaggccaacgagagagagagagagagagagagagagagagagagagagagagagagagagagagatatacaacacaggaggacttgggccaggtctgggaactaaagaccaggcttaaggaaaggctttctgataatgacttaattttgagccgagtctggtacccagctacccaggggcctgagtcagaggatggtgatcctttagtgacgccctgtgtcacactgaaatgtaaaataacaggcccggtggcccacagctcagttgtagagggcttacctaagattcatgagaccctggggttagtcctcaatgaagcaagaaaggaaaaaaaaaagtagttttagacaagacacacaggaaatagcgctgaagagagaagcagacccttgctccgacctcagtcccctccctaggtggccatgtccgctccgtttctccttctctggaggagagaccaccacccagtctctcctgcttctaagtgggggcaatctgctcgacacctccctttctggttctttcatttccacacagtcccgtgggatggtctgtgatgtgtgccttgcctactggtgtgtcgtgacctccattctgctgctgtggggatgggtggcctcactcctgaggatgtctgcctggtgtggaactgtggtatgttatacacaggtgtgtgcacacccacgtacccacacatggccttcgcagaggtcactagggttcccccaccaaccaggaaggttgtccccactcagcaagacctcctaccaaaccgttttgatcactccgatgggtgacgatggcgtcctggcgtggctttaatttatgcttacagcccttgctgccctgcaccaagctcaaccctgcagggctttcttgctagagaggctagcaatgaactctagggcaggcatggcacaggaaggagctgggtggctgggggcaggaaggcagccacgtgggtcaactctgaatcttcccaggcactcagacgccccgtggatcttagcttggtcctcagtcccagcctcgtgaaaaaggcctgggctatcttctggagttccagcacctgctatgcacttgagaacattcttgtttgtctgcgatgtctggaatcgaatctggtcctcatgtgagctgagcaagtcagtgccccacccccaggccatcaagacgcttagccagactgtggagttttatcttggttaagatatcttggttggctttaggcaaggcacgtacccagaggttgtttgccaagaagtggggcatccacttgtgcctggggctcttggttggcctccaaacctgcccttcagaatgcctccctggcatccggtggcatccagcgagtcctgcgcagcctaccctgaggttactgtcacgtgcacactctcctcccaactctcctgcaggagcatgcgccctcctggtggctgagagtcgcagggtctggaggtcacctctcatgttaagcttctcttactgtgcagatctcacttcctgatgccacagccctgcgtgttgttcttcctgtgcagcaggtgtctgtcccgtgcctgggagcacccgccgtaccccgcggtgaaaggtgctggaggccagaggctcacaaggcgggttaggtggcactcatggaaggaagtctaggccgtgacatggatgaaacaatggactccatgattcatttatcagcttcttatgtgcgcacctgccaggtgctgttctcagaggtcaggcagtggaactaggtgggggaggggcttctagagcgtgaacgcgccgtgggaagttttgattgtggagtgatgcacatgcagccatgatgaagtcccacagtggcagcccagagctgccctggaggctgtaacttaagaattagttagtggtacctgtcctctctgaaacctctgtgtgtgtgtgtgtgtgtgtgtgcgcgcctgtgtgtgcctgtgctcccaatgtgcctttcagctgtgggtgctttcaggctcagtctcttctgagcatgaccctgactgtttccacctgggctcccctgtgtctcccctgtggcatgaggggttcaccccaatccgccgtgagtggattgagtgagtgggttttaactcgtctgtctgccaagacagtagtagtagtagtagtagtagttcttcttcttcttcttcttcttcttcttcttcttcttcttcttcttcttcttcttcttcttcttcttcttcttcttcttcttcttcttcttctgatttatttattttatgtatgtgagtacactgtagctgtcttcagacacaccagaagaggacatcggatcccattacagatggttgtgagccaccatgtggttgctgggaattgaacccaggacctctggaagagcagtcagtgctcttaaccactgagccatctctccagccctgagacattagttcttagtgaggatagttccgttgacagatctgagggtgaggactggaatctcctttctggtacaattctactcgatgtagcaggaagatgtgaattcaggaacaggtgaagagagaagcgaatggctgggatctgtggctgaaggtggtggcatgacaaatatctgtattgtggccaccaatgtccttagggtgtttgaatgacagaagctctgtcaatagaggaagagcaagggtcctatgatcacatcaggcagcatgaagagacctgttgcttctggaacgggatgggttttctacactcaggccttgtggaaaagataaggctttgtgtgtcttctctccagtcctgagatcacgtgatgggttcatgccatttctgggcaatgaggaggtatggattgtagttgacagagggacgacgtgtggtatagaagtcttcagctccctggtgtgctggtatcatggtggcttattgctgagggcctgcctctgggggtggggctcaaggccgaggaggggacacagagcagctggaagtggccttgagggaaaagagttgattgacagcaggtaggcgggaatagtgggctagtaggtgttcttcctgagccccgcaggcaggagcgctgaaacccttctccaggagttgaagagctttgagctttagcttgagcttgcttccttagttaagtttgttttcttagttgcttttgaacctggtacttctctggaggcatgggcgcgggccaacccggctttaagaacatgggttctgatcctgctagagtggccacagccttggagactcagtttctcctctgagaaggaatgatcacggcgtctccctcgcagggttatggagaaggtttttagagaatattttccacagtaaatgctcactaaccgtgctcagtaatggtctctctcactgtaggagggagagagttcttagcgtcagacttccacagagctgccctcctctctgggcttctgaatacttgtatactttaagcatagaggacacaggcctgagccagatatagatgcatggctcctttgcatgtccccaactgtgtgtgttccattataagcctcctgcttgcccggtcctttaaggagcccagtacctgcccctcccccaacccaccagttctgccatctccctgggatctgtgcttagagaagtagctctgctgccccaagccacccagctgctcagggcctggacatctggcttcctggcaggctccagggaccctccaggggtgctgggattagccagctgtgggctggcttcagcatctctcccctgtgggagtcactttccaccaagtcctcttgatctcttggagttggaggccttccacggtctgtccctgcctcaagccaaaccccagatagctggaaaggcgggagaggtatgcccgggagaggtatgcccgagtcgccctggccatctgtgggggagccagcgctcagaggtgggcctggagatggcgacttcattctgcaggctttgctggggttgatatgggaggaccgggagcttagccttacttcctggactccgagcctgaggctggaccaaccaacttccatgctctgggcttgtttctgcaagctggtgggttacagtaggcactccatcccaacctgtgctcttcctgggagcctgcaggcatgcccctcctgcatgaggggcggtgtgtgtgtgtgtgtgtgtgtgtgtgtgtgtgtgtgtgtgtgtgtttgccccaggaggccaggccctgtcaccgccaaggtcgagatgttgtctgcagctggttgaaaaatgtcccctgctccatcccagggtctttggctgccaggagggtgacctcagcctttctaatgccaggatttggatcaacctcagcccgagtcactgtgagggagagagagttgtttctgtctgtccttccagagagatatttgcaagcagaggaggccaaaggggtgacttaccggctccctccttaatccagtccagcccttcccgttcctgagtgcctgtaggtggtgggtgtcccctccaggacacctggcttttgctccttacttagaagcagtatcccacccagagagctcctgctgcaagaacagctacacagctgcccacagctcttccgtgcagcccgctgcatccatcctctgaggcatctgcctttccccctccatcccagggtgagcaggcagaggatgagctcttgtccacaccgggataggccatgactctgcaccgcaggacatgcatggaggaccgcagggctttgctgcagagctttgctggggccgagggcaagagaaagggtatctggtctccatatcccacagtggtctcaaggtggcccctcgggcgccacctcacttcatcctgtcctctgaggggactttcaggtggacatcacgttgggtgcaggctcaggatttggtgaccatactattggaagacttccatataaccacgttcaggcacagcgcagagacatcactagcaccaggactgggacacctcccattttgggattatctgtttgtagtaacttggtggatattccgcctccacaacgggcttcttcagtgttatcccccttccacagacggggtgactcagctgaggtcccatggtcaggaagtggcagagggagggcttgaactcaggtctctgaggttctgcacccaccctgcaccacttgcattctgagccacagagacatcagtgacattctttactctgtctatgcattatcatcggttaggctgatcaaagatccgataaagctgccagtgcgggtgggctgagctgagtgctgacatttcttgaggtcgcccatgtgttccaggtgccaagcttggagcaggcggctgccatgttggctgactctcatgtcagataagtaaaatgtgggccattcttgcttcagccctggttatcaatagcttgtctgtctgcccccttgccgactgttctcctcacaggccagaaacctacttatgttcaggccatgcctgtccatctcactggcatgggatgggggcagggggagactagtggggagtggggatccttccagaagcttccagccttcctcctgcccctaaaggcctatgtgtcggcattgtgtctcctggcttctatctcttgccaccacatctcagcacaggggcatgagcttggggtttgcgttgccttagcagtgagcaccatgtagctgcagtaccagtgctgtcctggaagatcataggagaggggccatgaaagcccaggttagggccaccttggcacctctccttgaggctcctttctctgggtaacactcgagaccccagttccaagccttgggcagggaagtacagtccctgctgctgcttgcttcctctcagggcccctcactaatttacaaggatcactctggagaaagcttacattcagtgccacccagcagggaggatggcaagccactgtgtccaatcttgttagttctggaaaggcagccggccggtcctgttctgtgtcctggagccaagtgccctctggcttcctttcctgtggtctgaggccagctggtgggctctggcggctgttttgatctctgtgcctctccttcttccatcagtcacccacagcccagcttcaggggcgctgggtggcggcagttgggtgtcagtggtaacagggtagatctgtgataagggagcttgtgatagagtcctgtcagggttcatcagggtgcttggcagggggctctcattttctcaggccccatccagcgatgaattccacagagtcagtctgggcaggggtgcgttgttgtagacctgcgcactgggagggctgttctttgttgcgagtttgagatacagttctctgcctcctcttgcagagatctgcctctatgctagagtggtagatgtccccctgagcagcagtgatctcagcttctgcctatgtggctacaaaaccttgtagaagctgtctcttccccttactttgtagagaatcaaggcaagggacccaagatggaagctaatgagggtactgtgtccattctcacacaattctgtgaactgggtgataggtcagccagatttctaccagggaaactgaggtaagaaagacaggacaaacgacccagtctgctacctgcagccacctctggatggatgagtgtgtgccatgagtgtgtgaagttggcagagccaactggcagctggcctggcagagcctcgtagaactgagtgaattctgaatggcagctgcagaggctttctgcaggagtgaaatctaaggcacacagtaggcactcagagaatgcctactgtgggaatagtctggtctcttgctgtagggcaagggcctcttgcgtgggggtgttgagggccatggggacatgcccacaggtacctactacatgcactggtgccagggcatctgcttgtggatggatggtccacctagcatgcctgccaactgccttgttttcaatcttacctcagcatctgcgctcaatttctaaaaagcgaaaattgcctaccattatcccgcgctccattctccgagagctttgctgtgatgattgtaattatattacgcagagctgggggctgccccggtgtccagggttggtgggctcttattgacagggggatggcagcaggtgctggggccctgggttcttgatgttggactgcatctggggacagtgggctgtaggatccggtctgtctggataagttgatcagacaccttaattccgaaagcactccgttcttggattgtgacctctgcttgcctataggaacctatttttccaaatgtattaacatatgtgtttcatatcagggcctgtaagtgctttagccttcttggcaggaaacaacgggaatcgatatttttcactttgcttgtaagcggtcagctgtaggcgggataacaaatgccttctcggacgctaatgctgtgagacctggggaaacaggtgttgtttccaagtgacccaccatttccacataggcctccgctgtcttaaacccgggtcagaagcagcgagcgtgcaaggcttcttcgagctctggtttcttccttcctcttcctactcccacccccatgggtgcccccttctttctcttgggctgactaatggatcacagcactgcttcctgcggtcctcagtgcagctgtgtgaagagagagagagacgcagccactgctgaccaagtgaagctgctagtgagggaagcctgcggggccctggcctcaggtcgaggtttctccaggccaactgtgaagtgtgcatgcatgcatttgtgcgtgcgctggagctcacgagagagtgtgtgtgctgtgtatacctgtgtatgtgagatcgtgtgtgtgtgtgtgcatgcactgtgtgtctctgtgtgtgcacgcacgcatgtggcctatgtatgagtgtgtgtgtgtgcgcacgtgcataaacataaaccagtatctcccttagttacctcccactttcatttctgaggtagagtctctcaccgaatctgcagtttggctaatctgcctggccaataagacccaggggcccttgagtctccacatccttagcactggaattttaggtgcacttccttgcctggcttaccctgaaagcttaaggacctgagctgggtccctagctctctcctaaaagccatcttcccagccctgaaatgagggtttgtagaagatttctaggactggcctataagaacatagggggtcgggccgggaggggaggatggggccctggcagggtccccaggggatagctgtggtcactcccctgcctgggatggcagttcatagacaaagttgcattccctacttgcagtatttacacctccatgggacatcatttcaggcattggtgctgtgggcttttgagccttttctgtggtggctgatggccagtggcctctccagactctggcacaccttgtagcaccaaggtgtggaaacagaatagccagtggacttgtctggaggggcagagtggccctggtggggcagggactccagttcacaaagagccaacagtgagagcccaggggccttggtggccaggtgtgccagcctttgggacaaggccccgtggaggaaccagagctgtgccttaactctgacctccccatcagcttgttcatgcctcccaatcatgccttgccttgccaccaggctcccactgtctacagtgcctgagtctacctgctcacagaatcccactcagattagagaagaatccagaccctcacttctaacccaagagcctcattcacagggtggctcagcgcctggcctggctctcaacacctagccctctgccctgctttctgaggtctccattagcctcagcggtggaaaatcttaagcttggtcacaggcacactgtcactgtccctaacacagcagttcaggttcatgttgtcatgtgccagagtttattgacaacattcacaagctgcgtccgtttcctcggtgggagcatacttaagccactggctggtgctgtcgactcggagactggagtgggggtgtgtctgtctgctctcccccaaccccctgccccttggtgagattggacacggtgcaaggactgagccacactgttcatccggtgacacatcaaacatcatcacagtgagacagtgacaccttgggacccccccccgaaactgtggggagccctgtggaacttctgagtcagctccgctgtgtcctcttgatggacctctgtctgcggctggtggcctagaggcggatcttgccagacttgccctggtcaccacatttctggaatgccacaggctagtaaacagcgttccttgtggcctctgggcatagttctctcctactgtgtgggcccctggaatcagactcgggtcattatgcttggtggcaagtaccttaaaccactgaggatattgtggactttatacctggtaattaggcctggagacaaatgcagttacctgctgagccgtctcgctggcccaggtgcccctcactttgcatggttcaggtgaggcaggtgtatcgcttgctggccttatatccctgacatactaacgggcctgttaactctgatatggctttatgtatgcccatgtgcatgcatgtttgtgtgtaggtgtacatgtgtgtacttgcatgtcgaagccacaaccacagataccatccgctttgttttttgtttttgttttttaaaaaagatttctttattttatgtatgtgagtacaccgttgttgtcttcagacacaccagaagagggcctcggatcctgtcacggatggttgtgagccaccatggggtcgctgggaattgaactcaggacctctggaagagcagtcagtgctcttaactgcttgacccgtctccccagccccttgatttttgtatgttgacatgaagttttttcatttgcttgtggttcactatgtaggctggcctgggcaaccagcaagcctcggggacctgactgtctttatctcctcagtgctggtattacaaggacatacctcagctcgtacacaggtgctggggagtcagcgcagatcctggtgtttccgcaaggcaacttcaccaaccagttcatctctttagctttctgaggtagttctgatacccctacatgtccacatgttcctgacttaatctgattacttgatggccagtcatatctcacttgcataaatcagttgtttattggtctgtgcccctggggtttgggctggatggaccatgaggagtgttgatttgcaaaagtaaggtttgctctctcaacagcctcagctcacactctgaacactgagagcttctgtctgtgagggtgagataagcctgaaggtaaatggactgactgtctgtacactacagagggcctcagggcggggcacagcctgccttccgcagggcatggcatcccttgcttctgtctgcagctccatgcgctgccaacgtcaagttcattttcttgctataccaggcttccttcctcttttggtctctgggttttctgaatcttaaaacagtctgtggatctcttttcccttaaggttggaaaggtgacgcagtgggaaagctgtccgtgttggcgtgttgatgccgtgagtgttcgtgatgagagtgaggtttccttgctctgtctcattcaggctggagcaggaaatgcgggtgaccagtgccagtctggaaagatctgcctttgcaccaccagcagcagtcaggggtccatcaagaggacagagctgattcagaggctccacagggctccccacagtttcttgggggggggaggcctcccaaggtctcgatgtctcactgtgacgatgtttgatgtgtcaccggatgaacggtgtggctcagtccttgctctgtgtccaagtggatctcaccaaggagagtaggagggcagcccctctgcccccaatttctaagtctacagcaccggccagggtccctgcaggaggtgggaggaggtacccagagtctcactgtgatcatcctgggagttgggagtgagcttccaacgagatcagagtatgaccagtgggcaaaggtcccaaggaattgggaatccagtccatgtcaggagatacttgtgaaatccagagacaaattttctctctttttctttcacttgtttacatccatattcattttgtgtatttatgtatttgttgggtgtgtttgtatgtgtgtgaccagaggataagctgaagaacttggtttcttcctactgtgtgggtcctgggggtccatgccatgcttggtggcaagccccttgagccattgagccaccttgagacccctcagagcctttaatgcatgcatgtgtagtatgacatctttgaaggtcagcatgcttgtttcactgcaagccctgttagcctttggccctctgctaacgaagcaccctttggcgaccctgatacgttccaaacccatcttcttgcagacaggctcttgaagcccttgggcatgaatggccgcttgtttcctgcatgtagcagcacggcccttcttctggactctgtgcaggatgtcccgcgccctcctcaaatgtctggtgggcttcctcggtgggcagcctgccagtcctggggtgggtgggaaggccgtgggtggccccagctcagtctgtggtaggaggtgttgtggcttttcatctgtttttccacctttctcccaaacgacttaattttggtcttcctggatatgtaaggcctccagaaagtggtttataaaaagcatcggcctctctgacttcatcggccagtctccgggacgccaggaccatttaggcccttgttggaaaagcagggcatttcctaacactgaggtgggcagctccaggcgcctggtgacccaaccctgcagggccaacttggcctcaggactttgatctgcctcctgggtctccctgagcctggagtgtacgtgctgggctggctccaggtataccatccaattctctcctgactcacgagtgctctacccacatgacatcatgctagcctggaaatgcttgttcgttctgttccctgcccctctgcctccttctctctccctcccacctccccatcatgcccaacagaataaaggtgtggaaggtgtgaagggtgagggggataatcggcaaagattctgcatccccgacgtgctctccggcgcttagcacctgacttacagtggccagaggcctgcaggctgtgcacacacagccacctgcactgtctcctcactggtctcatacgtggccctctctggcccctccatcagaaacacttgtgcaagccctcttgtctatactggtctatactggttccgttcagtctcctcctgctggggtgtccctttgagtctcctctccccccccccgcagtctcgttcttttcctttgctctttcatagatcttttcttcgagacgctttgttagcgttttggtccccccagtttgtgtctcgctgtgctggcctctggtcctcagaccccattctggctgtctttgtccccagctccggcacaggcatggcagggaaggtgctccctaatgctatgctaagcaggttgctgtaacaagggaccaagtattcaatggcttaaaatacaaactctagggctgaggagatggcccagcatataaagtccttgatgcataagcataaaaacctggatctggacactcatcaccataggagagctaggacgggctgggcaagtagacacacctttaatggcagcatcagtgggtagaggcaggcagatctctgaatttgaggccagcctgggctacacagagagactctgcttcttcgttgttgttgttggttgtgttctgttttaaaggcagggcacagtgatgtgaacctatgatcccaccatggaagcagagacaggtggatcctggggctattgctggctagctggtctggtcaaccctgaacatgaggctccaagttcacagagagaccctattgcaaaaactaaaatggcatagatattacagaggaagacattgggtgtctgaattggactgtggtgatgtgtgtgtgtgtgtgctcgctcagttcctagcctttcctggcttctagaagtggcctcttttcttggttgagggtgctccgccaacgtcacatcatgttgatgtctgactctgcactgtcttccttttacgaaggatgactctgtagtgactttgtaccctgtaagtggcaagccatgcctgtgggtccctgcaggtggtgggctatgcctgagagactctgcaggtggtgagctttgctgagggtccctggagtagctccagctgagtctcaggctatgatattggggaaccccccctcaattctgaatcttgcactcaagagcctggagtctgttatgtgctctactactgagctaccctccctcaccaccacccctccccacagcacacaaaccaatctcctcccacccctcattttcattttgcggcagactctatccagattgcacaggcggccttgaacttgaaattgtcctagtagttgggactgtaggcctacacccccatgtgtgctttgagaacacttttagtggtatctctttaagagtgtggcaaccacccagattctccctcccttccagccaccaccaacaacattgacacagaaactccccattctcagctgcaactcagatgtcttgcagggacttcaaggtcctcctgggccctcacggccctgagtgctggaccctctggcaggaatcaaataaggtatgttccccaaggtggttctgaaacaggccttcactgcggttgattgcttttagactttccagaggggcccttggatcttttatttctttcaagaaaaagactgttcttggtcgtcttgatatgaggacatgtgggcatccccaagggaatggctggaggctcctggggtttgcagactagaaatagcctcagagtagtcagaagtcccagacaggactctcgatcctcctacactggagatttaaaatacccactttccatggtggtagaactttccaggggagggtgtgttgagagtgctgatgtgtgtgtgtatgtgtgtgtgtgtggaggacggctccacccacttcccctccagggttaggtttctgcagttcacaggtttccttgggaggtggtgctgggatccagcagcttgcagtccacagccaggtggttaattattcacatcccagtgcgtgcatcagggtcagcccaggttcacaccgtacagagcagggctctagggaagcctgggtttctggaggggagaaggtgaccttctgtgtcttgatgctgtgtgtgtgtgtgtgtgtgtgtgtgtgtgtgtgtgtgtgtttgcatgcctgtgtgtacacaagcacatgctaccatgcaggccagaggacaacctcagacgagttaaggttttcaccttctagagtccaaagagtacacaagcaggctgcagccttcaggaagttattcctgcaggggcgctgcgctgactatcgtacacccccacccttgagttttatacatttcaaaagctagagcatctctcagccctcaccggagaggcttcttgttgcaatagatggagattaacacagagacccacaactgctcagggtgcagagaataagagactatggagtgctcagccttaaatggggcggttctatcacgtgcatgtgcacgcacacacacacacacacacacacacagacacgctccctagactcagggatcattgcagaaggagtggagtgtaagagccagaggtggtggttgactacaaaggaacattgtcttctggacacagcagggctgctgcaaatacgacgcacagtaggtgtgacagcatgcagggctgctgcacatatgacacacagtaggtgtgacagtgtgcagaagatctgttcaaactcaagccagaaaaaaaagttacagtatggcgaagagaagggagcaatacaagcactttgctgactgacacctccctgtcctttgtctctttcgaatttgtctgtcagtttgccgaggactgaggcctgcgactcctctctcttccctgtgggtctgggctttgcactctggtcagcagcacctttgcccacttgagtttcagtccccttttcttccacttttcgctgacagcgaatgcagctgaacttctctgtgtccacggactgtgtggctgtctttagagagcagcctatcaaaatcggctatacttgtcctctgaggcacagacatgctcactttgccttgtaggcttgaaacctgtcttcctgactggcactttctttcttttttaaaaaattaattaattaattaattaatttttttgagacagggtttctctgtgtagccctggctgtcctggaactcactctgtagaccaggctggcctcgaactcagaaatccgcctgcctctgcctcctgtgtgatgggattaaaggcgtgtgccaccacgcttggcttgtctggcactttcttgaccagcttgaataagaagggattgctgttggttttagttgtgagcctggcctttaagggctgagccatctctccaaccccactgttgacttcataagaaccaatgaatcatgtgaagacggggaaggcaccttacgctttaatttctctagtgcatacttgaagcactagaatatttctgtctgtcttccttccttccttccttccttccttccttccttccttcccttccccttcctccttccctccctcccttccttctttcccttcccctctctccctccctccctcactgatctagattgtgtccccagacgtcactgttgtacacacctttggctcagtgcctatgtccctttgccaccaagtaggcttatgtgattctttgaagtgggcatagagtgctctcttgccctggacataccgtcgtgttttgagcagtcctcttgggagacagttttcaatgccgtgcgtcttgagtattgtctggattatctttctctggagctgaccatccatggtgcatagcttaaagtgacagccacactgctgcagagggattggaaagtgcttagccaggtggttcttctgttcctggggccatctgaggtcaccaatgaagctgggagctgacatgcccaagctgacaccccacttatgcatggcgggcctcttcctccctcactatggtggtttgagcaagaaatggctcccgttggctctcagatttgaagacttagtctccagctgaggatggtgttggggagggtatggaacttttatgaggtacaccactgggagttggtgctccccccaccctccgttccctctctctcctctctgtgtatggctgaactgtgatctgccagggtaactttaattcttttcaaaccttatttttaatgatggttcttaaacactttaacctcccttctagcccaccacccagcagaggtagtggaaaagaaaggtacaggggaaatggacctgcttagaaaggttctttggagcaatgctcgtctgtgttgtctggagattggcagttcagttcacaggtcggcagggctaggcagctcgatccactcgcaaaccctttacagataaaccagcagtccagtttggtagagtcgggttagtaaacacaaatcagcagtggtggcactacctagcagagtcagccaggctcagcctctgtcactgtctgcctagacctatcatttgtacctcccaaacgggcccacaggtcttgcctcagcatgtgtgtctgtcttagctgacatcactctgccaagcagccaaagtccacagaagcggcaagaaactgcagcacaccattaatggggggcagaggggttctctatggtgtcccagcaaatgaagctcaaccatgcgtgtaaggcggaccaatacatgcgtgttgttagcgaagaatccttcatcgcgtgtcttttcacgtgcttgctttagcagaacatcctctctcctgtgtctgcttcagctaaaccttccttcatgagtctgccttagttttcacctgtgtctgtttcagctaaacgctccttctcatgtttgccccagcaaaacaccacccagcacaactgactttccaaagaacccttaggtttccacttcatgccagccttttgatcttgtggttgtgcttttttgattgacagcctggctgtgacctgccagcttcttgctcctgctgcggtgctttctttgattgacactttgtcttctctgatatgatggattgactctactccctggagacacagctaaaataaattcccttttgtttaagtggccacagtaacagcaaagtggttgatgcactctttgcagaccctccagtggaacgatctttctccccctcttcaggaggtatcagagtcagggattctattgcctgcgacaaaacaccatgaccaaaatcaagttggggaggaaagggtttatttggcttacacttccacatcgctgttcatcattggagaatgtcaggataggaactcaaacagggcaggaagctagaggcaggagctgatacagaggtcatggagggtgttgcttacgggcttgctcatcatcgactgctcttcttgctttcttatagaaccttggcccacaagccctgcagggccccacccacaatgggctggacccttccacatcaatcaatgatttaaaaaatgccctactgtcttgtgcacagcctaatcttatggaggcattttcttaactgaggttccctcctctcagatgactttagcttgtgtcaagttggcataaaactatccagcacaggaggaccccctcgtctccctcccccaacctctactgtagcaaggcttgccaacttggtgactcaatttccaggggggtaaatctagaagcaactcagattctcaagtcctggtcctagctgaaccttgctcctatagcgacctgttgacccagcagctcacacaatcggcctcctctgctataggaaggaatacatcctggtacagacaggaggagttgttgttggtcgttatttagagagtcttgcacagctgggagtgcctttgcacatgtgtgaagttgacagtctttgtatgtatggaggcctttctgctgagaattgtcaagcaagtccttaggatttcctagagcttagcaaggagaattcaccaaccctgccctaactggtagtgtgtatctttggaacacctggggtgtgcctgtcttcacttggctctttccaattaccacccaggatgaccctgttcccattttacccagaagacatcagggctgaggacgggctgtcttggctcgtcctggatcccaccctcctctggggatgtctctatcccacacagtgcagagaatggcagataccatgcgggactgcatccccctccctccctgcagagatgtgacctggggatcaggggatgagaacgtgggatagtggttcttaaattagatttcctatgccacatctagttccaccatgtctaaagcttgccccggagcaaagctatgtgtcctcaggcccacatgtgaagccgagaccgtatctactgcccgaactcatacatagatcagaccccgtagcagtccggagttggcctcccgggtgctgggattacaggtgtgtgccaccatgactgacgtgggagtgacaaggaccatgtctgagggctggggaaagttcagagttccaggcttgggaaacacccaggtttccggagaggtgaaggtaaatgaatgcatgtctgttctttggggccccaacacttgtgggttccccacctctgcactcaacctgggctgggcaggcagcagttgtgctctaggtatagaagaatatcctggaggcccattcacggctctctgagtgccttcgcaatgctgtgagccggaccaggaatccacttccccacacagttgggaaagtgctgtccctctcctgtggtcctcatctgttctggtgagggatctccacctctatccccctctgtcccttcagatcagctgtggctcttccatgcatgcctaggataagctgcgaaccgagatgacaacggggagtggccgccttcttggtgatccaccaccggtgacgagtcacttctggcctgacacatccggcctcagtgtcttggcctttcatgaaagaaggcttagaatccatgggcgggagagcctgtgtgcagacttgctctgtccccccctggtgacaggcatcgtttcctgtgccagcatctgttccctctccctgcacatctgatattcccaacagcattgccacccaggtttcacatctcgagctctgagcagatgtccctcgttgacttggtgtgacaccttccatcctctgtctatcagggtagcaagctctccagagtcggggaagccatcaggcaaactggaaatgaagccagccagatttccctgtgtgcgcctttgaaagctatgtaagatgtgtcccaaacaagttctgaagtcacctctaaaggggcctcaggtacgagaacccgaggagtaggttattattattactcagtgtggacatcagaatcaaaattagggtctttcaaaccctgtggggcccttaggaagcttcctcacctctgtaatgtcacggagaagacaaactactacagatctggaggccccctcagggaccacataggctcttaccaggtggatggtttcctggtttaagatgagaatttgtagcatcttagtttgcttatgatgctgtaatacatttcttaagactggggaacttacaggaacagaaactcatgttcacggttgtggtggctggaggtcaaggtgctggtgggaaccaggtctggcaaatgttaccctgttccaagatggtgccttgttactatgtcctcacacagtggaagcaggaaagcacaaaggggctcacatgctctccttgaaagcctcacacaaggactggtctggtcccacaggtcccatcttcttcggctagccagcttggaaagctcccctcttaatatcgtcacattacggattagctttcaacgtgagtttggaaggaggcctgactctctggctggagcaatgatgtaattcaacattttctaaatcgggtgtgggacagtgtgcatcaggaccacccacacctctacctatggtcctggtgatgttgtccctgtctggagtcccctgcccaccacttccaagcctggacatgtgacttgcctaggccacctaggttctctgtgcctttggtgactttgatccatgagaccaccagtcccctcacaccagcctcagcactagctgtgtccacacttggtttctgggtgactattgacctcccagagcaatgctgatggcttctgagtggagagaagttaaaagcactggcttgggtgtgctgatgggcctggtggcagtatagcaagaaaagaacttggtgacctctgagacacgtgggactgatggctgggaaaggccagtagtttggtaggaggaggggactgggaccaactggacagtcttttcaggctggcatctggtattggctccgaccgctgctagtggaacacacgacaatgagtctgatttatcaaaggctccgagagtttcgagaaagtcccgccaggcctgccctctgcatcgcagtcctgctcacagagatctccccagtagtgtggccaggatccccaactcacagggttgctgtgaggacgtggtgacaggaagctgcctgagttttcttctccagagcctggccagtgaactgtgctcaatcaacggttgccgtatctgagggttttctgtgtgaacagtgaagtgttttcctgttcccaggaaggtagtaaccccagggcttatggtagctgtgagggggccctgggaagggcctaggttggagagaggcatcactaaactcagtgcccagcatagtatggaggctctcgtattttagttgaccatcatgtctcaataactaaaaatccccaagagctgatttgaataccttatatattatatgcaaggttggggtggtgttcatttaccgacccccttccacatacctgcacatctatcacccccatccatccatccatccatccatcatcaatccatcatccatccatccatccatccctccctccatccatccattatccatccctccttcccaccatccatccactcatccatttatccatccatccatccatccatccatccatccatctatccatctatccatccatccatctctttacctatctgtcctccctctattcaccaatgcttccatctacctttcattcattcatctgtcacccacccatccatcttctgtctctttctttatcagttcatctttctatttatccacctacccatctacacatccacttatctatccatgtagtcaccatccacccacacacccacctgcccatctgttcatccgctcatccatcccctatccatctctctccacctccccacccatccatctttcatttgtctgttcatatactcacttaacctatctatcgacgtatctacccatccatcttctatccataaatccgtccattgctccatctctcagccaactagcccagccaccttccatcttcgacagggtgcgtggagttcttggcatggtggcgggcacgtggtggattaccttgtgggcattaccttctgccccagacacttgcaggctgtataattcctatctcttctgcatccttctggggtcccctgacatacggtatggtgaaatggcctgtgccagttccctattccagaaaattctctactttctttccccatcacaactgctaagaggtcattgtgcctgtgtcctattctgacaagtctatgtttagaggaccggtgccctgcctctgcttggtgtgttacacagagcttctccagtctgtaagccgctgagctgtcagtgtggcagagctgtgacctacctaaccctgagcctgtgtctttctgtctctcctctccagggagtcggacctcttcttgctggacagccgcaccatctgggcttctgaggagggctggttggtgtttgatatcacagccaccagcaaccactgggtggtcaaccctcggcacaacctgggcttacagctctctgtggagaccctggatggtgagtcccagacaccaacacctctagtcccaggggaacctcctacccatgcacttcagcaggggctcagttgccgtccacaaacttgatttgttatctgcctgctcccatctcaaccagcctcaatactctggtttctcgcctacacccaacgcatgctcttgccgcttacacaagaagattgggagttgggcaagctgggccagagatggccttgctgctcacagtgtcagcaggggtgcagtcgtgttggacatgcagagtcttgggtcagccgagaccagctacatgagaacttcacaagcctagagcctcaagggcatataatacacctaggtggggtgtgccagccaggtttttggctcctggcctcctgggaaatggagcatggttgctggcatcctcagccttctaagtcttcagacattggcagatgttctccgtggggggattggagcactgaagacatgttagtggtctgagtcgccattgttagctggtccttcttgatgcgtctttctcgctccctcccatgaatatgcctctgtgggtatcacgcatgagtgaaggtgacctcaagcaaggaatgggcatcagatcccttgggataggcattacaggggggtatgagataagtgatgagggtcctgaggactggtctttggtcttcatcagggttttactgccgtgaacagacaccatgatcaaggcaactcttttttttgtatatttttgtttttcaagacagggtttctctgtgtagccctggctgtcctggagctcactctgtagaccaggctggcctcaaactcagaaatcctcctgcctctgcctcccaagtgctgggattaaaggcacacgccaccactgcccagctcaaggcaactcttatgaggacaacatttaattggggctggcttacaggttcagaggttcagttcaccatcatcaaggcggaacatggctgcatccaggcgggcatggagcaggaggagctgagagttctacatcttcatctgaaggctgctagcagaatactgactcccaggcagttagaactacggtcttatagcccacacccacagtgacacacccactccaacaagaccacacccactccaacagggccacacccactccaacaaggccacacctaatagtgccactccctgggcggagcatatacaaaccatcacaagcaggaagggttatcagtctcgagccatctttccggctccatttctaacagttggtttttttttggggggggaggggggaggaaagcaccttgttttcaggaactactccacccacctcccggtcaacaggatgaaagtgtgtcacagtaaggagttttccctagtgtccttccctgaggtcctaagttccacttcccagaggcgactcttgagtacctttacagggacgccatctcgatgcttaagaacttgctggaggttctggctgtctgttttgattctcacacaggggatgttgtgggtcttactttcctctgactgtgataaaacaccgtgaccaaggtgacttacaggaaaaggagtttcttttggcttacagtgcccaaggctcagcatccttgatggtgaggacagcaggcagcaggcatagagacggggacagagagctcacttcagactgaaaccatagaacagcaaggtagaagtaggagaggccttttactctgaaagcccagcctccgtgacttacttcctccagcaaggctgcaaaacagtgccaccaacaggggaccaagtgtttggatgccaaagactgtggggggacatttctcattcaaactaccacagtgttcaggtgaaaacgtatctggccccatctgctcttaaagagctaattcactttaaggtatgttttatggtcacacattgtcagtgtcttgagccctgcccgctctcagtctgtgactttggacctgtccggatcttggcacgcttgtctccatcacgcaggtggcaagggatgtggccctggggttgttagaggatttcatgagttgctatgagggagagatttaaaattgtgtctcaggaggaacatcgagaggggtggggacacttagcgctaaactgactgaatttaatcctagagccccatagagtaggattcatgcaaggcgtcttccacacgtgtactctggcacatgtgtgcttcccagaggatctcccagggtacctttcaaaatgaagattcaactagactaggtgtgaagtacaggaaagcttgtcttcccaggatgctggatgctggatgctggatcctggaccattctatgaacggtcagaactcaggtgtagcctggataaactgtggttgtcactaccgccataaaggctggaggtttgatggtttctcctccgtggtgaggactgaggctccagtccttttctgctgggctgaattcaccaagtaagtggggtcgtctggccgaagaagcccaggtatctgcgttttcctggtgttggaataacacagcttttacaagaaacttcacatttgtgcgcgcgcacgcacaggacacacacacacgaggatgaaagaacaacttgaagaagtctgctctctcctatggtgtggattccaaactcagttggtcaggcttggtggcaaacacctttacccactaagcaatattgcctctccatgccctggctttttccctacatgggttctgggagatcaaagtcgggtcctcctgctttggaggcaagcccctcactgactgagccaccttgcaccctactgtctcttcctgtcatctgcctggggctccagtggtcctcttttgttcgttccagctctctgcagtttagcatggccctctgaggccatggcttcagtctggaccctcgctaaaatcttgagggtgacaaggacagtctggcttaggtatcccccctttttttctttcttctgaggcccagggctgtgggagcaagatgtggagaactggaactatccatgtcctcccatcccccaccttctagaacattcctttctcgaaagctcacctaagttcagggctgagtgtagaccgcagtgtttaggatctctgtgctttctgaaactgtgctgtctccccctctcccagtctctaccctttccctgccccggagccttactcaggcctcttgaaagttccggagttccgtcatctgcctcaggagttggtaaatgaatgtcgtcaccctggtgactacgctcgacttgaaggctgctgttctcactttggagtctgttttttcctgtgtgagtgaatgtttacatgtgtgttggtgtgagtatgcctgggtgggtgtgcatagatacatgttcacacgggcacgtggaggtcagaggtcaaggtcagctgccttcctctgttgctctctccacgtaatttttttcttttggacagggtcccgccctccctaaattgcagctcactgactggctagagaggctgcccagtgaaccacggctcactgattggctagagatactgcacagtgaacctcggctcactgattggctagacaggctgccaagtgaactttagggatctacctgtctctactccacccccctaaccctggtgctggggctacccaggcattcagccatgctctgcttctcacgtggttgctgggaatccaatcacatccttgcatttgattggtgagcacttgacacaccgagacatctccccagcacgagtcttcatattttaaaatgatttccaacaaaccagaagaaagctccgcttggcacaaacagtgatactctcttcatcatccacagaccggtgtctggtggcaccagtcatgcccgtctgaccctgtggtccacagcagcccttgagctctgatcacagagttgaatagctgtggagacacacccgataacctgccaagctgggcgtattggctcttttgaaagagataactttggcgggagcttatggcacggggtctgcaccagccttcctcagctggtgctttctgaggagccacaggtgcccctcggagggaggggttcacggtctgttaaggatgaggaatgccagctgaggaaaatgaacgggctcaggcgaggaagctgatacccagagagcccacggggctccaaatatcaacagctcatctggaagcggagctctcctggctggtagctaaagaaattttgagccgtcagggtgaggctctgtctgtacctggataagggacagaagggaaggtgtccctgtccaggtgtagtgctttcccaggaaggcctttcattggtcacctggccagggaaggactgcccttaaaccatccagacaatacactgaggtcattggctgtgcgggtgaggacatctgggatggctacaggacaggatgactgggcacttcctagccttccgacgggttcgtggtcttccccatccggtggtctccagtgagaggttctttagtgtcatctgggtgcataggtcccattcgcacgcaccaccagcaagtccctgggggtgtctcatgattgtcttccggggcaccttggtaaccttggtaacaacagcactgggacccttcctatcccgttctgaggacaccctgcttatgtagacagccggatggctgacagacttcccctcctgcaaccacatgggtaaaaggctcacaggtgaccagaagctactgtgtgctgggccttgagctggcaggagagtcccctgtgcccaccctgggaacttgatgttttcatagttcctgcagaggtcaagctcaggggaacaccagaatcccaggaggcagataaccagtcctcaccctgactaacagtaaaccaagacctccaaaccttgaggccacagacaccacgtgggtggaggagacccatctggtggccgacagaatttggagctgattgcctgccaggcctcagtttccctccctgctccaggacatctgcttccatccgagtgtgtggtgtggacgccgcagagttccttctggaagcctgatgtttgctggcctgacgtcagagcctactggatggcaaattgcagagtccctggcttgctgaatgctcacttcctccatctggccctgggggaggtcccaggtcagaggtgcccttcccagaccacccaggcagtgtgcaaagcctgcctgttatccctccttccagctgtagcgccccccccccccccgttagtcaccaaagcgtcacagctgggttcgggggcgagcgtgtggtgtggggcggaagtcaataccctctggacacctcggctcccagagacagacatgcagcattgggaaggatggatgggtgaatgttgtgggggtgaggcctggtgaccccgtttttcatacagaaaagacgacaggaaaggtgttgactccatggccttctttccccattcctggacagccatgtcctgcacaccaggctggtgttggacgtggcggtgggggtgggggtggggtggaataggagagaagcgaggggctgcctgtgcaggcgcctgtgctttgagttggtgtcacaccaggctctggctcacctgttgcttctggaagcaggacagtcctgtggtccctgagggcaccactgctgctccccaggttcatcccaacgaactgcttggagtctccattccttcatgttctccatgaacatgatgacatgacctgttctgttgacgtctgggaggaagaagagggtgagctcatggaacgtgccgagccccggggcagccctgcctctgtgctcatgaatcccagatgtctttattactgctggtgtattcctcacagtctgcctgccgggggaggccagcagtcaccgacagccttttataaaagaagaaaccgaggcagtaaaaagccccggggttaagtcacatggctctcagtgctgaacttgggactcagacttgggtcccctgttcttcaatggaaaagccttttagaaatatgggtaccaatggcctggtggggaagaggcttgtggggacagtgggcatgtaaggggctgtgctaaggccagctgggcagatcagacagagttcaggcctctccacacctgactgtcatcctccgtcctctctcctgggatggagagaccttagaaagagagaaggggttccctgtggggcctccaggatgagcgtgtctccacgtgccacggcctgcactttttatgattgtgtggcccgtgttatcctggtggcagtgaaaataagacattttctccgcagggtggcgaatgacgccagcagtcgcagcaagtgggaggtagaggcaggtggatagccatgaatttgaagttatactgggtttctgtcacatagttctaggccacctagagctatagattgagactcaaatagaaaaccaaaactaaaccaaaagaagcttcctcccacactcaaacctcctgccggggcttacgcttcaagagtcagcagaccccacccccaagacccctcagtgtcctggctgatacggtggtccatggcactgcggagccacgctgaccccttccctatgcccacgtgttagaagcagcttcctgcagctaatagcctattgatccacattggttggaagcttatgcagtcattcaacaaacagcctgaaaagtagatttgccgtcatgtgacccacagcctctcccaaggtggtggacggtaaacagagacctcacactgaaggagagagacagagactgggtggacaagttcttgctcggaagggcttcctgtggtccacaaatggacacacctactttcccaaagtgccctttaactctagcatctactgtagcgagaggagccggtcctagacacacactatcctgcacatgcagaggcaccttgtttccatcgtgaggagcccagccatcctacttcctgtggctctcttgcctgctccagaaggaaacacccataggccctgtgatctggtgctctcctccgaatccatccacctctcagtctcttcacaactgcttctttggtgccttccagggcttacgcctcacctcccgatcttcaaggctatccctccctccctccctccctccctccgagtgtgtgtgtgtgtgttgcccagggattctctgctctggcacatgggaacgtgtgctcctcttcttgaccatccccagtggatccgacatggtcacaggacatttaaaggaccaaagggcatgtgctgtccagatgtgaggctgaggcatctgtgggagaacgcaggggccgagcctccggcctgaggctggggacactctggcataaggccagtctggtgggtagcttctctcacagcacagctggctagaggtacctctgcactccaggattacgtcacttcctttttgccctgaatcccaagagacagagaacagaagaggcccagtggctcttcttgtcctcccagggtccagccggctgtttaggtctgggtagaattgggtcactggggccagaaggtcacaagtgttcactacagtctcacttgtcactggggccttggagcttccaatgcagtgactggaatcaatttttctataatcgatgaagaacaactcacctagagttttccttatgaggtgtgaataagcaggcctagtcaactagtgttacagtgaacgccagcaaatgcccgtagaacattccagaggctggacacgtcaggttcagaggggagttgcttgcttttaccaacactagttagcatgagggcagccagaggctgcatttgtgactgcacactggttgtgttctaataaaactttatttgctaaagcatacagttggccagatgcaggaactggaggcataaaggtcctagctcctaactattggtcaggaaatgagaaggcagattcccatgacaacctctgagtggctgcttcccactgtgttcataagaataaatcgactgtggctcgtgtgtgtgtgtgtgtgtgtgtgtgtgtgtgtgtgtgttgtgaaatactactcagcaatgaaaagggtaaataatacaaacatggggtttcatggaggaatctggaagacgtgtagattgaaataagttgacccagaagagtggcaagtccatgtgacacgtcaagaaaatgtggtagtgccccagtgagaccccaaattgcactttatggatcaggatagtgaccgggagaaactggataactaactagctgggggtgcctagggtctgcaatagcagcagcagtgggctccctctgacatacacatccccagaccatggtaggtggcctagtggcctctgagagcagcagcctcttgctgagaactggaagaggctcgtgtgtgtgtgtgcatgcactcaagagtgtgtgtgtgtgtgtgtgtgtgctgactcagctggctgttgcaggaattgacacccatggcggcatacatatttgcaacaccattaaagcaaagcaaaacaaaagccaacctctaaaaagttattttttattatttcttacttttaaaaggaataaaatcaacaggccgggctgtgacttggtggagacttcctaccctgtttgaagacctgggtttgatctctagcacctcgtaaaggggctgtgtggtgcacgcctggaattccagcactccagaggtagaggcaggaggacaggaagttcaaggccagccccagctatataatgcatttaacactagcctgggctacgtgaaaccttgtctcagagccggggagcagcaacaaagaggaccagcagagtcccaggaaggggcagtcacccctggtctcatccgaacttccaggcaggcaggcaggctggttggtgccagttaaatttgagtggccaatgatcgatcccgactgcttcagcgccgtcctgcatgtagtgtttgtttttctgaagttcctattcagctggggcagctcctgctttcttatttccaaaacttgccttttcacaggcaaatccatgggcttggagagaaacacgtgttcagctaaccctcaactaaaatagaaatattttctagttttgccaaagacagactttatgaagttttgtgtgtgtgtgtgtgtttttttttctgcctacattaatgaacttacccatttctaccctgtgcctcattttggtaaccttgctgaatatttaaatacagataatcaaaacaaataattacaagtattaactgaaactgccgtgccgaaagcatctcgacgggaaagaaattcctgtaattacccttttttttgactgcccccttgttcagtatcaaaaacaatacagcatgatggctcacgcctgcaagcccagcccccaggaggagaggaaggaggatggctgtgggtttaaggctggcctgggctgtgtagtgagactcttctatatcaagtgtatgtgtgcctgtgtgtgtatatgtgtatgagtgtgtatatgcatacctgtatataacaggttatagcatcatgatgtaacagttaccagtgctggccacaaactcagggcctcatccatgctccacgagccacactgtggtttctgcttctagctatcagtaagaacacagctgtaggctctaatgtgtggagtgtggagtgggctgtattacctacatagctgtgacaaaacacccacgaaaatgacttcggggaggaggggcttcctgtggctcatggtgtgggggtccagtctgtctctgcagaggagttccagcagccggtcacagggcatctccagcagtcaggaaacagggagagacgaaggctggtacttagcccactttctctcactcagtgtgggacctcgggccacattcacagcggtctccctcttcagttaaacctctcgggaaagtacctcacagccacccccagaggtgtgtctctgattctaaatttagctgtcattcttaatggggtgtgtttaaatccttctaaagatgtcgaatgcagttgggttgtcttccagccttttacacagaaacccccaactctttccccacgttcccctttgctcctgagggccagcccttgtgcccatgttctctgtcgccagcctctggtgtgtgcatggtggtggtggtggtggtggtaattccagactctagacctagtcatcggggtgggacatgcatggcaatggttggtgtgagaacgtaggctgcaggctggcttgacccagtgacagctgtgtcacaggagcccctctctgaggtgtccttccacggtagccctcgtttggaaacatggtttccctggagtcagtacgtggagatagcttctgcactgctgagaacagatttcttctgaatatgagaacagcaagtgagttttctagagctttctagcagtttctctgaaaaattctagaaacttctcccttccatgctttgactgaactgggtcacgtctcacctctgggcagtgacaacgactctacagaaggattaggtgcctctcgtcaaactgcctgccacccagccctgaggccagggcagactgagtttgggcaaagctgcctgggtgaatggtgtgccattaactagggacacagggatgtgagactaatggcctcatccagtttacatgggaggaaatcaaggctgtgcgggctgctggtgcaagtgtgcgtttttggctccctctaagcagaggttgaggtgggtggaggttggtttgctggcagcctctggccccgaccagcaggtcagaagggcttcggggactggggccacgcttggcgcctggatttaaggggtccagagaggcatgggggcttgagtcaaggcatttttactctgtcctaaaagccttccaggggggaagtgcaattcctcagggcccggctttaatggtttcttttatagactcagtctcgttatagatggatgaactgggggggaccctgctcaagaatgcaggagagacggacgccgaaaggaggggaaggtgaatcgtggggggttgggaaatgtgttttcttaaacacaaactcttaaaaaccattctaactgccagaccaagccaggcactggaaactgggcttctccatctccgacctgcccggggaacactagctagtgtgatgtctaaccatcacttttgctggccttggctctgtcactgattgggggtgtagtagctgccctgatgaagcacacccttccctgagcctcctctgcggtcagattgagtgctgttgctgttgctttctgggttgcacgggggttttttctttctttctttctttcttttttggcaggtggctcagcctctctgatcttgtcctgctatgggcagtcgacattgtctccatctgaagtctccctgctctgaagtgttcgtcacccgatggggtggtcaatgtgtctaaggatcttatcgttgttgttccatggggagatgcacagagcatgctcatcaccagggccttggcacagcccaggacctgggtgtgagttgtttttcccagtgatatgacagactaacccacaaaagcacttagcacaggtctggtgagtctcatggctcgagggtaccatccatcgggacatcaggagcgtgaggcagctgggcacactgcgtccacagccaggaagcagacagagatggactggaatgctcagctcctttttattcatccctggatcccagcccatgggataaggccccagcttggggctggtcctcccagcactgttaacccaatctggaaactccctcatagacataaccagaggtttgtttccattggtaatcatgattggccgtcacatcctgggcgctcttttctgtaccttctaactctggcttctcatcccaggctttcttggagttctttttcctgtcccacctcttaattaggggaacctgtgcacggtgctgtataccctggaagagagaggggatctgggtacctttgtcatgtttgtctagcctcaaattccctcaaacggaactgtaccatgtgggaggaggggtctgttatatagagaacagccaccccggacgccttgcccatccctcctgctgggagctcctactggccacatggccctagccctaaccctggataccaagaagggatttcacacaacatctgttcagctaaactgagctttgtcttccttgttccactctgcagccccttcactggttttcccatcttcggaaagccatttagggcaaggaggtgcgggtctcacaggactgtctttttctcagtccctttaccaaagtctctcagcgaattccttcagttctcttcaaaacacagcaaaacctgccattttctaggcctgaaactcattacagtggcattcctgttggagaaaactggctggtggataaacgggacctctagggacatgtttctctgtgtctctgtctctgactctgtctctgtctctctctctctctctctctctctctctctctctgatgctggggtggagctcacaaccttgcacatgttgttatacttacactgagctaagtcccatcccaagtcctctatatttttgaggcaagtgtctctcagtcactgacatgaactgaactttcaattctcctgcctcaacctccagagcagctgagatgacaggcacgtaccacccaaacttggtgcctcccttcccccaccccaactttgatttcatgcgctctatttccaaacagaaagctgaaatcaacagcttcccagtgttaagcaggcagcagtaagggaccagctggagggtgtctggggaagggcatccaagaatctgatcctgtcccactaggctcacttccactgccccaggctgatcccttggcaccttcttagggcttcctggtccctggcttctgttcttcagcttgcagtctggtttcagggcaagcccaaggtcatcgcagagaatacttgaggtcctcagcccagtccctccctctgctttctacaattgcttcctgtcccatactggccatcatgaccaagtcccacaagctgtcatctcccaagtgccagagctttattgtccccacggaaatgcagaaatcctgtacccaggtgtcactggctgtgcacctcgccacccctacttcaggcagctccgtctcctagcacccatggtgacatgtggcctttctcttttcacggagccactggcgcctggagtgaagcctgtcttgcctgtcctggctgtttctcaagggcttacacctgcaaaaaccttgttcaggcaaaatgcttccattggccttgaggtattggtgcctatagcctgttgtcttctgtcatcccccccccccccacacacacacacactgcaggctctcactatcctggactccagtctcggttagtcctgccaggtctttatttgtgctgtgctttacacccatagtgacctttcccacttggggctcactcctcactgccacctcttccttctggtagcctctccactgtcatcagactgttgggagccacacttacgtcatagcagttactttcccatcccctgaagcctgactgaccaagtgaccaactcactagcctgagacaacggccttcccctcctggctcctctctctgctggtcttggcctggctcctcatgcttcctattccttgcttagtgtttgggtcaccactgggtgattgtgtgctgccccttgccccacaggggtcaccagaggccagggcacttctaagacagctcctggaatagcccagccagtctttgttggataagtgaacggctagtgcgcgaatgttttacgaggtgggaatagaatcatgtcccccagcccatccttgtcccttggacttcgtgtaatgaatacctcccctgcagggcagagcatcaaccccaagttggcaggcctgattggacggcatggaccccagaacaagcaacccttcatggtggccttcttcaaggccacggaagtccatctccgtagtatccggtccacggggggcaagcagcgcagccagaatcgctccaagacgccaaagaaccaagaggccctgaggatggccagtgtggcaggtaggtccgagcagctggaggggacctgctcattgcagatgcttccagacacatcaccctgtgacctgggacgtgtcttttcagcatatagcttctccagggttctggtgaccctgaagcaaggcaagggctaggcacaaaccaatcaggccttcttgtgagggccctaagccgactcagtcttccagctcctgccctcaggattctgaggaaacacacaagggactttgggctgtttagaattaagtgtgagaccacaaggccattcccctactgacccacaccttcccaaccctccactccaggtaaacttgcattatacatggcttcttccttagtcattttatttctgaagagggaaagtagcctgcaggggtggttgggcttactggttctaggctgtccccagtaccctgtgtagatgtcagtgggtagggagaggtgtatatcaattcagatgctatgcctgttttgttggctttaattcatcaagaacccctttgccttggtagacatggcacttccaatcacaggttttattccaatcttaactagtaagtcaatctcaactgctaaactattaaactcttagcacactgtgcacacatgcagcatgctgttgcgtatgtaatacactcattacacagtgctcattattactcaggaagaggcagtgctgctcagcgaggctcccctaatgctggatatgccaagctggagaggccatagggaaagtctctgaagggactaaaggagtcttaggaccagctctgggctgttcagggcagagttgtcaaatgtagacctaggtaagttttagtattgacctgcagagagctgaaggcgacaggcagggctgaacctggagccaggggacaggaggagtccttccctgtagcaactttcctatgcaaggttcatgaccgatgcaggacctgggtcactgtgcctgcttgtctgtgttgggtgcttctttgttccttgcccagataagagagtttcatctggtgtgacagaaggctcttgatgtttctgacatagatagattcctagatggcattgtttacgggcacaaataaattacctgttggtcgcagcttctggtatggaggctgacggtcctgttttacttgtttaaataagttgcagagtctgtctgcctcagtacccagacctaacatgggacagctcaggaaagcacagtaaaacatgttaaccgtgagtgaggcactgcctgcaagcagctgctgttctgaacagagtcactgcgtgttctctgccagtggcctgtatgggtcgtgaagacgagagtcttcaaaaacattctcttctgccagatggggctgcttataggcacctcaaaggggtctgtgagcccctagtgtaaaactgggttctttcatatttggggcccttgtttatgctgggattggaattccacggtggaagcctagctgtagaagctatttgggacaggtagatgtggttgtcaccctcatctgtatgcagtgacaggcccaggagtcggggtggtggctgggtaactcagctcattccaggggtgcagaaatacttctcctgggaactgagctgagagctctgagtgaggccaggttgctccccactcctgaggcccatgcaccccgagggtacaaaatctcatgcctcagcttctctgacttctctcaccagcctttgcgactggtggctgggacggaagaagcagctgaagccccggtgggtgggacattctcttgagagtctcatcttggagtctgaaatccctcccaagcaggagtgggagtttgatggcttcaggctgtgtgcagtgtaggtgtgaggtcatgctggctgctctgggaaggatgggtagagcccggggtgaaggagggctccattcagaatcggaaacttcccagaagcctttgccaactcagctggcatggcccatcccagcaaagccgcccttgtcgtgtagatctgcaacatggatcttgaagatctatgacagacatttgcctgcagaatgagagggacagtggggactggaggctgaccaccccacattgtcccacagaatgcccacttccatagctctgggatgctcccttgcacgacagctagtccatctggatctagctcggaatctgcctactcccatagattttaactccctatcctactctcgttttaagttcttccaaaccctgcctggaagtttaacattaaaaaaaacaaaccaacaactcaggactggggctccaccctggtttagtaaggcagcctgtgcgtgtgcgtaggcgtgtgcccagtgcctttgaagtgctcacacctcacatgatgggccacacaagttgaatcctttcttgcacacacatcatcctttatgtgtccggctgtagacacatgtcccagcatgcctctgcatgaaagtctctttcctgtccgccacccctgcctcggggttccagctgctcctgagacgcaagtagagaacctgggtcccttgtccccttcagcccaacaccctagtaattggtcacttcctccagctgacccttgaagcgagtttgagcatctgccccgggcagggcctttccgaggtagctgctcaggggctggtggcctgcactgcctgttgctcacgggccctctgctgtgctgggtggggtgaatggaacaggattaggtaagggagctaggtgtctcctttatccccttcccttgcttttctgctaagaaggacccactggggcattccaacaaccttctcccagggcggctacaaccccagataggataagcaaggacccatcccccgcagcacaaccatagctggctgccaacactaaaccaaagaccttctgtgagattttacccgttcccttcacgtcattaataaccattgcacgttcccccatgtcttgcttcagcatccgcccttactcagtatggggagctgtgggcagtctggtcccagtgagcctactcagaactgtttctagctcaggctgcttcaccctggcctgaggaggtagtccacagcccactctgctcctgcaggaagaggggagtagtgtttgtcaggtaggtggtgctagctgtagcctccagctatggcacagagttcaccttagatatccagtccatagctgttccagaaggtagaccagttgtccaggctctgtggactgtgctagggtggtgtcttgatccttgaccttcctgtgctaaagacagactggcctgtgctcgctcttcttgaccttagagctatgcaggtggaattcctgtgcatcttgggaagtgggccctgggggaagtgtcatttgtcaccagacgcctggtagcctgtcagtgggttcagaaggagcagtcatcatgtttagatagttgcagggtgttgggacatgagaaatgcctgagcactccggcacctggtctgcagggctctatagtgtagaccaggggccttggctttatgggcaagggcaggtgaaggaaggccctgggaatctcaggttagggaaaggcattaagtaccaaccacttgtgcaattacaggacagaaaagattccatagctgtgtgtgagagatagatggacagacagactcccacagtgtttacagagtacagcctttggcgcaaatgctacacacttctatcctggaaaacacaagcacactgttcttgcttctgggggctgtgggatttactctggtttccatcgccatccttggctctgcaccccgactgtggacaggtgcatgagcatcttggagctgacccgccaggcctccacaggcagagtattccggaagcaggatacgtctgagtgggactgggggcctcttctaaagggtggaggtgaccttgggggctcacaggtcctaaagcagcttgtgagtcatcgctgcccttcaggccctggctccagaggctgctctcccactgcaaaaccaaagggacttgaacacgtgcatttctctctcctccctggcttcttctttgcctccttgaccatgcagaaaacagcagcagtgaccagaggcaggcctgcaagaaacatgagctgtacgtcagcttccgagaccttggctggcaggtaaggacagctgaatctccatacaccgggccttgctctgtccctgctgaccacagggctgcccctgttggaacagtgtgtcacaggtcctgtcttttgtttccctagagacatggtcccatatgtcccaggctggcatcaaactcactgtgtactttgactcctcctgcctctatctcccgagttctgggatttcaggagtgtgctgccatgcctcctttgtgctctggaatggaacccagagtttcctgcatgttaggcaagcactctaacaactcagtcccagcccacagtccttgtctttgcttgtgagatgtcagaagccaggagccccaaccacagaggaagacttgggctgaacgtatgaggacatccatgatgtgccgtgtcacccacagtgtgatctactcatggccagaacttgaagcaccactatagcatgcagtttctttctttctttctttcttcctttcttcctttcttcctttcttcctttctttctttctttctttctttctttctttctttctttctttctttctttctttctttctttctttctttctttctttctttcttcttcttcttcttcttcttcttcttcttcttcttcttcttcttcttcttccttcttcctcctcttcctcctcttcctcctcctcttcctcctcttcttcctcctcttcctcctcctcctcctccttcttctctgtagctgtcttcagacacaccagaagagggcatcagatctcattacggatggttgtgagccaccatgtggttgctgggatttgaactcagcacctaaagaagagcagtcagtgctcttacctgctgagccatctctccagccctggttgagcacttctaaccctcctgcagctaacatgcccttaccttcacctctagctcaacacctctaaatgtgtcctcagcttagctgctcagttaccttctgtgaagcccattggtcaggtttcccaagacgctccctggctgctttcctttcccggcctacatttcagaagatctcccctgttctcctcctctctcctagcctgcagggacctggaagtcctgcctcttttttttccacccaaccattggccactggcatctttattgatagatcaaaaaccaactgggggcgaggaccttcagcgtcactaaccaaattcctgatcaaagcatcagaccccacccccacgccccgcactacaccgcccttctgaagtctgaacctcgtgcataccctagtccagtccgatggctggctgcctctctcacataaggccgtgtgttcaaatccagccttggagagtcagctttctctgtctgccctttgtcctggtctgtgatttaagatcaggcgtgtgttcctgagtcaagcaggttgcgtggtgggagtgagctctgcacataacaagtgtttcctgtgtgctgcgtccaacccttgtcagcaagagctctctgcttacaatccctagaatgtcctacctttgtggaacagcttgacacacatttccagcactcaggggttgccctgtctggattacctgagccacagtgggtcacaagcctcttgcaccaggcggggggtgggggtggggggcttggtttagatttgcagacacgttcagtccagtcttgacagtggtacaaaacgttgccacctacagagttcactctgaaaccgtacatacaaagaagatgcaaaacaaaaccaagagaaagacttaaaatgttttaacacagtttatggtgttgggttgagttgcggttgtagccatccttacccagaatgcaagcaaggtcgaggctgtaacctgaacaggcctgggagcaagctgaggcatgccacccggagcaaggacagggtggttccaggtgtagtctctgacccatgtctcactccctactgctatgccacctctcatccatgagacacaacacaagactgtcccttccagactctgagtcctttttcttttccttctgctgggggtcacaaaataccatgctcacttccctgcccctgcagggactcccacaggtcaggagagcatagcctgagcctatgtccactgggcatgaggagggagtccacacaggagtgggacacacagaggtaccacacacaagggtgggaccctacctagttgggccctctgcatagtctccctgaggtgtggcctcactcccctctcttggcaggactggatcattgcacctgaaggctatgctgcctactactgtgagggagagtgcgccttccctctgaactcctacatgaacgccaccaaccacgccatcgtccagacactggtgggtgcctcctggggggtgtggccagtggggctgtgagtgcctcctgggaggtgtggccagtggggctgtgagtgcctcttggggggatgtggccagtggggctgtgagtgcctcttgggggggtgtggccagtggggctgtgagtgcctcttggggggatgtggccagtggggctgtgagtgcctcttgggggggtgtggtcagtgggggtatgagtggcttctcctgctgttgacccagaacctgagtagctgtctgtccaagtgtgtgatgactcttgtgggtacctgctctatataaggctgagacaagttttaggcatgtaatggtataaagatgaatatgtataatcttggaccctaaaattcttttatttctgtatttgtcctcatttaaaaaagttaatcagtttcatgggctcttgtggtattgtgaccatgagtcactgtgcctcactgaagactgggtccactcctggtggggacagtcactgtgcctcaccctgggtccctcctcttgggtgtcagcctgccaccccgtgttccgataagacttgcctgctggctcctggccctccctcctgcgagaggcagatggagtttgttagacccacaggcctagctccgagcttccagttttctcttccagctttgaacttgaaccttcaggtcactaattcagaagctttattctgttgtctgctgtgcaccaggaactggggacactgcagggaacagcccagtattcttgaccttaggggagttaaatggaccaagcagatgagagaatttcagagtggggagaatgtacaggagggtggggggcagcagctgactcagtcagcctctgggactcactggaaagagccatgtggtgagagcggtgctctaagtaccacgctggtgcacacagtgaggccccccaatccctaagcacaaggctggcgcacacagctccccaccccacactggcgcacacagcctctgactgatgctccaccaggctctaggtgaccttgttctcagcagtggttgttgtctgggcttctctggacaactgatcccccaagctggttggaataccgtgcagttctctttgttatttaaatttctgttgctcctactccttacgtgtaagtctgcggtggaaagctcttccgaggcctccaccctgaggtcagtccaagctttgccctttggcagggaaagggttctgcgacccagctccctccttctctctctctctttctcacccttttcctcctgcccctgttttcatggttaaaatgatggaccacatagccacacacatggttgccaaactctctaccacagagctgtatccttagcccttaggtttcactgaaccatccagtctggccttgatctcactgtgaccttgtgatccttcagcgtcagactcttgagtagctggaattacaggcctccatcccaaggccagcagcaagggatatctttaagaactggctttctgacatcccagctagccaacacacctggggctgacgtattcaaagaggagcaagtgggggaggggagggtaagaatctggtactgcccaccagaagggatagaatacttggcttgccacaccctgtttgagttgctcatttataacaaatcgggagctgggggtgtggcttcgctgacagactgcttaccctgggactcagtcccttgtgctgtgtagactgggtggatgtggcggcttaggcctgtcatttcagcccagggctattgggaagtggaggctagatggtgtgaaactcaggatcatctttggctacatagcaagttcaaggtcagccctgagatgtaaaagccctgtctcaaaccaacaacacaagagaggaactcactatctggcctgtcctgagcactgggctctcttgatctggactgggatcagctttggtgaatagctggtgaatagctctctctctctctctctctctctctctctctctccctctttctctgtttctctgtgtctgtgtctctctgtgtgtctctctctgtctctctgtctctctccagttgtttgcttcactccccaccactctctgctgcctactctcaatttaccttgctattcaatggtgctcacccagtaccagcagggcacttcagttttccctcgtctgaactcctactctgcagggcacacaggtgcgcccatgagcaaaagcagacctctagttgttgtgatgctgggatttgaacctaggaccttgtgagtgccaggcaagcaccctaccactcctacaaacccaacccttaaaagtagagagtgtttttgaatgggcaggagtcagggaggatgctccacagcctctttggagtcccagctgtctcctccacatcagacgggtgcatggagaagaccgggccccctcgttccctcatctgtagggtggaggcaagtcctgagccaagcggggtcattagacatgcgcatttgtcctttatggtcatcttagccagagaatagatgttctttagagaaatctagaagcaggcagaaggcctcgccccctctcaccataattcatgtcggtggcttgcaggttcacttcatcaacccagacacagtacccaagccctgctgtgcgcccacccagctcaacgccatctctgtcctctacttcgacgacagctctaatgtcatcctgaagaagtacagaaacatggtggtccgggcctgtggctgccactagctcttcctgagaccctgacctttgcggggccacacctttccaaatcttcgatgtctcaccatctaagtctctcactgcccaccttggcgaggagccaacagaccaacctctcctgagccttcccctcacctccccaaccggaagcatgtaagggttccagaaacctgagcgtgcaggcagctgatgagcgccctttccttctggcacgtgacggacaagatcctaccagctaccacagcaaacgcctaagagcaggaaaaatgtctgccaggaaagtgtccattggccacatggcccctggcgctctgagtctttgaggagtaatcgcaagcctcgttcagctgcagcagaaggaagggcttagccagggtgggcgctggcgtctgtgttgaaggaaaaccaagcagaagccactgtaatgatatgtcacaataaaacccatgaatgaaaatggttaggatacagatatattttcctaaacaatttatccccgtttcttggtttattctgactttgtaaacagaaaagccggggctgtggaggatggagaggcccctcctttccgtctcgtctcgttgtgtgtgtttaccagacctgcccaaatccagcctgtagggaggaggaggaggatgtctgctcagaagaggccagtgagggatgtggcctcaaagggtgttgggatgaagatggagggaggtatgcatgcacacacacacacacacacacacacacacacacatgcatgcatacacacacacacacacacacacacacgcatgcacacacacacacacacacacacacacacacacacgcacgcacgcacgcacacgcacgcatgcatgcacacacacacgcacacacacatctgaagcgcatgtagactttggaatggctctgccagtccctcagccccaattcctgccccatggtaggaaatccatgagaaaagcaaagctaacaagcacagcggaccctacctgaggaagcacaggggatgcaggctcttcaggacactgtcctccaaacaaggcccctctggcacctctgtggccgagctccggagccaggtcctggccttcacagctgcctctcttcactctcaacccctaacagaaggttctgcgacagattggtttctggatctgagggagatggcagaacagggttgtactggcttagaaggttcaaccatgcttcctgcttcagaggtgggatgttggttatggctcaaacaaggcctctctgcctgagtttgcagagccccagctgccccaatggttcctagcttcaaatgcagagggttaaactggctgccagtgtttcctgcatccacacaaagaatgaggttagccaggcaggacctatggccatgtcgcatctggtcaggtggggaaccaattcttcatgtctgtgtccctggaaacactgggctctcttctgttctgttttagtttttcttcttcagtagcttgggctgcagcttctactctgcccattcgatgtgggggaaggccatttctttttgtaatttgttctgtgtgtttgcagatctggggctttttgtgtgactcccctgtggtgcacattttactttagagccctagtctgcctgcagtcggtgtctcttatacgtttaaatgtgtaaatagttgtgacaagacaaagaaattatttatttccatctgaagctctttccaaaggctcctcacagagaacaatgaggccgacttccttcagtctgtttgttttcttatttaagactatttattaacagttggaccgatgtacccatagctgtcgaataaagtggtccttagtgaaaattctgtataaatagagtaagaaggggtttgactttgcaataaaaggagacatttggttctggttgtccgacccatgtgtgtatttgtgtctttccccctgaactcctgaacactggagtctcatcggctgagaaccctcgaccttgatctcgactgttaacgggatgtttatcatccaggcccaggggaagtgggcgctcctcaatatttggtgcagctgtgtggggctccctgggcgggagagacggaaccaaacaacaaatgtgagtttggtaggctggatggcaaagatccttgattgaattacagcccagctgtcagcagctgcttcaaagaggcagggggtaaattagctgtgtttactgctaacatagtcgaaagatttagtcatcccaataaaatagaggcacaagagagaagagggggggtgtataccccaaacttgaaagccatgctggcctcacagctggcgtcattcagtgcccgtcacacccgggcagttgggggctgccctcgcaggccagctgtggaggtgggcagcccaccgcagggctggagaaggagtgccccccacctccccggcaagctcagggcagtgctcatctggctacatcggtctttgaagtgcgcacgaaggtcacctgacggatgtttctagaatcccaggcgatgcttgggacaggctgctctctcttcccctgttgactcagacccagcaacccagccgctcctaacacattccagcccctgcgatttctaaacctttcctgtcactgtcccgacaactcagcttttgttctgttttccaggctgaagcccagagccacaagccggaggtccagatgtggcctctcagatgtgtgccttagcctctcaaccccacccccacccccaaccccagtgatgtttacacatcttaaaaaacactaatctgttgccaatatgtttttgcaaataaggagtttgggcttctcttgagcgggccacctggttcctccctgtgtgctgctcctaactgaacagaggtgccagggccgttgtcacacacacacacacccccgccatggcctcatccacaaacggtcgaggtcagctgacatcttcaaaatggcagacggatgtctacttgtgcccacgacccaaaaggaataggaaaatggaagccattcgtgttgcttcagggcaggaacgtggcttttccgtttgtttccagctggcccatccccacagtaggctctatggccacgtgtggaaccagaccagaggaacttatagcctgtcacctttcccctctcttggctgccaactctgtcaacctctgtttgacattgggcaccagcaggtcctggggctgcttaagaagcagggattgatggctcgacacccaggcacccttccccagccctgtatgctagtctctgaacccaggctgagtttctgccctgtgtgtgagctcagcatgaagtctctctcctgcttccagacagcttaagggtctgcatctccagacatgaccttgaactaggctccccatgacgttgccctgaacaagcagcttatccattgtggtccctcccttcccctccctgaacctggtgaccagtgtggaagccgggaggtgtgtcagtgccatggggtacctctgtaggagcctctcacgggatcattgccgtttcctctgcaagagtctttctggaaggtaagtgtcagagtctcctggggccaacatagcactttctactactttgaaacctggaccctgcctgcacaaagccttctctttaggaacaatgctcaccatatccaaggaaggacttgctggacagatggcagaactcttgaaagcctcatgaaatgctgcttcattgtctataccaggaaccaacacagagactgtcagtcaacagtaaacccaactgtggggtgatgctgagtgcagggttccttccaagacgccagttaggtgtgtggtacctgtccccccaaattctttagaggatcgatcgctcattgcacagctccttggaacacttgggaaggactcagggtggtctgctcctgactgctctacacagaggagacctgctcaggacaggctcagggcaagcccgagagttgcattgtccccagcttccgtagtgggaatggcacaggtatgaatggtcttcctggacagggcccagctattcagacacaaccgtttgcacacagcaccataaaacaatgcttctagtggggttctgctcacgatgtcaatggacagcacctccagggagtgtgtgctgccaaccccggccagcattttcaggctggctgctcccgacccacacttggggtggtgagtgtctgcccctgccaaaggcatgcgtgatgacctctttagacatttcctattggcctgtgggccccattctcctggctcagacccttcagcactctggcgctggcctctcttggttccagatttgaggaaataaaaatagaagaggaaaacacgcgactttccaaggctattccacagctgcttggatggaggcacagtgcacctggccaggaacactgctgcccccaccgcaccgactctgctggtctctgtttcccgggctgctcttcattgcagggcaaggccaagactctgatcaactcagaaagtaagggctgactggaacccataaattatcagctctcctgggccacctcaaatctggtcccagggcacaggcgccaccctccaaaaggccgtggatgttgtgtgacattttgctgcggctggcttggattgctgcctttggacaagatccctatgtttttattttgcctggggccccacagatcctgtgcccaaaggttagagtggggcatctttcacatgtcactcaccaaggacattcttagagtctgtgagttagcttaggtggtgtcttgggcatggcgtgctgtgaagagcaggggatgaggtccttttgcaggtgacaatacagagaaggataagccatcaaggaaaacgtcagacaccagcaagctctcaccagagtgtacctggggtcccagaagatcttctcaagctatgactctcagaagtgggagggggaagagtgggcatgggtcacgtgagaagcagggggtggggcagagtgtaaggcgggcttatcctgagctgggcgcagtcgcttaaacttcctgtgctcaaagtctcctaaaaaggagggtggagggctggagacatgggtctgcagttaagcgcactggctgcccttgacggttcagttcccagcacccacacgactgctcacagtgtttatcactcaagttctgtgggatctaatgccctcctctggccttctcaggtactacatgcacttggtacacaaacatgcatgaaaaatacccaacacataaactagtaattagcctacggaggaggaggggggagggggaggggggaggaggaggaggagaattctgtgtttgttctagcagtttctgacacccttggaattccttggtaggcacaagaacatctgttgtcgttcacagcaaaccttgtcaaccatacccgaggttatggggatttttgagggttttgttttgttttgttttgttgggggggggggttatgggttttgtttttttttgtttgtttgtttttctatttttttggtttgttttcattgttgttagttgttttttattttgtttttatttgtttcggggtagggggttgagacagggtttctctgtgtaggcctagaactcactttgtagaccaggctggacttgaatttacagagctctgcctgcctctgcctcccaagtgctgggattaaaggtgtgtaccaccatggttgggcttttatggtgtttcttaatgttgactgaaagacccttggggtcaagagagctgaactttcagctccaaggactgaaggaacagggcttgctggcccaggtggccactggtgaccagtgatgttatccgagttgtgtcactgagtggaagctcacactcagcactgctgactggatgggtttgaatgactagatgtcgtctgggagtcagcagatgtgggtgctgcaccaaccagtcgggtgaccttggagaaagcctccatgctggtcttccaggccatgcaatgtttgacaactcagtgggagtttgttctacgactctggtggtcccgggctgagtttcacggatgtgcacaccatgggctctgagggagcggagaccttcattccacacaagctgtttcctgtactgtttttctcgtaggaagtgactagggaggctaagaaggacacattagccgcctgcttgcccaaactcacgtcattgtttaatgccataggcaagccacgaataacagactaaatactctccgaggatgattacgtgagcgcggtggaggctgtgggagggtggtggaggatggcggggcatggagcctggccgccatgagctcagaggtctgcaccttcccacctgacgtttgatggtgagcgttcagcttaactaacagttaaggctgcgtaaaaaaatggtttcagccactgaaggaagcagagaattacacatgtgagccctgacccttcctaacagaagccagagacggccagaggtctgtctgagcaggctttaacacgtctcctcaacacagagttgcgtggtaggagccttctgcctccgccctgtacggttaccctggctgcagcgtgcggaggagttgttcacccaggagtgctgtgaggggcggaggctttctgagcacattcttttccccgcccccgctgcttcttgggaggggctgttttcagcttgagaattctttccagtcgttcggaggtgcgtgctcccatgcccccaccccctccgtgtacaagtgctggtctttgtttgacctgtttagggtgtcggtgacagaaagaatgacaggtggccccgggcctccattccaacatgtcctttgagtggtccctaaaataataccattagcgggtcgcattaaggctgcttatctctggcggagcctgctgataatgccgagcgagcaggtcctcctggaatgctggggcccggatagagaagtgcctgagagcccctgatgaacgggcaggccttggcatccgttgtcccgatgacgatgacattccatcgggtttgacacctgctcccgcagcactaagttggcagagtcagagtgggcgcacctggtatgtgacagacactttgaaccattttgcagtctgcctgcatggctggggctgtgaggtcgagggacatccaggggctgcctcatggtgcagtcgtggtccagctgtgctggtcaggggtgctttgcttcagcatcgccatcgcgcccacccgcagcgtctcctggccgtggctggcgttcattcggtttttcccagccgtgattaggaaataaggaagggcgtacgggaagaggagaggcaccgcccagaaagcggctcttcttgctggacactgtgaacatttgccagacttacccgtgggtgtctctcccatgtcaacaaagcttatccttcgtctctgtaacctattcccctgacgcactgtatcacagagtccccacgtcatagagcaggctagcttcaaacataacagcctcctgcctcagcctcccaggcactgcgatcgacttctgagtgaacacgtataagcctccaatatttccatcccctgtttcggttctgatgcgtgaaaattatttttgaacctcataaaagagatgggatgacacaataagttaatatgtacagtactcagaggtgagcctggttcagagagagcgccatgtgaagttgacagcaccttcatcagcaccaaaatcacttttaccaccatcatcaccatcaccaacaccctttctgtcatcatcatcaccaccatctgcatctccctcacccggcactctccacacgtgtaccacaattcaatggatttggggcaagggagtgagtacacagtgggttaaccgtactatcccagtgactagagagaggcaggaaagccaggcatccttccagcttcttggagccctggaggaacacaaacaacccctctctcctgagcacatgtgtccatcactgccaccactgaaggggcacaggctgaggagtgagtgaggggtctttggtcacgcggccagcatgaggcggctgggtgagggccgggcttcttgcttgcggacactgggctggcagggctccctctgagtccgtgttcacacctgtgagacgggagggggaggctgatgtcataagcttgctgctgtggtttacataggagcacactgactgagcccagcaagcaggagcctgcctgccgctccgctggggtggtggccatgtggacggctgtgtggttcctatttcctgcctacgcagacactgaccgtatgtctcttctctccattgctcctcctcatgaagatgactctgcctggctctcctcgagcccctgttacagtcccccatgccttctggttacagaatcccccttcttggggtacactgtacttccaatgagaatctgggcacaagtgtgactcagcctctctgaattgttcccagatcctccagagatctggatctgggtccctccgactgtcctggaccctgtagaatccctttctgacccagactctggcatctttgagctggtttgctggccttggccaacatcaggctcacctgcatccacctggctgagcttcttacacgtgtatgtacccaggggccattcacatgtggttatgactctaaagagccctctgctccccctactcctcctgaccacacacacacacacacacacacacacacacacacacacaccgtctgcagacatgtcctctggccacataggcagcttcctgtaaggtccttctggcccactaaagtccacaagtcaaagcttccccacttctgacgcacccgtttctactcttacgatcagcatcaagccctcttcacctcagcttcaaacctgtccagtgagccccactttgggagaccccagtggagcctcttctccagcttcactgcccagtgccctgtgcacatgtgcccaccagacctcttcccggacagccctggccccacttcacccctaatgccagcttgacccagcaagcctccagcttagacacccatggcccggcacctttcacacccagactctgtaaagaaaaagatgctaggattggacgcctgattgcaatcccaggccgcggcagctaagagcaggaaggtcaggggttcaaggtcacccttgctacttagtgagttctggggcagtctgggccacgtgagaccctgtctcaaaccccatttcccaaacaaagcaaaacaagttaacactcaaccaaaccaatggaaaagaagccgaaggggaatatacaaaccaccagtatcaacggccttgggaggatggaatagtgggtccatttattgcctgcagtattaagaccatttccagtgagcactgatctgtttaatgacaaaaaactcaattatatatgtgaaaatacatacattaaataaaaatgctcatcaaatagtagaaatatatacatcttaagcaaggagacactagctgcttcctgcagtctttgagttaggttccgggaatacttaggtcccgtaggtcccgtaagtcctcctccctggtctagccaccagtcacatgccttgggtccagcctccaagcctccaaggccactgcctgcggagctcagccctaaccctgaccttcataggaacactgccaaccctctggtggctgtaatggtttgaaagggaagtgttcccatagtcttggggatttggtaccctgtgtgaagctgtttagatggcgtggcctctctggaggaagtgtgttacgggaggcgggctgtgggagagaaaagctttgactgcttcctgttggtgcctgttgccttgtgctcactgttcaaggtgtgaaggctcaggcaggtgctgcttcctgctgccattctgtctcctccgtgaaggacgctctggaaccgtaaagccagaataaaactcttgtggaagctgtcttgggctcacagaaacacgatgaacacgggcatcctctgagctctcagatctaccccagccttagagtcagcggggatgcggggcttatgtgctgagagggaggatctgttgccttcctttccacagaaaaccaccctgtccccgttaaactttcattttagtgacaaataagtacttgagtctgtcacaagattgaaaatacagagtagctctgtggaggttcccaccactggcccctactctcaaggggacacaagtttgttgttctgtcttgacaggtcacactgggaaatgaccaggccatgaagtctgggccccaaggcttccaaagagtcggtctgtgtttgttccttatctctgctgacatgtgtctctgtttagatgacactgaccacacacacagtgtgtctttattttctactgtcaatgatccccactcctctgctctgaatgtccatgcctctccaaattcccaaactaaatccgaaccctagcctgacatgtctggtttctgttgctacgggaaatcaccgacc

SEQ ID NO: 167 - DNA, 1843 bp, Mus musculus
ctgcagcaagtgacctcgggtcgtggaccgctgccctgccccctccgctgccacctggggcggcgcgggcccggtgccccggatcgcgcgtagagccggcgcgatgcacgtgcgctcgctgcgcgctgcggcgccacacagcttcgtggcgctctgggcgcctctgttcttgctgcgctccgccctggccgatttcagcctggacaacgaggtgcactccagcttcatccaccggcgcctccgcagccaggagcggcgggagatgcagcgggagatcctgtccatcttagggttgccccatcgcccgcgcccgcacctccagggaaagcataattcggcgcccatgttcatgttggacctgtacaacgccatggcggtggaggagagcgggccggacggacagggcttctcctacccctacaaggccgtcttcagtacccagggcccccctttagccagcctgcaggacagccacttcctcactgacgccgacatggtcatgagcttcgtcaacctagtggaacatgacaaagaattcttccaccctcgataccaccatcgggagttccggtttgatctttccaagatccccgagggcgaagcggtgaccgcagccgaattcaggatctataaggactacatccgggagcgatttgacaacgagaccttccagatcacagtctatcaggtgctccaggagcactcaggcagggagtcggacctcttcttgctggacagccgcaccatctgggcttctgaggagggctggttggtgtttgatatcacagccaccagcaaccactgggtggtcaaccctcggcacaacctgggcttacagctctctgtggagaccctggatgggcagagcatcaaccccaagttggcaggcctgattggacggcatggaccccagaacaagcaacccttcatggtggccttcttcaaggccacggaagtccatctccgtagtatccggtccacggggggcaagcagcgcagccagaatcgctccaagacgccaaagaaccaagaggccctgaggatggccagtgtggcagaaaacagcagcagtgaccagaggcaggcctgcaagaaacatgagctgtacgtcagcttccgagaccttggctggcaggactggatcattgcacctgaaggctatgctgcctactactgtgagggagagtgcgccttccctctgaactcctacatgaacgccaccaaccacgccatcgtccagacactggttcacttcatcaacccagacacagtacccaagccctgctgtgcgcccacccagctcaacgccatctctgtcctctacttcgacgacagctctaatgtcatcctgaagaagtacagaaacatggtggtccgggcctgtggctgccactagctcttcctgagaccctgacctttgcggggccacacctttccaaatcttcgatgtctcaccatctaagtctctcactgcccaccttggcgaggagccaacagaccaacctctcctgagccttcccctcacctccccaaccggaagcatgtaagggttccagaaacctgagcgtgcaggcagctgatgagcgccctttccttctggcacgtgacggacaagatcctaccagctaccacagcaaacgcctaagagcaggaaaaatgtctgccaggaaagtgtccattggccacatggcccctggcgctctgagtctttgaggagtaatcgcaagcctcgttcagctgcagcagaaggaagggcttagccagggtgggcgctggcgtctgtgttgaaggaaaaccaagcagaagccactgtaatgatatgtcacaataaaacccatgaatg

SEQ ID NO: 168 - protein, 456 aa, Mus musculus
PRVVDRCPAPSAATWGGAGPVPRIARRAGAMHVRSLRAAAPHSFVWAPLFLLRSADFSLDNEVHSSFIHRRLRSQERREMQREILSILGLPHRPRPHLQGKHNSAPMFMLDLYNAMAVEESGPDGQGFSYPYKAVFSTQGPPLASLQDSHFLTDADMVMSFVNLVEHDKEFFHPRYHHREFRFDLSKIPEGEAVTAAEFRIYKDYIRERFDNETFQITVYQVLQEHSGRESDLFLLDSRTIWASEEGWLVFDITATSNHWVVNPRHNLGLQLSVETLDGQSINPKLAGLIGRHGPQNKQPFMVAFFKATEVHLRSIRSTGGKQRSQNRSKTPKNQEALRMASVAENSSSDQRQACKKHELYVSFRDLGWQDWIIAPEGYAAYYCEGECAFPLNSYMNATNHAIVQTLVHFINPDTVPKPCCAPTQLNAISVLYFDDSSNVILKKYRNMVVRACGCH

SEQ ID NO: 169 - DNA, 117750 bp, Homo sapiens
ctggccaggtagcactataattatacctactttacaggtgaggaaatgggctcagagactgctatcaggctggctgaattaaaacatggttccattgctttctggcagtagaactgattaatctgagcctcaatttcctcatctgtaaaatgggcacaaaaatatctatttcaaaagagttgtgaggatgaaaggaggtgatgcagataactggaccagacgtctagactattagccgtcgttggtactgatgtctgttggtgtgctgtccttccctccgacttggaagtgcttgatgccactgtctgcagtgatgccaggggtaggaggagcttgcatatgctctgaacactggaaaaaattgttttttagggtttgtattccgaggctcagttgtctggggcacgagtgcttgaaggagaagagaagagaaaagcacactggaatgcttgcatacgtgctccggcaagtttgcatctgactctcaaggctgtttcgtcacctgatctcccagtgactctgagatgtgtgatgagtccagctcaaggagtggggagctcaggggcatgcccactgccactcagcaggtgagtgacaatctcaagtcaggcagtattccagacagaaaccaagatgtgctcacagagagttcattcactcattcagcaaagattcattgagtatcaactacatacggcacaccgctctgggctctattcacggtagtgaacaaatcagaccaaaacacatgcccacatttccatggcaggagagagacaatgaacaaataaacatgtaactattgtatttcaggtggtggtgttaagaggaaaagaaacatgggttgcttctgatagacgggcaagggaaagctttaatggtgaaatatttgagcagagacccagaggaggtgaaggaggtgaatatcagtatgagccttccaggcaaatggcacagcaagtgcaaaggccctgaggctttttgcagaaccaaggacacagctgatgcttcttgctttatgcgtaaaagccccttagtgtagaattgccaaacagaatacaccgtgaaaggttaagtttgcattttagataaacaaaggctcattgttagtgtaagtatgtcccttgcaatttgggacatatttattctaaaaaaattagtcattgtttatctaaaattcagatttaactggatagcctatattttttatttgccaaatctggcaactcaactcagtggtttgttatcatgtgagctctggaaataaaaatctcaggctggctttacaggggcaactggctgggtgaaataggggatcagaattgggtcatccaggcttgaatgctggctttgtcgtttgttagtcatgcttcttggccaagtcctttgacccctgggcctccagatcttcatctgtgaaatgggagatactgcatccaatttcagggcgattagaagacgagagctaatcagcaaagcttggacatcagatagctgtgtcattcatgctaactcttattagttgttgcatcatatgtaagatgagctcaaatctgttaatcttcccatacgatcttttcacatgagttgggactaacctgttatatttagagtaatggtttaccaatggggagggaataaagataaaactcgaagtaaaagaaagaatacaattttttaaatgaggagaaacacagtgaaggagaggagagaaggaagaaaacaacagagatggagagaagcacgacgtggggtggtgaggagttcccaggactctgggagcgaggagcccagtctaatccctgattcactgtaagactttgggcccagcagtttctctttgggtgtcaatttctctatcttcaagatgaaggaattgaaccacgcttctgcaggacttttgttgtaactgactggaaactccgtacacaatggcttaaactgaacagtcctgggtggggctggcttcagggatagtgggctccaggggctcactgatgctgtcagtctcctgccttttcttgttttactgtcttgtggcttctctcacagggcaggctctccctgaagggagggaagatgacagccagcagcagcccctgacctagcaaccccagtgggaggagagacccctttaccggtagttctagcaaaagttctaaaagttgaatctcactggcctggattaggtcacatgactgtcactgaacccatcgcatgggcatctctggttgaccaggctgggtcatgtgcccagtctgaattttagagaagaggatagttcaacctgaaatacagggactgatggtgaagaaggggcatttctactgaggaaaacagaggaaatcttggccaggcacagtggcttatgcctgtaatcccagcactttgagaggccaagatggatggattgtttgaggcccggagttcaagaccagtctggccagcgtggtgtaaccctgtcttctactaaaaatacaaaaattagccaggcatggtggtgcacacctgtaattccagctactcggggggctgaggagggagaattgcttgaaaccgggaggcagaggttacagtgagctgagattgtgccattgcactccagcctgggtgacagagggagactctgtctaaaaaaaaaaagaaaagaaaagaaaacagaggaaatatttgcagaagaaggagaaaaggcaggggtctcaaattaggtgagcttccaaagtgttttctgtggaaccctgggagcagagaaaatggtagtgaaaagaaacaggcctggggactctgggcccctgctgggatcacctgataacaggcagggtgtccagtccgatttgaacttcagataaacaacgagtaaatttcagtatgagtatatataatacatatactccaatataatgggatatagtcatactaaaattcattcattgtttatctgaaattcaaattgaactggacacctatttttttttttgctaaatgtggtaaccctagtccctcccctgctctatgtaaccaaagaagctctgtttctgttttctgtgtcgagcatgtgtgaaaaactccttgaccaaaagttttagcgctgcacaaaagagaaggcctgtatccttttaactgacatgattgccatgccctctccagctccccagtgctgtatccagcagggcttctggctgcaggcaacagaaaccagcttgggcaggctggtgcggaaaaggagaccactagaggatcttgggggctcacagaacccctgggaaggccagagaaccaggcttgggggctctctagttgggacacggccccagatcactctgcagaatagtctgggcctgcactgatagcttctggggtgggtgcctctgactggctgaaacttggtcacctgtcagggctctggctgcaaagcaggctagacagtgcctctctggatattcaccagatggggcatcctcaaccataagagagggctcagatctagctgggaggagggagatgctgaaaagcaggagcaatgaacactcactcctgctcttgcagatggaattctggtttttgatgtttctggggagagggggagtttatcagatcagtcaccagggccaaacagcagagttttgctgggaagggactctggggaaggttagggtcagattttgcctaaaggggcagacagttccagccttttcaaccactggctcagtagccctcgaatcatgaattcaatggagctgtcttgaaatgcaccatccttggtggtcctttggtttgggtgatgggttgggggaggctgggcacatcctccagacacagcagagccctttatgaggccaggggcaaaccagattcatcgaatctgactggtagatgtgtcttctttggtctaataaccaaaacgagttgaattagttgccaacagataaacattgagagatgtcacattcaaactcaagtttctagcttctttggaaaatcagaactttctggtgatgttggaatcaaatttctggatggcatcacccatgggcatgtggtttccagttcaccccagtctgcaccctccttatttatccaggccagtgtctcctgccacctgtcaccatgtctgtgctcatgattgccttccattaaattaagaggaagagaaatattccttgagcttcatgttgcatctctgtatttatgttacctggttggtgcccgttggcttttgagtgtatgacttctgcaataaaggaggaattgaagaagggctcagaggtatgttcctcaaacactgatagggcatctactgtgtgcaaggcctccatgggtactgggaggtccctacaggactaagacaaaccctgtgttttggtgtacctcaatgtttaaggacttaagtcctggaacaagatagccggcgtcagaattctgattttaccattcactcaccattggtgtggctttgggcaggttccctcaagtatttgagcctcaatttcctcatctgtaaaatggggataataataataaaaatcatacaaggtagttgggagaattaatgagttaattttaaaagacacctggaatcatagatattgaagttttaatttgaagccccaatttgtcagctataacttcagaaatctagagcctcgatcgtcaacatacagcctgaagacgacagcctccgagcccccaggagctagttagaagtgcagaatctcagctcactcagactgactgtgggaatctatgttctaacagacccccaggggattcacacgcacagttgggttggagaagtgttgctttaggttaaagcaaggaaggaaggggctgctcccaggtcactgaacgtgcactgatgcttaaaggcctgggctgtgtagacagatgtggctttggatcctggctccattacagattagattggctgtctgactctggacaaggtgctctcgggatgttggtcctcctctgcaatctgaggagcagaactagcctctccatgcagtggggagttgcgggtgatgtgggcttgggccgtgcaggcctagcaggtgcccagcagaagcaagtgctcccaacaggtgacaggtcggccgctcccctgtcacgttttggaaggaggaaagggctacctctagtgctgaaccgaggatagttagtgctcaaaaccataccagatttcctccaatcaaggaagaaataacagccctgataataataaacaaaaccactgcttccccctagctggcttccagatcctagaaatcctgcatggtatcagctttctctagagtgtgtgtgtcgtctgtattttccatttggaactgtggccactgccatgtgtacttaagactgatggaagacgtttaatctcttattctgctgcttttaaagttgtgcaaagaaaatctcagagtgggcaagcgtgaggagtccaagcctcccgtgcaatgagagatctgcgtgggaaacaaaatttcaccacaggtgtgctctaataatttcctctgcagggtccacctctgcacacaacgattttcaagcctgtgcaggaggcagctcttggccctctattccttgttggggttggaggtccaggtcatctggcctttgccaggtggtgtggacagagagagagcagcccactggcttccttggctgtgctccccagggagcttccaggccagctgagcctcctctagggcagatggatgaagatgaggtccccacctcgctgaacaatgtgtgtgtcagcagaattcttttcttctttttactgccttagagagacatgctgacttggtcaaaatcacttcagcaagatgtgactgatgatgtaggaaatgaaaactcctggcccagcactgggaggccagcaggcgaggggcgcggacactgggaccgggccacccgacacaataacaccccttacaattccaggccgtctttcatccaggcaaaggcggccccaggtgtggagcagactggggcagatcagattacggtcctggagcccagtgctgggtgccctggccaggggaaccacaactgggggtgtgtgggttgggggctagctgctggggaaatgagataggacccagggaagtccctgggccccagctggcctgcagggggcctaggcacaatgtgaggattggaatgcagtgatgaccttttcatctctcatgttcccttccacttcactctctcttttgctctggtacttttgctcttgctctcagagtcaggatacatctgcttttctctgcttggccaaaaagcagaccatcatgaaaagttttgttgttattttgtaactcaggaggctttcctgttaccatattttccttttcatccagatggtaacacaataacatttatcaagggttttctctgtgttccaggcactgtgcaaagccctttccatgaattaagttctgcaacctcacagcgatcccagaagacaggcgctatcagtcaccccattttacagatgggggaactgaggtgtagagaggttaagtcccttgcccatggtgcacagctggaagagacagagctggagtgtgaatgcggctgggcaggctccagtgcccaggctacctcctccacacaagacttgccctcggcaatctcaaagccttttctggtggtgggctcagctcccaaactggcatcggatgcactcccagccagatatttcttgcttgccggttttcattcattcattcattcattcattcattcattcattcggcattcactgagggcctggtgcagtcttggggatgcctctcggggaggaaacagggaaaagaaagacccccccaccaagcatggatcacagaaaagataaggctaaatgggggtttgtgggacttcagaggaaaccttatctcttgaggtcttggatatgaagagcatgttgtctcttcctcttgcatgagaaaagatggcgtctcagaggaagggttgctggggtgagggatctgggagatgccttagcttggcgcctgcacagtcagccctcagtcaaccggtctctttaggttttggctgtgcttattactattcattcaacaggtactaattgagcacctgctgtgtgccaggctcagaataggctcaggtgagatgcacaaagaagggtaaactagaatccttgcttagacactgacggatcagttgtttcatatgtaaattgtagcaccaagacctgctgcccctgcccccagcctcacctgcttgtgaagatccctccaaaagatttgagagtagataaaaagcagagactactactgaagaacagggctgctttggctccttattatttcagactttggaagaaaatgacctcctttttctctactggcactggaggtggcatagcctgtccctagcaagccagcgctggagggcgtgtgcagggctggggaccgagcctggtttctgttccctgctctgcagggctcaagcacttgctgttcctccacctgggatgcctttccctggaaaagcctgtctctttcttgtctttcaggactcaggtcagtggcatctcctccaaaaactccccttcccaccctccatcacctcaccctgtttatctgcgcccccgcccccactgcctgtcacttattgcaggctgaagtgacccaggctctccagttgtacactctcagatggaccctggacgactgtggcactcctgcaatttccccagtctccctggggtaggattcctgcttgccaggatgcccacctttccttctccctcctgcatgtcctcctctgcctggcttctgaattgtttccagagagagtgatagacaagatctgcctctccttcagtccctgaatcttatttaaggctcttgctttgcttccctggcctggaggccggctccttgatggagtctgccatgtgggttcgctcatggccatgtcttcctgcccagcatggtgcttggccctgggactggccacataatatctgggccaggtgcaaaattagtacggggcagggggtactttgttcataggtgattcagaaccacatatggtgacctcagagtaggaaaccaagtgtggggcccttaagagctggggggccctgtacgactgtccaggttgcaggccccacagctcgcctcctgatatcctgtgctccatgcttgtctgttgaaggaaggagtgaatggatgaagagcaggtggtgggggtggtttgagggccttgcctggtgggtgggtagaggcccctccctggcatggggctcaagacctgttccatcccacagcctggggcctgtgtgtaaatggccaggacctgcaggctggcatttttctgctccttgcctggcctctggcctcccctttctccacccatgtggcccctcaggctgccatctagtccaaaagtccccaagggagacccagagggccacttggccaaactacttctgctccagaaaactgtagaagaccataattctcttccccagctctcctgctccaggaaggacagccccaaagtgaggcttagccagagcccctcccagacaagcgcccccgcttccccaacctcagcccttcccagttcatcccaaaggccctctggggacccactctctcacccagccccaggaggggaaggagacaggatgaacttttaccccgctgccctcactgccactctgggtgcagtaattcccttgagatcccacaccggcagagggaccggtgggttctgagtggtctggggactccctgtgacagcgtgcatggctcggtattgattgagggatgaatggatgaggagagacaggagaggaggccgatggggaggtctcaggcacagacccttggaggggaagaggatgtgaagaccagcggctggctccccaggcactgccacgaggagggctgatgggaagccctagtggtggggctggggtgtctggtctcaggctgaggggtggctggaaagatacagggccccgaagaggaggaggtgggaagaacccccccagctcacacgcagttcacttattcactcaacaaatcgtgactgcgcagctacagtggctaccaggcgctgggttcaaggcactgcgggtaccagaggtgcggagaagatcgctgatccgggccccagtgctctgggtgtctagcgggggtaagaaggcaataaagaaggcacggagtaactcaaacagcaattccagacagcaagagaaactacaggaaagaaaacaaacgtgcgaggggcgaggcgaggaaacaacctcagcttggcaggtcttggaggtctctgggaggagaaagcagcgtctgatgggggcgggaggtggtgagtggggagaggtccaggcggagggaatggcgagcgcagagacaggctggcaacggcttcagggaggcgcggaggggtcagcgtggctggcttaaaaggatacagggactgaggggcaagaccggctcaagggtcaccgcttccaggaagccttctatttccgcgccacctccgcgctcccccaacttttcccaccgcggtccgcagcccacccgtcctgctcgggccgccttcctggtccggaccgcgagtgccgagagggcagggccggctccgattcctccagccgcatccccgcgacgtcccgccaggctctaggcaccccgtgggcactcagtaaacatttgtcgagcgctctagagggaatgaatgaacccactgggcacagctggggggagggcggggccgagggcaggtgggaggccgccggcgcgggaggggcccctcgaagcccgtcctcctcctcctcctcctccgcccaggccccagcgcgtaccactctggcgctcccgaggcggcctcttgtgcgatccagggcgcacaaggctgggagagcgccccggggcccctgctatccgcgccggaggttggaagagggtgggttgccgccgcccgagggcgagagcgccagaggagcgggaagaaggagcgctcgcccgcccgcctgcctcctcgctgcctccccggcgttggctctctggactcctaggcttgctggctgctcctcccacccgcgcccgcctcctcactcgccttttcgttcgccggggctgctttccaagccctgcggtgcgcccgggcgagtgcggggcgaggggcccggggccagcaccgagcagggggcgggggtccgggcagagcgcggccggccggggaggggccatgtctggcgcgggcgcagcggggcccgtctgcagcaagtgaccgagcggcgcggacggccgcctgccccctctgccacctggggcggtgcgggcccggagcccggagcccgggtagcgcgtagagccggcgcgatgcacgtgcgctcactgcgagctgcggcgccgcacagcttcgtggcgctctgggcacccctgttcctgctgcgctccgccctggccgacttcagcctggacaacgaggtgcactcgagcttcatccaccggcgcctccgcagccaggagcggcgggagatgcagcgcgagatcctctccattttgggcttgccccaccgcccgcgcccgcacctccagggcaagcacaactcggcacccatgttcatgctggacctgtacaacgccatggcggtggaggagggcggcgggcccggcggccagggcttctcctacccctacaaggccgtcttcagtacccagggcccccctctggccagcctgcaagatagccatttcctcaccgacgccgacatggtcatgagcttcgtcaacctcggtgagtaagggcaggcgagggtacgcgtctcctttcgggggcactttgagactgggagggagggagccgcttcttctatgcagcccgcccagctttccgctcctggctgaaatcgcagtgcctgcccgagggtctcccacccacagccctatgactcccaagctgtgtgcgcccccaggtcgggcgcgctgggttcggtgagcctgtaggggttactgggaaggagggatcctccgaagtcccctccatgttacgccgccggccgcatctctggggctggaggcaagggccgttcaaagcgcggggctcggtcatgtgagctgtcccgggccggcgcggctcgcgctacctggatgtaaagggcccttcccggcgaggctgccttgccgcccttcctgggcccctctcagccctgcctggctctggcatcgcggccgtcgcacccccttaccctccctgtcaagccctacctgtcccctcgtggtgcgcccgccttagcgtaccgcgcgctccgagcgccttggggcccctctccgggccgccggatgccccattctctcttggctggagctggggaagaaacggtgccattgctaattttctttgttttctttctttgtttatttttttcttttttctttttttttcttttcttttctttttttttttttttgagacggagtttcactcttgtcgcccagtctggagtgcaatggcgcgatctctgctcaccgcaacctctgcctcccgggttcaagcgattctcgtgcctcagcctcccgagtagctgggattacaggcatgcgccaccatgcctggctaattttgtatttttagtagagacagggtttctccatgttaggcaggctggtctcgaactcccgatctcaggtgatcctcccgcctcagcctcccaaagtggtgctgggattacaggcgtgagccactgtgccctgccgctagtcttctattttaagtatttagtggtaggtcccgggccggcagaatctattttcagcatttaccacgtgtggcgcgcaaaccacaggttttggcgattgggttgcgcgggatctcagagctgacgccgcgggggcggctgggggtcccggtttccgactggagccgcgacgaccccggcgacgcgagcctggggctgcagcgagggccggggagctccccctccatatgtgcgcgcacattctccagacttgctcaaactaaccccccggcagcgccagcgcgctgcgggactgatgatcaaatatttggtttccgagataacacaccccgatagcgctgtttcctgagccgctttcattctacttgtgtaacttgctgcgaaaacccgaaccaagtcaagacagcaaactcacgcccacgggcgctgtgtcaacatggaaataatgatactgaagccccacgctgggcacctggggcgtggactgggggcgcgggggaagcgcagatccgccttcatgcttccccctcctgataaggtccctggagttcccgggaggccattgtctgtacttaataataactaaatccaactagtgaaccaagcttcagcgagcaaggggtgggaggtttagatgccaaaataccttcaaaaaagtttaaattatactaagcagccagttaagaaggaagcagcaacatatgacctgatttagaaccatctccaagatgtatgaggtggaaagaagcaaggtgcagatgagtgggctgcatgtgtgcttgtatatcatcgtgtcctcctggaggaagacaccaggaactggagagagattttactggaggggtagagaggcgggggcatagctggggcttacggagtgggaggtggggtctgatttttcgtcgtctgcacttctgtatttgtgatttttttaaaacaatgtgtatttattaactataccaaaaactaaaggaaaattccaaatacatacatataaataatgaacgcagagctctgtcgccctcctgaagcctggggttagccagggccctttctctggtgggggatttatagcatcttcccttctgttgggtaccccggactcccactgaatgtgcaggtcccagtggctgccttcagagcctggctggaatcattaaaaaggtatttgtaatctctggcttctgcagaaggccctgcaaaccaagagcaaaaaagcccccagtgcttatgggccggcagtgtgggctaggccccggggctccctgtccccaagagaaagaccaggttgctcggagggtgcctctgggaactttggtgcgggctatttgctccccccatggcggcaggagcaagctgggacttgtttgggaaggccacagctgggtggttttcctcctctggctgtacatacacctttcaatccatttctttcatcttgaaaggacaaagaccggcttgtctgagcctcttaatcagtcaggctggctttgggctttgtgggaccctgactttctcaggtctagctttctgggacatcactccaaattagatggcagagtggcttttaacagagcgcactgaccttgttttctttctctctctgtccctaaactcgaggtcattagttaggtgaagacctgggctgcagtttggcgagacacttcctgtagatgcttctaatgttggcctttaatttctgctaagcagcagcacacaaataaatggcctgtcccttctatcctgttgtagcttggaatttctccataggagggacttgggggtggcagtagggttggagagggttggggggaggtgtaggagacttgtctggccactgagtttgctgagaaagtactgctatagtgtttttccttggattgcaaatcatgttgatctgtagtattcgaagttttctaaaggcaagtttattctcacaatttacataagagtgagaaaatatcacttgcacatatcaaactattacttcttattatggtgggagtttggcggggggggcatgggtgaggatcttggcagcctctgctgccccttcgccctgcactgcagagctctgctgtcttgcaggcaggcggcctgcgtgcgcgggaggggggacccttgcctgaattctgaaggcttttgcagacctggtgcatttattcttccttctgtctgccgccaaactggtttttgttcctataagtcgttcttggaattcaagttttttgccaggctgagcgggatctaaactagaggggaaactagaggggaatttacgacaaaaccaggtggtgggaatgaggactaaaggccgcaccttatgacaaagcccagcctgtaccataaagccccaggcaatgtgaactgagctgcctgagtgagactcccatcttcccagcctgggccccttaagttcaatggcaagatttgtaaactggtttggattaacaaccccgactcctctttgtagacttaattttggaattcaaaacagctaccctctcttaaataatccccaggcaatggcgactccgcacactgcatctagccatagcccgttaccattctttctctgggaagatccagcagctctgttaggaatcttgtaaagtagccggctggcactaggggagtggaagtcatcatgtttatctctggtccaggtaatgaaggcatgaaatttgtgtaatctttgaaggaaaagaagagaaagttggaaacctatcattattggagtcagcctataaaagtggcttttgttaatgtagctgaagagtagggagaaggccgtgcagtttgatttttgctttatgccatctggctgtcctttttgttgacaagtgtttggcattaagacctctcccactgcccgtcaagagcaggccctaccactgtagagtattagaaaaagattctgttacagtttaaaaatttccttcagggagtgcttcgcaaaggggagcgtggactgcaggcatttgcagctgtaacctggcttgtgttaaaatttggaaggggctgctccacattccagcactcggagcgccggccctcactggtgagcagccaaaggttaatatagatgtcacacagctccccccttctttctttctgcagagcgcctttgctataggagtgcaccaacagctgtgtttttcgtaaccctttcaaaatcacttcttttaaacctcattttcctgcttatataaatcaaagattttcctccacttttcccaagcatgtatgtgacccagctttgaacttttttcattttctatgtattttccttctggaatcaaggcagggtaaggctgagccctggatgccaacttgggtggctgtttttggttttggttccagggttgtcattcggttgtggagcggtccccatggaaggggtaacagagatggcccacttgcaaatcagtttcagggcagcaagggggatgattgtctgaatgcacagacagacgaaaccgcttttgagatgcagccctctcaagctacggtttggggctttaccatggcgtagtaggctctcaagcctttgccgagataaacacagctggtgcgcgatcccctcaccaccggaatgcctgcgatgtgagtgaatatcacgtgtccgctgaactcagagacaactggtgacttcattccagggagagtcccatctaagttgattgatcactcctatcactttaatatctctccctcatttggtaaggtcatatttggcccattgcaagaatcagcgtgccctaagtctcccccgtctccacccttccccatctgcccatccgtgtaacagcctgaatattttgaatggggagccctttgcaccatgcttctggccacattaattctttcacgctcactcttcagtcttagcgggggggctgttggcacactggtttcttggcaagccactgcaaggcttcgccttaatgcactctggcactgtcaccggggttagggcacaggcagggatgtgtgggacctgtcatgttattgtcagaaggaatgtgcggattagcctttacagcgtagtggtgggagagcactgcagctgtgtacacttattataaaagatttaagtcccactggtaaaatcaatatattgaattgcacaaccctctgcttttaattagtttaaatcaaatgcgccggtgccattttgccttctctcgccttcatggggtgaggaactaccaatatttacatagaaactgttaatttgtggtgaaaatgataacacatttagctttacacactcaaattgctccaacttgatggatcccagatcaacgtggagttgagctgaggagatgacgtcaccaggagcggggaggagacacccgtgatgtctgttgcttggaccctggattccagatgcaggtggacatgtgtgtagaggcagtgactggggatgctggtccttcaagaagcgagctggttctttctattgcaggtcaaaaacaatgagatttacctacatcatctaaaatcctttctcggaagcattcttacaaaattgcgaagtgggcacttgctcttgggtcattttgagcctgttctcacagcatgcaagggtcatgtactgggcagctcaaggcacggtgctttatttattccagagcttcacatgcttttctttccaatccctgaaacagtttatagaggaagggcgtttgttcactgcaaatgatcccatgtacgaccgcggctattagtgagccgtttggtattagctgtgtgttcaagctgggattgaattccgggttttgcagcaaatggcatctgacaaataataattgacaaaaaatgtgacttggtatttcttaatatggaacagatagttcatttaagcttccccggcaaaaaaaaaattgctcaaactcaaactgaaatagcaatgccagggaatactaggactgctgctgtgtatttttttccgctccaaagtagagtgtttatgatttggggggatattagagtgcatgaagtttgacacttacttatgcgaaactcaggcaagcatgtgcaataccgccttttcaacatttgtgtcggaaggcattgtggggagccgcgcaaagcctgtgctgatccgcgtggagtggattgaattaatgacaactccgagagcaccagctttagggtaattgctttattgttttggagccagggtgcatataatccggttcctgtgcaaacatgttgaacgtgtgttaatgcatttccaaaccagagcctctcacacaaccctgcttttcattaattgatgtcggtagcatggtacagtatttcaaagggctggccaagtataaactgtgtttccaatttccttcctttcctgtgtttggaatgccaatgttaatttgttcccatgcaggagcgggggctgccaaccgcggctttctataaagggcttcacagtgaaggcttccagccctcgctgatgcttggggctgcctggccaagtctcctgacactttgcagctaattctgggtgatatatggggtgggggattgggggcttcactgccgtgtaacggaagttctcggtgacagcagtgggtgtgacttggcaagggagattggaacggcatccacagtgattctctttagacacagcctaaacctatgtgtctgtttccactatgacagcacattagctgtgtgaccttgggcaagttacttaacatctctgcatttgtgtcctcattttataaaggctacaagagaatctcttcctcaacagattctaaagaaatagaaatcatatcacccatgcgcagaggctgtcacctagtaggtgtaaaacaaatggtagctcttgtttttattgtgttggccagatgaagatttacgttggtatattagtccaaatttcagtttttaagtacttaatcttaaaatactgagattaaactgcccatgttattttaaatgtcaagaaaatggtccccagagtgtgaatatgtgtgcgcctccctctttcagagatcaatggaatttgaatgaatgcaccaaacttatttgaggatgaatagagtctaaggctgaatcttttccccaattttagcatctatggttatttaatgattttactacttgggaaactggaactcagtgagagggtataccggaactctctgtagtgcctttgcaactttgaattaaaaattaatttcaaaataaaatgtttcatttaaaaaattgcattattgaagtatttcttcccaatcctttctggaagatggtcaaagtacaaattgtcttttccttcaagggagtgacaagcccaaagcattcattaacagaactgcacaacttccccactttttattggagcaggtgcaaggctgcccaaggctcccgcagctggggttaggctgcaacaacaaagccctgtgtggattcagcatgtttagaagcctctagagaccagaggacgaaagagaatggcttcagggccagataccgaggggtggcgtttctcattcaagactttccataaattcccttcagctctttatactgtttgaaaaatccgactcaccaagtattaggtttccctgcatctctgaggtcacgtgttctatcacatctttatctccctggagtagctttcaagtttcaatcttttgttgcctggcttaattaaaattggccacgaataaaaacttgcaccgtttccaaaatcgaggacttgtgtgtttctaagcattgggtttaggcctgccctgtcttgtgcttccagcctgtcttctgctttcatgtagcttggactacatgaagaaaaagaaaaagctaagctcttagcatgacagttggcatataatggtccaagtgctcatccccctggcaacttacacacacaaaggcaggcaagtttttttttttttttttttttggtggcttgtgttttggccttcaataaaggacacttttcctgttttttttcagacagccttattctcctgcccatgcacagccttgcagaattctcatggcatagaaggtgctcagatattggttgtttcggtgcacatatggcatgaagacattctaagcagtctcttctaaatgcttttgatctccaattcccactactaccttttcaggtacataccttaaatagtaataagttgtataactactgcaggatagctaggatagcttgtgcttcataaaacatagacaaaaatagaaatttaagtaggagacactaaagctaaaagcaatacaaaattttggtgtttgttaattaatacaaattttaactaatgaatcattttaattttaattgttaacacaattttaattaacaatatacatttaattaaaattaaattttaatataatttaattaagtttgcagtcatgaaaatttgcggtgcaatggactgttctttggtgttttcaaaatcatgatttaacagtttagaatcactgatctaaaggcctggtcccaaatttcgatgacccttcatctggtcagtataaatgaagttattgtgtgtgaagaaactcacaatcttggtgcgttaaaaatcccagaagtttgtttttcatttgtatcacattatagctctatcgtgggttcagggtggaggcgtggagttctgcacattggtggcagcagagtccctgggagaggctgaggtcctcagaatgttacgaataaggtgccagaaggaaagataatgtgaactgtgcgttggcttttaatatttctacctgggagtgactttctaacttcaaaaatttctatttttgtctgttttatgaagtacaaatgatcctaactagtagttatacaacttatttctttttttcttttttttttgagatggagtttcgcttttgttgcccaggctggagtgcagtggcgcgatcttggctcactgcaacctccgccttctgggttcaagtgattctcctgcctcagcctccgaagttgctaggattataggtgcccaccaccacgcccagctaatttttgttatttttttttattttttatttttagtagaaatggggtttcgccatgttggccaggctggcctcaaactcctgacctcaggttttatccacccgccttggcctcccaaagtgctgggataacaggcgtaagccaccttgcccagccacaacttatttctatttagggtatgtaccccaaaatttactcttccacctgaaagagcttctgctcacatttcatgggccaaagtgagccatgtggccaaacctgacccaaggttggcaaggagatgacgataccactgcttgctcagaaaggcaaagcaccagagagcgtccaggaaatggcacagatgacaccacgctatcatgattgaagtgtctctcacaagattcaaagacagaaatgtgggaagtaagttgtggggtgtgttactgaaaccagagcttcatttttcaaccccacctgtcaattatgcagatatttttgttgaagctagtgaactcccatgattgtcagttggaatttgcataacaattataattgtaatatatcttttcctgactcccagtgggttcctcttgcctcctcccatcttgcgcttcattttggagactgatgttctggaggcttccatctcactgaagtactcaattggttcaacaacaataacatctctttccattcccacttgtaaagtgacttccctgtttatgacttgtctttcagcaaaggcaagcttcagcttttgtccggttcactatctagagaattaagaagcattactctgctcctggctaatgaggtgactgctggtgtttccccggaagatacaggttatcacttcgccatgaaatcttgtccacaatggaagagctgcttgctttctctcctgggccttagagacattcctttttctttctttctttttttttttttttttttttttttgagatggagtctctcgctatcccccaggctggagtgtagtggcatgatctccactcactgcaacctccacctctgggcttcaagcaattctcctgcctcagcctcctgagtagcagggattacaggctcccacaaccacgcccggctaatttttgtatttttagtagagacggtgtttcaccatgttggccaggctggtcttaaacttctgacctcaagtgatccacctgcctcagcctcccaaggtgttaagattacaggcgtgagccactgcaactggccccttagagacatttcttagtccaggcaggatcttgcataggctgaatctagacattaaattcagagaccccttcatcatctaaatgcatcactgaaatggattgtagacctcagagggctaagacctttctgtgtagcagcaatggattcagagtagccatctttatggggccctcatgcagttctctcagtattctgcagggtaagcagtgtcatttccattttagagaggaggatgctgaaggggcccaaacatgcacagctaggaagtgtggggcagatgtgtctgtccagctcttgctgggtgcagagctgcccattctttcctcctgaacctgtggggtatcgaataggtagcggggagcgtggaggagatgatgttgagaccattaaaacagaagccgagcccatggccttgactctgtggtcccgtgttctgataagtgacatagagataagcaggcacacacctttcccttctgttatccaccctgcttgtgatacctcccctctcctcggtctttatggtttaaaaataattgtcagggcatagggccctgagtgcctgtggggggcacctacatgtaccccataacccctccatggggaaattccatagccagccagagattggtattttaatagcaattcctcaagatgctgtataaaaaagaccacagaaacagtttttttccgtatgtcccagcatgcctttgtgtacggtctgtagtattgtaaactccccaaaatcaaaatgtgcatgaacaggggattcgagagagaagcaggtgtagctctgggaggggatatggaatagtcgccccagcgcagggacttctttttgtttttgttttttgtttttttttttttactgtatcaatgtagactggaaacaatgtcagaaggagaaagcaagtagcagaaggatgtttaggatgtaaccatttgttaattacacacataggcacccccgcccccaacctcccacacaaggggaccaactcataaatgtattgtttgtgggttcatacacattgcagtaataccatggacacatgggcaggaaggactccctaccttcagggtgagagctgcccgtggggaggagggaaaggatagttttgatgagagtttcaaataaatctcacctatttctgtcaagttttctgtcttttaataagaagaaaccaaaagaggctgggcgcggtggctcacgcctgtaatcccagcactttgggaggctgaggtgggtgggtcatctgaggtcaggagttcgagaccagcctggccaacatggtgaaaccccgtttctactaaaaatacaaaaattagtggggtgtggtggtacacacctttagtcccagctacttgggaggctgaggcaagagaatcgcttgaacccgggaggcagaggttgcagtaagccgagatcacatcactgcactccagcctgggtgacagagcaactctgtctcaaaaaaaaaaaaaaaaaaaaaaaaggaaagaaaccaaaagaaaatacaatgtggtatcctggactggatcttaggccagaacaaggacatctgtggaaacactggtacagtctgaaacaaatctggagtcgagttgacagttacacagcaatgtgaacgtctcggttttgtcaaatgccctgtggttgtggaagatgttcaccctgggaggactgggtgaagggtactcaagtattctctgtactagctttgcaatgttcttataaagttattctaaaataaaaagtttatttattttttttaaaggaagcaactatgatgctacctctcatcatttctctgttatgggtgcatggatgtccatgagctcatccaccagctgctctttgtggtggtcctgccatttccaaggctgggggcaggagagccagtcctagagcctgttcagtatgatgccctgaaggccaataacgaatcaatctacggacccattaacacgacagggactcagcaagtaaaagaaaaacccacaggacagtgccctgagaactttaaaactctcttttcctcattcataaggtgcccgatataaagcagctgttagtttatggtcaagaaagagggggtagggtgggaggagatctaaaagatctttcgattttcttcttggtcctgaattttgtaaaatgccccctactccattccccaatcttcccacttctcaagtttcagtttttgactgacttgacctaacatttcttgagagagaagcccttaaaaatggcagcagggcctcagaaccttccaggctagtaaatgtttatgggatggaggcactggttggtcatttcctttaggaggaaacaataaatgaagctacttgccttatgcctactcaggccctgagctcctaattatcttaatatactggtgggaagtggggatggaagggggtgggggacccagaaatctctgcgcctctggagcttggaagtgccctttttagtacgtttagtgtgcagtttctcagcctgggcactattggtatgtttaaccagatcgttctctgctgggagctgtcctgtgtattataggatgtttggcagcattcctagcccttcccccaggatctgacaaccaagtgtatctccagacattgctaactgtaccctggggggcaaagttgcccccagttgagaaccactggtttagagtaacttgcctcaaccttgggaattcatctgggagccttagcctcaaacgcactgacccacagtggtgagtgggaaaaacagcatttctagatggacgggttattttctggctgaaagaagcacagattgcaatcaaaactcgaggcttctcctgggaacacagctctacctggctttgaaacaccctggagactgaaatggagctcaagtctctaacgagcaagcattgtctcctgggaaccaaaatacttgactgcaccttttgctcgatgatgctaaaagtttattaaacacacatcgaggactggcccctcttttatttttatcttcggacgttcctcaggaagaatagggcagatctctctcttaccttgttcccctctcttggcaggtaacttactctggggtgggagagggaaggtgagcacagaagctatattttcccgtgtctccctgtagcttaaatgctgcttggagcagggagacctgcttgcttcagaccccagcccgcgggccaactccagcccacaacctgttttagtacagcctgcaggctaagaatggctggtacattttttaaaagtgtgataaatactcgagaagaatcatatttcatgacactaaaatgacatgaaattcaaatttcaaggtctgtaaataaagttttattggaacacatctatccacttacgcattcactctgactgctttactgccgctgcgacagggttgagcagttgccacagacacgatggtgaccgaggcctacaatagtttctgtctggctcttcatggggtttattgatccctgctttccacacgctatgtcccctacctgggaaagtgcaaaaagtaaaaaagcctgagttttgttttgttttgctttgtttttttgagacagagccttgctctgtcacccaggctggagtgcggtggcgcgatcccggctcactgcaacctctgcctcccgggttcaagcaattctcctgcctcagcctcccgagtagctgggattacaggcgtgcatcaccacgcccagataatttttgtatttttagtggagacagggtttcaacatgttggccaggctggactcaaagtcctgacctcaagggatctgcctgcctcggcctcccaaagtactgggattacaggcgtgagccactgtgcccggccaaaagcctgagttttttatctgtcccttttgtccttctgcagacagtgactcagccacacttcctgccccccctccatgttcactggagctcctctgagtctgcgaaagctgtaggttaaaggatgtcccctcggaagactcctctgcatctttaacatgaggcatgtgctctgagtccccacaagggtgatgtcgaacacagggaggcttttcctgcgtttgcttggtcccagcaccctgttctcctgtgtttttgaaaaaattctaaaatgtctcagatggtagttaagagtttgggtctgagtcagaccgtcagactgcagagcccccaccgctctgcccccacctccccgactcaggcaggttgttaaaccctgggtctcctgtttcctactctggggttaatgtgggtgcctgtctcctgggctgctgtgaagatcccatgtggggagacaggaagagggctgacctcgggccgcctgcagctggtgcctggggatgtcagtggtaggcagtgatgctgtcatttgctacaccatagccaatcaggaacccaccgtgcacgggacctgcctgtgccctgagctcagctgctctgttacccaccgtggtgggatgtgctgctggtttgtgctggggtccagagcaggcagtgggcacggtggcccccaagccgtgtctccacaggacttggatcagggcagctggccttctctttgcgatgatacctcagctgaaatgggaggcttgtcggtgtcgactggacacaggcaaaacaggaaactgggtgtattttgacgaatcctgttatactagaaaattgcctcctgctgattaagatctgtgtttattggtgcagagttttaaggagacacccagatctgcccacccttgccggctgggggcacaggcaacctgctgggtttagacagttgactgtgggctggcctactccaaaaaaagcacatcaataaaactttcacagtaaagttatatatttttcttttatttctttgaacaccattcatgtcagacttagtggggtggcatttctgtgtttccctcactttttgatatgggcaaatgaatttctcctttttttttttttttttgagtcagagtcagggtgacaggttctgtcatccaggctggagtgtagtggtaccatcttggctcactgcagcctctaccacctgggctcaagtgaccctcccacctcagcctcctgagcagctggaactacaggcatgtatcaccatgcctggctaattttttgtgtgtgtatatatatctatatttaatatagatatatattatatattatataaatatatttatattaaaataatatatttaataaaaatatactctatatatatttttgtagaaattgggtttcaccatgttgcctagactggtcttgaactcctgggctcaagcagtcctcctgcctcagcctcccaaagtgctgggattataggtgtgagttactgcacctggcccatttcttcattttaagtgaggaccagcccatgccagatgttcattaaatagcatgatttcaacatttatttttatgtatgtgaaaatagggtcaggaatgacaaattactcgccgagctttggggatggcaagtctgtctgtctttgggtccaggtcactggtgtgtgtcctcaggcaagttactgaaggggttggagtgctctgggcctcagtttccctctctggtgggtggctcaaggctcaggacactaggattgagtgagatcatggcaggaaggggctcagtcctcacctgcagggaactctcagtaaacagggctgctcctggctgccttgggggtccagtctcgctgcagagcctcttctaggctcatccgtgaacatgacagtagaccaatatcaatggagaacatgacaatggcctgatgatgttttagttcagcagctgtaattcattggagatgcctggaagtttgtgactaaatacagccctcatatccaagactatacacttccctgagtaccttcacatttcaaacattatatgtatcttatttactcaactcccatcatagattttgaaaagaatccgggacatttgaaaaagtgcgatgcagtcacccctgcatcaggggtaggctaaagacagcaggtaggacagacattgggtagagtgggaattacctttgaatttccatgggaagctgtttcgttatgcagtatctccatatggctgagttccttctcccagtttctctcccagtgttgcagcagatcactgcttcttccgttgcacatgggatgaaataatctgcttgagtgtaggacctgtatcataccaaaacacttgccttcaaacactagaaggtaagaagtttggtatgatacaggtcctacacttaaggaccctctgggtgttatacttacacttaaggacctataacaccctctgggacagcagatactataagagatacacatcctaatggccactacctgcttctgtggagaggaatggtgtttcatttagaactcgttcagcagtcagccgggcgtggtggctcatgcctgtaatcctagcactttgggaggccgaggcgggcagatcatgacatcaggagatcaagaccatgctagctaacacggtgaaacatcgtctctactaaaaatacaaaaaaaaattagctgggcgtggtggtgggcacctgtagtcccagctactcaggaggctgaggcaggagaatggcgtgaacccaggaggcggagcttgcagtgagccgagatcacaccactgcactccagcctgggggacagagtgagactctgtctcaaaaaaaacaaaacaaaacaaaacaaaacaaaaacaaaaaactcattcagctgcagttcacagaacacctgcctagcatggcttcagcacaaaaacatgtcattatctcctctaatagcaagtcttcagggagatgagttcacgtttgcaggggcagctcagtgatactgtccaagcatccatgagcttcccacctccccctaccaccatcctcaaattcctcatgtctcttacctcatgcttacaaaatggctgctgccgccccagccagttcatcctcatgcaatctcacattcaaggcaggaggatggggaatggcacaaagagctctccttgcctgcctgcctacctcttggtttcctagaagttccttggaagacttctccttgtctcttgggctaaactgtgtgtaagcccctgtcttgttacttcgagggagggtgtgaatgtatgcagctggcatctggccagcacagtgggaggcaggggagggaaaagtgggttggcagtggttgttgggtggccacattcaaatgattgaaatggtttctctctccctctttgtcgttgtttcctgtgttgtatacagttagatttacaaaagttatttgtacatgtgatgtggttccactgtatgcacatataaatagaggccctaagcaagcttccaaagcctccagatgatagtgttccactgtgaatatatacagaaggttggttgcacattgacattaatttaaccagaccctctgtagctcatagaaagattttagttattctttaaactcaaacctacctacaggtaggtacattagctctaactttgaggactatatagaactctagccaacagccagttgtttgctgaaaacaagctttgttttattaacataaccctcctgatctcctgagataggggcaaaatttcttgaaaatgacccgaggaggtcaggaattattgtcccctgggaggaagcagaggctggggtggagcttggtttgagttctgcttgtgggacaggcggctcctgtttcccctgagtggaggatgaacagagcaagagactcaaagcattttaagaatctgtgtcagtgtttgttagccaagggtggagagctgcttgaaagaaacgcctgcctgccctggtggaatggtggaacctcatgcttacactgggagcctgatcaaatgttttctagtaaagggttctgggcacctatatgccttctgcttattcccgtgggagactaacgtgatagggtctgggtgcctccttaagcccgttggttggaggagatgattaggggagaagctgagaggtggttctgaaaaatattttgctttctattaaatggctgctgagcaaacggaactctctgttctcgtccccattgtcttgccttgaatgtggttttgtgaagacatgttgcttggaaccacagcagccatcttgtgactgtgggacaagaggcctaagaattaagtcaacatgcagacaatgatggagcaaagaagacagaagaaattggggttcttagtcatatgtttgaactactacattcaactacaattgttggggggaggctcttaagcagtttgaatcacatgttcactcatgaatcagttgggtctagagggtagaccaggctgcatcaacacagttgctggagtcagcctctggccctttgtgcctgggctggggtgtggaggtgtgtctactatctgattacagctatgttagccattgtaataatcatcccagtagtgaacatttgtcaaaggcttactatgtgccaagcaccctttgtcctcttttggtttttttttgagatggagtctcgctctgtcacccaggctggaatgcagtggtacaatcttggctcactgcaacttctgccttctgggttcaagtgattctcctgcctcagcctcctgagtagctgggagtacaggcacgtgccaccatgcccggctaatttttgtacttttagtagggatggagtttcaccgtgttgaccaggctggtcttgaactcccaacctcaggtgatccgcccacctcggcctcccaaagtgctgggattacaggcatgagccaccgcacccagcctgtcctctttagttaatattaacatatttaattttcatgacagccatttcaggtggggcagttattatcacccctattttacagagcagataaatgagcagagagcggtagttggcccaagaccacatacccagttaagcatcattggatttggagatccagttcctggagacttccctcttacacttgatcctgaactgcttctcaagcctgaaggataggtttggagcaggccagtcaacagcattgctaattggagagtctcacatgagggcaggaggaagacacataggggttttacagttatgtgtgtcaggcctaatgccctgtatctttgcttatcaaagtttctgaaaaccaggatgtatttaaattgattaagatattggtatattttcccaaagagcttctgttgaattgattgtgcctcttagtatggtgacaagcgtgtgttgagtagacctggcaatgggtaaagctaacaacacttattatgaataaaactgctaattgagttttaatgaaactgcttattgaggtgtaacgtgtgcagaacagcacagaaatcaagagcacttgtgagtgtttacaaggcaatcacacagggtaaccagtgtgtagatcaagaagcagaagcgaccagaaccccctcgtacttgtacccagcggtaactattgtcctgttttctaatagcataaattaaccttgcctgtttctaaactttatataaatttaattgtacaataatactgttaaatcactaaccatggccgggcatgctggctgacgcctgtaatcccagcactttgggaggctgaggcgggcagatcatgaggtcaggagatcgagaccatcctggctaacacggtgaaaccccatctccactaaaaatacaaaaaatcagctgggcgtggtggcgggcgcctgtaatcgcagatactcgggaggctgaggcaggagaatggcgtgaacccaggaggcggaggttgcagtgaaccgagatcacgccactgcactccagcctgggtgacagagcaagactctgtctcaaaaaaaaaaaaaaaaaaaaatcactaatcacaggagcaatgatttggaaagaagaccccaagtagaactttttggagtctgtttgcaactcttccagttacatttcatataggatacaaaatgtaatttaaaaaccattctctgggccccgtagggtgcctcatgcctgtaattccagcactttgggaggctgaggcaggaggatcacttgagctcaggagtccaaggcttcagtgagctgtaattacatcactgcactccagttgggagtgacagagtgagaccctatctctataaaaaataaaaattaaaaaaaaacaccacttttttgttttgatctcatattctcctgcttcccacaccggaaagaggtttaaaggacaaccatgcaatttgaagggtgttttgatcgtttagcttagggatttaagtttgagttcttacaatgtgaacttgaaatgagtgaggctcttcaagatttccagttcccaccaaatctgccccatcagcccctggggcggcttttgtacgtctctgcaccttcctgttttcagaaatgaagctgattactgtggtccagggacagagtgtggctttaaagaagactcttattttgaaagggagacaggggctgggcatggaggaaaggcagaaccatcttttccttcactgcacctgcatctcctgggcctaatgagtttaggctgatggaacccaggcctcaggaaggattataaattctcatttgatttgatttgcctctaaaataccttaaaccagctgtgtctgcccagctgacccaagcctctctggctgctctggggggaaggtctgagcaggctcctcctgtcctggggaagggagggaggacggcagcttcacttcccccacctggctgctcttggggcctgctctggcctggctgggagcaggcaaggcacaggtctctgctgccctccctggtggccagcctccatgtccttgaattctcccaacagccccagaactgggggcctctgcctgtccccattttatagagagaaaaagttgagccttccagaggtgggttaacttgtcctgggtcactgctggtgattggcagagcctgcgtgtgaaccagacctccaggccccatggcccacgctcaaccccagttctctcctgcatcctgggctgagtaaggctaaggagccggtgtcttcctcctgatttgctcacggggagagtttcaaaacccacttcactaagtctccggagaagctgctgagtgcccagcaagtgagcgtgggaggtggtgtgtgaacagtgctaagcaacagagcaatcagagcgaatagcttccaagactattacatgtgccaggcactccatggacactctcctttcctctggttctcaaagtggggtttctagacctgcattatcaccatcacctgggcatgtgttagacattcatgctcttgggcccaccctagatcacccaccttagacatgctggaagtggggcccagtggcctgtgctgtaataagctcgcgtgtgactctgggcatcctgaaggtggagcatgcctggtctactttactcctgggctttaactggcagcccagtggagtcagtgctattactacacctgcatttcacagaagaggagtgacgcgccccagcaagtggcagagccgagactcgccctctcgcccggctctgctctggaaacctcctgagtcctgctcctttgctcagttcttactttcctggagttaaaatctagaagagaggacagtggagaaacaggtcagcaggtctctcaccaaaataatcccagtagttaggctatgggagggaaatgaaaggggctgagagggaaggaggcccagggagagtgtcagtgggggtgagaccaactcagccgtggggaggggctgcggtgcccgggcaggcctggagcaaagcctctgcggtcgtgaacttggcacgtctaacaattaccagcaggataccactcgccaggtgcttggtggggagtgtttgctccctaggtgaccccatgagcagagtgaggatccttgtacctgttcaacagcccccatcccaggcctcaaacccgtaagtcaggagttaaattcctgaatttctcacactgggaacgccatttcattaatttttttaattattttttttttagggcagagtcttgctgtgtcacccaggagtgcagtggtacgatctcagctcactgcaacctctgcctcctgggttcaagcgattcttgtgcctcagcctcctgagtagctgggagaacaggaatgcaccaccacgcctagctaatttttgtatttttagtagagacagggttttggcatattagccaggctggtctcccggactcaagtgatacacctgcctcgacctcccaaagtgctgggattatgggcgtgagccaccaatcccacagttttaaagaaaaactttctcctacatctctgagaacatagtcggggaccctcatttgcagtggccccctgcaaacccttggtgctacaaagcagtgtgggcgacagcacctcttcaatgatggggacacctgtgatctgggctgtccactaggaaggccatgagccacatacagctgtttagattttattttattttttgagatggaatttttgctctgttgcccaggctggagagcagtggcaccatcttggctcactgcaacctccgcctcctgggttcaagtgattcttgtgcctcagcctcccgagtatctgggattacaggcacgtgccaccatgcctggctaatttttgtatttttagtagagacgatgtttcagcatattggccaggctggtctcaaactcctgacctcaagtgatccacccaccttgccctcccaaagtgctgggattacaggcatgagccactgtgcctggcagctgtttacatttaaattaattacaatgaaatacaattaaacattcagatctcagtcacggaagccacatttcaagtgctcagtagccccacgtgtctcagtgtgctttaccagacagcacagatagagcctccaagctgccccgaggtgttagggtgaaccccatacaggtcaaaactggtagagtatcagcagctttttacatggtacagtctaataggcgagaaaagggacttcagagaaattcagtcctttcctttgttatgggaggaaactgaggcccagtgagcctggggttataccagccagctcacagctcagatgaggccaaaccccaggtttcttgaccctcttgagctctgcctgtctgtcggtccagatcaaggactctcaactcagcactagtcacatttggggttggatgggggaccatcctgagcattgtgaaatgtttagcggtgtccctggtctgtacccagtacatgccaggagcaccccctcctaagttatgacaaccaaaaatgactccagacaatgcccagggtgccttcatgggagtgaggggaggacaaagtcagctctggctgagaatcactggttcttttccctcaatttcaatgagctgaggatggggttggaacccagacatccctggagactgcgttcctccctctgggaggtgggaagccgtaggccagggggctgtctgggtctatagtagaaagagcaacatgtgcttgcggcccatttttcttttcagctctacgggcatctgggtctttttaggcaaagaactggcctcagctctagagataattaaacccatcttttttccctctccctgccccatcccctaaaccctttggttcattcaattcacaatgataacattgttcaagcaacactgcacacatgttgacattgaagtgtttaatcttgtggtacaatcattccctctggcccctaccccaacatctgtgcaggctgcaggctcagggctcatgacaagaggatggccaaggagatgcctgcctgtggtctcgcctccaggtctcatgtctctggacgcagccccccagcacctaacaaggaggcagtgtctccaaagaccctcttggagagccaggcgggtaggactccaggtggtattgctggcagctgaagcatttggtggaaagttcgagagttgaagcagttcaggaacaggggagacaatgctgcctgtgtgccctttgccaggcagggccctgccccccaatctgggggcctggggaggggtaatgaggagatgggtgaatgctacaaaaccttcaggctgtcagcctccctccctcaaggactggcattaggcaggagcaaaatttacaagtctgagagggagctgagtcggatgcagaaccttcactttgagtttagctttggagatttatgtggcgagtgcatcgagtgtgccaagagcagagcatggttcagctcagagctgtccttattgaatcgttgccacagctaagaggtcactggcagctcccatgtgaggaagagagttggtatggctgagtggggaagagtacgggcctttaaagattcagatcagctgtgtgaccctgggcaagagtcagtctgagcctcagtgtcctcatctggaaagtgagcacgatgtgtccccctgcctctgagaggggttttcataaggattcagtgagatgatatatacatgtgaagtggcagccaggccagtgggagggcttctaaaatgctggctgcccacctcacagccatcaggatggtcactgatatggtttggctgtgtccctaccaaatctcaacttgaattgtatctcccagaattcccacgtgttgtgggaggcacccagggggaggtaattgaatcatggagtccagtctttcccatgctgttttggtgataatgactaattctcacaagatctgatggtttgatcaggggtttccacttttgcatcttcctcattttctcttgctgctgtcatgtaagaagtgcctttcacctcttgccatgattctgaggcctctccagccatgtggaactgtaagtccaattaaacctttttcttcccagtctcgggtatgtctttttcagcagcatgaaaatggactaatacattaattggtaccagtaaagtggggcattgctgagaaaatacccaaaaatgtggaagtgactttggaactggctaacaggtagagattggaacagtttggaagactcagaagaagataggaaaatgtggaaaagtttggaattgcccagagacttgttgaatggctttgcccaaaacgctgatagtgatatggacaataaaatccaggctgaagtggtctcagatagagataaggaacttgttgggaactggagcaaaggtgactcttgttatgttttagcaaagagcctgacggcattttttccccaccctagagatttgtggaactttgaatttgagagagctgatttagggtatctggtggaagaaatttctaagcagcaaagcattcaagaggtgccttgggtgtgttaaaggcattcacttttaaaagggaaacaaagcataaaagttcagaaaatttgcagcctggctatgcgatagaaaagaagaatccattttctggggagaaattcaagctggctacagaaatttgcataagtagcaagaagcctaatgttaatcctcaagaccatggggagaatgtctccaggccatgtcagagaccttcatggcagcccctcccatcacaggcctggaggcccaggaggaaaaagtggtttcatgggccagtctctgggtccccctgctgtgtgcaccctagggacttggtggcctgtgtcccagccactcaagccatggctgaaaggggtcaatgtacagcttgggctgtgatttcagagggtagaagccccaagccttggcagcttccatgtggtgttgagcctgtgggtgcacagaagtcaagaattgaggtttgggaatctgcacctagatttcagaaaatgtatggaaatgcctggatgcccaggcaaaagtttgctgcaggagtgggtccctcatggagaacctccgctagggcagtggggaagggaaatgtggaattgggactcccacacagagtccctagtggggtgcagcatagtggagctgtgagaagagggccactgtcctccagaccccagaatggtagatccaacagcttgaaccgtgtgcctggaaaagccatggtcactcaacgttcaatgccagcccatgaaagcagctgggagggaggccgtaccctgcaaagccacaggggtggagctgcctaagaccatgggaagccacctcttgcatcagtgtggcctggatgtgagacctggagtcaaaggagatcattttggagctttaaagtttgagagccctgctgaatttcgaacttgcatgggccctgtaacccctttattttggccaatttctcccatttggaatggccgtatttacctgatacctgtacctccattgtatctaggaagtaactagcttgcttttggttttagaggctcataggcagaagggacttgctttgtctcagatgagactttggactgtggacttttgagttaatgctgaaatgagttaagaatttgggggactattgggaaggcataggtggctttgaaatgtgaggatatgagatttggaggggccaggggtgaaatgggtttggctgtgtccccaccaaatctcaacttgaattgtatctcccagaatgcccatgtgttgtgggagggactcgggggaggtaattgaatcatgggggtaggtctttcctgtgctattctcatgatagtgaatctcacaagatctgatgggtttatcaggggtttcagctttgcttcttccccattttctcttgctgctgccatgtaagaagtgccttttgcctcccgccatgattctgaggcctccccagccatgtggagctgcaagtccaatttaacctctttttttttttcctggtctcgggtatgtctttgtcagcagcatgaaaacagactaatacagtcaccatcaaacaaaacaaaacagaacagaaaatcacaatggtggtggacatgtggagaaattggaacccttcccgactgccggcgggaaggtaaaatgctgtagccactatggaaaacagaatggtgcttcctcaaaaatattgaaaatagagctacaatgtgacacagcgatttcatttctgggtatgtccctgaaagatttgaaagcaggatctccaagagatatttgcacacccatagtcacagcagcattactcgcaatcacaaaaatgtggaagctgcataccattcagggatgaataaacaaaatgtggcccatccatacagtggaatattattcagccttaaaaaggaaggacattctgacaggctacagcacggatgaaacttgaagacattttgttaagtgaaataagccggtcacaaaaggacaaatactgtgtgattccatttataggtgttgcccaaagcagtcagattcatagagacagaaagtagaagggtgggtgcctggagctggaggagggaggaagaaaggggagttagtgtttaatggggacagagttttggcgttgcaagatgaaaaaagtcctggagactggatgtgcaagaatggtatcccgtgtgtttaaaatgactgaactgtacacgtaaaagtggttaggatgttaaattgtatattctgtgtattttaccacaattaaaaataaaagttttaaaaaatggtggctgtttacctggcttaggtgttccataggttgtcagggctgcaatctaagtgagcttctatgaactactcttctacagtacaactgacggctctcacgtccatgctggggcagccagaaagtccttgttgaatgagtacagtggaggtgttatctgaacaatgtgtatcattgtcaacttctaggcgatgttctgtttctctgggcatagagcattctcctcccttctcccaagagctgtgtgtgtcagtgtggcctctccaggctgctcatgttattaagagaacattttcctgttagagtagtcaggtatgtctgttccactttccagaattcccaatttattgcatgcctctggcggctttttcaagctccttaatcttgccatgtaaatctttgaatgaatgaatgaagagccatcatcaaatttcacatccctgaaactgtgggtcgtaaactgcctcctaacagcagccgggataagtcagctccagtgagttctggtgtgtgccagaaccttccagatgagctgtagccctccagggaaagagcgagccagggttggtagtttcagagttaaatgggtaccggggacgttccgggatatggggccctgagcagtcctcgggtctgtgaaaacccagttctgacttctggttataatgtggacttcgattagttcttttagccccttgagcctcatcctcattaaagtggggtgtgggggtctgtccccggcccctaactggagctgaagaatgctttggactagtctgtgctcacagaaaccagactctgagtgaggaacatggaattctaatgctggacttgtggtttttgcctggaaagcatccctttgctcataaaatatttgttcctgcctcatagtttagcggcatctttgggggcagtgagagggccgcatagtctggaaggttaaccaaattttttctgaagaccataaagttttggaaggagctgctgggtgattatttactatccatttatcaactctttccagccctggctgggagaacggcttcaggaggaaatgaaggcggctttgcctgggctgacggttccccttttcatggatacaaatatctttcatgtgcaactggccacagtcttgctcgtcaggtgttttttttttttttatgcatggctgtccccatgagagctgcttcctgaggtctctgagcaaccagtgaccaaatccagtgaatggtccctggaagaggggtctccctgccccctttctctgaatctggccactgttgcgccatcttgccctgccagtcctctggtccttcccttcctttggaccaagtccttctggtggcatcgttctccccctcccaggtagccccaaatattgatccaaggccatgctagtctttctcatcataaatgcatttttcgtgcataactttatccataaacccaattcaacagctcccagcttgagcattcttgccagggttatctaaacctctttttccaactgtccagttgaacattctgcaggtcatctcaagtttcacctgtctgcagccacacgtgtttcttccctaccacttcacctcctgagcgctctctcctgtgttgatatctactgatggtgttatcgccctcctggcattccaggccggcagtgggcagcatcctctagttccccctcttcatatgcttgcttttaatcaattgtcttgttccttcccctagagaagcacttctggtccattacacttctggggtcctgacaagagatggaaaatgctgacatcttttctcttgagccagtcaagattgatagtggctgcctgggtgccagaattaagaaaggagtgttgccattgtttagtgatgcctacctcgggtgccaggagggaggaggagggtgcatgtactgggtatgcatcatctctgatcagagcctcctctgagctccctgcctctgtcctcactccctgcctctgtcctcactccctgcctctgtcctcactccctataatccactttccacagggtcaccagtcctctatctaaaatagatctggtcagggcactgctttgtgtctaacaagggaccaagccatcatggttgatgacatcaatgatcaaccccttagcttgacattcaagcattttcccaatgaggaatttgttgcttttttcttgtcgttctcagcaaacttcttacctaaactccccagcatgccctgtttcttgtctgtcgagccctcgatcatgctgttgcctctgcctacagtgcccttccttgtcctctgggactagtgggcctccgttcttccttaagagtccattcagcacctctcctggaagaaccctcacctgcagagctgcctcgtacctgaacgcaggcactgggatttgccaaagtcaacaaaaatgaatgatctctttagggactgtgtctcctttggcctcataccctgtttccccaaaattgttgacatggaaacagtcagatgtggaactaaagttgaacgtgcctaccctctgacccagaaatcctgcttcaagacatttacccagtggacacgtgttcaccaaaagccatgcacaagagtatgcattgcagcacagcttgtctcaaactgtaaactctccaatggctcaaactggaaactccccaaatgactataaaaaaatgagttgtgtcctattcatacgatagggttctagacagcagtgggaatgcatggaccactggtacacagaaccacatgagtgaggctgtggaaggctgcagacacagaagagaacacatctgtgattccatagtcaggtctcatggaggcagagccagtccgtggtattgggtgttaggaaggcagtcagccttaggggaggagggactggtgtttgggagggacccctgtcgggacgacttcggagctggtaataaatgttttgtgtcctgccctaggtgcattcacgttgtggaaattcatcacacttcgtgaatgcttgtctgtgtgccttactgtgtgtacgttatcaacaaagtagtttacttaaactagaaaggaattgcgtgaagagtaatgtgttcaatgcagaagatttatgaggccctgctaagcatcaggctgtggagggcatgcgatccagagctgagacagtcatgggccctgttcttacagagctcagtcaagggggatgccttacatttgggaatgatccaagtctgaagaaagcggttttcatggtgaatggtcatctggagagaacacagctacctgggagtgtttcctgcccatccatttccacttctgggtgtgtatacaattgggcttgtgtgtgttttgctcagaactgccttggttgcagtcaggcagcagtctgactagagttagcttaaaggggacttctttgaagcatctcaacgtaactcatagattggaagagctgaaaccccaaacttcaggaagggcagggactaccagaccaggggatcaacccagcaggtctctctcctcaattccaacctcagtcctccgtgcttggaagcttctttctcacagaccagccttccctgcaaggtgctggcaaggggcttcccagagcactggattacatccttagagatcaaggcggggagagcgaacaggggctctttcataccaggttccaataaaaataaaagaaggcctatgtgtggccaaggttaaggctggcttcctcccatccctcaactggggagaagagggtcatggaacaagatggtggctcccttggagtcccatggctcaactgggacagtgatgatggactctccaagagagacagatacacgagggatgggagtgggggtggggggacatgggcaaggctccttaacagttgtgcattgtaatgagccatgccccaactttgctcatcctgatgagctatgcccagcacaaaatcatccctcaggaagcaggagaaatatatcttctgtatctgttttctcgtgtttgtaacaatgtattgtgttcgtttagttttgtgcattatgatgtacgactgtacatatgcatatatttgggttcatacccctaatttttagggtgttaaatactgtcccacggctctgaatactgcaggttctgtttaagcaccagctgccctttgcaagtctacagagtgggttgccaatttctttggttgtggccctccctttgtatcagacaactataacttagtgaggggtttgcctgagtatgtctcataactgtaggtgggaggaagaaccccagatgttagggagaggcaaggtactcctgagtgatgccgggggcaggtgtgactcccatctgggacagaagtcttccctggcatggcagaggatcatgaagggggggcgcccaggtgggcagcttcttgttcctacctggcctctaacccattattgacaccttccagcccagaatttcccctcttagggctggttttggggctatttcgggtttttgtaaaaggaagacactggacttgtctttgggacagtgatgggtctgcttgctgtcaggatggtgttttctggaatccattttctttggacttatcttttggtcttggggatttaggcccttttaattttttgaagatgaaagtcctttgttaatgcctgtaagctctctcagcccttggggtgctgggatgtaactggaggtagagggaggaaaagctggaatcctaggctctgggcttccttaggaagcttttctctgtgggcatggggagatgtcaactctagacatttagtttaaaactcaagtcttgggtaatcaactatatacagtaactttagaagaaagtataaagacatattttcacctgaaaaatacatgcaagcttctacctcttgtagtggtaacaattcaattatcttgatacttgagttgaaatggtgtagatttcacactgtggagtggcttccatagaaaagggaaaccttggaaagatgagatttggaagttggtttggactttgaattatccactgcttatttgtgtgtgtgtgtgtgtgtgtgtgtgtgtgtgtgtgtgtgtgtacttcatgactgttctttctttgataatggatacaaaattattttcagaacatgtgacaatgtgggtttcagggagaatagagtaacattgtcgttcctgcttctcatagtctccaactaattaatgaaggaaatcctctcagaaagccataccaaagagcccacaaatgtttgcaagaaatttagttcctcactttatccctgagtttctttttagaaaagaaccttgtaactctgataccttaacagttaagatacagttcatcttctatattaaaaacagttgtacctgcagctgttgtaacaaaccttgtgtttgtgattatgtgtcagtgttttctttcttcattgggcatgactctaatgattgtacctgtgtttatgtcatgcttattcaaacgtatctttattgttcggtctattgcactttttttttcaaatgtaatcataagtgcactgtgtaaatgcccacagcacatgttgcttcttctgcattgattgtcattcttctggctcattgttttagaggccctgtaacaatggcagactcaaatggctcacctgtggctttctcctgtcagcaaatggcttctgtaatcttcccaacaactccatgagaaagggccattgttactatctccagggggaggggaacacacagggattaagtagattggggaaggtcacacagctggtaagtggcacagccaagatcaaactcaggccacctggctctagagagtgtgaaggtcaagagggtgagctttggagttcagccgctcacctgatttgtgacctttgaaagttacccggcctccctgagcctcagtgtcctcatctgtaaaatggggatcagtcctgtctcatggggttccatcagatgatggcaaagagtgcttgctcagtgcaggactcacagagttagcactcagcaaacatgtgctttgtacttccgggctcttcagccatccttagttgtacatcctcagatgttccccagcccctttctctgctcaggctgattgcgtatctgccagtggggctgctctgaagctgggttcatccagcactgggagcagggaactgaggtttgcggggagccactgtgttcaaggcattggactttgcacctgtgcatgattgtgggagcaaccctctctgctgaaagttgaatcatggcacgactcaagggctcttcctggtctttggaggtctggctgtgctgcagtggagaacagagatggttggaacaggacttcatctgtgcttcaccgctcctggtcccctggagaaaagcactcgagaagccatgagttgtcccaagactgtgccacctccttcagggggcagacctggtctcttccacctctctcctagcatactcatgaaaacctctcagatgcaatgctttgggagaacagcttccagggtgattaaagctgcaatgcacaatgccacttctaggcatgaaacacgtgtcctgtgatgttcatagcagcactgctttcagagccccaatctggaaactccctgaacgcctatgaactgtagaatggatacatggattgtggtctaatacaacgatggactatcatatgacaatgaggatgaatgaacatgcacggtgacgtggatgaattacacaagcactgtgaaatggaagaagccagatacaaaagatgatatagtgtatgaggccctgcagcgactgttcaaaaacaggcgaagctaacctatagtttgagaagtccagggtgggaaagggggttggtaatgttctgtctcttgacctggaggaatctccgtgactgggtttactttggtttacacacacgctacacgtatacaacagtgcagttaaaaagttctggcaaacggccaggcgtggtggctcacgcctgtaatcccagcactttgtgaggccgaggcaggtggatcacgaggtcaggagattgagaccatcctggctaacatggtgaaaatcccatctctactaaaaatacaaaaaattagccgagcatggtgacgggagcctgtagtcccagccacttgggaggctgaggcaggagaatggtgtgggcctgggaggcggagcttgtagtaagccgagatcgcgccactgcactccagcctgggtgacagagcgagactctgtctcaaaaaaaaaaaaaagttctacaaacaagcagaggaacggcccttgttgagctcttcagctgttcacgcagccacagagatgcatggtggttcaggcctctggtttgggcaggacctgggcttgaatcccaggtctttggccctggggaggtcactggacacctcctgggtctcaggtgcatgcctcacctacctatgcgggattgtactcacttcctcgggctgctcaccttttggggctggcatgagggttgactgagctggaaaggtgacagaggactggccgggggcagtcccacggtgacacagtcaggccctttgccccgccttcccacctggggtcacctcccgaggctcacttggttcccaagtggctgccctttacggagactcctaccttctctgtaaatcaaagcagattggtgacatccccatggccttctctcccattcatctggcctgtcccatagattgggtcaggagagaagggttccttgtgggcgtgaggggcgtgttgtgacaagcagagctgtcatctggaaggaccccggaacggtttctggagagtccttccctcccgccagctctccatatatggcccaggattctagcagctgtggttcaaaggtcatcttcccgaggtctctccaaagacagggatgctcctgtgcccagccagagaccccagcctcagggacttcatctgccccttcttcctgagagggaacagcctgagcgggtaattcccccatgcttcctgccctcaccctgctctctttttggactgttgttaaggtttaaaccagattgtttttaatggagctgcgcagccagggtcttggggctgccagtgctgtgaacttcttcctcaatggtgttcccgtcctgctgtcccacttggaaccgggcagccataacccagcctgagagctgaagattgctgatcgtatttctcctttcttctgaccaatctgctggccaaactggttctgctctttctccctctctctccagttccccacccccagacaggaagtggagatgggcttgtattttcctgcagatgaaaggtgtctggaggttcttctcactggcctgagtgtggtcattctgccccttccagcactctgtggctcccattgtcattcctgctccatgttggtccagagggggcatgatccacaggagccacaggtccccacccagaaacaccattcctgggctttcatcttggtgcttatcatctatgaaatggacatgacatcttagtctaataccgctgccaggagaagggagaaaggtggaggccttttgccttattttgtcctgagtcacgttcaacctccaccccaactctgccattcactccttttagtgctgttagtctactgctgtgactgtaaaccttggcacctcattagaaatatctgggggtgctttaaagagatatggattcccttggttcaggagggggtcggagtagctgtgtgctggagcctactgtgtgcttctcttcccatgtccagcagcctcacgttggtagcttgaaatctgccaagatggcagtatttacacggtgtagtcagcaggcgcttcagatcaggtccctgagagccaattgttaaatgtttaccatcccagacttgggccaggacatcagtattttctaaaagtttccacagtgattttcatgtgcattcagggctgagaacccctggtcctagagatgtctcatactaggcacagtaaggtttatgcttaccaacaatagctaacagttatccaaccctagcagatgttaaactatttgtgtgaatgagatcattcaaccctgaccataacccatgaaggaggattacaatccccattttttagatgatgaaattgggttccatagaggttttctgttaccttatctagggccactctgttggttagtggctgaggccagattccaacccaggcctgagcccctgggacctgagtctggccaggacctcttggatggctgtggttagtgccctacttttcccagcaggttggatgcagaatcatgctcttgtcgttcaggatgaccatggggaccatggggtctgagcctgtgaccctccagtctacagtgtgttggtgaggaaggagcagttgtcactggggtcactggcaatgggcatgcctccatctagcttaggcaagatgcttggactcagagccagagagtgaaacccagacactaatgagctgtcggtgttggtgtgtgttctcttcctcttccagtggaacatgacaaggaattcttccacccacgctaccaccatcgagagttccggtttgatctttccaagatcccagaaggggaagctgtcacggcagccgaattccggatctacaaggactacatccgggaacgcttcgacaatgagacgttccggatcagcgtttatcaggtgctccaggagcacttgggcaggtgggtgctatacgggtatctgggagaggtgctgagtttcctctgggggcagaggaagaaggtggtgagggccagaggatgggtcagattggcacaaccacgtgccaggccctgtaccagattatcccttctaaagaaggtgtatggtgtatgtcacttccttaaaaccatgaccgacaacaaattcaggaatagtagaaggccagggagcccagggatgcgtggtgccttgtgggtttttataggcagtctagatctggctgggtgctaagggacatagaagaaaaggggaaggggaagaaacatttttgaagggctacctctctcccgtttctcactctgaaacccagtgcacgatgtcaggcaaccaattaaggtggccatctaaaataaaatgttaggggaagaaaaaaacccaaaccaaaaaaaacagagaactcttagccttccaagaatcactaggtcagaaaccaaacgtttgtgttgaaagtctttaatttatcgagatccattaatttcaaggtcttgtgagaggtaaggaggctaagaaaaagggctgggacatttagcaggtgcattctattcagacagtcccgaggcagaaatgaccaaggtcctattactcagtggctgggttgctggaccccgcaggctgtcagacatctaccgtccccactgggcagggaaattgatggaagaaaggtggtgtgggcacctccttgtgatgtgcaggcttagcatcttcagctagaaaggggacttgttaccatagacagggacagaagaaccatcacagctacgtttgccaagcactgctatttggtgctggtggggggtgggggtggggatggtcatctaagtaccaagaaaacaaaactgttcttgagcgtttccagagtgttttgcacttgatatcttgtttcatattcacagtagccttcagaagtggtggcttatctgtaaaatgaggagaactaaagtgacctgaagccaaagaatgaggctacccagagagaatgtggccacattaggacgtgagcccaggtttgcaaagctggagcccatgcttatgaaagatatttctttccaaaatttgtttttaggccgggtgtggtagctcacgcctgtaatcccagcactttggaaggccaaggcaggtggatcatttgaggtcaggagtttgagaccagcctggccaacacggtgaaaccccgtctctactaaaaatagaaaaattagccaggcatggtggcgggcgcctgtaatcccagctacttgggaggctgaggcaggagaattgcttgaacccaggaggagaaggttgcagtgagccgagatggtgccaccgcactccagcctgggtgacagagtgagactctttctcaaaaaaaaaaaaaaaaaaaagtttttgagtaggcaagacatgttcatggtataaaatcaaaaggaaagaagaggaaccacagtgaaaatgaaggcttccagcccctgctgaggtggtccctgatgccagtttcttgagtctcctgaaatcagcgaaggaatctgtgttgctgttttcacctgtggaaccccacagtgcactcactcctgcctctggctttcatcgttggatgatgaaccttggcagccctttccaggggttcacacggggtgccctcatcctctgagtcacctcactgttccacggcttgggttgtgctgtgtttcacgtgtgcacgctggctcctctgttctatgatggatggtgccgcagggcaagtaccctcgctgacatacgtgttcatgtctatcagtcagataaagttctagagatagaattgtggggtcagagggcccacacatgggtggctttggtagacactgctgagcagctctcctgggaggtgacatcgacatctactcccagcagccagggagcttcttgcttaggatgaaaccacagcctctgtgtccaggctgttatctggattctccactcagctccggcagctcttggtccttcctgctggctttgtgggcacctggtcccatcatggtctgtggtgcctctgctgtcttgcctgagatccatggggtggatcctgagggctgcagggttgggcagcaggcctgagcactgtgtttggaggagggatgggcgttccaggcgtcctccctgccaggctgccggcaacaggcaacttgggctgggggtgcccattctagtgctggggtcctgctcctgggggcttctgggctgctgagtgactgagtccctcctcagcacaggtacctgctgcatgccatgcctgagggcatcgaccagaacgaaccagacacgagtccctgccctctggaagctcacgttccagcagaggagaggacatggcaggtgggagcattgagcaaggaagggaatagggtgagaagcagtggagggcaagacggagctgctttctttaggtttctacatgttcttcctgtgcctcctgcagcaaagcctccattcttcagaagttaaatggttaaatttaaaaaatatattatttattcatttttctggacaggttgttttgtttttgaacctagaaccaagatgcccctatgatgtaattccccagctattaagagcatggattcaaatcctgccaccagctacccatgtggccttgggaaagagtcatctctcagagcctcagtttttccctctgtaaaatggggataataattgaatctccctcccagagttgtgctgtggatgaaagggggtgacatacttacaacagtgtcttacacacaggaagtgctcaataaatggtcacctgcgttagtatcatcatcatcacagcaggaagtggagcaagacctctttaggaagacaagagccctgggtggtggctgtggcactgccttcccgtgtaggtccaccgagccaattcccctaattctgcaatcttccagtaggaacaaagccctgagcttgcaaatgctcttcaaatcccccacgcttcctccagctcgcctgttcagagataggctttttctttgcatgtccccaacctggttgcatgtccccaacctgggcccgcacagcttcttccagctgaaggcctcctgcagacctcagcccgggggagcccagagcctgccctgctgtccccgccatgtggctgcctctgtctctgtgccgccagctgcccagctgtgcagggctgggacatctgacgagctgtgcctgagctccaggaaagccccgggggtgccgaggattagccggctttgggtcagcctcagcgtctctccccttgtgggagtcactttccactgactcctcttgatctctcggaatccagattaaattccgataatgagccgagctggaggccttccatagccctgcggctctgcttaaagcgcggccccagacagctggaaagacatgttggagccgcccttggcgggctgtggagcgagtgggggctcagaggcaggtctggggacagtggccttggctccagaggccttgctggggtgagagggggctgcgaaaggatcggagtcttatcctcattttctgaaccccaggcctgaggccaggccagctggggcctggcttccaggagctggacttgctcctgtctccattggtgcagactttggttccaggtgaaggtgaggatatttggggtaggggttgtgctgtttgccctgtttctgctgtggagctgggacctggcatcttccatcccagtcttccccgtctctccttgagcatgtgtcaggcttgccccactccacagcgctgccccacatgtaggcgacacacttctgctttgggagctggcctctgagaacctccctgggaggccaaggccagccagggcagcagaatctgctccaagggagtcggccgccaccaaggtcgagatgatgttggcagctggatgaaaatgtccctgggttcatctcagtgattttggctgccaggagggtgacctcagcgtggtctcgagggccaagatttggatcagctgcagcctgagtcactctgaggaagagggagctgccccctgcctgtccccaccacacaggatggattggcagaggaggcctgggctcagtttcctgggtcccttcagcccaggcagaggctcttgccctcgactagccctgggatgggggccctgagtttctgcctttctgagaagctccctggggacgccgtgatgattttggtccataaacctgagaaggtaggtggggctggatgtggtaggaggaacgatgcagccccctcacagggcggccctcgggcagtgggccaagggctccttgcccagtcctctcctggggatgctggggtggtggcaacttatgatgtgcggattcatgacttggtagcaagactctgggcgggttttgccctgccgttagcccccatgagcgtgtttgggcagagagccatggtcacgttccagagcatgtctccaccctgtggttgaggcttcttgttgcgtggtgcttactgtttatgactgtgctggacacttcagctttgtttcatgccttggaaaggttcctatgaagatgtatcatccccattttacaggtgcggagcctggctcagaggtgggaagtaacttgcccaaaagcacacagctacaaagtggcagaggtggggctcaaacccaggctcttagatttcagcagtcaccatcttagccatggccgtgcctcagtgattcccatagtgctgattccctcacctggggctcagatgggtccattgatgagtcctgagctggttttcagccttggctgtgcaatagaatcacagaggcttttaaaactcctgatccgtaggggttgaactgtcattggtgtgctttaaaagctcccaggtgattccctgtgtgctggggtgtgaacaggtggctaagatctctctaatttctcacccatgagctgtcttacatgcccaagaggaaggaaagagattccttttttttttttcttttttgagatggagtctcactgtgttgcccaggctggagtgcagtggcacgatcccagctcactgcaacctccacctctcaagttcaagtgattctcctgcctcagcctcccaagtagctgggattacaagtatgtaccaccatgcctggctgatttttttatttttagtagagatggggtttcaccatgtattggccttctgtgacacattccatgttcccttcagcttggtgtctcagagaagactgttcttcttcccatgagactgagcccaaagtgtagtccagaccacaattgtcagtctcaatggcacaggaaagggactggctaagggtgaagatccctttggactctggctccagaggcttctggaagcttctggaagcttccagaagcctctggagtttcttgctgctcctgaaggctacatgcctgtttcctcgtctcctggcttctaccccttgccactacacctcagccccagggcatgagttctggttttgagctgccttctcaggatgtgccaggtcagcttcctgagtagccttttcagagggcaaggaggattccttttggctgctgggaacttccaggatgtcctggaaggtcagaggagagcagccctcatcaaggagccttggcatttttcctcgcagtccctttctctgggcctcactccagaaccgagactgaagctgcctgagagggagtggcaggcccttaatgcctttggttccgcttggggtcctctcatggatctgcaaggatccctctggaaaaagccacccagctgggcagagatggcaaaccactgtgttcaatccagttaatgccagagacacagccagtatcccctactcagcatctgggggccaaatgcccgttggcttcctgtcctgtggcctgaggccatctggtgggccttggtggcttttttttatctctgtccctgttatttcttcccataattcatcccgagcctggcttcacagggagcatacgggtggtggctgggaatcgatggcaacagattccgtttgctgagtgtttgcggcgggcgggggctcagcaggttgcccacattttccctgattccccgtaggtgttatatcacgttcagtgaagccgagcgggtgtccccacgaggtggtcagtcctgcccctcttgtagaccacctgtgggaaaggtctgctctctttacgtttccatcgatttagctgggtccacaatgcgatcttggagcctcctctctcccatgacacttgtctatgctgggagaagggatggctgcctttgggaacagtcatgatgacaaaagctaattgcatgcaatgggggctctttactgcttcccacaacaaccccccatggagacacccttatccctgcccacccctctttttttttttttttgagagatagggtcttgctctgttgctctgctggagtgcagtggagtgatcacagctcactgcagcctcgacctcctgggttggagcaatcgtcccacctgagcctctcaagtagctaggaccataggaacacaccactatgtctggctagttttttacttttgtagagatgaggtctcactgtgttgtccaggctgatctcaaactcttggcctcaagttgttctcctgccttggcctcccagagtgttgtgattacaggcatgaaccaccgtgcctgctcccacaccctctttcacagacaaggaaatgaaggcacaatactgggttggggattaaggatgagaagcttccatctttccccagtcgcatatgtttttcttccttggctggtggatacacttttttctttctcctcgtggcagtccagtcctgtaaattgggaaatggtggggcaattcatattttccacacaaggaaattgaggcagagaccagtgacctgcccagcctgtcccagtagtgtgtagtgaggctttgcagacgcacctggagccgcctctttttccacccctcggaagttgcacggacttggacagcatgtggacacttgctgaaccgtgtggggctgcatagtgaagatctgagtggggcccagcagagacagtgacagggggtccacaaggggaggagttttgttcgttttgctcactgtggtatccattttgcctagagcctggcacatagtaggtgctcagtaagacaccaaatgcacgaaaggatgaaagcacgacccagccttccctttgaagatgtgggctctctgaattcacagaccacatggtctggtcctgtgtgcctgagcgcatgtacaacagatgcctgctggatgagtgagtgccggccacagtatctttgccctggagctagttcgtcctaccaaatgctccaatgtgctttctcttccagaattgaaactcgagaatgccttgcttgcaatctttcttcagcatctgagcccaatttccaaaaagtgaaaattgcctgtaattatgatactttctgatcctatggatgtttccctgtgatgattataattacgttatttacagctgtgtgccagtgggtgcccaagggtaggtcggttcttgtttgcaaataggggagacatcagcgtgtgtgcggcagcctggggttctttacactgggatgcatttgggaagaatgggctttcgtggaggcagctctctggataacttgatttggcactttgattccaaaagcacttcatgcttggccctgggcctctgctcgcctatagaagctcatttttccaaatgtattaacatctatgtttcgaatcaggatctgtaattgctttagcttttttggcaggagacaaagagaattaatatttttcaatttggtcacaagcagtcatctgtagctgggaagaaaagtgtctgctcaaatactaactctaagggtggggaatacaggcttaccaggaacatgatgatgttttaaaggagacaaccacagttaatgaagctagttcaagttcagattggaagtaggcatgtaggtaaatactcaaggttcttccaaaccctgcttcttcctttgtcttcctattgcaacctctgtcggtgccatgttcttctttttcctcaacaatgcccatggctttccattttgccaccccaagaaaggaggaaggaaagctgacacctggtcttgcattccagcacgcatgccacccttctcctcctgggaccaaggcaggcattgctaatggatccctttccctccctttccctggatccttggtacaggtctctaaataaggcagccactgccagttgagtgaagctgccatcaagtgaaacctgttggccactggtttcaggtcaggtttctccaaagctcaccctcagctgaggattgtgtggctgtgagagtgaaggattagaaagtgtttccaggaaaggcctttaggagcatcgggcagtggggagatggggaggccaggtgagggagcggtgctgcgcagagcaccccgaagggtgactttggctcactcttcctgctagaggttctggagacaaagttgcaccctcatcctagtcccgtcaagagagctgaagtgtttataccctgtcatttgaggcagggtttcggtttccgagcctccgcagtagtgacctttgggggtggctcattctctggggttaagggccatcctgggcatagtagggcattcggtagcagccctggcttctgcccaccagatgccaatgacacatccccacactcagttgtgaaaccaaaaatgtcaccagatattgtcagggtcccatctttaaaagggcctctaactaggccctgactgagaagcacagggtggagggagggagggatgtcaagtacctctgggtgacacagccgaagttgaacatacttaagtgggaagtccctcgcccaccctgtcttcttcccaccttcccacttaccttgctcactgctacctaccaccaaacaccacctaccagcaaacaccagctaccagcaaacaccagctaccaccaaacaccacctaccaccgaacaaacaccagctaccactgaacaaacaccagctaccaccgaacagctaccactgaacaccagctaccaccgaacagctaccaccgaacaaacaccagctaccaccaaacaccagctaccactgaacaaacgccagctaccaccaaacaaatgccagctaccaccgaacgccagctaccaccaaacaaacaccagctaccaccaaacaaacccagctaccaccaaacaccagctatcactgaacaaacaccagctaccacctaaccaacaccagctaccactgaacaaacactagctaccaccaaacaccagctaccaccaaacaccagctaccaccaaacaccagctaccagcaaacacataccagctaccaccgaacacacaccagctaccaccaaacaaacaccagcaccaccaaacaccagctaccaccaaacaaacaccagctaccaccgaacaaatgccagctaccaccgaacaaacaccagctaccaccaaacaaacccagctaccaccaaacaccagctatcactgaacaaacaccagctaccaccgaacaaacaccagctaccactgaacaaacaccagctaccactgaacaaacaccagctaccaccaaacaccagctactaccaaacaccagctactactacaaaacaccagctaccaccaaacaccagctacctccgaacaccagctaccagcaaacacacaccagctaccaccgaacacacaccagctaccaccaaagaaacaccagctaccaccaaacaccagctaccaccaaacaaacaccagctaccaccaaacaccagctgtgcagctcctcacacacatctgtccgaggtggtgctcaaacccagctgttgtcagaacctcctggaaatatattggaagagaaaaatacaggttcccatgtttaaccccaactagtcaggtgtaggggctaggagttttcatcatgaatgtttaaaaacaagctcccaggactggttgtgtcaccttctgggcccagtgcaaaatgaaaatgtgtcaaaaatgtataaaggatttcaagacagcaacagcagagcatgaaaccaagctcggcgtacttctgtgtgtcgggccctgtgtgactgcacgggtcagatgcccatgaagccggccctggccttgccatctccctggatacagatgtctgttgatatctgtgttgataggtatctttatacagatacctttcagccccagcctcatttccagctgtctcctgtacacgtaaacacgtggaaacacagacagatccacagaaacacagacacagacacagcacacagatgcgcagacacgcctggtttcccctgttttaacacctaacatcaatagggtacagttttcataattaaggacccagcatctgcatttttattaatgaaagtcaatcatttattccggacccctttgcttttacttcttgtccttctgtcctgtccaggacgccacctacccttcagtggccacattccctggggctcctcctgcctatgtgtttctcctgctttgcttgtttctgaaagtgacagtcacccagcgtttggagggagttgatgcagagtcctctcccactatcactccgtctatctcagccccacctattttaaaattcaacctgaatccctacgctctggctgtggctcgatgtcttctgaacttgagtgacgtgggtcacagccacacagggtccccagactggagtccttgtaacccctgggctttcagctatggcgacctcagtgcctggcacagagcactccatgtggctttgcttcttgagtggaaatgagattataagagcctttttggggtaagggttctttgtctcctaactcttccccagggcctagttaggggcgctttaaagatggcacttgaggtgtcctcaatagcaggctctttcccctccatgctgtgggcttagggagcgggctcagcctcttgctctggggttgaacccacaggtcccggaagtgggagagggtgggtggggtggtttgggagtcaggtttgcaagtgggattgagagctggaaccaggagcctcccaacaaacctgtcatggtcattctccttggaaagctttctccagctgagtcctgcctccatccctttccccttgggtgttccacatgcgggggctcacggtgcagtaggaaaagcatctctgaggccctagtctggctcctggacataagagggatcctccagcttccccagcatcactggtgtttgagtcttttctctgcagatgccaccacaggttgtcctggcaggggtccctgccatgagtgtagacagcatttctcctccagcccatgtctggctgctcaggtggtgactcccaccatgtcagcctcaccaactgccaccttggacagggcctccactcctcctcggagagatggacccgctgagccgcagacctcgaggcttcccctccccacacaccttcccctatgtgggagctctgtggggaactttctctgacccactgaggagtcggagtcaaggtctatggggaattccccagccccctcaccctcaggagacagtccctcaccctcaggagacagcccctcgccctcaagagacagcccctcaccctcaggagacagcccctcgccctcaggagacagccccctcgccctcaggagacagccccctcgccctcaggagacagcgccctcgtcctcaggtgcacccctctggagctgctccaggaggttctgacgggctgaagtcccaggcccacagtgttctgttttgacgatctccaagcttgccttacttccccgccctctccaggtggttcctggggtcacctctcagacaaactacttgcattcaagtccttgactcaggacctgcctctggggtcactgaagcatgacagaggccaagtgtcaaccacacagggcagccgggagggcttcctggcaaggggcagctttggcaccggcacagcttctgggacctggtgagggcctaccaagtgcaagctgatgtcctcagcctgcccccttcctggacccccccggcttcaggatgctaccgtgagaataagtcttagaacagcccgctctggccttctctagatgttccaacccagcctctgtttttgagaatcttgaatttggaaattgcgtcacttgtttctgtctgcaaagcactgtcaagtttctttccccttgtcgccctgctttgctgcactttttctgtctctgggtttggaatcttaaaacagcctgtggttctcttaaaaaaaaaaaaaaatgaggttggaaagatgacccagcccgaagactgtatttgtggtgcttgtttattccttgagtgtgctgcaggaaaggggctgaatttacctcattctattttggtctggacctggaggctggaggaaatgcggtccccaggagaagtctagaaagatgagtctccccatcctccatggctgcccgcccacctccacagtgccagatgcaggcagctgcccatccgtgtgggatttcccccagagccgtgtcagaagctctgcagtgccccccagatttttctggggggaccccccagagttcttgatgtttcaccagagttcttggtgtgttctgtgagctggaatccagctcgcggctcagttccactgggtttctggatggatcatgcctgggttgaatggaacagtagagcctccagttttccagaaattctggggctcaaaccctgatatcttaagcaaagagggacaagagtcaggtccaaaaggaaatgtgagatgtgctttcttcccagctgttgctttctgcccacctgagtcctcttgatttttgcctgatgtggggaaaggaggtggctccgaagaggtgatggggacagtaaatgggggcactcaaccggaagcccatgcagcctggcagtttccagtgaggggtcaatttgaggtaatttgacagccccctggttccatagccaggcctgtgaaggtggggggtatggaggtgcccaggggctgatgagggtttcccttcaactaggatgtgcagctgggtgcccatggcctgggagtgtgggtgcccagtgggacatagagtgggctgggtgggctaaggccccagtgaactgtgagtcagagccatttctggagctacctgaataatctgaaaaagtatttaccatttctcttttaataatgtaaactattggaagtgaaaccagaaaaccttactggccataaggatgcagaggataccagcacatttgtccagcgtgcatctgaggcctgctttgtgctaagctgtgtgcctggtggagaggccgctccagggctgaataaaatagggctggttcttgctgacaaaaagcttaaaacctggcaggaaaagaggagaacccaaaaaactatacaaacaaactgaaactccagcccagatggcgcaggggagaggacttgggcttggagcgtgtccgacgtggatgcaccattagggcatcagtggacgcttccctgggatgctcaagaacaggcaggtgtgagggaggtgaaaaggcagggaacagtgttgcaggcagcggaaacagcatgtgtgaggggctgtggtgggctggagactggcacagatgaggagggctgggtgggaggaggctgtggagacaggggccggaccatccagggccttacaggttggatgacctggagttgacaataatgcctcctctctctccccagtttctcggtttggactgtcagttccatagtcttctttatcacagaacacattagagagctttggctttttatcctaagagctgataaagggtttgaggcagggaagttaattgctcagcccctgcaagctgctggggcagggggagtgcggggtgagaagagtggaaggggaacccccgggttctctgggtggtagctctccctccaccatcaaaccatcaccgtgcaggggtgacactttgctggaacaaggctctggggtggttccattcactacctgcatatctctgagcctcagtctcccacctgtgagaggggacaacagtgctcgcctctcaggtaccatacggttcagagggctcgctccgcaccttgttctaagatggttccatcttgagttggggtcagctcactgcagctgtgatcttactttagagccaaggcagcttgaatcccatggtggaagattcacactgacattgaggtttgctccaaccagctgcgaaccttgagtctctggctttgcgctggcatcttgagcatatctttccatttaactcattctcagaacaatcctcatggctacctccattttacaaacaaaagaacctgatggacagagactgacttgctcagggttacttcactgaaatttaactccaattttcctcaactcagagcctggagccctacagcctacatccctgagcacccactgtgggacccgaggaccactctggggatttcatcacaaagaggattccgggcctctcaccccctgattgtctctgctggtggctgtgtctctaatgagggagagccttccatttgtcgctgtatttctcttccctcttgacccccagcctctgtgatccacaccttgacacaagtttgaacggctcgttactgcgctccattgccggagcagacatttctttgcagcaggacttttcagagcctttaaagagctaaggtgcattatgacatctctaaggagcaatgtgtcatgtggtgcttcccaacctcatttcaccacagagcattttggatttttgatcctctcattttcctctcttagctatcctattaataagttgcagtttttgagaccttgataaactccaaaccctttgtcttgtggatggagaaactgagggctagaacataagggccactgactcgccttctgactgtgacaacgctggcctccgggtgctggacgggcatcttcctgactttcccatgagtggctgggttggtgctgtctgcagtcagctggccctgcccagagggagacagacagccgtggggtgggtgagagggccgtgggtggccacccgagctctgtctggggcaggaggatattgtgcctctttgtgtatttttccaccttactccccaaagctttaattttagccttcctggatatgcaccgtcttcaagaaagtgtatttttaaaaagccttggacctccctgacttcctcttcccgtctgggggatgccagggactgttctatgatttggcaggaaagcagggcattccctgaagctgaggtgggggagcctggggcccgggctgagtcctccccagcctgcagctcagaaggggcaccccttggacccgggagctggctgccagggtggggccggcttccttctgggctcctttgatctccttcccgggcttccctgcaggctggggttgctgctgggctgactccaggtgcacggcgggttgcagtttcccggcctgactcaccgcagccgcaagcctgtgctccctccatgacatcatgctagcctgggaatgctctggccatgctcgctggctcgctctcttgctccttttcttctgaggaatatccttgcggcccagcaaccgttcacaacatgcaggccttcagaatgtccggcctgcagttttccaaagagcagcagagtgaggcgagggcgagggtcagactaggggtcggggagcgagtcagctgggtctgcgagtggcagagcccgtcatctccactcctgcttagaactcctcccggcttcccagcgctcagcaagacctgacctcccgcggccagaggccctgcaggggacatcgtgcacctgtgccctctcctcactactttctcatcatgacttccgcattcggttctctctgccgggaacgcttttccctgcccttttagctgtgttagttctgctcatcctctgacccccttcgggagatgtttctataaaacgtcctccccgcacaccctcacacctcacatctagtccttttcttttgtcttgctcacccagaggcctcttccctccttcacgccacttaattagggtttgaatgaccctcttgtgtgctacgcacgcccagcctctggacccggagctccatctctggctgccgctgtgtctctggctcctagcagagcacctgtggagaggaggcgtttcagtgtggatctcaggagagaaactgtattcattcctccagctgctgagcccagtgaccgccaacttagtggcttaagacaacacacatttattctcttagagtttgggaggtctgaagtctgaaatgggttttactaggcccaaatcagggggtccatagggctgcatcttttctggagagcctgggggaggatctgtttccttgttgtttctggcttctaggagacagagccccctttcttggctcaaggttcccagccgcagtcacaccaccctgacccctgctttcgctgtcacagcttattctctggcctcctgcctcccctgttatcaggacccttatgattcctttgggcccatgaggataatccaggataatctcccaactcaaaaatctttcatcacatctgcaaagtccctgctgctgtggaaggtggcatacccacagcttctgggatcagggcctgggaggtggcatacccacagcttcctgggtcaggacctggatgtgtctgagggggtgttattctgcctaccacatcatctgaagtgtgttttccttttttttgatggtgggcctgggccagccccgtcctctcctgccctgcctcctctaacttgggtggggctcctggagatggctttctgtgcttcgagtaacctctggcctggggcctgttgctcccagcagaggcgtgtcctgagcctccctgcccctcagtttttgtacaatccccatccccatgtaataggtggtattaaggtgatattaagtggggatgcggattgtactgacctcattggaggagggaggaggaggtgggagagtgtcccttaagagcctagtgtgcagtaggtgcccagtacgaggtgtcagggtgctgagggcccccggccaccagccgggtgattccacatgcggcccttccaaccctggcttgcgcctgctccctgaaggtggtggggggctgtgtctgaaggtagcagagggggatatcaggctggctctcaggctgtgatggcgagaacatttttcattacactgccctaaattatggcccagaactggtgtctaatcctcgttcagccaccagctgcccatgcgcaagacaaaaactctctcatctttccaagctgaaaattaaaatgaccagaatggatttccaagggcctgttctgctcctaagaccctggatggctgggcccaggggcaggaggctgaaggagccccgatggtgggcgcagacaggatggggactgtcccaggtaacgagacagtgtgcactgtgtggccatgttggaattcgtgtttcctgtggctccaacgcgtgcctgggtgcctcagggccagagagatcctcagactcccaactccgctctgttttgccctggggcagtttcagggccatcttccctggatctgtgtttgcgctgaggccgggtcctgcatcccacatgggagtcttactcccctgggaggcgggtggtgggtgaaggcccatgaggatcagtctctaaatagcctctaggtaggtagccagaggccaaaaaaaggacttcctgccttcccacgtttgagattttaaaatatccccttttccattgtggtagaactttccaggggaaggtgggctgggagacactggaaacgagcctggggatgtgcggttcctcgtcctgctcccctagaattagatttcagccgattcacctgggcgtccttgggaggaggcacctgaaagcccagcagcacgctgtccccaggctggtggttaaatattaacgcctcttagtgcggcggcattggggtcaccagcggttcatgccttgcagagcagggctatgggagaacccagtttcagaagagaagagaagacgacttttggggtcttgctgtttctttaatcagaaacagcctgagaaagtggaaggatcatcaagtttatagacaacagacgtgtggcctgtcccctggctctgctgcctttctctgagattagaggagtggaaaaaactgtccaaacccaggaaagaagatgagagccaggcttgccccctcacctaggtttgttctgctgttcaagtataacatggaaatatgttgccccatacagatctagctttttccagaaatagggcatgcttactaaattgagacaatattgacgtacatgtgttagcttgtaaagggaagcaaaatacttcacagtgaattgttgctaccactctggtgtgtatgcgtgtaaatgtttcatgcagctgtgtgtacactttaaaacaattgttaacataatggcaccatactctatatttggggcttagattggccttatccattttcaaaaaatagctttattaagatttgaagtgtataattcagtggtttttggtacattcagagttgtgcagccaacaccactgtctaatgttagaatgttttcatcaccccgaaaggaaactccatacccactaacagttacccccattttccctacctgtctagctgttggcaaacactaatctactttcttttattttctttttgtttgagacagggtctcgctctgtcactcaggctggagtgcaatagcgtgatcacagctcactgcaacctccgcctcctgggctcaagcgattctcctgcctcagcctctcgagtagctgggactacaggcatgtaccaccacgcctggttaatttatatacatatatatatatatatatatatatatatatatatataaaaatatataaatctaggtatttgtttattcatttatttttgagacagagtttcgcccttgctacccaggctggagtacaatggtgtgatttagtagagatggggtttctccatgttggtcaggctggtctcgaactcccgacctcagggtgatccacacgcctcagcctcccaaagtgctgggattataggcgtgagccaccgtgcctggccaatttttatattttttgtagagacggggttttgccgtcttgcccagtctggtcttgaactcctgggctcaagcaatctgcctacctctacctcccaaagtgctgggattacaggtgtgagccaccacacctggccctactttctgtctttatggatttgcctatttgggacatttcatagaaatggactcatatactatgcaatcttttaagtctgactgctttttcttagcataatgatttcaagattcatctgtgttgtagcctttatcagaacttcattttttaatgccaaataatattccattgtatcaattgactgtattttgtttatctgttcatgagttgatggacactttggctgtttctacctttttggctgtgaataatcctgctatgaacattggtgtataagattttgggtggacatgtattttaattgcttctgtgggtagctgaattactgggtcacatggtaattctacatttgaccttttgagacaccactatactgttttccagagtggctgccccattttccaatcctaccattagtatatgagagttccactttctctacatccttgccagtaacactagttatcatctgtggttttggctctagtcatcctagtgggtgtgaagtgctgtctcactgtggtttcaatttgcgtttccctaatggttgctgatgatgtttagcatcttttcatggctcactggccatttgtgcatcttctttaggaaaatgtctgttcaaattagccttctctattttgggagtcagtggcgtgctagctttacaatatgggtttcaaacactccttcttccatgttcttgatcaaattatataagaaagaattatctgttgataatttgcaaaatctgtggttataaaaccaactgggggccgggtgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactggggaggctgaggcaggagaatggcgtgaacccgggaagcggagcttgcagtgagccgagattgcgccactgcagtccgcagtccagcctgggcgacagagcgagactccgtctcaaaaaaaaaaaaaaaaaaaaaaaaaaaaaccaactggggtatggggatgggaaagaccttcctatttcagtttcttttgggcaaatcaaaattttcatttctttttgcaccaatttttgcattttgcattttcccagaagtttcagtcctacaaattctgtttcttagcaccttcctatcatatttccaccttgtcaacaagtgtagatttatacggtcctttgaagcggctgtgcagggctctgttgccttggatgtgccataatgtttttaccagtccctctcactggatggttagtgctcagtttttctgttataaacaatgtgactgttgtttgggttatctgtctctgaaactaaccactcatatgtagtggcttaaaacaacatcgttttattgctcaggaatttaggcagggcttagctgggtggttcttctactctttctggtatctgctgtagtcactgatggagctaggagcttgactaggtctggaaggcctgagatggcacctcactggggactggcttggtttttctctctctctctggtttatagacccttatcctccatgacctgtgcctccttcccctccatgtggtctcttccttcagcagtgtagtcagatttctcgattcagtggcttccttcccagagggcaaaaatagaaatgataggcttcttgagtcctagtcctgagcctggcaggacctcagttccactgggtcctactggtcacagcagatcacatggtcagtccagacttcagaggtggggaacagactccacaagtttatgggacagcagcatgtgcatacagagacaaggaattgttggtggctgttatttgcagaaaatctaacactactgtgaacataggacacttttctgacaaattttggagtccaaggtaaacattcttggaatggacaagtggtctgttgactggagaatcatgggcaagtcacataacctctgggaccaagacatgtaaagtccccatcctaggatttcctgaagtttagcagagaatagacaccaacactgacataccttgtaataagtatagatgctcttccaggagtgtcttggagtttgctgccaggctggtcttaacctggctcttcctaatcattgaagaagatggcattattctcattttacataagaggaaaccaagacacgggaattatctggcgtaaccttgccttatcccttctccatcacctgggtttcatccccctctagtattttctctgccccacacaacgctgtgatgacaacacgtatcatacaggatttgacatcttcctatgtgtctcttatccccaggtgagtgaaggaggtggcagggtttaagcgctcaggctcttgagtcaggtttcctgcgctgtcgcctggttctgccacttatcaggtgtgtccctggagacaactggcttcatttcactgaccccaacttttctcatctgtaaaacagtaacaggactttgatcatttcatagggctggcggggagattcagagaaccgaggcgtggaaagcaccgagattctcagcagtggcgaaggtgaaagaacgcatttaggttcctcagggcctttcaccctgagccttccttacctcttctctcacctgggctgggccggggaggccagtgtgttcaaggtaaataaaaatgtcacaaagggctccttcagtgctctcctggttgtaagaaccagtgttcttttacgatgctcaaggtggcagctagaaattccccctctccgagctgtcagactggacctggctgctgagtaattccttccttgtcctttccatgaggtccaacctcatgcctgggctctcagtctgaaagcaaagcccgtgttagcatctcacactcgacccatctcagcaaggctcccgtctcccagtgccttctgatgaagatttggctctcctaagtgtgcctgggacaaattgcaaactatgacttgaaggaggggagttgacacgttcacgttgattcatggatgagtcagtgctggcctgtagcatctggcctcagtgtcatagcctgcaataagagaatgctcagtatcgtttggcgaggcgttctctgtttaaaggtctcactctgttcctttggttaccattcattgttttactgtcctcgagggcctgtccagatatctggtcacattttcctgctaataacaattttccagcaaaatcaccatctgggtttgtgacttctgtgctgaggtgtggatatttcctacaggggccttgggagcctgattcagtaggagaagttgtttcgacttggagtggtgcttcttgtctcatctgttaattgttgagaatcgctaatggttcattgacaaccttggtagcttttcaaagccaggaaagtcatccaggcaaactggagataagacagcaggaaattcttgtttataagtttaaaatctgtgtagacatccccgaagccagcctgaaactacctctaaaagagcatggggaagaagaagtaaatgagtcatgaaaaataatctcatgactttaattcagtttggatgtgaaaggtaaacttagggtcttcaaagtcctgtgtggctctaaaaagacttccttgcttctgtcatctctctgtgcttgagagaggaatgagtcctttacaatctttaaaaacaaacaaacaaacaaacaaaaaacaaatacctcattccttatagtcctggagactgggaagtccaagatctaggcgctggcagggtcagtgtctggtgaaggctgccctctgcttcaagatgacacctcgttgccgtgtcctcacatggccgaagatggaaaaacagaaagggtccagactttctccctcaaacccattcataaagacaccaatccatccccaatggcctaatcacctcctaaagggcccacctcttaataatgatgcattggggattttcaacatgagtcttgggaaggacaaaacattgaaaccacagcaataacagaattaagcattttctgaatcaggttctgggggtcattgaatattacttaaaaaggagactttgaggtggcatgggaggaggtgactcctgcgcccatctgtggtcctggtgatgcgtccattgctgtggggtgcccaccctcccatggctaggagtgggcacatagattgactgggccaactggattctgtcccccagagttttggatggagagaggcccagagggaaaagcagctccgattcgttccttctgtgcttgtgcctgagaaaattgcgctgtgccctcgcacctgcctcggttcctgtctgtttctgaccctggttcttcttccctgtgtaggcttctccgggtctgttaatctcccaatacttgctaacattacaggtctgtttcccgtgtgtcttctctgagccttgttcacattgatgtgcctgacgaatgtctaacatattatggcatgcagcagaagggtgatctagcagacctcacaaacctagagttgtccaggtcagacaggaagataaatagcggtggctgtctgcagtgttagtacggagagctgggggctggagccaaccggagatgtgtgcctcatcaaaggggacatgagtggctcggctcctgcccgtggcttagtgggttacattccaacgaggttgactggtgaaaggctctgaaaaggcagtgtccagaagaactgtctttgtgtacagttgcaagcttgggcttgcaggtagcctggttggtttccagtcctgcctggactgtcctagtggcataaccctgggcacacaacttgacctttcggatcctgagttttgagttctgcacaatggcatggggaatattatctaccctacagagtgttgtaagaactaagtgacatgagactggtcaggcatttcaacctggagcctggcatatggtaagtgctccataaaggatatgcctgacatctttacgtgtgagcagacaagattcactataatcaccaggaagattagataactccaggtatgatagagactgttgttgccctggggcagggaccagtgtcatgttgttcatcattatgccttggtttctggtacaacacagaggtataaatattctagttgactattaaaggactcaaagtattgaaactttgaattcttattaaaagtgtgcaagaaatgttatgaagatctttcatactagaattctactatccagaaatgtaacaatccacttatttaccctcttattcatctactcatctacccattcatccatccatccacccatttacccatccactcattcacctacccgcccacccatctactcatccatccatccatccatccatccacccacccactcatctacccatccattcacttatccatccaaccatccatccatccatccactcattcacccacgtacccatccattcactcacctacccatctacccatccatccaaccacccattcaccctccatcccctgtcaagttaattatgattttacccattttgctactgtaaaaagtaaggaagagagaatgaaaggattttcactattaataccatcagtccagagattcacctcctaactcttggtgggctcataaagatggtgcacgtcctggaaatgaagagtatctgctctggtacacaggtaaatgggctgaaaccccagcttggcaacttcctggttaaatgaccttggaccttgggcaaatcatggctttaccataaattgagtggaaatgatattcccacagcttcgggttgtgggaattgaatgagatagtgtagtgttgagcccgtgggacagtatctggcacatggtgaatagttcagtcactatcaacttctgctctctgagactcttccagcaacacggaggctgcataatccctgtcttcctatactctgtcccgctgggatgcccttaacaatttatggggtgagattgccttgtaacagctgccttttccctgcgtgtatctctttgtagctcttctgcactctctttcctcaccacagctactgaggggtctttgtgcctggatcttggtctgatgttcccacttgtcggggaccagtggactctttccctcccctcccaccccatgaggctctgcttcccatctgttggggtagtggagctgtgacctggctaacgcgaagcccgtgtctctcctcctctctcgcagggaatcggatctcttcctgctcgacagccgtaccctctgggcctcggaggagggctggctggtgtttgacatcacagccaccagcaaccactgggtggtcaatccgcggcacaacctgggcctgcagctctcggtggagacgctggatggtgagtcccccggccactgccagtcctaatgcagcctgtgctcctggacttcaggagggtctcagcagtgctcatgcttgcttcactacaaacaggcttccccgcccctcccaaccagtactccatgttcagccttttgatccaaaccagaagcagccccttcccctcttttcacaagaagattacatgtttggtcatagcagaattgggtaaggcttcattacacaaagggtggtcccatatcagcaggggtgagggcagccctcttatgagaaatgcagaatcctgggcccaccccagacctgctgcatcagaacctgcactttaactagagccccaaggtgacaccacaggacacaggacattctggactgttccgtgcacggcagggtgtttagcagcgtccccggtctcttactcactagatgctagtagcatctcccagttgtgacaccgaaaaatgtctccagacatcgccagattgtgccctgtgggacaaaattgcccttgtgcaaggcattggtcccttccacattagaacctgaatgtgcgtctgactctccagttcctggagaatccattgtgagtctgccctccccaacacttctcattcccactacagttctgcctcctttgagaagggaagaaggaaggatggtgagtggagaagtgggaatggacttctctatgctaatttttccccaccccaaacagataagaaatgatatcttgtagcttgactttgcttaaaattcagtggtgatggtttccagctgtgtagcttcttccttccaccagttttatgaacaaaacaattttttcatttatttttgaataaacaccttcacaatgtttgcctttggagctatgaacaatacatgtgtaacactaaatagtttccctcccactttcttctccagctgctgagttccacttcccagggacaactgctgtttctgtcttttcagagatgctctctgggtatttcagcaattacatggagattcggctttctgtttttcccctctcccataaatggtggcctggcatatacagtgttctccagctgacttatctcggagactggtcctgtcagccgttaaagagcttccttgttccatgtgttttgtgtccatgtagctctgccacccacacactgtgtgacgttggacaatttccctaacctgtcagagcctgggctttctcatccagcatgcaggtgatgagaggatttgggccattgggttgttacaagatgtaatgggttattatgggaagagtttttaaaaatagtgccttaatgtacgtaggattttcccaggcatcttggtaaaatgcagattctgactcagctggcctggggcagaggagtctgtgttctcagacagccaccaggtgacagaagctgctggtccctggaccgtgctttgagtaatgaggcttagaacaggacctaactgtaatacacatgtaaaggagagcagtcatcatcctcgtcatcatgatcaccaaaactgacatacccagctctcctgggatggatgcctaggtgttttctagtcttttggtctcacaaacagggcttcagtgggaaaccttggtgtgtaggtcgtttttcgtttgagtgtagctctaggaccaattcctgaagtggcattgtctatttgtagttttatttttttttgagatggagtctctgtcacccaggctggagtgcaatggcacgatctcgattcactataacctccgcctcccaggttcaagcgattctcctgcttcagcgcttgagtagctgggactacaggcgcccgccaccacaccggctaatttttctatttttagtaacacatttctgtggacttgtagatgttggggaaaccttccaactgggccccagtgggttctgtgcttctctgtcttgcctgttctgctggctcaggtgattttgtcttaattgacgccagccctgtggccagctcctcttactaccagtcctgccctcatcattccccccagacacagtcagagtccttttgcccctttcacctccagcacctactcccccattgtccaggttatggagaaaggctcagcattggtggaggcagtgctgcctgatggttagagctcgggctcccgagccaggctccccaggttcaaatcctagccctgctatttccggccttgtgacctagggtgagtcacttaatgtgtctcatctggaaaatggggttaataatagtttccatctccaagggcggttgtgagggattagatgagctcatgcaagtgaagagtttaattgctcagtgtgtggttgctacgaagcaccactgtctcttgtgatcctcacaattacccagcaaggtagatgctgtggctcacatccccgtggtgcaggcaggaaatggaggctcctgagaacccgccggggctccatatttcagagcccacctgagaccctctccattccttgcagcctagtggctgcaggttgctatctagagtcagatcaaggattagatgctgtgtccctgtccccctctgactccgggacaccatctttgctcctcctgggcagggccctgggggccgggtgtggtgccaccgcccagtgacttggcttgtccaggtgctgtgcgcgcccaggcagtgagttttgtgtggttgcccaagtcgggggaggatcacccacttggattgtcagggaggggcaaagtgtataatggccagttggctgtgtggagttttggacctcttgggggtgagctaaagagcaagtgagtccgggattttcgagacatcatggctgtgaaaatgctttgttttccctaccgtggaggatctcaagcctggcgtccttcagggtcaccctagggggcaaactgcacatgcaggtgcctgagctccatttcagacccaccgtgggggatctcagaggatgcgcccaggaatatgccccttttccccagtagctttaggggtacatgtggttttgtttccgtgggcaaatcataaagtctgagattctagtgctcctgtcagccaagtagtgcacgctgcacccagtatgtagctttttattccttagccaccttctaaaagaagacttgggtaacttgaggcctggcccagtgacaacactctggcaaagtcgtgcacggtgcctagggcagcctgtttacaagatggtgcctgggctgacaggtacccctcgggttctgggtctcaaccctcccctgccagatcctgcacggggaagggcagcagggcctgtgggaggcggtgtgcatccgacaaatcagtgcacacctgctttgtgcctggccccgagctggctgcagagaccctggtccctaccctggggacctcttactgatattaactcagaggatatcctgcctgcaccagcacccagagaagacaggtgcccaggcagcagcgcccatgtcatcatccagaaggggtagagacagggtcacctgaaccttgcaaccactaggcagttacactgtgcgtgggtggagaggagcccccagcagctgctggaatttggagcccggacacctcctggggccttgcttttctcatgcacacaatgggcatgtggaggatagtaatttgggccagcgtgtttccattctagcggggcgcagccatcgcagaccttctttcagaaggctggtgtttaaccccacatgagcccctgcctgccagtggtctccaaaactccaaagcccagatggcgtcctccttccctcccatctggccacgggtggtggggggtctcgaggtcaaagtgcggaggtgcccttctgagaccacccaggaagcgtgcgtcttttccctcttcctcccagctgggccctcctgtgagtcaccatgcggagcagccgcagctggggctctgctccaggccagcgtgccctcgcggggagaagcctataaactcccaggcacctgcagctcatcaggaggaggccgagcggggagcctggtctcatctccctggggatgggctggtgctacaggaatgagggctggagtctgtttgtctttcccttaatacagaagagaggagaggcagcctctccacttgttccagcccccaggctgtgcttcccacccatggactggctgtgtcctacagcccatgctggatgctggtgtcagagacccggggtgaatctagcactgcccagagccctgtgagaaaggagaggatagagaggagagcgagaggagaggaggggagaggagagtgagaggagaggatagagaggagggggagaggagagcgagaggagaggatagagaggagggggagaggagagcgagaggagaggaggggagaggagaggagagcaagaggagagaagggggagaggagagcgagaggagaggaggggagaggagaggagaggcaaggcacctttgagtggagggaatcctgcagctcggggctcctcccaccttgtggccttaaggcaggggaaccctccctacaagccaggccctgagcttccagtgtgggtgcagcttttagaagcaggatggactagcaacccctgcacactcatactctggcacccctgcccctgtcatagcacagctcctcagtcacctttgtgtggtctcagcagctactccaacttcttggggtcttgttcctttgtctgttccatgaacataataccatcacggattctgtaggcggctggaagaagaaagtgagttctcagaacatgctgaatcctgggcccagcaccctgtctgtgctcatgaatgttagaagttctaattgttgatttatttagttctctcaataatcctgcccaggtagcacaattgatatcaccaacattttatagatgaggaaatagaagctgagaaggctggggaactttctcatgactcccaggtgtagatctgggctttggccagaggattgtgactccaactcccttcctctttgctggaaaatcttccaaggaatgtgttcaccaggctgcagcctcaggatggggtttggaggggcagatgagcccctgcaggggacccagcctggccatccggaggtagagaccccaggaccctctaacatgttaggtcttacctggcttttcacctgggaaggaaagtgtttctaaaaagcactcagaagacagtaggcttcttgcaggactcactgtgggagccccctttgcagaagtgaccagggctgcccttgacttctatgggctcctccctccattacaaaaaaaaaaaaaattagggccgggtgcggtggctcatgcctataatcccaacactttgggagactgaggcgggcagatcacgaggtcaggagtttgagaccagcctgggcaacatggtgaaaccccgtctttactaaaaatacaacagttagccaggtgtggtggtgtgcgcctgtagtcccagctactcgggaggctgactcaggagaatcacttgaacccgggaggtggaggttgcagtgaaccgagatcatactaccgcactccagcctgggcaacagagtgggactctgtctcaaaaaaaaaaattaaattaaaaagtatgttttatggccatgttgatatcaagatgaatattataattctgggtgaattaaaaattaagattatttttgagatggggtcttgctacgttgcccaggctgtccaggctcaagcgatcctctagcctcagcctcctgagtagctggaattgcaggtgcccagctttgaattaaaaaccaaaactttcttagacactaaaagttcatgttttatcttccgattttaagagacattatagtgttttcgtgggccctgcatcccagcatggggagtgaatgatgaatgatggtcttcccccacccccgcatctggttgttagaacaagtttcctacagcaaatagcctctccacctatgttggaagcacagttattcactcaacaaacaatgagccaaggactgttgtgcccctacaatgaggcaaggactgttcgaagcagcaggggcacagccttgaacaaaatgaagatttggctgttgtgttgctcacattcttctaggaggagtccgaccaggaacgagagaccatgtactgaagggtaggggtgaagccatgcagatgaggtctgaggctctgagtatggttcagaagggcttcctgctgctctacaaatcaatacgcccattttccttgtgccgtcttctacccgcaaagcctgctgcagagagatgaagactggtttgggctggggagactgtcgtccttgcagacatggaagcaccaggtcatttgtcccaagaaagggactgcagccttttgtcctggttcatggtgtctccctcctcttccttgtttgcagaagaaatcactcgcgactcaggagggccatgtcaatcagccctgcctctcagatccaagaagatgatcggggagcccttgtctgcctcatgttatactccctcgttggggacccttttctccagctccagtaagcgctggctgtccataccctgagctccaaggtcatagggcacctctctccctcctgcaccccatctttgtttcctgaagtaagtctgctgggggtcaggagcatgtgcattttggctatctgcatgcagagagccctgagcgtctctcctgtgacacacgagagcacgtgtcttacttcatgctcactccagattgaattggatgggattgcagagcatttaaaggattgaagggcatgtgctgtccaagtgtgacactcagctgtggcagctgaggaaggagccaggaggtgagccactcgcctgcggcggctgtggaaactaagccccacaaagccaaggctggtgagcgatgccgcccacggcgcagctggctccaaggtgccttcgctccatgcgattgcttcacatcctgtttgtccagaagccggagagggagagaaaagagaaagcctgatgacccagtggcggggatcggtccttccagggctgggacggcaagaatggggagggcggaattgggtaattggggccaggcagatgtcacaagtgttaactaagttctcacttgtcacttgggccttggtccacccagagaaatggctggagtgaatgtgtttttcacaattaatgagaaacattcttgtgctgtgggtcttggaagggtagcctgtagccctgggcctggaaaacaaaaaagccacaaggaaaccgagatgccacccctgtgcggcgtgggtgggctgcatcccctcctttaccaaggggcctcactgtgctccctgcctgctctccagggtctttccgcagagttcgctgggttcctcgggctggccatgccgattttgctcaagtcgtctggggtttgccagcggtgccaggatgcacggctgggccctgtcctcagctcactctgagtcctatctccaccaggctccttttagaaggcctttccctctatgcctcagtgaatccctcctacctttggggtccccgtaagtcacctacatctatgcctgggcagtctctctgaattttgggggatccttttccctgccatcgcctggactcattggcagatggtgcaggggtcgagctcacaggctccagtcggctgggccagggtgtggactccatctctgtactccctagcattgggtccccggtaggtgactttgcgcctgtgaccttgctttcctcctttgtaaatgtggggtcacagttctaccttgggagattccagcgaggagcgatgcatggaacgggcttagcacggtgcttggtatacattggtgggttttcatttttgttgagaagcaacgatggaatcaactgtacccagaatacttatactggcaaataatagaaaataatgatgtcttatctcatgaggacactgatggttttccctacaagtctggaagtgagtggatctagggttggttagagtcagggtcagcaaaggttttcatcttcagtaaagtaccagagagtacatattttaggctttgagcgtcaggcgttcgtttttgcctgctgtttagtgtgagagtagccacagatcatgcgttcctgactgtgcatcgactgtgttccaataaagttttatttgcaagaacaggcagtgggctggatatggcctgcaggctgtagtttgttggcccctgggctagagtatcaacagactcgaggctttttcccttccggccccatcatcttgacagtgttgacattttgtcctgaggctctctcatcatggttggcaatgtggctgcctccatgtccacaagcatggaaggaaaatgcagtaggcaaggaggaaggatgtttatctcatcatgtgcctgccttttttggggagaagacacttctgagaagcctgcagcatccatccccagcaggagctgcaggggatgctggaaagggtctaatgtgcagcgttcatggacggaggaaggtcaggcacgagggggctgggcatggctgtggggtccgcaccagccacttctgcctcacctccctgcaacgattgggccttctccaatctgctctggaccatcggagcaaaggtctggtcagacagctttcctggcctcttcagacaatagtagctgtgatgctttgtgaacagagggcgcctacagcgtgcaaagggctggttttggcaatgtaaaggactcaatttctgctttacatcagaaaatgccaaggtaagttcaccccaaaacctgcacatgatgtctctcattatatgagtaatcaccaaagctggaagccaccagatggatggataaacaaattatgctacttacatacagcaaaaaggaatgaactattgaaatgcagctacgtggatgatctcaaaggtattgtgcaggttggaataagccaatgcaaaagagtgcaggagtccattggtatgaaatatctagaaaatgcagttatagtgatgtgagtgggtcagtgtcttgccagaggccggcggtcggagccatgtgactacaaagcggagtttcccagccttggcactactgggtagttctcagttgggggccgtcctatgcatcgtaggatgttgacagcttccctggcctccacccactcaatgccagtagcaactgctcagttacgacaaccaaaaatgtctcaaacattgccacatgtctcttggggagcagcatcaccccagttgggagccactgagctaaaaggcagctcagagagttctttgtggcgtggagctgctctgtatcccgattgaagctgggtaccggcgtctgtacacgcgctagtgcttacagatgggcataccaaaaggggtggattttactgtatggtaacttaaaaactaagacttccaaaagcaacaaaacacaccacagagagacaagcactgagtcccaatgaagaaaccagcaaagccatgacctctgggcccctctacctgcctgtcaggtaggccgggcccctttcccacctggcagctgcagcctgcagagagctcagttattataccgcaggaaagcctttctatcccacccttaaggagaatctcttggagatagaatacaagatgccgagttaaatttgaatttagacaaacaacaaagaatcgcttagttcagcatgtccctcgtattgcaaacattatatgtttatctgaaattcaaattcaatcaggcaccctgtttttgtttttttttttcaaaatctgctattcttgggcaaatctgcaggctttaaaaaaaaactattaaacctctgctaaaatatattttcaaactttctcaaagatacagattttatggttaaaatatgatgcaggtcctgccttcctgcctacatcaatttgttcactcacctcgcccctatgccttacagatgcaggctggctccctagccagtgtgacttgtccgggacatttaaatacaaataatcaaagtaaatagttacgcgcactgactaaatctgatattttataacataaaatgaaaaggaattgttctcctgcaaaataacctttctcagcccttcctggggtattagaacaaaatacatgttacatctgtacacgagcacctacgttagtatgtgctttatatatatatacacataaaaaatacataatatatattaatatgtcttctatattttatatataatatatactatatatattatagtatatatactatatatactatagtatatatgctatatactattatataatataatagtatataatatgtaatagtatatatactatatataatatatagtatatattatatatctatgtataactatatattatatataatataatatatagtataatatgtatatattatataaatttataaatataaataaatatataaatttagatataaatatatattatataatatactataatatgctatattatatattatatataatatatattacatatacaataatatacaattatataatatactatattatgtggtatatactatattatataatatactataatagaaaatatataatatatagtatgtatactatctatactatatatactatataatatatagtatatgtatattttatatctataatatataaaatatgtataatatataaaaacatatatatactataatataaaaatatataatatatagtatattatatatattatatattatagtatatattatatatatatgttttaggtggagtctcactctgtcacccaggctggagcgccgtgacatgatctccggctcactgcaacctctgtctcccgggttcaagcgattcttgtgcctcagcctcccaagtagctgggattacaggcgtgcaccatgacgtccagctaattttctttgtgtttttagtctctactaacacggggtttttagtctctacaacacggggtttctccatgttggccaggctggtctcaaactcctgacctcaagtgatctgcctgcctcggcctcccaaagtgctgggattataggcgttagccaccacacctggcctacatttctttcttcctaggtgtaatcaggctaatttgcatgctcctcctcatttagtggctcatgggagggaactttccttctgttggccccaccagagcctgcgcctgtcttgcctctggagcaccccagagcacacggtagtgctgggctcagtacccgaggcatgaacacgtgttcagtaaatgaatcttcaggcactggttgatgcttcatgatgcaccttctaagttcattaatctcttcttgataaagcactacattctctcttgggttttgtaggtcagactcggctgcgatgactcacctttacacatcttcctttcttggcttgtttagggagtgtgtttgtacagccatggctcttgaccagggatggttttcctcccaggggacatgtagcaatgtctggagacatatttggttgtcatgacatggagaggtgctactggcattagtgagaagaggccaagggtactgctaaacatcccaccatgcccgaggcagccccgatgcccactgcgctggagtgggcaggcccaccatgctggctgtggcctgtctggtgaacaagctttggagccagcgttaaagctggcttctgtgcaggagcagtgggtgcaggagaccatccttcccctaagttgttgagcttgttggaggaggagggtagtatgtgtgaggatcccagggaggccggccctgagcgtggtggggcctggaggaggggcgggcaggagcggacgcgcttctggaccaccactctctctcccagccttgttggttccccacacggcattcagaatgggtctcccaccacagaaccctggccacgtcgccccctgcccaaatcccccactgggctgggagaccccaggtgacccagccccatacccacctcggcttcacccccttgggctcctcactcactctctccagcctcaccccctcgggctcctcactcacgctctccagcctcaccccctcgggctcctcactcacgctctccagcctcaccccctcgggctcctcactcacgctctccagcctcaccccctctggttcctcgctcactgtctccagcctcaccccttcaagctcctcactcactctggcctcacctcctctggttcctggctcactctctccagcctcacctcctctggttcctcggtcactctctccagcctcaccccctctggttcctcgctcactctctctggcctcacctcctctgattcctggctcactctctccagcttcaccccctccggttcctcgctcactatctccagtctcaacctctctggttcctggctcacttctccagcctcactggcctcttcactgtgctgacacacaccgtgtatttctcatgaacctggcatgtgccattccctctgccaggaacatttcctccccaaagcctcccatggctcactctgccctgtacactgtgccccactgtcatgtccctgccaccctgtcctaggttcttcctagtccttgccaccatcagacacagcactgtgcacccctgagctgatctccctcgccagtcagctcccagggtggtcgtgttctcattcaccgatgtgccccagcccctggcacacagtaggtgctcaataaacagttgctgaatgaattaatgaaaaaacaagttagttgttcaagcctgggacacagaacctacgttaggagaggaggacgaggcaaaggatgcttctatctcagtgtttccagatgggaagctcctctgtggccaccagggagaaggtcagtgtgtgtttcatcgacgtggaaatatgtctgcaatatattacgtaaagggcagagtgatatgaaacaggattgacggtgcagtcccaatcatgtggaatggcaccctgtctctgcgtcacgcgtgtgcgatggggccagcctcacaggtgtgggtgaacttagaagggccctgtgctgggtttgcttctgctgcccccaccttgaaatgatgaatcacttttgaacaagaggccccacattttcattttgcaccgggccttgcagattgtatagccggtgctggcgcctggggatggatgggaggtcgctgcccgcaaatgggctctgagcaagatgttccagggcctacgttcttctctgtgatttcctctgtttgcagtcatcaggtattgttttcagagccccctgtaccccaagaaaaagtcagataactgagttcagagtatttcagtccaatttcttccaaatgactatagtcaggcatttgacatttcaaggaataacagggacaaaaagacctagctgttggaagaagttgtcccctccccacccctggggtgctgacctccaagctcatgtgtaggtcccacccccttctggggagctttgaccctagttgagaactgactgtaaacccagacggaagggaggccttgggtgtgtttgcagcacgagagcttgtggttgtcgtggcagagaatgcaggctttggttttgacagaccagggttcgaatcttggccttgccgtggaccagctcaaaggccttcctcactcagagtcttgttcctcctttgcaaagtgaggttgcagcatctgccctggggctgtgttgaggatggggtgggccatgagctcccagtctgctgctggtgaggcaggcatttattgggtaaacagccagacactgcggtaggcatccttactgtttatttatacaaactgtccctctaaggcacagtgagtgggtcattcccacccctgttttgctttttagttttttaaaaaatgtgagatctaattttcctaacataaaactcaccatttcaaagagtgcaatttggtgattttttttttttttttttagtatattctcattgttgtgcagccatcccattgtctgattctagaacgtttccgtatcactccgaaatatcccttaagagccactctctgctcccccaacccctagctctaggcaaccagtaagctactttctgtttctatggatttacctgttccggacatttcatagaaataggatcattcaatgtgtggcttttgtatctggcttcttccatttcgtgtaacgagttgaaggtttgtccgtgttgtatcatggatcagaaaatgactcctttttatggcaaacaatattccactatatggattcaccatattttgtttatccattcatttgttaatggacatcgggttgtttccactttttggccatcataaataatgctgctgccaactcttgtgtacaagtttttcatgtgaacccgtgttttcagttctcgtgggtacacgcctaggagtggaattgttgggtcacgtgaagactacatattaaactttttttaggaattgccagtgtattttctgtatccctttgttgttgttgttgttgaaggtgaataagtgtctgctgtggtgttgttcagcctttaggttaaaaatctgaacctttttccaaacttggtgacaaaggggaagattccatacctgtcctcagagtacctgttccacgtcaggttccagatggctggcaccatgctccctgtccccaagtctctaggaaaggggcaagaacaacccaaaataccagttcagactaagaaatcgaagggtttttcatcttagtggctggggtgggaatgcgggcttcagggctggcttgatccagtgacttagcaatgtcaggagagacccggtctctgttctgccttctaccagggtggcctctttggaaacatggtcacctgtggttgccagatggtggctgtttctgtggctccatctatccctcctccctcaatcgtgtagagagagagagagagagagagagagagagagagagggcaggcttccttctggacactagagtgggaggcttcttttccagaaacctccaggatacttctccttcatttattggccagaatgggtcatgtgctcatccctgaactaatcactgtagccagaggattagttgccttttattaaaccacaggccccacctctaaggccagggtggaggctatgtaaggcacaactgccttaatgaaaatccggttggctatcacggaaaggggggacagatgagtctcatggcatcatccccattttacagatgaggaaattcaggccccagcatacaacttgcctctctcagcccacacaggctggttagtggcagatgcgggtttaaacacccttgagactcacttcttgcccctctgtcctgacatttctcagctgaggctgtggctccctggatgtggctgtcctgacagctgcccaaggcaagccagacaccttcactcagaggtacagagagactttttgcagcgcgtggatttaaggtatctggaacagcatcagcttttcaggccaggcatttttattttgccctaaaagccttctagtgggggaaacacaattcctaggggctcagctttaatggtttcttttatagaaccattcaaattatagatgggtgaactccgggaaaccccgctcaagaatgcaggaaagccaaacgttaaagggagttaaggtaaaatagcggcgggtgggggaaaatttgttcttttaaacactagttgttaaaaaaccaaagtgaaccccctggtgctgatctggtcctgggaggctgggtttcttgacttctggcccgtctgggggactccaggtgaagttaattccagatgtgaacaggcccatcgcttttgctggcctctgacccctcccatctaacttgggggcaccgtatctgcagaggctcagcctcccaactccccgtcatcctcacctgggttcagattctactttgttgcttccaagccgggtatccctgggcgggttattcagcctctctgagcttgtgctgtcatgagtaaaacaggctttgtttccactggatgctttatttttggctttgaaatactcatcacccccagacatggtattacatatatatttgccaatgacctcatcattgtcaaagccagtggatagatagtgtgttcttaggtccatctgcagagcaacggacacggagtttgctccctctattttcctcccctgttttccgggaccccataccctgttggtgtccccattcttcctgcccaagcgtcttccagatccttccttaccgggtactcctgcacagtctccgtttcattcccctgacctctcagtggaacacagaggccaccttcacattgcttgtcaggctgtacacactttccccaggcgagctcatccagtcttctggctttaaatgccatctctacactggggacacccaagcttacattactgtctggaccactgccctgagctagcatttattgagcacttagggtatgcaaagctctgtcctgagctagcatttattgagtacttagggtatgcaaagctctgccctgagctagcatttattgagcacttagggtatgcaaagctctgccctgagctagcatttattgagcacttagggtatgcaaagctctgccctgagctagcatttattgagtacttagggtatgcaaagctctgccctgagctagcatttattgagtacttagggtatgcaaagctctgccctgagctagcatttattgagcacttagggtgtgcaaagctgtgtcctgagccccagctgtgcattaagtgacagaggcagggctttgaacctgcctgggccctactccctccctcactagcccagagctcatctcttccaactgatcaattgatcaagcctaggccagacctctgctgcccacctgacaccttccttttggtgtcaagtagggatttcatacaatatctgctaaacgaaactgcattttgtcttccaccctctatttcccagcttatgctccattgcctcagtttccctaccttggtaaacagtccctcccttcttccaggggcttgggccaagagcatgccagtctcatgagactcccctttttctcacaccttttataatcccttcccaaattcagtcctaaatctgccaccttcctggtttggaggctgtgttcttgttattcgagacatcacctttgggggaaactggatgaagggcacttgggacctccctgtacatcgtctttcaacttcctgtgaatctataatcatttcacaacaaaaagttaaaaccaaaataaattctaaagattttaaaaatgaactcttgaggatctggccttttctcaccagcctccctccccactgccctgggtccagtctcacgtcacctcccacgtggaccattctgttgcctccacctggtctccctgcttccaggttgacccctgccatcggctctccaggggcagcctgagtggccttataaacaccactgaaagtcccaccccagtggttcttgcttcttgtagagcgccttggtgtcctgaccagggccctggatgcgaagtcccactcactgggtggcttgaaacaatagggctttattgtctcacagtctggaggcgagaagtctaaagtcaaggtgccacagggttgtcctcttacaaaggctctagggaggaatccctccttgcctcttctggcttcagaggctcctggcaatctttggcatttcatggcctctgtcttccccaggctgtctgcatctgtgtctttatgtggccttcttatggggacactagtcactggattaaggctcatcctaatccaggatgagcttattttaactgacgacagcacatctgcaaagaccctgcttccaaatgaggtcacatcctgaggctctgtgtgggtgtgaattttagaggacatcagcaacagaggacactgggctgaggcaggtgctcgtgttgcccataggacccgacctgactcgtgcccctactgcccctcccagttgtccctgctacttgcccctgccccttgaacacaccctccttgctcctgcctccgggcattcacctctgcagttccctctgcctggaatgcactcttcccaaacatccattgggccccctcactcactgttacccagatctctgctcagatggcccctatagtcattagggttgtttgcaattgttcccaccttccctggcacggagcaagattgccccccaactccctgaaattaggcagataccacgacctgctttggccaatggaatgtgagtggcacttatggggttcgctagcttgccaccttccgcacccctcagcctggttccccaccccttatatttcctgcctgccttccccacttgcatggaaacccagagaacaggatgttttcttggctgctttcgcagttgtgttccaagttccttaaacagtacctggcctagagtgagtactcaataaatacttactggatggaggaataaggagttcatgaatgaaccgggaggcatagcatctctgcagccctgtcccgctcgtggccctcctgtaactactcttctgtgcacttggctgcttcctgtccagggcagagcatcaaccccaagttggcgggcctgattgggcggcacgggccccagaacaagcagcccttcatggtggctttcttcaaggccacggaggtccacttccgcagcatccggtccacggggagcaaacagcgcagccagaaccgctccaagacgcccaagaaccaggaagccctgcggatggccaacgtggcaggtatgcttaggtgggagggatcacagacccaccacaggaacccagcagggccccggcgggacccggcaggagactgactcaaaatccattcaggtgctcaccagatggctctggaacaaatacagcaggaagaaaacccccaaatccacccctacacaggacatcttaattctgtaaaaataaactagcttagaaatgcaagtagcaaaacattcgtataacacaacaccaagcatgtagatatttaaataaacagaacaatggcggcacttgcagctacacagagatgaaggaagaccctgaaacatggatgggaagacccctggggggcttaccccatggaaggagggggaggaagaaatggggaggtagaagagtttgctgtatctttatttcataaatgaaaaatattttaaattcatggcaaactttaatacttgataaatattatatatatacacacacacacacatttttttttttttgagatgaagtctcactctgtcacccaggctgcagtgcagtggtgcgacctcggcttactgcaacttctgcctctcagattcaagtgattcttcagcctcagcctcccgagtagctgggactacaggtgtgcaccactgtgtccagctaatttttgtatttttagtagagacggggtttcaccatgtcggtcaggccggtctcaaactcctgacctcaagtgatccacctgccttggcctcccaaagtgctgggattacaggcgtgagccactgcacccggccaggtggtaggtgttttaagaatatatgatgtgcgatacttttcagtttgtttgaaatgtttatttacgataggttttaaaaaaattaaagataatatttttattgcaagcaaatcaaacattaacagtaaatataagtaaagttaacgcattgtgcgaaggagacttccaggaggtcgtgctctgcaggtcctctaaagcagacagcttttagcccatcatgttgtgtggttcttgaggctctgaggtagatggcctcccacttcacagaggggaaaactgaggctcaaagagggtaagtcgtttgtctaagggcacagtgtaggtaactggcagccctgggattgggtccctggggtctgggttgtcccttgccccaggccctcttccctgttgggcattgccggggccatctacctggcctggatgagcttcggtgtccccagcaatcccattgggtgctttctgacaattcaccaggcattcgtggagcccccacaggagcctggctttgtcccgggcactggggctgtggctggggtgcaatccctttccccataggctgattgggaaaccgacattgacagcctctggtggcctgggggtgctgggatccccagaaggtgcattctggttttgagctttggaggtgggctggcctggagcagccctgctggcaccgtgggcatctgtggacagccctcccacaccccttgcctggctcatgccccctgcacatgcagtgtcaagtccgccagaagatgcatcgggactcctcccagactaaaaccaaagcttcaaataatgaacctcacaacaaaccattttccagtggactggaggggtgacacctcccagatccaaggagcccagtttgctccccatccccaatcccatcccgccggccaggggagctgctgcccgggggtgccgtttctctggctcttcaggaagccatttgcaatgagcagggcaatagcctctccaagatgccagtgtcttaatctctggaacccgtgaatgtgtcaccctccagggcaaaggggagttacgactgcccttggaatcacaggtgctaatcagctggccttccaatacgcgggctctgtgtagcagggtggtcccatcagtccttataggagagagcctttttgagctgtggttggagccatgtaagcacagagcacagaggggtggagatgagtggggccaccagccctgggatgtgggtggcctggagaagctgcacaaggcaaggaagggatcctcccctagagcccccagttgcatttacctgctaagactggtgttggacttcagagccacagagctataatccgcttgtattgttttgataatttgcttggttaatttgttaaagcagcgataggaaagaatacatctttgttggcaaagtgattttctttttcttttttcttttcttttttttttttttagagacagggtctcacgccattgcccaggctggcgtgcagtggtgtgagcatggcttactgtagccttgacctcctgggctcaagcaatcctcctgcctgagcctcccaggtagctgggactatagatggatgccaccacacctggctattttttgtagagacagggcctccctatattgcctaggctggtgtcgagctcttgggctcaagctatccttccactttggcctcccaaagtaccgagattacaggcatgagctactgcccccagcctcctcagagtgcttccctcatcctgctaaggagctgggacacaaccatctgggggccggctcaggagttgcagccttcttggctccaggttgatcacaaggcagaaaaaggtctgaggtgcaaacctgccctgccaccatgtgggaagctattagctgcttatcacctccggggcctgcggttggtcccaggaagcacccaaggggagcaaggggctattgagaaaggtcctggcgaggggatagcagcagccccacccccaaattaaccctctagtgccaatagcttcttcctccttacctagcctagcttgaaatttatgttcattttacttttcaagggagaaggcaggtcagtggggttggtggcctttttaagacaaggcttcctgacccctggcgggtgtcctggggcccccggatggacctcagtgggtctgtgtggcccagagtgtgtagggattccgtatattttcttttctgacagtggatccatttttccaggtttctcaaaggggtctttgatctcccaagtcaaaaaccaaccaaattccttcatttgtattcgaagcctcttttatgctggactcttgaaggctaggattcaatgtcgaacacccacacaaaggctgcccttgggggtgttaatttaggacaggaaggagggggttgccattcacatccatacatagtaacagacccagagtcagggtggtgcctagggaacgcagcccatcccgagggctgcagacaacatttcgtggcgagcgagctgagagctctgggtccagtgggtgcccacgaggccaggctggtccggagaggatgctctgggctgtgggacctgcaggggcagaggcctgtgctgtggggtttcctggcgcctttggggagtggggaggaggctgtgggggctgaagcaggggaggggagtgagggtgggcgggtcaggcattctcttgggagtcacgtcttgagtttgaacttcatgccaagcatgttcagaagtctttgcagagattcaagctgtggtgtggggtgcaggtgataagatcattctggctgctctaagaaaggtgaggaacagggtgggtgccgagggggtgctcggaggccggagactccttagaggatgtggcagatcatccaggcaggaagtgtaggcaaactgcatcccggcagagacttccgtgtcttggagctccatcgggtgcacctgggtaatgagggggagaggaactaggcatcgcgggcttagaattcactctgattttccccaccgcctcctcatcaaagccccaccaagtctccatttacacagcccccaggacggggctctcactgtttcccgtggcagaaattcattgctgggaacctgcctccttcccgcggatggctcgtggccctgtttgcagctcttctaaaacctgcctggaagttaagaaaaaaataaaataaaaataccgaggcctgggccccaccctaggcttaggccagagtccttgagtgtgagtgtgtacgcctgtgtgcctgcccctttgaatcgctcgtccccccggttttgggctggagccctgccgtggagccacacaagttgaatctctcggcagccctgtgtgtgctggggcgggggcacatgctccggcacgctaccccacgcggagctcgctttcctgcccgccagccccctcccccggggcttcacgtgctcttcagatggtgcggtttggggttgagaaactgggtccctgcacttccttctccccacccacgtttggacccagctccctggtaagcagccgcctttgccagatgacccgtggaggcgggagctgagcctaagcaccagtcctgacttgtctgcggcccaagcagggggttgaggaggtggatgaatcccggtgctggcgtcagggctgtctcctgctcactttctgttgcttgggggcgggtggggcaggcttggacggacaggggagctgggagtccctccttcgtttcctttccttgttttcctgctaataagtcctaaggatacacaggagctccggccactttctgctgggacagccgtgatcaaagagccctggaagcacagagcagggtctggagtccctggtggcagggccagtgcccacgcctcactcgtacaccataactagcttcatgagctgtgctcggccttggtctgtttggccttgggtttgaactaagttatgccaaatgtcgtggctttactttaagacagggttggggaaagtagcactcaggccactccttgtcccttctgtgctcatgacagacattgctaatagatcatggcctctcctgtgctcatgacagacattgctaatagatcatgggacttccttctgacggagcctgaacacagcttcagaatcctccttgactcaggacaccaaggagtcagcaatgtccctggctcgagctagcagcttcacctgacacatccctgagctgaggggatgttccttctcctccaccctgccttctacccccccacagggaagagggaggaggctcgtggaggggcatggctacctgtggccctgggcattgccacagccatgaaggccatcttaggtttctgcttggcatcgtgtgctctagagggcaggctgtagagtccagctgtttgggctcctcccagatggttccttgaccttgaccttcctgtgttgaggacaccctggccctggggaggttcctgctgccccagagctggttctctctctcccagccctgctactcccccacggagggtggggaccaggggcctctgggctccccctggctgcctccatccactctgagcacccccttgcagcattgagccttggggctggttccagccacgcagatcttccctccgcccacactgtctgctgacccaggccccagcttcctcattccttgccaggctcagtgcctgcctctgatcctctatccgatgctactccagcggcctcagacatggagggcgcctcgtccccactgctcagcatcgtcatgcaggaatgcctcgcccttggatgcctccccaccctcctatctcacttccttttggttcttacccacatgtcacctcctcagaagagcgcctgctggcacccgcggcagcatgcccgctcactccagcttctcctgccttgttttcctctgtagccctcatctccgtgtaagtcatgtgcactcacttatctatgacccgcctctcgttctggaaaagcccctgagtggcagggctttgctgtcttacacctgggactcatctcatgcctgcacaccaggaagcagcccctagcaatggctgaatgaatgagtgactccacaaggcatgcaggccgcgagggcagggcacccaggggcaagcgctcctgccccaaagcctggagcccaccagccccgccccagccttcagcgagttcacttcaccgaaagtctcaagtgtctcctcaggaatcacacatgtgattcggttataatcaattaaatgtaatttcgttattggtgtgcatatctttccacattgcttttctgaactgtagataaattttatatctgtataaatagatatattcaaaaatggcattttgggaggccaaggcgggtggattacctgaggtcaggagtttgtgaccagcctggccaacatggtgaaaccccgtctctactaaaaatacaaaaattagctgggcatggtgatgagtgcctatagtctcagctactcaggaggctgaggcaggagaattgcttgaacccaggaggcagaggttgcagtgagccaagattgcaccactgtactccagcctgggcaacagagcaagactctgtctcaaaaaaaaaattgctgatgaaaataaaagcagcctgcttttcagtccccagcagggagcatggtgctcctgtctcagcctgagccttggaggccagttcctgactcctgtgctctccatgctgttctcctctctcctgcctccttcctcctcaaccctcttctttctcctttctgctttccactcttggcttgctgcttctagcccatttcattccacaattgttctcagccatggggtagctaaggcacactgaaggtttccaggaccaacagaatgtccagtctgtgtctgaggaggtgtcctaatttgcagtgtgtggtccatgggaggctagcttactgcaccactcctgtcccacccattttacagatgaagaaagtaaggcttagggaagggagttcggcgatgtccttcttatcttaccatttctcattatcctagaagctatgcagatagaattctcatgaatcagagaaaagccaaaaattgagtggtgttccactctttgacatataccctaatggcatgtagtgggtgtggaggaaagagccatgcattcaaacagttaacaggtgtgtgtgtgtgtgtgtgtgtgtgtgtgtgtgtgtgtgtgtgtgtgaatggagaatgtgcgtagtttcaaatttccctaacaagtgggctagaagaagaagaataaaatatgaaactgccatgaacactcaagcctaccccaggaggtataggagctctcttcattttgcaaaccaggagtccaagatctaggagagctggggtttgactccagagctagagcagtccccaagacctggtcttgactcacgagttagactccactcagaggctgactgtgctccagggtctacacctctaagggcgacacctgggctcaagcagactgccgttttctatatgggatgagccttcacagggcagccagttgggatgggttgaggtttggctgtagacatcagaaacccaagtcaaatgcgcttcaaccagtagaaaattcaccagcccgcagagctaaggttgggtggacattagggttggttgatccaggagctcaacagtgtcctctgagccccagctccttctgccccaccccaccatcttcagtgctgcttcctctcaaggccacagctgtagttggccaggggggcttcattattttttgctcctgggcagtaggaggaagagaatgaatgtctctccatgggtctttcttaggaatgtgggaactttttccagaagtctctatgtcttttagtttgtgttgggtcacttgcccttcctgaaccacttcctgactcctggacaggatgtgcactgatgagcttagctttggggatctaatagtgactttacaaagcctctttgagaaggtgacattggaaccaaggcttgagccagacacaacaaagattgcagggaggggcattgcaggtggaggaaacggcacatgcaagagccctgcggtgggagtgagcttggtgtttggtcaatcagttgtcagagcacaccgggccctgtgggccacaggcacagcctgggccctgctctgagtatgacagagagcccctgggaagttgtaggtggaggaaagacaggtcatgactaggaaaaaagcaatccctctgttgtggggtggaaggaaggttgcagtgtgtgtgagagagagacaagacagacagacagacacttctgcaatgtttacaagtgctcaggccctgacccgaatgcttccaaatttacgtagttctggaaaaccccctgtatcattttcactactcaaagaaacctcgggagtgttttcttctgaaaggtcatcaggttttgactctctgctgtctcatttcttcttgctggtggtggtgatggttgcttgtcccaggccctgtcccgcatcctcttgcccctgcagagggatgagtgtgttggggcctcacgagttgaggttgttcataagcagatctctttgagcagggcgcctgcagtggccttgtgtgaggtggatggggtttgattcccttatggaatccaggcagatgtcagcatttaaacaacacacgtgtataaaagaaaccagtgtccgcagaaggttccagaaagtattatgggataagactacatgagagaggaatggggcattggcacctcccttagtagggcctttgctgggggtagaaatgagttttaaggcagttagaccctcgaactggcttttgaatcgggaaatttaccccccagccgtctgtgcttcattgctgttcacatcactgcctaagatggagggaactttgatgtgtgtgtgtttctttctcctcactgggctctgcttcttcacttccttgtcaatgcagagaacagcagcagcgaccagaggcaggcctgtaagaagcacgagctgtatgtcagcttccgagacctgggctggcaggtaaggggctggctgggtctgtcttgggtgtgggccctctggcgtgggctcccacgaggcagcgggtctgtgctcagtcttgtttctcatctctgccagttaagactccagtatcaagtggcctcgctagggaaggggacttgggctaaggatacagggaggcctcatgaaatccgagagcagaaatgtggttgagacttgaacttgaaccaggaacccaaacactttggactctgaaccccattctctgcatgcacctcattcccatcccttggctggctgcttctcaagatgatgccgggccgtgtgtttgaatgtagatacctggggagccatctccccctctgccctctgacttcatttaccccattcccattcccacgggagggacggatctgcccagcttggttcaggcacttgttcctgaaccagtcaactgtttcaggggtggggtcatgttactggcacatggctgccccctctggagccatttgcatggagtgaggcaaaaggcaggggatgaatcctaggagaggagtgagggtcatgtgatccacctgccgtgagctctggtgtgattctcattcagcagtcatgcagcatctgcagcgttctgggccctgttctaggtactggattggagatgcagcgatgaacactgcaatgtgtctgccctgtggggctcaaatatccctggagagggtattgtcatgaggtcatcagggcaactggtggtattctaccctcagggagcttgtagttcagtgggagagtccagaatcttccctggggattatgcccagacacactcagggcgtacgtgcacacagccagctctgagccctcctgtgagcctgccctcaggactgatgaccacatccacctgcagctgggacagaacccaaactccaggggcctctgctggaagattccatgtgcttaagcatcactgaggagtatattgattattgggcaacatttctgtgccacccagaccctagaggcaaggatggcacatggatcccttactgaccagtgcacccggagccagcatgggtgatgccattatgagttattagcctctctggcaggtgggcaaaccgaggcatggaggtttgtttaaggtgaactgccagtgtgtgaccacctagtgggggtagagctgatgattgcctcacaccggaggctccttcctgtgccgcgttctgtccagaagacacagccatggatgtccattttaggatcagccaagccccgtggggctttccttcatttttattttatgtttttttagaaatggggtcttgctctgtcacccaggctggggtgcagtggtgtgatcatagctcaccgcagctttgagccgtcttcccactcagtctactaagcttggactataggccaagactatagagtggtccttctttccattcttttgggaccatgagaggccacccatgtttcctgcccctgctgggccccctgctgctcagaaggcatggtctgaggcttccaccttgggtcgtgagcctggcgtggtggtttctggccagcatgggggttgggatgctgtggctcaggccttctgcatggtttcccacactctcttctcctcctcaggactggatcatcgcgcctgaaggctacgccgcctactactgtgagggggagtgtgccttccctctgaactcctacatgaacgccaccaaccacgccatcgtgcagacgctggtgggtgtcacgccatcttggggtgtggtcacctgggccgggcaggctgtggggccaccagatcctgctgcctccaagctggggcctgagtagatgtcagcccattgccatgtcatgacttttgggggccccttgcgccgttaaaaaaaaatcaaaaattgtactttatgactggtttggtataaagaggagtataatcttcgaccctggagttcatttatttctcctaatttttaaagtaactaaaagttgtatgggctcctttgaggatgcttgtagtattgtgggtgctggttacggtgcctaagagcactgggccctgcttcattttccagtagaggaaacaggtaaacagatgagaaatttcagtgaggggcacagtgatcagaagctggccagcaggataatgggatggagagatgagtggggacccatggggccatttcaagttaaatttcagtggggtcaccaggaagattccatgtgataatgagattaacgtgcccagcacgtggcgacactcagtaggtgttattcctgctctgccaacagcaaccatagtgataagagctgtagggattttgttcttttgcttagaatccaaggttcaaggaccttggttatgtagctccctgtcatgaacatcatctgagcctttcctgcgtactgatcatccaccctgccttgaatgcttctagtgacagagagctcactaccaggactactccctcctttcatttagtaatctgcctccttcttttcttgtccctgtcctgtgtgttaagtcctggagaaaaatctcatctatccctttcatttgattctgctctttgagggcaggggtttttgtttctttgtttgtttttttaagtgttggttttccaaagcccttgctcccctcctcaattgtaaacttcaaagccctacttgggattgaaggtccttaggctggaaacagaagagtcctccccaacctgttccctggcctggatgtgctgtgctgtgccagtatcccctggaaggtgccaggcatgtctccccggctgccaggggacacatctctatccttctccaacccctgccttcatggcccatggaacaggagtgccatcgccctgtgtgcacctacttccatcagtatttcaccagagatctgcaggatcaaagtgaattctccagggattgtgaaatgatgcgattgtggtcatgtttaaaagggggcaactgtcttctagagagtcctgatgaaatgcttccagaggaaatgagctgatggctggaatttgctttaaaatcattcaaggtggagcaggtggggaagggtatggatgtgtaagagtttgaaattgtccatcataaaatgtgtaaaaagcatgctggcctatgtcagcagtcacagcctggaggctgtgaacagagtgccagtcactgatgctcttgcctggcacctacagttgctggaaacccagaagtttcacgttgaaaacaacaggacagtggaatctctggcctgtcttgaacacgtggcagatctgctaacactgatcttggttggctgccgtcagcttaggttgagtggcggcctcttcccttagtttgccttagtccccactattccctattgtcttacctcggtctattttgcttatcagtggcactcacgtggcactcataggcatttgagtctatgtgtccctgtcccacatcctctgtaaggtgcagagaagtccatgagcaagatggagcacttctagtgggtccaagtcagggacactattcagcaatctacagtgcacagggcagttccccaacagagaattacctggtcctgaatgtcggatctggccccttccttccccactgtataatgtgaaaacctctatgctttggttcccttgtctgcaaaacagggataatcccagaactgagttgtccatgtaaagtgcttagaacagggagtgcttggcttggggagtgtcacctgcagtcattcattatgcccagacaggatgtttctttatagaaacgtggaggccagttagaacgactcaccgcttctcaccactgcccatgttttggtgtgtgtttcaggtccacttcatcaacccggaaacggtgcccaagccctgctgtgcgcccacgcagctcaatgccatctccgtcctctacttcgatgacagctccaacgtcatcctgaagaaatacagaaacatggtggtccgggcctgtggctgccactagctcctccgagaattcagaccctttggggccaagtttttctggatcctccattgctcgccttggccaggaaccagcagaccaactgccttttgtgagaccttcccctccctatccccaactttaaaggtgtgagagtattaggaaacatgagcagcatatggcttttgatcagtttttcagtggcagcatccaatgaacaagatcctacaagctgtgcaggcaaaacctagcaggaaaaaaaaacaacgcataaagaaaaatggccgggccaggtcattggctgggaagtctcagccatgcacggactcgtttccagaggtaattatgagcgcctaccagccaggccacccagccgtgggaggaagggggcgtggcaaggggtgggcacattggtgtctgtgcgaaaggaaaattgacccggaagttcctgtaataaatgtcacaataaaacgaatgaatgaaaatggttaggacgttacagatatattttcctaaacaatttatccccatttctcggtttatcctgatgcgtaaacagaagctgtgtcaagtggagggcggggaggtccctctccattccctacagttttcatcctgaggcttgcagaggcccagtgtttaccgaggtttgcccaaatccaagatctagtgggaggggaaagagcaaatgtctgctccgaggagggcggtgtgttgatctttggaggaaaaatatgttctgttgttcagctggatttgccgtggcagaaatgaaactaggtgtgtgaaatacccgcagacatttgggattggcttttcacctcgccccagtggtagtaaatccatgtgaaattgcagaggggacaaggacagcaagtaggatggaacttgcaactcaaccctgttgttaagaagcaccaatgggccgggcacagtagctcccacctgtaatcccagcactttgggaggctgaggtgggcggatcatttgaggtcaggagttcgagaccagcctggccaacatggtgaaaccccatctctactaaaaatacaaaaattagccgggcatggtggcacgcacctgtaatcccagctactctggaggctgaggcaggagaattgcttgaaccccagaggtggaggttgcagtgagccaagatcgtcccactgcactccagcttgggtgacaaaacaagactccatctcaaaagaaaaaaaaaacagcaccaatgaagcctagttctccacgggagtggggtgagcaggagcactgcacatcgccccagtggaccctctggtctttgtctgcagtggcattccaaggctgggccctggcaagggcacccgtggctgtctcttcatttgcagaccctgatcagaagtctctgcaaacaaatttgctccttgaattaagggggagatggcataataggaggtctgatgggtgcaggatgtgctggacttacattgcaaatagaagccttgttgagggtgacatcctaaccaagtgtcccgatttggaggtggcatttctgacgtggctcttggtgtaagcctgccttgccttggctggtgagtcccataaatagtatgcactcagcctccggccacaaacacaaggcctcggggagggctagactgtctgcaaacgttttctgcatctgtaaagaaaacaaggtgatcgaaaactgtggccatgtggaacccggtcttgtgggggactgtttctccatcttgactcagacagttcctggaaacaccggggctctgtttttattttctttgatgtttttcttctttagtagcttgggctgcagcctccactctctagtcactggggaggagtattttttgttatgtttggtttcatttgctggcagagctggggctttttgtgtgatccctcttggtgtgagttttctgacccaaccagcctctggttagcatcatttgtacatttaaacctgtaaatagttgttacaaagcaaagagattatttatttccatccaaagctcttttgaacacccccccccctttaatccctcgttcaggacgatgagcttgctttccttcaacctgtttgttttcttatttaagactatttattaatggttggaccaatgtactcacagctgttgcgtcgagcagtccttagtgaaaattctgtataaatagacaaaatgaaaagggtttgaccttgcaataaaaggagacgtttggttctggctctttggcctgtgtctgtctgtgtgtgttgtgtttttctctcagttcttggacactgaagttctctcacactgctaagagctccctgccttcgtctccaccgtgaacgctctgtttagcatccaggccttgcggggaagtggccgctcgtcaatatttggtgcagctgtgtggggctccgggcaggagagatggaaccaagcaacacatgtgaatttggtaggctcgactacaaaggtccttgattgaattacagtgcagctgtcagcagctgtttcaaagaggcagggggtaaattagctgtgtttactgctaacatagttgaaagatttagtcatcccaataaaatagaggcaccatagagagaaaaagggcaggaggtgcacgcccaaaactttaaagcggtgccggccccagagctgacactgtccagtgcaaatgattggggcagttgctggagcgcgactgtggacgtggatggcccccagcaggcctggcgaaggcggccagggcccagtgtctcgccgagcatggagcagcactcggctgcgtagcgtggagcagcagtttggacgcctttcctctttgaagtgcacactcaggtcacctgatggctgttgttggaatcccagcctgatacttggacaggccgcccattcttcccctattgcctggaataaagcggctgctcctaacaagtcccagtccttgtgatttccagaccctcccgccattgtccggacaagcagtttagcgtttgttccattttccaggctgaaggccagagccacacactggaggtctagatgtggcctgcacacgggtcttattcccctggcatggtggtgtttatccatgtcttaaaatgtggattcgttgccaacatgtttttgaatatcagaagatgagggtgaagaaaaactccccaaatctggcttctcctgagaatcggcaggcctggccactctgggccccacacacacatggctgctctgggtggctgcagagggacagctggtgcccagtctccactgctccctattgcctctcttacaaaagggtgaatgtcagttgctgtttttaaaattgtagatgcgtatttatgtgcatccatgtccctaatgtccctattaagagcaggatagtagaggctagcctgggagagccgggcactttggaaaggacaaacattctttcgttaccgctgtcccactttcccttttggccctctgggcaggccctacaggcacgtgcgtctgtggctatagcaccacaaatggcctcacctttcctcttcatcttcccccctcctggtttaccacctctcttgctcattttccccctggagcgttttctcgttgcctctcttctcagtcccgctcactgtcaggcacagagaggtgaaggaatttactcaaagtccccagctaatagttactggaactgaaatttaaacctcaaaacctgggctcaaccccaggctttcctgagctggaatctcccagggctgctggagaaacatggggattcctggcctgcagctccgagcctgccagtgtccgtccgccatcctgtgtgttgggccctgacgactgagttcctggaccattgctcagggctcggtctccctcctgcttccagactgcctgagggccttcctctgtgcgcaccaacgctgagtgttagcttctctggtgggtggggccgatggccagcctgctgtaccgtggacgctgcacacgggtagtcctttccctctgtcttctcctccatcgcctggtgacaatagtgtgtggaccgtgctggggggctgggagggttagcagtggtcaccggggccatctacagagtggattctcacaggcatgttttgagtcctgccctctgttcagatcttttggagacagtgagcatgtgagtttcctggggctgccataagaaatcactacaaactgctggcttaaaacagcacagattcattcctgtggctctggagggcagacgtccaaaatccaggtgtcagcagggctgtgcttcctctggaggctctcggggaggacccttcccagcctcttccagcctctagtggctccaggtgttcctgggcccgtggctgcatcatcccaatctctgcctctgtctacccatggccttctccatcgctccactgtgtgcctttttttttttgagacggagtctcgctctgttgcccaggctggagtgcagtggtgcgatctcggctcactgccagctccgcctcctgggttcacgccattctcctgcctcagcctcccgagtagctggggactacaggctcccgccatgacgcccggctaattttttgtatttttagtagaaacggggtttcactgtgttagccaggatggtctcaatctcctgaccttgtgacccactcgcctcggcctcccaaagtgctgggattacaggcatgggccaccgcacccggccctctgtgtggctttgataaggacacctgtcattggatttagggtccacccagataacacaggatgacctcctcctctagatacttcataatatctgtgaagatctagatacttaatatctgtgaagaccctctctccaagtaagggcacattcacaggttgcagggattcagatgtgggcatatcttttttgaggccaccattcaatccaccacaagaccctctccctttcccaccacagggttctcaggccccacagagcttctccgtccagcctcagttggtcctcactgttcctggttggtgccactgctgccgcccatgctgggcagagtgaactctggagctcctacggctggaactcaacctcagcttcccaccagctccaacccttctcatgtgcactgctgggggcactctctgcaagggggctggcagctggacgggggctccaggccagagtcccccatccaggagcaggtggccataaataaggatgaccacggtggcttggggcagccaaagtgcgatgcgatgccctttctaggagcagggtgggctctggggacagcacgagcttcctctttggccggaagtgttcattcttcatctgctcactcactaattcatcgtgtgtccaccgtacaccaggcaccatggcgggcagtgggtacaggtaacagaacagaagtctgcgctcacgggagtgggtcctgatcaggggatacagcaaacaaacaggacccagccccatgccagcatggctgtggtccctcctccatccagaaataagacaaattgttgtttttgactgtgttggcatcaaggtgaatatcatccaggaatagttacattcatttgttctgactttgaaagacattaaaatatgtttgtggccccgaaagtcccatgggcctagtcactgtgcctaccgtgtttagtggagaagccagacctgatcgagccatttaatgccaaggaatgacgtgtgtcgggaagccacagcatgtagggggacagggaggacagggtggtcagggacagaccctgaggaaggccctttcagctgagacctgaatgcaggcaacgtgggctgacagggatggaggtactgcagggaagaggtcttccacctgagggaggagtgtgtgcaaaggccctggggtggcaggcgggaggaacagcgagaaggccacgtggctgcggcacagggaggcaggcaggacgttagcagagaaggagcaggctggttgtgcatggcattgaggaccacagagggaccctgggcttcatccaaagtgcactgggggccattggaaatgcagataccaggggaagccacggtggggagggttaagggtacctggaggaagcagggttccagtcccaccttgcaccaatcaagctgctgccccttcctcctcctcgtcctgggaggttgctctgcagagactggccgtgggatgggcgcacaagcccactctgtctggtgtttagagcgggaagtggcacccagtcaaggttgcatgtggaggtggctgagaggacaaacactcacttcccctggggaagacatctgctgccttcttatttatctgggacaaaggagaattctcatgccaccaggcaagaggcagcacgtgctgggcagaggggccgggattggctccagctcagagcccaacccagttacttagtcagctgtgagacctccatctgggcaacttatcaccttctctgtgcctcagttccttcatctgtgacatgggtatggtgcctacctatacttaggatacttaagagcagctgcatataacagaaaaaccccaaataatagtggcttaaagaagataaaagtttttctctcatctgaaagtctgaaggtcagccatccaaagacagggtggtagttgtcttactctgcccctaaggatctaggcttctaattttctgctctgccatcttaattcatggcttcatcctcacaacctacctcatggtccaagatggctgctggagcaccagtcagatctgttgtattagtctgctctcatgctgctgataaagacatacccgagcctgggaaatttacaaaagaaagagatttaagggactttcagctccacatggctgggaaggcctcaaaatcatggcaggaggcaaggaggagcaagtcacatcttacatgaatggcagcagagagagcttgtgcagggaaactcccgtttttaaaaccattggatctcatgagactcattcactatcacaagaacagtgcaggaaagacccactcccgtaattcaatcacctcccaccgagttcctcccacgacacgtgggaattgtgggagttacaattgaagatgagatttgggtggggacacagccagaccatatcatctgtgttctaggttcgtgtgctttctttaagcagccaacccagagatcagacgcaaaaggtccacttacctctcatttagcacaaatgcagtcacacttagctacaagggagactgggaactataggtttttattctgggtgacactaggcacagccaaaaatcagaagtccaagtcctattaccagcagaattttaaagactctggtaattggcaattacctatctgtattagtttcctatgattgtaacagttatgatggacttaagtggtttaaaacatcacccatttattctcaaaatttccatgggtcaggagtgcaagtatggcctcgctgggttctctgcttaggatcccacaaaagctaaatgcaagatgtcagctctgtgttcttatctgcagctcagggtctttgtccaagctcattcaggttttggccaaactcagtctctcggaattgtaggactgaggcccccatcttcatgctggctgtcagccaagtcacttccagctcctgaggcttctctcagttcctttccatgtggccctcttgcaacttggcagcgaatccttcaaagccagtgggagaatatctcttacttcttgcaagggctcacctgatgagtccttcaaaagctagtgggacaatatctcttacttcttgtaagggctcacctgatgaggtcagacccacccaggatcatctcctattgcttaactccaagtcaattgattagggaccttaattacatgggcagaatcccttcattttggggagcaatagccaccatattcattcaaggggtggagattatatggagggcagaaatctttgaggccctcttagaattctgcttcccacagtacctaagctacaccacacacggcaggttgcgctaagaataaagtatctggtacagaggaggtgcaaaataaaacaacagggactgcagtggaatccaggggcctcccactaagaatccccccaccccatccgatgatttcaacaatttgagacctgagttttatgtgcttggcgttattatctgtaggccctcaattctttatagagtcacttgtcaccccagttatcctacatgtgcctgggaaggaggatgggatgactggtctgaatctttgcaaaagacagtaaaagcttctgagccctccctctgagccaaggacccttctcaaggcataacaagtgcttcacacttgatctcactcactgaacgctcacaaacctgagagctgcgccacagactgcctttgcgcccctatagaccaaatgggacctttaaacgtttgctgggctgggtcctcacaaccccagggggagttgttcacacaagcgtcagtggaaacaactcctccagggtggggcagtgcagagggggccctggccagccctagtctggggcatctgatggcaggaccaaccctccctcacaggacccagcccttgtcagggcccagcccacactggggttggtgcccgtctatccctgacaaggacactcacagtgacctccttcggacatgtttttcttcttgcctgtggatcaattcctcctggctcagacccctccaggactctggcactgatctctcttggtctcggatttgaggaaataaaaatagaagaggaaaaacacagaactctccaaagctttggagtggctgcagccatctggatggaggcagcatgcgcctgggctggaagagccacggtcccttgactgagtctcggtgcttctccccgtccctctcagacacggttctcatggtggacgagatggggccggatcttaggcccgggattctgcagaatgcaaggctcagagcttgcctagctctgagtggcttggagactggtgtgaggactgagggtgtccacagatcaccaacccacaccggcagcctgagttggaagacaggtacgaactactggccggccaagagtccctcaggttctgtgcgcaggagggcctggagtttggtttcatgcttttgttcttgctgtcgtgaatttattcataccttttgaacaagggccccgcattttcattttgccctgggccgcgcagattctctagctggtcctgtgcccaaaggacagagcaaggactcagagtccaattcggcgtctgccacgttcatcattcaacaagtccgtcttgagcacctgcgagctgcaggcagtgttctgggcagagggatatgctggggtcaggagggaggggtgcccgggctctggagtcagtggggaggaagcccaggctctggggtcaggaggaaggaggctccgggctctggggtgacatgtccccctgcctggacaggctcctgagtgcatcatcaaggaaaccctcaggcaatggcaggtgtcaggtagaagattaacaaagtaggctgggcaaggtggcttacgccagtaatcccagcactttgggaggctgaggcgggcagatcacctgaggtcaggagtttgagaccagcctggccaacatggtgaaaccccgtctctgctaaaaatataaaaattagctgggtattgtggtgcatgcctgtaatcccagctactcgggaggatgaggcacgagaatctcttgaatccgggaggcggaggttgcaatcaatgagccaagattgcgccattgcactccagcctggacaacaagagcgaaactctctcaaaaaccaaaaccaaaaccaaaacaaaaacaaagtagcctgggcaacatagtgaaaccccattctacaaaaaatacaaaggttagccgagtgtggtggcatgtatctgtaatcccctccacttgggaggctgagaggtaaggatcattggtcctcaaggctgcagtgaaatgtgattatgccactgcactccagcctgggcaacaaggtaagaccctgtctcaaaaaaacaaaaacaaaacaaaacaaaaggattaacaaagaatccctgtaggaaacaaaattggctcaaattaggaccaactgaaggcggaaggtggaagggaaggggctgggacgtgtacaaagttgtgtaaggcggagtgcatggaatccatgtaaaatgcccccaagcctaaagggatgagggagacactgaggctaagagccagaggagacccttcctggggaaaggcagtgaagctggagaggagaagtcagccttgccactagtgacgttagggtttggagcactgtttgtgtggggccatcctgtgcattgtaaagtgttcagcagcagccctggcttctacctgccagataccagtaacatcccccagacattgccacgtgtcccctgggggacacagttacccgcagttgagaaccactgcatcagaaaagctggagtcagacaatgaggctggagcctgaggcctggggcgaagccgggggtttcgagggttggggtccacttactcaaggatcttcaggtggacaagtgaaggagctggggttgagccctgtcctgcctcctggagaccccagtgacatccagcctgctgggctggccatcatgagcctatggtctgccagcgtctgcctccttatgagagccgcagggacctgcgggaggctaggaaggggcatggagagctgcgaatttattgaagggaaactcctgtaacaaatactgccaccggacaaaggaccttgtgtgtctttttaaaggaacaatttggagcttttctgagctgcgtgaccacgggcacatcacgtagctccttgaagccttagtttcctcttctgtaaaatgggcacagtcatgataaccttctaggttgctggggtcattcattaagttgatgtcagcagagcatttatcacagagctggcttattgaagctgccatcgtgatctgatgacatttagggtcctctgcttaaagccctccaagggctcccccctcactcgggtaaaatcaccagaaaggccatgcaggacacacccccgctcctgctggcattaggtctgccccctccaccccggtcttcatttcctatgactgctgtaatacatgactgcagacttagtgccttagaatgacacatatttattcttttaaggtcagacgtctcggaagagctggcttattcgggaagctccgaggaaccttgccttgtccagccttttgggcacccccactctttagctcacagtcgctccctccatcttcacagccagcactgaagcattccccactcgctctcattcagacctctgctcccaacagtcttgtcatctctctctctgaccgtctcacggaaaccctgtgatgacatggggctcacccacatatttcaggatagtctgctcatctcaagatcctgaactccatcgcacctgcaaagtcttttgtgcaaggtgtgatagaatcaaaaataaatatttggtcctgccacagagtttccaaaacccttggaatcccctcagcgggctgatgggagcatcgattgtcattcagaccaatcctctcctgaccatacctgagtttatgctaattaggtaacccttgaatggccaatggaatcaaccctccagagcgaaactctgtctcgaaaaaaaaaaaaaagaaagaaagaaagaaaaaagaaatgctgattagagggttagaactttcagccccacctcctgaccctggggaggggagagaggctgaaggttgatctaatcaccaatggcgaaagatttaatcagtcatgcatacccctccctgaaagaaggggttcagagagcttccaggttggtgaatgcgggttgattctgggaccaggaatgctgtttctgcagacagctgcagggctattccctaggcttcttgaggtctttgtccaaagtcacctttctcagagtcttctgacccctgttgacccctgagtctcctcctgaccatctcttttcccctgtcacttgctttctctccttaatactgattgtcacccaacgatggaatgccttacagaagactagagagcagcaactttgtctattttggtcactgtgtgtccccagttcccagcacagtgtttggcacacagcagagcttatttgacatgttttgatgaataaatgtcattgttgttaccaacaggctggaaatcaggacacgtgggctctgcccctcacagtt

SEQ ID NO: 170 - DNA, 1986 bp, Homo sapiens
gagcgctcgcccgcccgcctgcctcctcgctgcctccccggcgttggctctctggactcctaggcttgctggctgctcctcccacccgcgcccgcctcctcactcgccttttcgttcgccggggctgctttccaagccctgcggtgcgcccgggcgagtgcggggcgaggggcccggggccagcaccgagcagggggcgggggtccgggcagagcgcggccggccggggaggggccatgtctggcgcgggcgcagcggggcccgtctgcagcaagtgaccgagcggcgcggacggccgcctgccccctctgccacctggggcggtgcgggcccggagcccggagcccgggtagcgcgtagagccggcgcgatgcacgtgcgctcactgcgagctgcggcgccgcacagcttcgtggcgctctgggcacccctgttcctgctgcgctccgccctggccgacttcagcctggacaacgaggtgcactcgagcttcatccaccggcgcctccgcagccaggagcggcgggagatgcagcgcgagatcctctccattttgggcttgccccaccgcccgcgcccgcacctccagggcaagcacaactcggcacccatgttcatgctggacctgtacaacgccatggcggtggaggagggcggcgggcccggcggccagggcttctcctacccctacaaggccgtcttcagtacccagggcccccctctggccagcctgcaagatagccatttcctcaccgacgccgacatggtcatgagcttcgtcaacctcgtggaacatgacaaggaattcttccacccacgctaccaccatcgagagttccggtttgatctttccaagatcccagaaggggaagctgtcacggcagccgaattccggatctacaaggactacatccgggaacgcttcgacaatgagacgttccggatcagcgtttatcaggtgctccaggagcacttgggcagggaatcggatctcttcctgctcgacagccgtaccctctgggcctcggaggagggctggctggtgtttgacatcacagccaccagcaaccactgggtggtcaatccgcggcacaacctgggcctgcagctctcggtggagacgctggatgggcagagcatcaaccccaagttggcgggcctgattgggcggcacgggccccagaacaagcagcccttcatggtggctttcttcaaggccacggaggtccacttccgcagcatccggtccacggggagcaaacagcgcagccagaaccgctccaagacgcccaagaaccaggaagccctgcggatggccaacgtggcagagaacagcagcagcgaccagaggcaggcctgtaagaagcacgagctgtatgtcagcttccgagacctgggctggcaggactggatcatcgcgcctgaaggctacgccgcctactactgtgagggggagtgtgccttccctctgaactcctacatgaacgccaccaaccacgccatcgtgcagacgctggtccacttcatcaacccggaaacggtgcccaagccctgctgtgcgcccacgcagctcaatgccatctccgtcctctacttcgatgacagctccaacgtcatcctgaagaaatacagaaacatggtggtccgggcctgtggctgccactagctcctccgagaattcagaccctttggggccaagtttttctggatcctccattgctcgccttggccaggaaccagcagaccaactgccttttgtgagaccttcccctccctatccccaatttaatccctcgttcaggacgatgagcttgctttccttcaacctgtttgttttcttatttaagactatttattaatggttggaccaatgtactcacagctgttgcgtcgagcagtccttagtgaaaattctgtataaatagacaaaatgaaaagggtttgaccttgcaataaaaggagacgtttggttctggctctttggcc

SEQ ID NO: 171 - protein, 427 aa, Homo sapiens
MHVRSLRAAAPHSFVWAPLFLLRSADFSLDNEVHSSFIHRRLRSQERREMQREILSILGLPHRPRPHLQGKHNSAPMFMLDLYNAMAVEEGGGPGGQGFSYPYKAVFSTQGPPLASLQDSHFLTDADMVMSFVNLVEHDKEFFHPRYHHREFRFDLSKIPEGEAVTAAEFRIYKDYIRERFDNETFRISVYQVLQEHLGRESDLFLLDSRTLWASEEGWLVFDITATSNHWVVNPRHNLGLQLSVETLDGQSINPKLAGLIGRHGPQNKQPFMVAFFKATEVHFRSIRSTGSKQRSQNRSKTPKNQEALRMANVAENSSSDQRQACKKHELYVSFRDLGWQDWIIAPEGYAAYYCEGECAFPLNSYMNATNHAIVQTLVHFINPETVPKPCCAPTQLNAISVLYFDDSSNVILKKYRNMVVRACGCH

SEQ ID NO: 172 - DNA, 2243 bp, Homo sapiens
gagcgctcgcccgcccgcctgcctcctcgctgcctccccggcgttggctctctggactcctaggcttgctggctgctcctcccacccgcgcccgcctcctcactcgccttttcgttcgccggggctgctttccaagccctgcggtgcgcccgggcgagtgcggggcgaggggcccggggccagcaccgagcagggggcgggggtccgggcagagcgcggccggccggggaggggccatgtctggcgcgggcgcagcggggcccgtctgcagcaagtgaccgagcggcgcggacggccgcctgccccctctgccacctggggcggtgcgggcccggagcccggagcccgggtagcgcgtagagccggcgcgatgcacgtgcgctcactgcgagctgcggcgccgcacagcttcgtggcgctctgggcacccctgttcctgctgcgctccgccctggccgacttcagcctggacaacgaggtgcactcgagcttcatccaccggcgcctccgcagccaggagcggcgggagatgcagcgcgagatcctctccattttgggcttgccccaccgcccgcgcccgcacctccagggcaagcacaactcggcacccatgttcatgctggacctgtacaacgccatggcggtggaggagggcggcgggcccggcggccagggcttctcctacccctacaaggccgtcttcagtacccagggcccccctctggccagcctgcaagatagccatttcctcaccgacgccgacatggtcatgagcttcgtcaacctcgtggaacatgacaaggaattcttccacccacgctaccaccatcgagagttccggtttgatctttccaagatcccagaaggggaagctgtcacggcagccgaattccggatctacaaggactacatccgggaacgcttcgacaatgagacgttccggatcagcgtttatcaggtgctccaggagcacttgggcagggaatcggatctcttcctgctcgacagccgtaccctctgggcctcggaggagggctggctggtgtttgacatcacagccaccagcaaccactgggtggtcaatccgcggcacaacctgggcctgcagctctcggtggagacgctggatgggcagagcatcaaccccaagttggcgggcctgattgggcggcacgggccccagaacaagcagcccttcatggtggctttcttcaaggccacggaggtccacttccgcagcatccggtccacggggagcaaacagcgcagccagaaccgctccaagacgcccaagaaccaggaagccctgcggatggccaacgtggcagagaacagcagcagcgaccagaggcaggcctgtaagaagcacgagctgtatgtcagcttccgagacctgggctggcaggactggatcatcgcgcctgaaggctacgccgcctactactgtgagggggagtgtgccttccctctgaactcctacatgaacgccaccaaccacgccatcgtgcagacgctggtgggtgtcacgccatcttggggtgtggtcacctgggccgggcaggctgtggggccaccagatcctgctgcctccaagctggggcctgagtagatgtcagcccattgccatgtcatgacttttgggggccccttgcgccgttaaaaaaaaatcaaaaattgtactttatgactggtttggtataaagaggagtataatcttcgaccctggagttcatttatttctcctaatttttaaagtaactaaaagttgtatgggctcctttgaggatgcttgtagtattgtgggtgctggttacggtgcctaagagcactgggccctgcttcattttccagtagaggaaacaggtaaacagatgagaaatttcagtgaggggcacagtgatcagaagctggccagcaggataatgggatggagagatgagtggggacccatggggccatttcaagttaaatttcagtggggtcaccaggaagattccatgtgataatgagattaacgtgcccagcacgtggcgacactcagtaggtgttattcctgctctgccaacagcaaccatagtgataagagctgtagggattttgttcttttgcttagaatccaaggttcaaggaccttggttatgtagctccctgtcatgaacatcatctgagcctttcctgcgtactgatcatccaccctgccttgaatgcttctagtgacagagagctcactaccaggactactc

SEQ ID NO: 173 - protein, 408 aa, Homo sapiens
MHVRSLRAAAPHSFVWAPLFLLRSADFSLDNEVHSSFIHRRLRSQERREMQREILSILGLPHRPRPHLQGKHNSAPMFMLDLYNAMAVEEGGGPGGQGFSYPYKAVFSTQGPPLASLQDSHFLTDADMVMSFVNLVEHDKEFFHPRYHHREFRFDLSKIPEGEAVTAAEFRIYKDYIRERFDNETFRISVYQVLQEHLGRESDLFLLDSRTLWASEEGWLVFDITATSNHWVVNPRHNLGLQLSVETLDGQSINPKLAGLIGRHGPQNKQPFMVAFFKATEVHFRSIRSTGSKQRSQNRSKTPKNQEALRMANVAENSSSDQRQACKKHELYVSFRDLGWQDWIIAPEGYAAYYCEGECAFPLNSYMNATNHAIVQTLVGVTPSWGVVTWAGQAVGPPDPAASKLGPE

SEQ ID NO: 174 - DNA, 2546 bp, Homo sapiens
gagcgctcgcccgcccgcctgcctcctcgctgcctccccggcgttggctctctggactcctaggcttgctggctgctcctcccacccgcgcccgcctcctcactcgccttttcgttcgccggggctgctttccaagccctgcggtgcgcccgggcgagtgcggggcgaggggcccggggccagcaccgagcagggggcgggggtccgggcagagcgcggccggccggggaggggccatgtctggcgcgggcgcagcggggcccgtctgcagcaagtgaccgagcggcgcggacggccgcctgccccctctgccacctggggcggtgcgggcccggagcccggagcccgggtagcgcgtagagccggcgcgatgcacgtgcgctcactgcgagctgcggcgccgcacagcttcgtggcgctctgggcacccctgttcctgctgcgctccgccctggccgacttcagcctggacaacgaggtgcactcgagcttcatccaccggcgcctccgcagccaggagcggcgggagatgcagcgcgagatcctctccattttgggcttgccccaccgcccgcgcccgcacctccagggcaagcacaactcggcacccatgttcatgctggacctgtacaacgccatggcggtggaggagggcggcgggcccggcggccagggcttctcctacccctacaaggccgtcttcagtacccagggcccccctctggccagcctgcaagatagccatttcctcaccgacgccgacatggtcatgagcttcgtcaacctcgtggaacatgacaaggaattcttccacccacgctaccaccatcgagagttccggtttgatctttccaagatcccagaaggggaagctgtcacggcagccgaattccggatctacaaggactacatccgggaacgcttcgacaatgagacgttccggatcagcgtttatcaggtgctccaggagcacttgggcagggaatcggatctcttcctgctcgacagccgtaccctctgggcctcggaggagggctggctggtgtttgacatcacagccaccagcaaccactgggtggtcaatccgcggcacaacctgggcctgcagctctcggtggagacgctggatgggcagagcatcaaccccaagttggcgggcctgattgggcggcacgggccccagaacaagcagcccttcatggtggctttcttcaaggccacggaggtccacttccgcagcatccggtccacggggagcaaacagcgcagccagaaccgctccaagacgcccaagaaccaggaagccctgcggatggccaacgtggcagagaacagcagcagcgaccagaggcaggcctgtaagaagcacgagctgtatgtcagcttccgagacctgggctggcaggactggatcatcgcgcctgaaggctacgccgcctactactgtgagggggagtgtgccttccctctgaactcctacatgaacgccaccaaccacgccatcgtgcagacgctggtccacttcatcaacccggaaacggtgcccaagccctgctgtgcgcccacgcagctcaatgccatctccgtcctctacttcgatgacagctccaacgtcatcctgaagaaatacagaaacatggtggtccgggcctgtggctgccactagctcctccgagaattcagaccctttggggccaagtttttctggatcctccattgctcgccttggccaggaaccagcagaccaactgccttttgtgagaccttcccctccctatccccaactttaaaggtgtgagagtattaggaaacatgagcagcatatggcttttgatcagtttttcagtggcagcatccaatgaacaagatcctacaagctgtgcaggcaaaacctagcaggaaaaaaaaacaacgcataaagaaaaatggccgggccaggtcattggctgggaagtctcagccatgcacggactcgtttccagaggtaattatgagcgcctaccagccaggccacccagccgtgggaggaagggggcgtggcaaggggtgggcacattggtgtctgtgcgaaaggaaaattgacccggaagttcctgtaataaatgtcacaataaaacgaatgaatgaaaatggttaggacgttacagatatattttcctaaacaatttatccccatttctcggtttatcctgatgcgtaaacagaagctgtgtcaagtggagggcggggaggtccctctccattccctacagttttcatcctgaggcttgcagaggcccagtgtttaccgaggtttgcccaaatccaagatctagtgggaggggaaagagcaaatgtctgctccgaggagggcggtgtgttgatctttggaggaaaaatatgttctgttgttcagctggatttgccgtggcagaaatgaaactaggtgtgtgaaatacccgcagacatttgggattggcttttcacctcgccccagtggtagtaaatccatgtgaaattgcagaggggacaaggacagcaagtaggatggaacttgcaactcaacc

SEQ ID NO: 175 - protein, 427 aa, Homo sapiens; identical to SEQ ID NO: 171

SEQ ID NO: 176 - DNA, 127767 bp, Mus musculus
  misc_feature (1)...(127767): n = A,T,C or G
atggaacgtagaaacactggagagacataatactgcttgtaattgttacaaaagcagtaatggattcaaatgttgatgctgttaaacattttctttttctggtctgatgatccagtcacagaaacgagaagttaaaacttttgcatacaacattaggaagtgctctctcctgtcatgttgaaccaaggaacttgtggtatgtgggcagtacaaattctgactttaggtatgcaagttttttggtaccaatcaaatgttttgctacatgtttctagtttaattgtggtgatattaaggagtggaactcgaatggataaaatgaaagtatttataaagacatggatgagtctgagtaccctggaactctgaatcccctcacattcttgtggaagcagaagctaatcttttagcattataagaaaaaaaaaacctcttacttgaaaaaaatcaatcaatcaaacaaacaaacaaacagaagcgacaaagcaggtgttgttcaaggacaattcttccactttctaacacctctcccttgtgacaatcttattcatgtacaaagagaagaatgaaaggctgatatgaatgaccatatggcacagagttaaatcagcacattgttttgatgacactatgacaatttggacagatatacaagtggtcagagtcctcctagaagcctttgtaataatatatgtgacagaggtagtagaagtcataaggagctgaatctagctgcatctgacattacccaatatggaaagaagaaattcttagcaggcccttttcacttttcaaactatatatatcatgtttggttgcttagacacacactgtaagactgacatttggatccaaagcaaaagagtgtagcattcagttcgaatggaatttagggtggtgctgtatttcagattccttagacacaatttttggaaatgtacgaagctcagagatgctggtatagagcctatggggagaaagtaaagattggataagctgaccaggatttgatgtaagagattgccacccctaaactggcaacaaggatccatttcaaaagtggcttctgatttgcctctggaccctactatatattgagctcttctcttatgatgatgccaaaggattttgcaaaatgatctccgatgcatagaaaacaggtattgctatattcacccaaccataaaattagacatgcacagaagtatgcctgtaaaatggaagtcaaatatgcagaacctaatatcagcatgcatgtatgacaaaaataattctcatgagaaggtagctgagatttccatagtaccttttcctgcacgcttattttttctcacacactttactccacagagtagttcctgatttcctgttagttcaggttggacctgtgtacagatgatcatgttcattattttattattactagtagttcaaagtagatgacatctacagaaaacttcaccaaacaattaatgtaaaagatgttggccagcatcttaatggtatgtcatacttttcatccttacaaagaatgaaagaaagcagagcctgagaatcactgctttcttgtgtacagactggaaggtgcttcagctgccaagttcaggggagaagagatcattagatggaagaaggagggtaagagaaatgaaaagaagaagaaggggaagaatgagaggaggagggagggagaatttaagggaggaagagaagaaggcatggggggagaaagagagggagagtgatatatacatatacaaatacatatacatatacatatacatatacatatacatatacatatacatatacatatacatatacatatacatatacatatacatatacatatatatatatacacacacacatatatatatgtggagagaggggacagagaggaggaggaagaagaagaggaagaggagagagagatagagggagatagatgagagaggggagaaaggggaagagaaagagagagacaaaaacagagagagacagagacaaaggagggtgtctgtggccaccaaatctgtacacatcactaatcaggtgaataaaagtatatgagtatgactgttaggtccttctagtcatgatgttattttctgtgtaaatatgcatagaaaatggtcttgatatcacaagtaggttcatgacatcaaaatcaaactgtgaatagtcacctctgagcactttggcaatagtacagataaggacatttttgtgaaagcccgtgtgtgttctattcaggtgggggaaagttctacatggatggtacaagcctacccctcagaggacacaatcattcatacaagtgcctttacaacactcagtactccttgcagtcttcacattggtatctacagagtttttattgtccatgtgaacctttgctattttagttctcaccagaagatacagtgaaataaaaaaaaaataccctcttgctgttgccatgtctttctctgtcacaggaaacaatcaattctatgcaacagcaggcctgaaaatgaaattttgcttatatcataccagacaacactctgaaacaatggctactgacggcaggaagaaagttgaattttggattcatacccacataatctgtctctgataaatctaacatgacagttttagaataagggaaatagagccactcaaggttatgcgagacagtctgcttgaaaaagttctgctccttgtttctaacatttcagcacagtgcactgactaaggaaagcatgtctccatccttggctgcattctagatgctgtggaaggtgactgcccttttccaagttgggcatctcaagttcctcttgaatcaagtcagcagtgcctctggcagctgtgtgactgcactctgattgagggtagagtagtggaggctataaagtgcaaaatcagagggaatcacttggaagccaggacattcaaaaaccagcaagccagcataaaatcaaacaaaaccaaacagaagaaaatagcaagagaagctgtagaaatacagcaaagaaaaccaaaagctcaagtggtccagaacaaagggagcttgcttataagaagcctgttgagttcaggtgctgaataaatcactgtgtatctttgaaggaatcagctttaaaaatagtttaaaatagaaacaaaagagatacaccttttaaaattttgcatgttacacaaccaagtgtcattaactcaaggcataaaatgtcacagcctatctctagaactgacttgccttgcacaattgaaactacacaatttttcagcataatctcagttttccatattcctgagcttctgtggtacaccattttagtctgtgcatctgcatgcttgcttatttgagaacatcagattagtggaggaatgcagtatttgtcctgttggtacaagtaatctcacttgacatatgtcctcaagagtcagctttttatttttttattttttttttatttttccttcttcctcttaatggcagcatactatttcattgtgtgtttgtgtcatttttatatcttcatctgaaacttgttttgttttactatctctataactagcctattttcactgtaactattataaacacagagtgttactagctctttcaaatattcactcgaattcttctccatataaactcaagggaggcattgctccttttttgtatgtcgtagggagaaagtcccatactattgctcatatggccagtatcattttactttcctgttgacagtattcagggatgccagaagctcgttctagttaccaccaacaaaattatgctctttggcaggagcaaaactttttatgaaacaccaaacattacttttaatgacttcatgtagattactttcataacatgaggacaaaaaaaaatgacaaaaacaacctaagcaatgaacgatgctttgtattggcttccagtatcccagttcatcatgatggggaattcatggactggcacttgtgacagcttgtcacattgtttttacagtcaggaaggagaaatggatgcatgctgatgttcatcttgctttttaacagtcatttaatttgttattccagcccattaattggaactagggacattttagatatgtcttcccatcccgatttatccaatctagacacgttctcctagaaaaacccacagatctgtaccccaggttattccagatattgtcaaattggcaaccggattagccaccagattaatgtgttttgattgcttctcaaatattttttcatttttactatttattttaaaaatattttaaattgtgttagtgtgagtaagagtttattctcttgagtttaggtgccccctgaggccagaagaaacagctgattctcttgaactggagatgggtagttgtgggtcactgaatgtgagtgctgagatcgaacttaggtcattttcaagtgtagtgtgtgctcttaattgctgagtcatctttctagccctcacaagcatcattaacaccctattttaaagaattaaaaattggaaattgtttggtgcaccaatgtgcaaggttataacattaaacttatattgaaaagaggaagaaaatgactcaatatcgataaaactcacatttaatattcataatgaaattatgattcatttattctgacttatttggcctttttaataagtagaaactatcacatgaaacactatcattatatgaatctcatccctttcttttgtacatttctgattttcagggctctccaaaaatccctggtgagatcatgtactttcgggcactgtctccttccatgaaaaccaactttttctctctctccatctcctttggttccatcacatgcaagtctacttgcaagtcttaataagggtctatcctaaatagttttcaatacaacatttttgccctgtctcaagtggggttcttttagttccggcccttgtagtcccttctgaaacacagactcacactgtatcttcctacattctgcatgctcccacctaaacactgcttccaaaatagcctgaaaagcaagttttagaacatttagctccatgtgatctagaaaacgtccctttctcctgtaagataaagcaaaaaatatgtatattttatacacatataatatatatttatatactgtatacaatttaagctatagtcctgtttgtttctgccaccaatctttgccttgtgttcactctcctagaaacactgaactacttgtaagtctcagcatgtgcccatgatttgctgatgtcactggctttctatgaattgccttcctaggcaaaatgctagccttttcttagctaaaccctgcttgactcagtccaggtgtgagcctttgatgacatgtttctccctttgaaatccaagataaagttggcattagagatatttgcctgctattctactttgctttctgttgctgtaataaacaaaatccacttggagaggaaagggcttatttcagcttataggttatgatccatcattgaagaatgccatgagaggatttcaaggcaggtgcttgaagtaaaaaatggcagagaaacatgactcactgggtttgtttgctggcttctcagcaacctttctgagcccaccagcccagatactgcagtgctcacagtgtccttgtacctcctctatcaatcaacaattaaggaaatgctcccatatacatacccagagattagtctaatgaaggtaactgcttgattgaagttccttcttcccgtgtgtgttaccttcaaacccaagataatccatcacaatgaccatccttaactttcactgataatttgcacaaaatctgaatttgtcattttctcatcacattttttgttgttgttgttttgttttgatttggttttttgttttgttttgttttgtttttcaagacaaggtttctctgtgtagctctggctgtcctggaactcactctggagagcaggctggcctcgaactcagaaatctgcctgcctctgcctcccaagtgctggattaaaggcatgcgccaccactgtccagcttcattatatcatcttaatctcgtaatttatagcaccaggcataatagataaataccgtagtcacttgctatctatagatgctataattgaaattgatgttattaaatccttcaaacataaagtggatactgtttttctattttaggattctatactttaaatatcatatgtatatacagacatacacctacatatatctatacatacacatttataatgcttatgattagtagttttagatatgtgtccttgggctttgaatttgacatgctgagtcaataatttaaaattctgaaaaacaacagtatgaacaatattgtctcaatcttaatgtttagctatatttttcttaattgagaatctcaaaatccatttctctttatatatttagatctttacaactcttcttttttttttttctggtgtcttagaaaatagggtctcatgattagaacactggaacgttgttctgtttctttggccatctcccatcttttgatgggtttcaataaagcctttcagggttatgatgacttctgctttgtcagactttatcagtacaaactgtaacaactgagtgaatagtacagttttgactagatatgcttccagaagtttgtttcaagtctgttcaaaattacctccactccattctccatgcctgacaaaatttctctatgataagtattttaattataaaatatgaatataaaataattgaagatttgacaaacacttaaatttgttagtttgtgaaagtttactttaaaaattaaaagaaattataattgaaataaaggtggactaagaatgagaaaatatatatctaactgttatcatcctacaaattatatttcaatataaatatatttcaataaaaacaacagcagcaaccaaccactgaaacaatcaatgagaaagataatattgatttttactttttgtgaattttcttgtatctgaaaggctgcttaagagctacagagtttccaggagtgaacagcagagggcagaaaacagcaactaggtccttagaacctattgttctattcaatttctttgtaatattcaaaattgattttgttattgataaatttaagtattcaagaaacacgaagctttgtggctttaatgggtgatctttatgcttataaaaaaacaaacatcagtatttttctatttactgtataaccatttactccattcagtttaaagtcattatacttagacagcattctgtggtgaaaagaatatctactacttaatgtagtgcattgaaaagcttcatggaagatcatattaatgtaattatgttagttttagtaggaaatgtttctagctgtgtgaatgtcagatgtttacctaagttttgaacatagatttgctactagagtagcaatcacatttcaaaaatgcctgataaaatgttatagactatgtacaattacaatttaccagcagaatgtaatgtttgataaggttgtttatattccatggggataaagcactatgattcagcaagttcatgttctttaaggatgaaatccagtcaattttgagttcatgactgcccttgaatttcaaataggttaaaatgaaagctgctttcgaagagtccctttattttaaattttaatttgcttgccagacacattaagtatcatacattttttccataatcaagctcctgtccctttatcatcaactatcatcccagagcactttggatgagaccgaagatgctctggtggcagacattgaacagcaagtataagaagcatgttactgagacattttccttgctgtatctgttgacctggttctattagaagttcataaacttcaaaccactcttgtgctgggtgtcagaagtagaggtgaaaatgtgtgtaatttgtttgattattctttatgtaacaagttggggtatttataattcttgttttacctataattgtattcttattgattttctacaaggctttgtatgttcctatttagaggacctgtttaaatgaatgtgaaatttttgattcacaggtgagatgaattattggttataaaaagaaggtattttcacccagaatatgtcagcttataactttagtatattatacatatgttatgcatttttgccttaggaacaaacacccccctcccacacacacacgcacacacacacacacacacacacacacacacacacacacacaaacacagacagagggggaaacaggggaggagaaagagagtgagtaacagagggggagaatgacttaaaatcacaagcttacaatatttggaagtcacgggtattactttgcttttttgcttttcttcattccttctcattttcatgagaaacatgtattttaaaatttgttttaataaatagggacttttagacccagtgactaaggcaaagtatgatttatgatggttaaaaaccatgtgtgatattaaagtcacattttctccataaggtttaactatggtgtgctttcatgcactttgggccatcagccagttttccctttgatgctgtcagcttcaatctcctggctcctggcaacagatctctgaaatgagacctctttcatttctctgtttaaaacaaaacacatacaatttggtaaagaatttctgaggctgcagagagacttgccacgcaggtatatagagatggcttggcatgaagtggagttttgaacatagatttcacaggcatatacaatcatcgctatgctttaccaagccccttctcacaaactttaatttttaatgtattcgttacagtccagatacccaagcaggctcggtgtaatgaggtaacctacttccttgaggcagtgattatttttgaaacttaaggccataatgtaatggggtatctggtttgtaactaagagtgatacatccattctagactactacccccccccccccccccgcagaaacctacggttctttcaatctctatacaaaacggacatctaagagccaagtctacatgactctacagcaggggggagtctgcactgtagtacaagagcaatccacaggcaatgtggcttgaacaatcgaaccactatccaaaggggcatactctaaagatggattcctacacgaagtctttcaaaggttcgatcgagttacccgggtcttggcatccttttatagttaaggatagaattttgggtttccctgagattatgcttgcattataggaagctaaagttcacgattttgggagttgtcccttcagggagtattttgtttgctttttatctgggtcagctgaggcagaaggcagtgtgtggatactgctaagtggattttgagacaatcaaatcatattcgttgtgctcaatgtaaaacagggccctacggaagaaagcttcgccgccaacagcaattagcagttcggcttcctaggcatagcaaccggaaatcagttttgcagcatttggatctggctggaacatctctgcagctacagtaaaccctgcaacctcagcccatagcagggaccaaagcgctgtccgcggtgctaaaatcgaatgcgcaagactggaggtctctaagaggcaccaggctgcccggctctgagccgcgctttctcggcaccgcgcagaagctgccagggctgtgcggggtgcggggcgctgtgcgggggaggggtgggtgcgcgagctcgccgcctgcctcgagtcgcgcacgcgcgcccgggactgcctgcccctctctgtgactttcctgtgtgtgtgcgtgtgtgtgtgtgtatgtgtgtgtatgtgtgtgcgcgcgcgtctgagagaggagagagggagaagagagctcgagagagggtgattgtgtgagtgcacgggagggtgctgatattcccagacaccgggaccacagcagcagctcagctaaaaactgcattcagccagtcctcggacttcaggagcagggacaggacgcaggcatcaacagccaccagctaaacctgggagataaggattcttctgccttcacttcgtggttttagcagctccttgctaaatttcgacctcaaaatgcagaggatctaatttgctgaggaaaacggtcaaagaaggaaaaggaggaaagggaaacgaggggatattttgtggatgctctacttttcttggaaatgcaaaagattatgcatatttctgtcctcctttctcctgttttatggggactgatttttggtgtctcttctaacagcatacagataggtaggtaccttttgtgttatgcctttgaattgtgcataatttggtggtaatctttgttcacagtgtgcaaattaattcatgtcatgtagacttatgtcataccttgactgcattccagattgaaactacctagaatatacatgattttcttaggctgaagcaaaaagaaatgactatgccttttgacacaatagaggggaaaggatctgttcatttctgaccggggactgcgttacttctgccttgaaggcatctcctagtgtgctcagattttcaggggaatgatcgcaaagctcaagattaaaagggagaatctttttggtctttagactctcccccttgccttggatccgttgagcaccttttggatccttgctgcccaactcactgattacgtttattatagcgggtagtgtgaataagagactctggggctgttgggtgctagcatcccactcttatctctccagggctctgacatcgttctcttgcttgctgtttatttttgcaggggggctatttccaaggggcgctgatcaagaatacagtgcatttcgggtagggatggttcagttttccacttcggagttcagactgacaccccatatcgacaatttggaggtagccaacagtttcgcagtcaccaatgcttgtaagtaatgaatattcatatctttccagtgctgcacagggacacagggaaagcaagcctgtgaatgccagtgaaggatggtgtgcctgtgtgtgtgtgtgtgtgtgtgtgtgtgtgtgtgtgtgtgtgtgtgtgtgttgctggcttgtcatgtgtgggtgggagtgactgaacacgcgcgtgcgtgtgaaggtacagcgagaaggtggctgtaatctttgggacccccactgaccggcgggcagtgaagtggggacaaaaggcactgaacagtatgcgcagtatgtgcaccctagaatctggggtaggggttggacttggactgttctttcgaattcagggggttcttgcttgattctggcgcctctaaagaggatctcccaaccccctccctcttgcgcgcctattggcactctaccaaaagagaacacgctgttccccagggcgcgctgtgggactgttggatagatctcatgccttagtccggtagcctggcagggcagcttcgacctacagtcccgcaagccccacgtcgtcctattgcacgggacaagttattgcaatggttgaggagttgggcccggggctgttacataatgcccacccgaggggcgcgggcacgagactgacgcaggccctgactggcttgtgtgagcgggcatggaagggatgttaagagaatggagaccccgaagggctgagaatgcgggcagcgggggatgaggctgttgatggggatgcctaccagatacaaacctcaacctgatcgccggcagagcagggatgaggaaggcggggaacagaagctaggtgcattctcagttccctgaagctacgcccaagtagaggcgagggtggcctgagtgctcaccagccgcgcgtgctttgttccagggtcgcaggctcaggcaaaggcgactggagactgaggatgactcggaagcgattgcatccggctgagttttaaaatttgaagaagtcgcagaccagccattttagcttttgtagttttcagtatcagcccctggcctctgcatagggatctggaactcctgaggacgctctggcaaggctttaggcagaatgactggtgtccagttgctgggcaagtgcgaggtcgcccgaggccgaggactaggtccccgtgcagaggcagcatcctgcgcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaaatgcccaaggcagtgttcccacaaccggttgccatcccacccacaccccacctcacccccgccccccaaagcctgtcatgtattctgtgctttagttctttaacaccagggacatcaacaggccagtttgcaaaccgtgtccgcaaacaaataaatgaagaaatgcatagggtgataatgtgcttctggtcatttataagaccagaattctagtttttctgaaagagccttttaaggatagttctcttaatatgctaatgttgaggaaagaggcagagagagagagagagagagagagagagagagagagagagagagagagagagagagagagagagagagagagagattgttgaaaatggagtcagagatagaaagagagagagagagagatacacagagaacttcctcatagaagagacactagatggctcagtgggtaaaaacatttccttcaaactgatggacctgggattactccctggtctctgagaggagaaggagagaaatgacgcctggatattgattgtcctctgacctccacatgccccctccaaataaataattgaataaaaatttaaaatgtaatagaatattacagaaaagtatcccaatgcaatacatgttattacataacagacacaaacaaaatgttttaaataaatgtgaaaggcatctttaattgtcctatttacctactgaattaggccattcctgcgctaccaaagaagtttccgtttcttgtgagttacagtttggcatgcaacttgagctgaattgtaccgagctgcatttgtatgcacaaatgcagtgtcacagtgcgctgacaagtagggttacacaaagattctgaaatattaaaacattttgaaaatatttaataagcaagaagttgatcgttggtaacaaataaagagatgagctaactgggaaactaacaaatacagccaccaaactaaacgaatgtttctctgttccaacaggtgccgagccactgtactggggctctttaaggctcagagattgtactttgtgtggcatgtatcctcaggctaatatcgttgactgggtttatttctagtatgaattgtactgaaatgagatacgtggcaagagtacacccacaaggaacaaatacattgttttcttttacatactgaattttatatatctgaccatagttctaaaatgcagtatattcaagccttcatttttttgaaatagatttttttcctttaaaaaagtcacaaaagcaaacattctaaactatacattcccaaatcataagactgccccacccacagagcagtataccaggcactaaaacaacaggaagaaacaagagaaacaatgcctcaggagaacccaggaccttgactttgcaactccaatgctgtaagcttactgactactacagatcactgatatgccacagtaaaagaaatgaggctctgcaaacagaattttctagagtgcacattggcaagtggtaaaatttctaaaacttgcaaagacaaatatttgccttggaggcagggggctaagaatagtaaaaatgatacaattaatttaactctttaaagggaagaaaggagatgagagcagaggaggcatatgtgtgcacaaccaaataaccacaacttccaggttaaataaataaaagtctgtcttgccccatgtatcaaggtaaacatggccacttagaggctgctgtgggttttaccccagtgcaaatagataatttgtttccttactctatttagtcatctttcatagaaaagatacaacagcattaagtacattgacaagcaagatcaacaatgtctttcccccattttctccggaaacctaaggaggctatgacaattttgcattgtatgaattactaattgctgcttctaaacaagattattctttatcctaatgagtgcacagaacaaaagttatttgttaagatttgtttgtaagaaagcaaagctttagaatgaagggctatcgttttgtcagaggagtggatctgcttagtacttaactgtgtgagatggatgctcctactcaggaacactgaggctgacatagagttaaatgtctaaggatgtctactgaatggtgtaagagttaaatgaaaggaagtcattttattctgatctagaatgtgctctgctgcactcagctcccacaccttttcagtcacaaccagatgatgaaagtacctgtttgttcccattttgtttccatggataccagagaagacaaagacagacttccaatgtgttttttttttctttttcctctctgccttgtttttttttttttttttcttcttttcaagcccttctcctctccccactgatcccttgctccccctttcctttctttttggattttgttcaaatgaatgtttaaataagcttttattatgagaaaaatgtaaagctcaaagaagagagaaaattgagactatcattttagcaagagttgaaagcagtgaggaacctcagaatccaatcttttatccatccacccatttatccacctatccacccatttatccacccatccacccatccacctatccacccatccatccatccatccagccacccacccatccacccattcatccatccaccgattcaatccatccattcatccatccatccatccatccatccatccatccatccagtaccacaatctccctagtaccttctaattgtcagagaataaatgaatattatcccaataacaaatgctttctgatcatttacttcagtggtctttctaatggttttgggagactcggtaatgctatacttttcatgaggagaagcctctgaggtcctgtatgagtggtttactgtgagtatggaaaagaactctagtaggtcttcatgagtaagtcatcatagtaaaagaaaaaaatctcaatttttgagaaaagaataagttgatatttgtgtttctatacacactctaaagttagctaacaaaaccaagaagtgtgtttagaaaaaaatattaagtactgtatactataaatgattttagtaaaattgaatatgggactaattagaaaaacgtttaaatggaacttttaaaataggttatatatatgagtattcaagctcctacaatttggggattaaagaacaaataaatctgcttatatgcatctgtttctatttattctaatggattattatgataaatgagcatttatctagctaatagtaatttaacatttttatattttaattctataatggtacatacattataaaaatttaaaaattacataaaacagtgattaaaattttatttttctctgagccagcagatggagatgttggagaaaagattgtgctccatcaaactgctgcacacattgaataccttctaagacatcagaaatgaatttatttggagacatataaaaatgtcaattaaatgtatttagaaagaattaactacaataccatgtttggaaataatattcagtaaatactttaagaaacagattgtttaagagtttatttttaattataaatttctacatatttttgcaaacttgatcacaggcacagaattctaaaataattcttacacacatacatacacacaaacacacacatacacacacacacacaccagaatgtgtgtgtgtgtgtgtgtgtgtgtgtgtgtgtgtatgtgtcagattttaagccttaattttttaccaaatattagttctaaaatgtctttcctatcagtggattttagtactgaattattgaaattgtatatctgtgtccatcaaattatttaatgtttgatagccttcagtacactgtacatagaatgaatcctgtgtgtttgggccatatgtgtgcatctatagttttaattatagaattacataagaattgattgctcagttcatcacatatagctttttccttgggaaatatatgaaacataccactactaactataatataaagagtttaaagaaaccagaaataacttggatgctgttataaaaaatcatgatatgaaggaaacaaacaagaaccagaaagagaaactattgccctttcaactaaaacattagagaaactacatagctcatttatatctaaatagataataaataggtaatttattgttgaattatctgtactgaaaattttctccgtttatttttatttttatattttattttattttattttattttgattttttcaagacagggtttttctgtgtagctctggctgtcctgaaactcactctgtagaccagactggcctcgaagtcagaaatctacctgcctctgcctcctgagtgttgggattaaaggtgtgaaccactactgcccttcaaaaattttgttcttatttaagaaatgtcaaggaaattgaagaacacagaacagaaattagattgtaattggttaaaataattgtattttgggctgaaacttagtacgtaaataaaaatcatgacaagaaactatagcatggttatgtatttgactgctatttgatatcttgctacttccgtctggaggatattttgtttctcagcaagtgtcaataggcaggttactgtactgtgacaccctgacaactggatgctctcaggctctcttgacatctagggactaccccttcagttatctctaaactatgtgtaatgttgaaaaatgtaaggaaagaagcagctgcttgctaattattccagtgtttcagacactgtaagaaaagtcaacagacatagttaactacagagctcattttatcagaggttaacaactaaagtgaaatgaggaactattcttttttttctcgtctttccatcttgcgttagagtcaaacattgactgggctttattagcctctgagtactattccactcccctcccctttgtaaaaaaatactgtattctactgaagattctatggatcctattgaaagaataaaactctcttaatggcaatttttagtcaaaatttctgagattatctcaagtgggtttaataattatcaaacctgttacaatgtgccccttccatggaactggaaaatgaacttttgagctcaacgttgatatttcaaaactaatcatgatttaaaattatatatatatatataacatgatttaaaattttatatattttttgaaacaatagttaccaattttgaagaaaatgctcattttcttctactcttagtaactctccagtactagtctgctaagatgtcagacagaataatttttgtgttcattcttttagtgaaaaaattaactgaaatgtctagaattaaaaatttttattcttcagagaacattttgaaatctattgcattgtgtatttgtatacgtgtgtgtgtgtgagtgtgtgtgtatgtgtgtgagtgtgtgtgtgtgttgtgattactttgtatacatgaactttcgttttcttctgagcatatagtttatctttaagttagtctctagtagttttgctctgtcttttcactatattgatactttttgggtatattaacttattatatatcattttttacattaggatattaatttgatcaacagtctaagtgcttacttctaacttacggattaaagctagggacagttgtaagatttaatatgataaacttaagaacagtcttcagcaaaatagaatcaggagagttgtgaaataccaggccgatttcagaaagacatttttaaataaagaatttcttatgctactttgatttatctgtatcttatgcctaaaaaaatcatttctatgtcaaaagccatacatgcttttattaattttaatattttgagacttcttcagaaattaagattttagtgttgtaaaatctatttagtgctgaattctctgtttttggtagttatttcaatgttcaaaatacgataaaaaagtaggtttaggaaaaatttttcctaaatttttgtaaaattctaaaatctaaagtaatatgaatagggcaccttaatgccatgatactcccttctccgtatgtaaaattaactctaaatgtttgccattttcttcgtttgtgtccctttgaagctgttactctgatgaatgtctgtaagcctcagaaaatatccctgcatcatacgtattttgtctagcttactaaacactcagattctactgatagacatggaacaaatatatttatataacacaagactgcctattgctttaataaactatatgtgtgtcttgtataattccccacccatcaaagaatatagactaaattattcatttccatgtccaacactgaagtttgagttacataacttgacatcagaaaagattgcattatccattagtcttttatggctgattttaaccctcagtcagagttttgtttctgatttagcatccattaacatcagcccagttgctgcagcaagaatgtcaaccacgggattatataggtttcattttgtatgtgggagagggtcatcatttttaagcaagaatctccagatcaatgaaaatattctctgatgtatattgcaaataccatatgtaaagtgcaagaacatagaccatgaagagcaaggggacacatcgcaggcactggaactttatcactagccagagctgtaagaattaacatttgaatttcctctctctttctcttcttcaatgtttactttggtttgatggttgcttcacttgggtcttttctagagtgaatcatctgaactttcatagggctttttacaattgattgaattcttattgtaagattacttttgatgtggtatagaaatgatttattgtgtgtatgggaaaatcaggtaaggaggcagtgtctatgttcctttttccaaacacaacactgaggtgttttatcattctggaatgggagaaaaaaagccacctttaaacacagaagatgaaatgacttgggaggtatcatagcttaggaaacagttgacgcaaatagctagactgtggcaccatgggattgtcaggtgcagccattccacatctgcttgataaatgccagggagcttatttcagaagatcaaggaacagtctatgtcaacactaatgaggcatttctgtttatttaaccttcacacacacattatacatttaacaataatctggctctttaatagacagatgttttaaattttaagtaattataaaatttaacaatgaaaatattttaaatggaaattcatttggatatttctaacacttgaaatctagtaactcatgagaattttttttttagttatttataattctcaaatatcttggcctcaaacttggcatcttctgcctcagcttcccacatagtagggttaagatcatgttcaacagctacagacaaaactaactttaagagaattatctgaaagaaagtttttaggataatacaataaataatttcattataaaatatgagattgcattctggggggaatttagtcaatctgtttgaagacgttgttaaatagactttcatggtgctaatttcaaacaatgaagacataattatcaagagatttgtgtctgctatttgttgtgaattacatgtgtttaatggggctattcatttgcagtaatccagataacacagaaatagtttgtaaaatggcacttcatttgtatgtgagacactggcaaaggaaaagtggtatgtttagagatatatttgtgcaagtgtgtgtgtgtgtgtgtgtgtgtgtgtgtgtgtgtgtgtgtgtgtgtgtgtagagagacagagacagacacagacacagagatagacacaaagacataccctgagagatttattaattttttaatgcattttgtgttatatcacattctggttgtcattatcttcttttgtgaaatgtatttcatatttgtaaaatgttgaatttcaggtttgctttgatttatgtgaaagatggtgaagattgctttataacatctaaggtcttccaaattttatagtttaactcattcttttacagtgttttatctgtacatttacaggccattgacatttttatacggagagactgttttaaggtgaagggccataattcaaacgttatcaagaacgtaaatacttttagctctttgcaggaaaagttcataaaatcttgaggtttctgtcttagaaagaagtaagtcaatggttagcattttagtgaagggtgaaggttttcttctgagaaaattaagaaacatagaccgcgaattcctggaacccacaaccctgaagcaccctggggactgccttccagtccggtggctcggtgtgggcactgagaagttgctttccagtttcccagttttcagctttttagaaagctaccatcctttacaggatttcgtgaagatacagtcataaaacctcgagggatgaacttggccacacacatgtaccaaatggcaaaatttgattattgttagtggatgtcttggatgatgatgtgctaagacacataatatcctatgagtaccttttaatagagctttgacacctgagcagaacaaatgttacttgctgacaaagagactaacaaaatccaccaccgggactactacaaatacaatgtagattacaatcaaatgtgagtgaccatcaaattagagttcctggtattgagtaggagtgcatccatcacctttattgtgtagcaaacctcagaatgctgaaaaccgtttactttagtataccttcttaatctaaagatatctcagcactttacagaaccaagcactttatagattcccaatctttctcttgtttaattaattaaattatatttgtttaaatgaagggcagtctggagagtcacagattgaattcaggcagaaataggtttgaaaataattagcagtttcatggtgcaatacatgacatttagtctgtgtaagataaggttcactttccttgtcatacttgatatcacaattagaagtatcgagtggtaaagtgaatgtccagatgaatttgttacaagtgagtcaatataccacaattaacgattatattttctcatcatttttagaaaagtattcagtatgtattttcgggaataactttggcatctcccccacccatggtccctttcacagataagtaggaagagctgaaattttttcataagttaaatcataggtttacactacttatttaccctttcatcattaatgtatttaaggaccaacaatgaaggtgtttggttcccattaataaaaaggcaatagacacaaaccagtttccttttgcgttctcttgggaatcagcaacctttaggttgttgatggctagtgaatcttttgccatattcttttgacagtgtggattaatgggctttgtttgcctgtttctcatctgctaagacatgtggagtgtttaaaaataattaaaatagctaatccacttgctttgtgaaacataaacttctgactggacacttagtcacagtaatgcatgaaaatattagagacttatctaagttttatgaagttagtcactgcctcactttgatgttatcttatgttacagtcagcagctatattactctaatgtagtgtagcaagaagttgaaacatacctactcttttaagacaaatccataaatttataaggaaagctacacatcatgagtttggaatcaaggttgggacaaaatgtagggcataaaaaaagaagtactggtctgttgagtgccaagtcaatcttgtatgcacaaaaagctctcacagaatttgtctgtctatcttcttcaaacgctttgtggatatctgttctatactgcttcttgcagtaatgtcaaatgtgacggtaacaagaacagtttatatactggaaattattggtggtttaagaggtctatgtatggcaaaggatggtactacaccaactagacaatcttattatattagattgtatggttattgtttgtagttcatttataaatcttatgctatgccttggatatagaaatgaattgaagtattttaaaagtgaaactgttaattgccaatcttgtgatgaaaacataaaaaatgattttagaggtaaaaagtcgttttaaataatgtctttgcacatattactgaaaaaaagaggttttccaattgtaaattccactgttgataactataatgctaatttcagatctttaaaaaacattttgattcaagtttgaagcaataatttgcaatttttttgtgtaccacaatctctttaatgcactttgaattagtgcagacaagcttgtctgctggtctttaaataaatgaatacaaataaacaaattttgttctttattgaaactagtttagcttagtgattgataatcaagatgtaggttttacaatggtaagggttgtagcatattttcaaatgttaatataaataactgttctgaataagctaaggaagacagacatcctaccatcataaccttagttctaaaacaaatgttatttaatccaaacattgatcatacagcaatctaaaaattcctggtgtaaaacatcatgattatctcaaaaaaagtaacttttatgtataacaaaaataaaaagaaactaagccattatttgaaatagtatgttgctgtttggggtgagttaaaatttaagctgtacagaagttttgaactttgactctaaaggcatttataacaaggcttgtaggaaatgggagagaagaggagatctggagctatagtgtgttctggacataataggattgctgctgagctgtgcctgttttctagagaaatgagattcagtttctttaaggatgtggcctttgatatatcacacattccaatggttggctttatacacatgagcctaagggtagtacaaattgggctctgtgaatgagagagagagagagagagagagagagagagagagagagggnnnnnnnnnnnnnnnnnnnnnnnnnnnnnnnnnnnaaccaccaagaaaccccagacattcataggaagactgtgggtgaggagttgagagaaacatggggtgtgactctgatcatgtagattgcacgcatccacgaaatagtcaaagaattaaaaaattacatggaaaaaaattttcaaagttacttacacataattttaaaacgctgcaaaggggatacaatcagtattaattatgcctctcaccccacccatttatctgagataatcattttcagaaacttctagaaatgggaaaatagtaatagtatggttgtttacttcgatcacctctgccttaacgtaagtagaattctttattactagcacagcctgtcttcctcgtacttgctcagtaggctggtagccatcctgaagtttgttgatgaatcttttcgtctaccctgtcctgttacttagatggacatcttttttgtatgatgaaggcagaacccaggatcatgcacacactaagcaagcatcaatcactgaactgtattctctcactcactgtccattttaattatctgcatataggattacagagtaaacagttacaaacataataaattgtgagcaaatagtagaagcaattatggtttttctacgtgtttaaaaagatataactttatatacctactttatgtatatatatatgtatatatgtatatatatgtgtatatatatatagtatatatgtatgtgtatacacacacatatgtatatgtttctggtactgtcttcagcctcttagtgctcaatttaaaccttttaaacttttactacaatatttcttatgtaaattttaggcaagaagatacaatttgtatttttgtatgtgtgtgtgtatgcacttgtgtgtccataaataaagcatgtacatttcatcatagtttagtttagtgtatgccatgtacattttttatttattgatacatgaaagtaatatgcattcctatccacatgtgcagtccttttgtctggttctctgattttttgtttgtttgtttgtttgcttgcttgtcttttaggacagggtttctctgtgtaacagagcataaagagataaagctgcctgtgcttttatttcatatcctctgaattttgattgttttgtttcaaagtaaatcatcttaatttatttattatgtatagaaattccaggaatccaacttcatttttcatttaacacaaacaattgtcaagtatataaaaattctatcttattttcttgacttgaattctatcagatatacttttcaattaaatagttcctcaaagagttaaaagcgaagaatttgcactgaaagaaaagaactcagaactctattgcagtcaaaggaatgtaaagttatgcaagatatttgtttcctgaggagcatagttaccataaattaggcttttatgttgcaaggtctcagatcaataaaagagttcgtcacattttgaacatttagttgagcccagagggataaatagaagattttattatgtatttttggctcatgtcgcagcaccattactacttaaatgggctcttggttttgcatattccctaacccatatcaagtttaagtaatggggtgtgattatgacttggtttctgaacatcactttgaagttaattcagtgtagcaatctgcatgtgctcacaatgtaatctttaaggagcatagtccatatgtgacaaatgagtggaaattatctcagatactcatggctaaagcagccaatgtgaggtttcctttccctcttgtcttgaaaccgtcattctctaaaatatcccaatgtgaatctatatgtcagagaaatggagtttcaactgaatcactaaaggaaatgtgcaagtgttacatgcagcaataaaaatcttcaggttattttatcgtacctggcaaggactgtgtagtttgggtctcatatcagggaaacctgtaaatttttaaccactttattttatgaaactgtgaatgttacatggccttggtgataaagctgaaggtgagcaagggtctggaagtgagttttttggaccacctttctatgggaattaaaatggaaagttatttttatctttgagtataagttaaagcaatatattatattcagtttctacaaggctgtagtcatctctttatatttgagtgcatattttcatggagttagaaaggatttttcctggaggaagaggaaaaatatgcttttagcagcagagtttcaacgcaaaaaaaaaattgagaaataaatatattttatgaacaacatagtttcacttcttccaccactcagtgtgatgattcaatttaaaacgtttttcagatttgtttattttatgtgtatgggtgttttatgtacgtgcatgtctgtgcaccacttgtgtgcctggggcctattgagaattggagcaacagatgattgcgcgctgccacgtgggtcctgggaatcacacccaggttctctgcatgagtagccattgcccttaactgctgagccatcgctccagcacagattattccaaaattggtgcaaaaaccttttgtagctctgattaaaatgttattccttaactaattattactactaaactagtaatatcttaaagcagaaaaatatgcataattatacctgaaagataattattattatctttagtaaaattagtattagtattagtaaaagtttccaagatgtttttacacgtacttttataagtaaacagttggtgacattaaagctgtttgcaaatttaacttttattatttcataatatttattttgatcaaggaattaaatacctatcttcattttcagtaattttggaacaccatttaatctattataaaattctgttgcaaattaaagttctaaattttcctaactctgataagcatattattgttactggggcaaaagccatagaatatttagttaaagatttctgattattacttagagaattcctgccaatttctaatttgaaattataacaatttaagttggcaatttaacagatagtggagcaatgataaaataaaagtatggactagcaaataaaaccaatagatggaggaaatatatatggtggcatatgctgttaaatccagcattcaggaggcagaggcaggtgaatatatgagtctgaggctagtctggtctacaaagttagtttcaggacagccagggccacacagaagagtcctttctcaaccctcctaccccaaaacaaaatatacatagttgattctcaaaggcttgttcagcttctaaattccctgtaacaaagggctaaaggaaactgatgtcaactgtgcataatttgattttataagtcatatcactgccttcttgtgcttagcagagggcttcccttttatagttgaacattgtggaaaaggcaaaagctccacagaagtgtatcagagagcaagaagcatggtgtctgatagatttctacagggcacttgtttttagtaggagagctcagttacaatagtggaatatcccttgttcagctggtaacgtggacggcaactcagtactctatctgttaacagccatagtatgactataggtactgacttggtagttgcaggtatatttcatgtgcagaaaattcataagtaaagatctgtaaataagaaggattgagttcaatgtatgtgagtcacttctgtccctgccaatggtattattttattaacccgatggtgcttaaagaattttatcttcttttgcaatgtttgcaattcccaaggcgaaaatcaccttgggttcaaaaagatttggatatgaatctgacttccaactcgataaaattgatctgaaatgaaaattcttgatcttataaaatcaaattgaccccagaaagctgaaggagtgtgaattttattgtattttaattttttttcatgaatatcctctatgtgggaaaggtcaagatcagaggacattgagctcctctgaaatactaagaagtgtcagagttttgctcccccatttccactttttctgtgcatctccttatagaaaagtcagagtagcattctaaacaacatgatgaacaccaaagggaattgaactttagttgcctttctgcagaataggaacagcatttggcaatgatttgtggtggcaacaatggcttgtacttactggcctataactatcactctgtctaccatgaaagatggttttctctcatggaacctcaatcagcaagaaatcagcaatcaactaccaaaccaacagaagagactgccagggcaatatggtggagcaatgagtaatagataccataataggaagggtgggtaaggagggcatcaaaaggaggtaaggtcttatctgaggataaggagcagtaaggtagaggaggaactgggaaaaggtcatctctgccagagataaccagaaatacaaagatcccagtgagagaagtcttggaaaaaagctgacaactagcagaatgagtgggcaggacagtaggcaaagatggccactgagaacagagcacagttctgaagcaggcatgaaagcagcatctgtttggatggttagttcataagcaggctggaagataaatagtaaggcaaaacaaaccaaagaaacagatctgaaagctaagctgagtgctttatctttagagcaagcgtcagcaaaaatgtccaatgggaggaagcaagactgctgtatatattcagaaaaatttcacagtgataaaatatattcctttctttggctttggcatttccctttatgtggtatggtgtaggaaatatggtcattatgaatttctctgtagtcttggatatgaacaagtgatatgcatgctaaggcagatatgaggtctgtttgtcctagtgagatgagaaaaagcaactgggagagtgaaggatttatttctcccatataaacagttcattatcaaaagcagtaagggttcgtgcagagcaggaacctggaggcaggatctgatgcaaaggccaaggtggggggtgctactcaatagctctcccatcatggcttgttcagcctgctttcttacagaactcagaatcaccagctcacagatgccatcactacaatgggttggaccccccctccccaccaatcactaataagaaaataccctacagctggatttttatggaggctttttttctgaatgatccttcccttcagataaatcgagcttgtgtcaagttgacataaaactagaaaacagtactgaattgctttctataaatgaagcaactgattaaaataagttcaaacttgggatcttaaatatctgtccctaacttactgccagaagtattttataaacaaggactctccagtagacttgtgaaacgtttcatggtgaatgatgttgaagattatgggctggttggcttggactcgggaaccccatttctttttcttctctctctctctgtttccttcctttttccttccttccttccttccttccttccttccttccttccttccttccttccttccttcctccctctctcactctctctctttctgcttctttctttctttctttctttctttctttctttctttctttctttctttctttctttctttcttgccaggcaggatcaggaggtcaagctgctgggagtgtccctgaagccttgtctttggatggatgaagaatctctactctgaaaaagaagatttagaaaaacatgcaatttacctcacttttaatcttcctcagtttcttggtgaaaaagtaccttgccatggtagaaaatatagctactcagtaacctgccaaagatatcttatgttctaacagtatttatttttcccagttcatgtatctaaaaacatggggggaaatggccagcatttatcaacagggaagaaagtcggttcgtatacataatggaagcaggtttgtaaagtgaagttgttgtgttgagtgtgccaaaggcacaaagggaagcttgatgtcctttatgccctcaaaaaactctgctattttattttaaaatttcaggcaataatttaggtgacatctcatatctacttctgggttggtttgtattgctgagtttaaagtcagcaaaatgaacttggacttcctttgtgaagaatctgctctgcttgtgccccctccttatctgagcagtagtgaacttgaaactccatgtcactaaaaaggacgtccaagctaatggccagccctagagtgttcagctggtttccttagaacgctaatgcattgtggaaatgcatcagttttctttttcttttctttttctgaagatatcattaattccctatagatgcaaattttaaagattttaagtgtgattggaaatatgagagaaatgaaatggagtcacaaaatggcaggacagacctccagaatattaagataagaagtggtattttccctaataatttccattacatttttttttaaatcatgattggtttcttctcaagaaattttgtcttatatcttactgcctttgtttctgccattatttaaactccttttccttcagttgactccttgggaatgtacatatgctctttgctttcgcagcgtggcatgatttcatatacatgaacaaaaacaagaggccattcaccctcttaggctctctggaatgacatatagggaaacaaagaggatgcaatctgttgtttacagccaagcttagggaattatttctttctcatagttatttttatctcaattttaactgccttaggaaatatgattacatatgaaatatttaagattgtaatattaaatctactttcatttgggatttctaaatttatctttttatataacttctgaaaacaattgaaagttgatcgtctttgcaactatagctgtatggttgaattcattttcttttagtagtagatggaagcattttcttgactcttttcttttgcttcagcaaatgaagaagaaatttgctaacactagagagctgtcacagatatttctgtcacatcttctgaacacaatgtggttttctgtaatcagcacattcctttccagactgatttccttggcctatctttgtaccaacctgtcccttgtgccaacctgtctctggaaatgaaactcaaagttatcttctcccagagtaatataattatactagggagtaaaataagattcatacactcaagacttgaagacaccatgcagtatattctagcatatatatttatactatattacattatattataacatataataaatatataataatataataaaatgtaatataatatatattataaagaattttcccagatattaaggaagggtgtagtacaaagtcctgacattgggagtttcatgtgcagcatcattcctaaacacaaccgaattgtcccaatagtacccagtgtaaacttagctccgaactgctaggtaacaggagatgtacagttctcaaaatcctgcacagactggtgatatattatctagctaacaaatgggaacaaagtacagtgctagtttaaaacagggacttcagagttctaagccagagttcgtgggcacttgtgagtttgtgcagaatatggaattcagacagcagagttagccaagcacacacacagggaaaagtggagccattatcctgatatcaaattgtcactgtcctatagacagacgtcagacttttctcagttcaagtcaaggtgaaactgagcattcttccaagctggaagaaatttgtggagcatttacttaataaactaaacacatggaggcatctatctcaaaaggtgatgtgatctagttaaagcagcagtcatttaaaaaacagatttggactctgtatctaggatatatgactcaaaacatcatgtgtctggcaaagtgcctggttagaatgtgctgaatgaatgatactaatctcattctttgctaccctgtaattttctcaagtataactttatgcttagtacttgtattgtgtatcatggagaccagtgcagcattgagctagctgtaggtgataaaaatctatttagctattaattccttaatataagccattgtctaatggtcttcataatgagaaactacaattcttgaaagaaagccactatgggagtgttgaattctcttacctttgtgttttataagtgatatttatggttcccgagtcttacagtcaagcagaaggcatgtgctgaggacattacctcagggaaggtaactgctgattgcttacatttcaatgaactgacttcagtgctctctgaatactttgtaactaccattatgctgccacaccttacatcaaaactggtgattgtgcattaactagactgccaagaatcattacatttcataaatcaaataaaatgtttctttttttgtgtggatagatatttaaagccccaagttttaagttcaatgcacaagtttaattctcttgacactatcttccctcaggaagggtaatgattaatagagtataaaaaatagaaacacgaaaagcatttttaactttctgcagtattttgcttagtgacacatatctaaactcaaacatagttatctacttatctaaaatactctaggacttagtatagtcatagggtggatcacggcttgaggcacaggatgattgctacatcatagtgtgctacatggagcagggcaagaattcacactgaaagaaattaagctatcacagggctgggttgtccttttctttctcctgagcaatgcacacattaagtaaagacacagtctctctaaggcagtgccaatattcacagtggctctgaccccgcctcttctcaccagacacaaaactctctagaaggcaaaggtgagatgtgtatgaaaacacaagaatagcttcattcctacattgaaaggcaccattaaattaagaaagccttctagttcttcagcaaagagaaaaggacataagcttggtattcaagaaaaatgctaccatgtctgcttacttagattacactcttcttaacctgcgcacaaactaagcatctccttacaccatttacttcatggccctggagatacctggaatgatgcagggggagagaggctggagtgaaaatagaagtagctgcagaaggggaaatgaaagggtgagagagggagcgggagggagggaaagaaagaacgagagagacatagagaaaagacctgcaagttctcataaagaatttaaagacttttatgacatggagtttcaccatgaaagaaaggcaggtactggtgtcctgggaggagcagacgaaaataatatggattcctgagtagtatttagttttaagctgtgaaaaaatacttctagcttctccatttacacatgtataatgaggtgtgccaattactgcatgatccagctaatctgtgaactgagactttccacatgaccaatgcatcctgcaacagattggcaagtcacatagacacttgtctatagccaggggactactcaagaattgagttcaaactttacttatgtggtattggatgctgcgtgtcttagctaccttaagaaatcacctcttgccaactgttattagtatgtgttcaaagagttaatatccacagtaatctgaaaaaaaatccataaaaatacagccctctagttaggcattgggacaaaaccagttttcccagtattatattgatctaggaatattttcatgagtgagacttaaaccatggactgagtgtcagtgagcatgatagctttgtgggtaaagtactgctgatggtctgaattcgatcctctaaaactcacagggtggaagaagggaactgactcatgtaagtaatcctcttcttctaatgtaccatagcaaacacacagatacacacacacacacacacacacacacacacacacacacacacacacacacacaaacacacatacacagacacataaacatacacatgctaagaaagaaggacattgcaataaggaatgaggctgcagtattttaaggacttagggacaactagataattatttgggaattgatgcacaaccttcaatgtccaatgtccctaatgtgtaagaccatgttgaagtatatttttaaatcatacatcacatagcacagaaagccataaagggaaacattaactttaatgacgtagaattcaatatctatgtaatagaaatgattctcatgaatgtaattgatacatcttttatgttaatggttattaataccaaggaggagcccttacatgaaaagaaaaaagcaaaaaccccaaatataaatatttagggcttaaaaatacattgaagaacagaaactagtgtgcagcaaatatttcagtaaatctctatgtgctagaaacatctggtttggaggaatcaagtggtccccttgcatgcctagctgaattgacttttaacttggccaaatgtgcaatagtcaactgagatgtgacacttgtaattaatcctcaggatagtcacacgcatagccacggacataagtgaaggatgctcatttatttcaacattaaaaatcacgaagcaatttaatcagcaatcatgggtcagttaaataaatgacataacttcagtatatttctatgtcgtcatgaaaatttatgtattcttatatacactaaagtattttatcatgcattatatataacatgttatatatttttaaatcaaattatttgtatgtagtatatgcatacgtatgagtaatatgtgcattggctttgtttgataaaagtatcttttgaagacttgtgagcagcttttatcagtaaggcagctgtgggagactcctgccgccttcattttttttctttttaagattttattgatttattatatgtaagtacattgtagctgtcttcagacactccaaaagagggagtcagatctcgttatggatggttgtgagccaccatgtggttgctaggatttgaactctggaccttcggaagagcagtcgggtgctcttacccactgagccatctcaccagcccgctgccttcatttttaacttctctccttgttccccttctttcttctttggaaggaatgtgttttagccctataggaaattagactctaaacttatatttaccagattacattaacattgttaacttgtgaaactttacgttgaattgtcccactgaaattcaaagaacacagacacttcaaactacttatatgggtccaatcataatttagatagaaataaaatactaaaatttagtcccattggaatttgtgactctgatgtaactccctctttccttataaaccagtcatttctgagacctgaggatctccagtaccctctccacctgtctgcgttctcctgagaaacaataagagactttaggaatgtcagtgaggaaaacgatggaagctattctgtcattgcggctcaaaacctatgaagcatcaaaagatggctcctgtttttttttttttctaaaccagaattctcatatctttaatattctacctataaaataaatttgaattattgtattgaagaaatgcgttttacaaaattgtctttcacaaggtcactatttgtagtagtttttgaaaatcaaaactcagagtgtgtttttagtaaaagccattgaagatcaaggctaaattgaaaggaatcagctatgtcataaaatatatctctagatatatgaattgcatgcatgtgccactattccaccttagaatgtagtttcacactgctgaagaaacatttaaaataacacagtgcaatcagagctcagctaatatgatctagtatctgggcaattccaggaaaagactgctgaaaagcatgccagaatatagcaaaagctacaccctgctacatttccatggaagggaagttatttttaggaagaaatcaaaagtatacatatgaatagcatcacattgtgggctcacaaggcattttaaacatcagtgttacattgtttcgccttctgttgccgtagcaaacacccaggattatcaatctgtaagaagaagagatatactttggttcccagttttggattccctttatcatgcatggctccttgcttctgagcctatcgagcacatggcagaacaatatcagtcacctagtaactagacagagagaagagagatggagatgggggtcggtggcagcaacatcctgtgattctcttcatgagcatcaccacaaatcctatatagcaaaccctggaagttgaacactttgctcaggctggcctccaactcacagtcctgctttgccttcatgagagattggattgcaggttcgtatcagcacagtttagaatatttgcatattcactctccactactgtggagctgctgagagcctttcttcatcaagtaaaccataacccacatttatccacaaggggtgccagccacagcgatgatgacattcctggtgttacttagtctaggctgctgagccagagtccatgtgcctgccattctaagccctagaattctgagcccctgtgcaaggctcaattctttctttaccctttccccagtggttcatcactcttggaggtcattacatttcacaagatttactcttatgttgttttgtttcctacaaccgaaggaagattttatctttatttcttagtctgaagaattgactgcatcttggaaacatggttctaactgattaaaaagatcaaccaatgagctttgcttgattctgctaaacatcatttatagcagatgtttagactgttttctgggctaaaagaagctatagcagggcattttgaaatccacagggttaattttaaatgttatttacttcggtatctcagctttacttatgagaatagaatgctattgaatttgagccttctaaataaaagtctaggaagataatggactttatcagtagaattattatgaggataaactagattttcttctaaagccaattttatttaatagctcaggaatgtgaaccatatcatgcagcagactcttactacctcagcctcagaattactcacaatcgaagagaacggcagaggtccaaatgtcatgaagccaaaagaaacaaacttgagtacagagtcagtaaaggagggtggaaaaggcaaatactgaggcatccaaatatggcccggcatcctgaggaagaactttgcgtatctgaagtagctcctttgcacaggtggctctgtgttatcataaagtacaaggattaactctcctcagtacatcagatttatcttgaaaaccctggctattttatgcctctgttatgctctgagcagatcacttaatgagccagttgatccttgctggtagcaaagaccaaggcacattcaccctgtatcctgacaaaaataaaagaccctaaagtaatcaaaagaagaacacgcaactttcattcttcatacagatctttgtgggtttgtttattttctgtagaaaaaaaaaggacatatccaagtctctctcacatttgacttctgactaccacctgatttaattagaacttggcgtatataaaaagacaaagcaatgccaggtaaagccattagaactctacatttctcatgttatttagtctggttaagttcacagttgatgacatttctgatattaggaggctgtcaagaatgagtcttgggtgctcatgtggcttctaacttcaacttcctatgaagcttgctccaagtttcacctcattcatttggagtaggttccattcagaccggtatttaatagactcccatttgagttgtctccacccagatcttagcaacatccttctttcgctaacatagacatagtattttcttgtttgagtcattagctctccttcttcctttatcattaacacctcatgaatgacttttaaaaagaataaatgcacagcagttatcaaaacttccaaggaaaatatttgatttgtgtttatatctttaaaagatttatcaataatcaaagttatttaagtagcattgcaaaaagaaacacagaaacagacacccaataatgtccaaccagtttgtaccacagcagttacctatgcttgctatactgtgacttttctggttggcattgaagtatgttaaagtgagggaagaatagtaggatttctaaagctagaatgcagtgtcacacaggtagtttatttgagtggggaagcagaaaatacattatctttactttttaattaaacttaattggtaccatatccttgttccttctctaccatgcttctcattccaggttctcatattttaatggaagtaggaagtaggactgtttcagagttactttacacaaaattataaacatttagactatttcagatgagccaatagttatgttggatgtctctatttgtaaggcatgcatggattcaagaagtttataggttgcctaggaaattttaatatgccaaaaatctatttgcagtctggttgcaggttgaaaaatgcagacttcatatattacaattcaattttagttcagaaaatatgtctaaccaggtgggttcagaaggggtttatgatagagtagcacataaactcatcacagcatagggttaagggctagtttgcaaatgtgacagcttgcacatttggttcccataactcagtctgacagtcccagcatcctgggttcacgcctttgacagggtgtgcagctgctctacccacgcattctagcagagaatatatttaataagcatttattataattgcagtaattccccaattctgctgcctgtgatgtaatgggaatgatgacattacttttccagggcagaactaaaataacatgcagtgatatttccagtgggaatttgcactaaaaattcatgaggcattaagattatttttatttattcttctctcatatattgcatcccagcctcagttcctcattcttcctctcctttcagtccccagcactaccacgtcctctctcatccagatccaatcctcttctgcttcccttcagaaaagtgcagggctcccggagagatcagtcaaacatgctataacaagttacaatatgactaggcaccagcccctctattaaggctgggtgaggcaagattggctttatttttactctgtgtatcacatcacattaaaaataggggattttcagagaggaaactaggaaaggggataacatttgaaatgtaaataaagaaaatgtctaattaaagaataaattaaaaaagaatattataaaataaaggcacttgtttatccatatatatatatatatatatatacatatattacttttgaaaaatttatatacatatacaatgtatcttccctccatttttccctctgactcaccatgttctcatcaacattccctcccaatttcatgtcctgtacttttttatagcctactaagtctaggtagaactacttatatgtgcacgggtatagagttatccaatggcgagcaaggaacctaacagtggccacatcctcaaaacagatgatttttcccttccctcccaattattcttttcccaaatctcatcagcaaagagtcaggactagagataattcaccccatatacactgagatttcggtgagttgatttttgtataggtcttatgcaggtaaccacagcagttatgagctcatgattttaacatgccatagccatagggcagtaattgacagcactcttccccatcccgtatctctttctccctacttcctcttctgcagtgtttgctgagtcttagtgctggtgagtcagtagagatgttgcatctatggctgagcatccaactccttaatctcagcactttgatgagttatgcactcccacttacgaacttaactcacagctatgcgaaagtgaaatatagtcagctattttagtagtgatatgtgttaaaaacagacaagagacatatctaaatccttgcaaatggatagatattgatgaaggaatagaaatacaaagactattaagaactgtggccttgcattatttttaaaagttagatgtaggttaacaaattcactgaattgatgcataattcactgagtgaagaggaaattagcacagcactaaataatttttttgatattagataatgttgtgaacagcaggggtactgtattttttactgtattttaatgacctcttatatcctgctactatttacattatttaaaatatcactaatcacattttctgaataccgaaatacaagggtgcctgtagaatgaaaatgtaagttgtccaggtggtttttattctttagcacttttgaatcaagaacctgctggcagagtgcttctagccttggaatcttattctctaatgtcactcataagagcaagatctgtcttggaattggacttccataaccttaaaaaaatgctttgaattctttattacatatccgaataacaagttcccgaattcctttgaaatcatcagactttgaaattaaaatggtctcaactcttgaattttttatttaatccatttaaaagaattctttgtatgaaaattcaaagggctgaaagcagtgacgatcaaagttgatatggtttaagacaagaacaaacaagaactttcttaccaaattttatgaaactgtaatgagaacttatgtctcaaaagtaattggcttagtgcaaagcaagagcaaagttgattcaaataatctgttttgatttaataagatattaaccaaacaggtaagacaaatgagtatacaaatcaccatagtttgtgaatacaatgttaatacatattgttcaggttatactagatgattcatatgatgttaaaatctaccctttcacagtttcagttatttattttgtgagtagacagtaaatctacaatgttaagtaatgtatttagcaactaaagtcaattgtattagaattgaatgagtactcacctttaaattcaggacataattgtgatgtttaggatatatgtacaagttagaaaataaaaacatttaaaagaaagcaagaaaagaaactgtataaactctgtttagtagttgtttctccttttgaatcttgaaaatatagatgtggcataagccactgagcattagagaattaaaaagtgctcctgtcagacaccctatgtgtgtacacaggcatgcatgtgaatacatacatgcacacacatgtgggtgtatgtgcatatgtatgtcagttcatatacagatgcacatttatagtttgcccatcatctactaataaaagtggaggtttgagaggtacaatcagtgctgaagggacaaaaatcacagttctacaatgtcaccccagaagctggaagagtttctttagtcttttaagggtattgattcagggaaaactgggatttggagatttgaagtagaagaaaaaaattaaaactagatagtgtgaagcagagttggaaattttattaaagaacttttaataaaaccttacatacaaagattataagaaagagcgccacttagggaaaataaaaccatataacatccccaaatattgatatattatcctcaagtgaggttcaaagaaaagaagacatacatgaatgtaggtataggagtctcaagaaaccagctcaattaagggttagcattagcatatatcagtttggtggtgctcaaattacttcctaaaagcttgcaagaaaccattgttttctccctttgtctttcattttggtaagtgagattgatcccactgtattttatttggaattataatctgatgaggtaaaactaggagtcatcatgattgtataggcattcagtatatgaactttctacagatgcagcctctggtaagattcctagagaactgaaggtttgtacctgggcagagtaaagtgccttgagcacctgttaattgtgttggagttcttgtctctgtcctgggaaaacacttcagccagccccaaaggtgaggtggtttttccactcatcatgttctcagaattttctttatctatctgtcttgagtggaactaaggtgttttgtttccgcatttattgaattgactttttcatttcatctgatgccagttagaaaaggaacctgaagaaaagtctggaagacaatgagcaagtttgatgaacccaacaaaggcagggcaagattagattccttcatttgcaagaagatgaagcccatgacaactgagtgacctatcaaaaacagtgattctccaactattgtggctttagatctcttccagaaagatagtcacttaatctcactatttgagcttcaaaaataataaattatttcataaaacactgaactgaaggctctgaaagtttaaataacttggccaagatctcaaagtcaatgattattgaagtatcagttaagtcctgaaggctagaagggtctggacaacttcttgtcatcattccaaatgtccagagcatgatgattttaatttgtttttccttttcttagcaatcgactctacaagctcaagtatttttgatatttaacaagcatattgcattttatttatcaaatcaagcattactggaaattttattttttaacagacagttatagatatctttactattctgaaatacaaatttaagtatatttgtcaaatctcattttttaaaaataatttatctttgacattcatcaaatttctactgttcttttaaaattataaactagatggcatgtttgtaaatttacttttatgaatgagtaaaaggttaatgaaatgaaggcccaccaatgtcttaaattaaattttagaatacattttttactagtatctgggtttcctcactgacagtagctccatataaagtattatataaggacaatttgataaaattcagcttataagtattaagctcctttcataatttaaaggatgttattaaatttgtctaacctgttcactgtacatataaaagaagtacagagctgtacctgccacagacttcccccaatcagctctgctatggtttgatttcacttggtaatattgatgatgattttacacaaactgtatgctcatatttttctcctggagaaatgttcatacctattcagatgcaaaggacacacgctcctcgttcctcttcccttctgccacttttaaattttggcactcgttccttgggatgagtctcccagtgacacctggagagtctgatgctccaacaggaaggaggccattagctccgaggtgttggcccatgctgagaacacagcacccgacagcctccacagcctgtgctttcaggcttccttctggtgtggaagtcagagtgttcagtttgggctacaaattttgaatattgaaagtgtgttagcattgaatcctattttccttggttcttaagaaaatgtaaagataatctgtcattttttttccttcactgacttagaagacttgcatgttttctgatgatctaatctatactgttttatgtactgcctgttaagaatatccagatcagaggtcaacaaagatttcaaaaaggaagagaaaccttgaagttagtcttaactgaacagtctgaagttcagaagggaggttaatgtatgagcaataggaacaactgggaattcaactgataagttgaataaacaatgttcattattgagtctaaaattgcttttatgctatttgtatacatttgaaagtgagctgttgtaaaaatgtatgtttgtttttgcatgtaaaccaatcctctagatgttcagagaaagaacacttgagtcattttaatgggaactaaccattactaccagctaaaaatagtagcttattctattttcttccgacaatgagcatcctttgatactgaaaataatgtgtcttgggaccatgatttttgttttctcccaaataagtgcccaaagtttaagagacactcaagaactgtgatctcataggccagccatctctgagttgtttaatagactttgatttcactctacttggctttaccatagctatgtgaaggaagtagataatattgtaaagaatgatttcaagtaaagactggcccagcagttcttctggggtccaatctggcacctaagcatctttgtagctactgcttcattccaacacaaattcatccgccaggacaaatccaaagagtctgtgaaatcaaaatgtcaaataatggaggtggtaggtgaattgttctcccacaaatagagagagacacatccaaatactgagactcaccacctcctagagcagtggataccataggtagaaacgaattgcaatttcagcctctgattgcaggatgttgaaaggggaacaaacactttgggttaaaaaaaaattcaaggaagcccctcatcaccttccctgctctgctcacttttgttcttttcttgtgagttctacaagggacttggtggatatcacacaaagatcctttttgtttcagtcatgaaaggagaattgtcacccttttcccccccttaaccaaagagtgtctttttttttccattttttattaggtatttagctcatttacatttccaatgctataccaaaagtcccccatatccacccacccccactcccctgcccacccactccccctttttggccctggtgttcccctgtactggggcatataaagtttgcaagtccaatgggcctctctttccagtgatggccgactaggccatcttttgatatatatgcagctagagtcaagagctccgggttactggttagttcataatgttgttccacctatagggttgcagatccctttagctccttggctactttctctagctcctccattgggagccctatgatccatccattagctgactgtgagcatccacttctgtgtttgctaggccccggcatagtctcacaagagatagctacatctgggtcctttcgataaaatctttctagtgtatgcaatggtgtcagcgtttggatgctgattatggggtggatccctggatatggcagtctctacacggtccatcctttcatctcagctccaaactttgtctctgtaactccttccatgggtgtcttcaggaggaaatattgtaccagaaaatctattacattttctcagagtccccctgtcttggagaaaaaggaacaatcaacaatgtctggctccaatcatatgactgaaaaaccaaacttgaaaaacgtttataaagttcagaggtgaaaggattataatattgtaaatttagcaaacattagaacaaccattaaccatgcagaaaaagtagtatgactgatgtctaaagaggagggagattgtgatcacacaaaatggttcataaaaccacatgtggaagggaaaagccaaagaaaaaatctaaacaaggaacaaacaaaaaccagtaccaaatttgctactttaactccattcataattagtttcaatgtcagtgctcttaataagatttttaaaatgtaaatcaaagcatataataaaacagaagccaaactcttatactgtctgaatgagaacctcattaaatataaatgcacacacagaaatatgaatgggtagggaaagacacagcacactctgctaagcaagagagaagccatgttaatgtcagatacagacaactttatataaaagagtatttttcctgaacacatacatgattacatagtgatataggcatgaatatattaagaaataaataatactttatttttggtaagatttttttatcaacttaacgtaatctagggtcatctgggaagagtgacctccattgagagaatgtctcaatagggttggcctgtagacaaacctgcggagcattttcttggttgatggttctgggagtctccataccactgtggggagtgccatccttgggtaggtgggcctagaaggtgttaagaaagcaggatgagcaagcatgagcaggaagccagtaagcagcaatcctctataggctctgccttcctccataggctctgtcttggagcttgagagtgagttggaaagataaataccttcctccccatgctgcttttggttatatttttatcactgcaatagaaagtaaaccagaacaactccttactgttcttaagaaggaacatttaccaaccttcaaatacctatttcaaaagaaggaaaggtgttgggatatttaatccattatatgcgatcagaatttcctagttcaagtatagtcaaatagattacaagaaaagactgagtctcattaacataactacaataattctgcaaaacaaatgcaaatggatacaataatttataaacatgtaatggcaataacagagttgtagagaaatcctgttcaccataaaaaaatcaattgaaacaattcttcatataattaagctacagaagaattgcacggtaatatacataaagaaaagagctttcatcagaattcaacactcattcatcacaaaactctaaataaattcatatgagaaagtgatcacttgaattagataatgcatgtctacataacactgcaggaaaaattacattagaagacagatgccttctcactaaggccaagaaccagcaaaggtgtcttctccaaatgatgttcaccatcctccttgaagttatacctaataaagtgagacagctaaaagtctacagaaagggaaggaagaaatttaaatgtattcattttcatatgacacgattatctacacacagcacctaaatgaatggccagaaagtcttggagcagataaatgacaataaaatgcatgtatgaaacattgaggtttaaatgcagagcagaagaaacaagtaagagggataagtgaaatttgtagctaaaattgaagtacatttcaaaatgaaacatatgcataaatgtaatataattgtataatatctgtttgagggaaattactacaattttggtaatataaatcacagaacaaagaaataactggagaaagagacacatttgaggatagcaagacttaatattattcttcccatcttgttctgtagatttaatataattccaccaaatttttaacaatttatttgggatatagtgacaaaatgattctaaagattttatagagtgacatatccagaattttatccaaattattaaatcaatttgagaggcagtgacttctcacctgacttctaaacatgttataaagcagaagattttaatatactattggataagactagatgaatacattaacataaaaaactagaggtcctggtgtgtgtgtgtgtgtagtcagttaatctttaaaaaaaaagtgtatgcgattagttgcattttttatgcataacatgcctgtagttactagttatagagttatgtgttgctattagttacgagttagagacctgaaaagggcattgaattccctagaattggaggtccaggtactgagagctgccagatatgtgtactaggaactgtatctgggtcctcttcttcacaccatttcttagtgtcagagacctaccctaggcatgggaagcagtttgctttatataaagttcaacgttcccaacctttctttctttgtttttcaaaaatttttattaggtatttatttcatttacatttccagtgctatcccaaaagtcccccacatgctcccccacccactcccccacccacccactcccacttcttggccctgacattcccctgtactgaggcatataaagtttgcatgaccaatggacctctctttccactgatggctgactaggccatcttctgatacatatgcagctagagacacgagctctaaggggtactggttagttcatattgttgttccacctatagggttgcagatccctttagctccttggttactttctctagctcctccattgggggccctgtgatccatccaatagctgactgtgagcatccacttctgtgtttgctaggccctggcatagtctcacaagaaacagctatatctgggtcctttcagcaaaatcttgctagtgtatgcaatggtgtcagcgtttagaagctgattatgggatggatccctggatatggcagtttctagatggtccatcctttcgactcagtcccaaactttgtctctgtaactccttctatgggtgttttgttcccaattctaagaaggggcaaagtgtccacactttggtcttcgttcatcttgagtttcctgtgttttgcaaattgtatctttatcttgggtattctaagtttctgggctaatatccacttatcagtgagtacatattgtgtgtgtgagttcttttgtgattgcattacctcactcaggatgatgccctccaggtccatccatttgcctagaaatttcataaattcatttttttctaaagtttatttgagtactgcataactcacctttgtgtgtgtgtgtgtgtgtcctctcttaaatatttgaaagacacaagctgacactttttgcgaattacttacaaatctacttagctagagaaacaggatttctgtatacattttcaatctccaatttatagcatgtttgctttccatctttttaggggccaatagcaggtgtctaatgtcttcctgttttcctttaactatttatcactcttcaactcttcttgacagttgccatgataatttcccatctcttgtccattgttggtggtgttggaggctcattacccaatacttaggatcttcagtcacttggtaaagcagagtccacataaaaggaatgtgcgcaccaggtggaacctggatttgtaaccacttgcccagacactaaggttaatcagtacctacttttgtcttaagttgtaaagagtagaaacattaaattaaaattctacacagaaaagtactcaggattaagcaaggcaagtaaggagtgcagtggtgaggagtaagaaggattgggaaatgagaattgaagtatcagagaatggcaatgtggatttacaagggacaagtaagacttggtagatgcttgataaagagctgctacagactaggaaaagaacagcgggctacaacatggcatttgcatccgagaagatgacaagacatggcttcattctctgctaggattttagtttggtagcctctattttaacagcaaagaatatggtgttgaaaacttactggtatccaaacatacctattagtctttccctccccccatatgcctgtgtaggagcaccatttaagctatttctagcaacactcaccaagcactatcagtggcccaggtccagaaaacatgcctgagctacgactctcatgaaactacactcatttcacaaaatgaaaatgaggcaaactaggtcaccagtattattaatttgcatatgcattacatgaatctaaagtaacctctattgcaacctcagatatatgccagggaaacaatactgaaaatattttatataaatttttagaaattgaatgtgacatggtagtatactcaggaggctcagtcagaaaggctggaggtgaaaagtcagccaagtttatattgtcataccttcactctagaaaactaaagctcggatgtagctccttggtagagcactttccttcccgacacatggcccttggtttggttcccaaaacacatgcccaaaaattttaaattggctttttaaattgtgagatattagaccttggtgataggacatctagaattcactttccctttgtatttaaagcattcttttccatttgcaatatctttcaaaaaatctctctccgtttgtatcataagaatcactcacaggggtttctgtttaaagttctagaagttactgattgtagttcatagaataaagattggattcatctaactttgtcaatcaatttgcaagctcaggtctaagagaagagatgggggtctactttcttcactagagtcacatctacttaccaaatgactaataagagtttaggtttacaatgaatatgagaaatcccaaagaagttaccttgacatggtattttaaagtattatatataacattggttttaaaatataccaatgttacttaaattaattaaatcaaattcattctcagctgtgataactcatttggtgcaaagttccatctgaattatgcaaatcttgctaagagggagagactgggagctacacagaaggaagagagaagatgaaaggagaggaagacgatccagattccacgtggctttaaatagccacaggtagatacaaatatcataagaggataaaataattgggacaacttgtctaatctagttgggcagcttgtatcactatcaattggagattatttcgtgggcatcttgtgaattgagaatttattgatatataaatctgactgattaattataaggttctagagttttgatttactgggttactggaatttgggaccactgaccacagtgggtttatggctgagaaggtacaggaggctctgaggcaggcaaactggagaagggaagtctgcagactagggctagctagaggcagcaagactgtcgttcagagagtagctgggtgtggtgcagaaacttccattctttttattatgtccccgcaacataatatgtcagtgaaatacaagtttttgtttattttgttttgttttattttgtttttgccactaggtgtgttttattttcattaaccatacatgcaatttctatgacatctcaggacaaacaggtggaatttggcaatctcattgatggtaggagcacccacttaaagatatactgtccaatggcacctttgtgaaacgcctgtgtcagcttttgattagacattgttttgtacatcgctcttccttcatatcaggagaggacctcagaggagacagagtgaggtgaggaaatcctcccatctaggcttataggaaatttctgtacacttttgctgctcaatggtttgtggtctacagactttctacgccttttgttttcagcctgggcctatctagctgcaattcccaccatgtacagtatgtctttttcttactatttgtggattctcagtagagtcagtgtttctgctgctcccatatattttgctgcagcaagagaccaagattcaaggtttttaaaatgccctagatatgtaattatacacagatgaaccaaatgataacttaacctttccagtgacttattagtgagaggtcacagcaaaggtaaaatctaccaggccagttattctatgctcctattgtagggttgtaatagtgagtgtatatttgtgtgtgtgtgtgtgcacgcgcgcactcatgtgtatgtgtgtgtgtgtgtgtgtgtgtgtgtgtatgcttgcatgtgagtgtgtgagtatatacacatatactcaaataataggtctacatattaagaagatagtcttgtaagcatatgttctcataatgtatctttgatttaggatatcttatcactaatccagaattcattttgccaatctatcgaaatgttttcccgatgttcttatgtgacattattgagatagtttcagaatgttgatataaacttctaccctcattaacattttccatgttaacttgggaaggttattcaacattttgagtgttggttgcaagaagtactaaattattatagataaacctttcaacagcttccaggacaaagattaactattgacactactttttagaataatgcttatgcagacattagattcagtatgccagtttccaaaacatttttatttcgtgaagttaaagagtatatatatatatatatatatatatatatatatatatatatatatatatacataactaatacataccatttcaccaacgcatatcataagagaaagttcactatctgaaaatactatataagttcttaaataacttggaaaattcctttaaaattgataattattttatgattaaaaatttctaaagtataagatgtatttgattaattgtttccaaattatcaaaacttcatcctcattgatattgctcttgtgtttgacatcctacttcatcaacactcatgggacttcatttttgctattttctttttaattgtaaagtatttccagaaaataatttcctagggatagactagcatttacttcacatattggtccaaatgacacagcttatcacctctagcttggccattaggatttactttattttgttcttgttgattaaagatctgttgtcattctatctaaaatatggactacaccataattttgctcttaaaaaattaaaaccagacacatttttcattctttgaggacttattagaatccttacctatgtcagagctgtttatttttatattttctttgtgggcttggcagctattgcacagcttgaaggaggcaggaaactaaagtaaagggtttcagtgtgaacttttgttcctgcctccaactttcaccagttgcattcaatttggacactcttaaattgccaactttacaattttctctgtgatttatatctagaattatacaatttctttagaaccagacacactttcatttagatatctgaaataatggctttaactgacttcacgtgtgcctttgttcagtgatcacatgaaactgaaataacttgagatatatgagtcagaatatatattattaatatttccccttgcaattagcttgcatctgctcagttttagcttcttgagccttatctttcatagaaatggctatttgccatactgacagagatttttatttccttttcttaattctttgactattctctttattccaaccctttaaatagctttgatctactttaataatggagaaatattgtctagatgattattttttcttttcttatattatctacagtagtattgtgaaaatagggtatgaataattttggagtcatatcaataatgactaaatattgatattatgtgacctttattatattatcttccatatttccacacactttgggcaatgtggtagtgaattgagcagtcgtcaataaaatatgagcttttaaaaaccaatctactattggaaaggaagaattatgggctgtatagaaggatttaattacgtacattgatcaagtatgtcagatagttattcaaattctcactcaacttttattgcctcaataacacattgatggcatgcctttaaaatatgtttcttttaagaaatacaaaatgcatacaaaataaaaaattatttctcaaaagtcatctatgttccagcaattggttctacacccatgcatggaggccggattaagtgaagtgtccgggtttaaaaagagaaaataaaaataaaacaaaacgaaaaacaacaacaacaaacttatattaagtcgggaagaatggtggtggcggtgatagggaatacaagaagtggaagggaggaaataagagctggatttgttttaaacacattataaatgaaaaaaatatataaataaatcaaacaaaaacttgttctagatgatgagggtttcagcaacatctctagggttccctttgtgtttggacaatgcacagatttcctaagcagcacatctaaaatagaacatttaagaaacttgacaacaactttgtaatagtataaaatgtggatagataaatctagtaagtgtatagagtttcaaggccaagacattcagaatatggtgatttaggagaaaccagaagagggcagtgaagaaatataaaggaatgatgaatgtaagactaattaaacatacagagaatggtagactaagtcccttcaagtagatcataagtcacatgggttttatgtgaaaaatatatgatatagaaagctcataactcactggacattttctagaatgtatctgttgcacctttggccttttataatcatatctaagctagttggggcccttcagaacattgagcccttttaattctgccgcttgccaggaacacaccactggctcttggcttggtaagatgtgaagccaagcctatgggcaatcacttaacctggcatactatatataacactcatactacaccagcgcacagagatctagacctcatctagagtccgaggctggcaagacttcagaggtcaaaaccagtgtgtgtgacaaggaaatccatggccaagaagaagaatacaaccatctgttgtgaaaaagcatcttctgtaaacgaaagtaattccccttcacttccatgtccaggtcccatcattaaaatttacattagagttattgcccattactgctaatcccattattgcctgccatgttagatgaaggatgatgcaaaaataaatgttatagatttttaaagtggcacataataaaggccacagcaataaacccaggacatttaacctcactcagactgcttagcatgaaagtcaggaaggacagatatttgctagagagaaagacaaatgcattctcactacttcacagccttctacagctgagagataatgttgcagcacattaactattcctgtgaaaaatgtatgcaaaggagagacaatttgtcactatatagatgggtgtcatggctataggttaaacattagtgaggcaatttatagagactgtcactcgggggtgcttattatgccgcacattgtctcagagccatttagtattttgttcactagttatgcagtgatcacaggcattttggagagatttgtgtaggtgtgaaaccaccatttcatgagtgggtgccctttaatccacagatgggaaagaaaaaagtcctccagtagctatgtaaactttaaaaagttctattcataacagccttatttataatagccagaagctagaaagaactcagatgttactcaacagaagaatggatacagaaaatgtggtacatttacacaatggagtaccatgcagctattaaaaacaatgaatttatgaaattcttagacaaatggatggatctggagggtgtcatccaaagtgaggtaacccaatcacaaaagaacaaacatgatatgtactcagggataagtgatattaacccagaaactcagagtacccaagatacaatttgcaaaacacatgaaactcaggaagaaggaagacaaaagtgtggatactttgatccttcttagaaagggggaacaaaatacccatggaaggaattacagagacaaagttcagagcagagactgaaggaatgaccatccagagactgtcccacctggggatccatttcatatacaaacaccaaaaccagacactgttgtggacgccaacaagagcttgctgacaggaacctgatatagctgtttcatgagaggctctgccagggcctggcaaatacagaagtggatgctcacagccatccattgtatggaacacagggccccaatgaaggagctagagaaagtacccaaagaactgaagaggtttgcatccccataggaagaaaaacaataagaactaaccagtactcccagagctccctgggactaaacaaccaatcaaagaaaacacatggtcatactcatggctctagctgaatatgtagcagaggatggcctaatcggatcatcaatgggaggagaggcccttggtcctgtgaaggttctatgccccagtatagggaattccagggccaggaagcaggagtgagtgtattggtgagcaggaggaggggggaaggaatagggcattttcagaggggaaattaagaaagggcatagcatttgaaatgtaaataaagaaaatatctaattttttaaaaaatgaaaagaaaaggggatgtttcattttcacttaatttcatcaataacatagaaaactgtactgaccaacaattttcataaataatggaaccatggttcagttccctaaaatttctccctaaaaatcacataaattttttaaaaaatgtatgtacaacatactactaatatatgtaaagggnnnnnnnnnnnnnnnnnnnntcattgtaaaacttgtcatgctttaacctcttcattcagagtgtaaaatctgctgtacaaaaaaaattggcaaatagtaactccatttgatactacatgtatttcagagtggttttttgttttgtttttgtttttgttttccttttctgcttcaataaaaactgaccatgtttcatgaggattttaagagaaagccagagatcctgaaagtagcaattcaggagtgaagtgttgctttccaaaaggtttgaacaccaacaaaaatgaagcttgactgtaagatcctgccatttattttattaactatttggctctgatcaaatattcatcaagtaataaatagtacaaaattcctgatttggctattgcagaagaaacaaaaactatgaacatttgatttattgttaaaagcacacttgcctaatcattaatattttcctgattatgttctatagttttaataacacaaacactaaagcatcccggtgaagtaaatagacaagataggcatcccaagttactgaattaggaactgaggttcaggatcagccgttttcctaccaggtggtcagtgaaagttggctctggcttctaattccccactttggttttattgtcgtactgagccctttgtttaagaagtttggaaattgacaagacaccctgacaaaggtactgtaactgaagtaagctgaagatggggtgaagagagaatgacaagggcacagatacagccagggaaggtggcattcacttgatcataaacaggattctcttcgtggaagaattgccatcttactaagtgccattcaatttattgcatgcttgctgtgtgctgtgctctcttgtgaggcttgtacacagaaatggatctgattcactcctcagttggatcactgcaaggagaaagccgagaagcagtaactctggctaccacacagtcatgcctttagaatcacaaatgataaacacatgcatgtgattcagatcacaaagaactgataaactagagcaactcttctttactcagcagctggaccacataggcagcttttgagcaagagggtgatttctgctgcgatagcgaagagatgtattacagaggatgctgtttgagaagttattgcaggaatttagtcaataagtgcttaagagactctattaggcactgtcagcagagctaaggaatacagattggagaggtcaaatggatagtacttgctgaacacttgtattcttggtaccaaagatgagaatatccttacatcttttggcttaagaaaatgagttcgattttcagctcgtgaacactgtcttgtggaagcgataaattcaaactaaagaaatatataaacaaacttttggtgcataattgatagttagctaagattagcattagttacaatgtggaaagtacggtggaaaccagatgttttcgtatggttatatagctgctgacactgctgagaatgtgtgtgtgtgttgttatgcctttataacttatgatgatatgggtaatattgctatccttaggctgagacagaacagagtaagttgtctctccaagctcaaatttagattaaaatacaaattgctcgaataattagaatttttattttttgtgcctacagtcattgctagtacatccttggatactaaataatttctctatgtctttaacctcttaagaataaattatgtgacttagatactgtaaaacaatggtttcatatatttcttttatttttttaattctataaagtttactctcctgatttgttgaaataattttaactaccacttgtttgagaaaaaagaaactataatataaacatggacctataaaaacattaatagtatatatggtatttaatattgtgcatttactgggtatgtgaagagggataaacaaagaaataactggggtgatagagatttaggaagatttacatgaaattttgaattggatcttgctaataaggataaaaaaccctaaaagtgaaatggaaggacaaattaggagacaaattgtcagagaatgcctttcaggtagtatgttttaggaagacctgcagtaaagagcataaactgaaagaggagaaagatgaccagactacaagctgcaaattgggcttcctacttatgaagcagctcacaccattttattagagtaaatattaacatatagatgtaaaaatagaaaacaaaactaaatcctactcagctcttttccccttccagtaaataactgtgtgaagtctcccagactgtatcgtgaatgccacattagcagcaccaatgagcagaatgacccaagagggaaggagtgtcggatgccccatcagcagtgtttccagcctagatcttccgtgcttgtaataaaaagtgaaatgatcagcaagttactcacacccaggagattatgacttctgtagtgtgacctaaaacgtcttatgaaaggacttgactttgctgagtttctcaaagttgttattaaatatttaactcaagtagaactcaacaagaatatcttcaataactcctttgcaatcatttttaagcctcaagtcatacatgacctccttatgttaatcaggatattcattcaaaaacttacaacactgtgtaaaactgtaactgtccagaccacgaagctggagctgaaactgtcctctgtctatatagatgactaaacagaattctgatttttttatctcattttagaaagctccttttgcatttttctcagagttaataacacactgttttgaatactctaggacttctaagccttcttcctttagaagacatgatgcagggaggtagctttaccttttgaaagcatcctcaagcaataaaatatagagatgaaaatgaaataaataatcacattttaaattgattcaaaatacctcagttttagagtttaatgtgtcaataggcttctacactcctcatgctggttacaatttcagtatgaaatgttcttacaggtttataatttgaatattcggttcccttctagcagaattgtttagagaagtgctaggaatccagatgccgtggtgtcacttaactaaggtgctcattctgggtatggcaatggaggttggctgcctgtttgtatctctttgcttcttctctgctacaaggccagaatcttctgccacatatttgtatagccatgatcctatgcataactaagtgcccagaatgaagagtggataaaacctcgaagactgaaagctataagttatttttatccattacattgattgtgtcatatgtttccatggtgatgaaaagcttattactaattccaagtaatacagaaagcttgtgctaaaagtggggtcattgctttcaataaacctaaaatgtagttctgaaattttggagataggcatatgagaaggatttgaaaatgtatggagattaattagtactagtcaaagcctaaagtagaattgactgagtgattctagtgtgagctcaaaagtcaagaatatggacagctaagaatgaactcataaagatgcaaacagaaagaaatactttaacgagaataggaataaaggctatttgtgttttgttatggtgatgtggtgcatggaccttttggtagcccaccttaatgtttcaggaatagttcgcactatcagcccctgcccagagaatactggatccgcaaatgaaaaacacagatacacacactgatcagtttcaacctgccttattggctcaagtgctggtcactttcaatctaccatggctaacgtgcacttcccaatactcttagctcatcacttctcaacttgccctaggttcagttgctcagttacctggccatgctgctcaagatctcacatggcttggttagcttgtctatctcgaaaacatggtgagaaacatctttcctctctctctctcctgcatttgctagatcacttgcgaagacctggaagtctcacctattcttctagctcattgtctgctagcatcttaattgatggatcaagatccaactggagaacaggactacctctacagtgatgattatctccacctgctatcagttacctgagacctcatgggcagtagagtttaagctagtgaaggaatatttaagacagttcagtatcttggctgtggcattgttagtaagaacatcttttagacaagtttaaaatgagaattgcaaacaaggagtagttccggaaagttttggaaaagcaccattttgacagtcaacttgaggccaagcaagatgtacttattaataagattagtaccattaaaaagtaaggtaatgactttcaagagggaagaagaaaagataccttaagaatatcttaagaataaatacaaccactttaaagtcaggactgagcttataaaagatgtacctgcttaaaagtgctctgtagtgctctggttacacagggttgctggggaaaatatttcttcatatgaagaaacctaagaaactcagaggatgctatggccacggttcaaggaagagaggctgttgcttaaaaagaaagcaggccttgatgttatccacatgatgctagttttatagatataacagatggcaagatatgttgaaaagaggaagcctggtgttaatgaattcttgaatgaatgtgtgctattgacatgggtatggtcatgtgaagactctagcctcagatacagaggtaatgggcaaagattctgctactgcggtgaggctcagaaagaaatgacaaagctttacttggggtccaaatgtggatattaatagtttatacagaaaatatccatcatcacgtttcctcctagatttttacaccctgaaaactgctctcttacagagactactcctaccaagattagctaaacctgactactttatacatctgtatactgtaaaccctgcctctttacttatctcttatgaccctacctccgtattcagctgcatccaataaacctgcctgtcttttcaactctttatagaaaaacgtggtgagcttccagggtgctacagtttctctatcacaaggccagaaccacctgatcccaacactatgaatcttgggtgctatacagagcgaaagaatttagtgtcttccctgttagatttaatttttttgtcattagtttcatttgttttcttttgttctatccttccttcttactccctgttacttcactttagaattgagatttttttattatttgcattttagaaatacataactgtccatttgacttcatattggttcataggtaagagttttgtttgtgtctcagaaaagactttgcatttggtctttaagccaagtccgtaatggctaaaataatgctgactctcagagatagacaattcattctgagatgggtggaagcctttggaagccagggcaaaatgttaaaatctgagtgggcaatgcacactctctagtttttggtgttttttaggaaaatggtagagagtggaagttaacacatagatggggaaaatcggtcactgtgggcatgttcttgcgggttatagattgtacgggtcctttctttatctctctctgctcatttgcttctattaattgaactcagttctaccacagccttccattacaagcacataacaagagtgaaaatagagcttttgtatcaaatacctaaggctcttgtgtgtctcacacccaaatgtctaagtccttctgcaatctgattctgccgtttccccagagtagcactgtgtttgactttgtgttattgtcattaagtttccccttctcaggctgtcatttagaacttagaaacagtacttcagctaagatgctttctcacagatcccagtgacactcgtaccatatagggttagggactgtgactgagcagttttgtggatattaagagaaaaatatcaaaaatttgggtacactagaaaaaaagaaagtccttatatgccatgaaagatatatgtgatagatagggttgagggtggccaaggtttgtaaagagacgaaggtcattgctataaaataattacctagaaaaaaatgtttctaggtttaaagagatgtaatttcttaagaagttttgtacaatttatgcttcttattgagacaaaagcagtgcttccagctggttgcaaaacaaagaggtctcttgacaacacacttcagactaatggaaaatgaaagctatggctccttgctgagattttgtgttcaaacagtggcttccctttcaagcatcccagtgtgtctggggttgctctttccaacacagaaaatattccattaatgagaagaagctccatcaaaataatcatattgcatgatattcccatagtgtctggatgccatgccaacctttcacaggaaatcaaataaagtagatccagggagaattttatagcaatccactcttttcaaatgtcatatttcatcaatttaagatttagcaaatattgtaaccaattcaaatataagatgtgcaagttagcacacacgtatccatgcacaaaataagagatcacttactcaaaatagtttgcctaaaaggcataactgtcacaatctttttcatctaaatgataaacagacacatttatcaaatatattaaaggctacttttttttgcctacatgagaataaatactatgggcatgactaaaatagtactaccttattttagagttacatggaatgtatgaaaaactatttggtggttctctgaagtgtcagcttatctcaaataagacttaaaataaaagagttaatatcaataatctattacgcagatgttttctaaaaacccagaaggcttatattagatagaagtaagtagaataccaagaaatatttaaaggaaaatctcttagaaataatgaccacccagagaaatatctgatatcactatccatcagttaatatataattattgaaatgttggctatcatttattggtcatctactgttattattgtcatcagaatccacatctattttagcaaggttcttttgatgagccaagtctatatctatataatattgtgaaagagacaagtgaagtaaggtagtgtttgttttaccttcaaatggaggtaattctttttgaagatgctggtatgtccaggatcatttgggaaatactatgtactcatcaaaagcatctaataacctgggttgatggccagaagactgtcacagatgatttctatagaacagtgcagtacaaggccaaatagctcttacttcccagaaatacaaatagtcatattaatgtctcaaaagaccattcagattatattgaagaaaactgaatagagggcccattagtgtaggtgcagtaacaacttgcttgttagtcaattaattgtggttttaaaaaaatactgtacactactttgaatgcagatcctgaatccagactgcctacatttgaatatagcctctcctactgactatcaatatgacttagataagctatttccactatttggcttttttttttctatcacaggattttggaaatattaatagctcctgtctcaagagttatcatgagaaagaaatgagatgacataaaacttagcatgatatctacaatttaagtattttctatcactgaagcagggtggatgggatgaagaggaaatggctaaacatttgaatataggggtctcagcatagaatttcaaggatgacaaaagcagagggaatagtcatgtgctatttactgagataaaaatacctgaagaggacaatgggttggggaaggaatggtgactttcaaacactatcatattatattaaaaataatggtcctgcaaaatagtttataaaattctatttatgtgcagaagaacatataggtcaggctttgtgttaaaaatcagcaactaagtttagaaaattgatgtagttttatttactaactttatttaattgctacttgattgggtaacacaaagcaggatgcctctctggtgaaagatctctgtagtttggcagcaagtgcgatattttcttttcacaggtattttggttaacattagaacaatgggaacacactttgataatataaagaattatcaaaacaatactgcttaagctttttaaaatgtatatccatgtgtgtgctggttaaaggcatgcatgctggtgaccttgctaatggtgtgcatgtgcatgaagaagacagaaaggagctttggacgctgttcctcacgatagcagtctactttattcttgatacatgttttctcactgaatctagggattgctgattaggacaggccagttgactcatgagttccagggatccgcatgcttccgcatccctagtgataatcttattaatgcatgaatctatagctgttttttttaatgagttctacggttcaaactcagttatctgcttgggaggtatacattttaccaactgagccacctcctccccagctcatataatgtcttttaagcaatcggatttgcttaagaatggagctgttttgagagaatatattgtctagataagaacaagttatttctaacagcaataatagacacattaaagtgaaatggataaatcttgtggggttccacttgtagacaaaataaataaataaataaataaataaataactacaggcaccttatagctgttgagagagagagagaggattaaccagtctcagggatgagcccactgtttagttaccctataaaaaagagctcagccctgaaattaaatatacagacacaaacaaacaacaacaaaaatacccaaaccacaaaagtaaaacacaaacaaaagcctcaaacaaacaaacaaataaaaaggttgtattatatattgaaatatatatttatatattgatatatatgtgacattgacaagtaaagataaagaggccaaaaattagagcagaaatgagggtgagggacataggaattgctagaagagggaaggattttaattgtattttaattaaaataaaagattaaaaatacctaatgacttacgtgtggttttttaaattatacttaaatatatttgaagcttgttaaataatctatgcccttccttgtagccttaattgctatgttttatccttaatagttttttgaattcatcaacctgaatgctaagtaaataaatttcgataaactagatgaattattgatattaatttactatttctttcgatttgctaatgactttgtattttacatgaagggatattgcatttctggccaatccatgtaattacatgatgattaaatgactttcatttctgtcttttcaatttctagtctgctcccagttttcaagaggcgtctatgcgatttttgggttttacgacaagaagtctgtaaataccatcacatcattctgtgggacactgcatgtatccttcatcacaccaagcttcccaacagatggcacgcatccatttgtcatccagatgcgacctgacctcaaaggagcactccttagcttgattgagtactaccaatgggataagttcgcatacctctatgacagtgacagaggtaggtgacagaatgtatccccttttaatgggtcaaacacagcatttgtccttggtcctatgtgatgctatgtgatgctatagtaatatatgaaaataactccagagtttcttggtttaaatttgctgtgtaaattaatgatgctttttaaatacaaatgcattctaatgtaaaatagaaagggaaaaataaaaacaagaaaacaagagtccagagggatagaattcagaacccagtatttgagagcacagttgatagggatagtctatgacaatccaatgacttagtgttcagtcatagcataaaacagcttgttatgtgtgcaacaaccatcgcagaatgactgtgttactaatcatagaagtggtgtaagtggtgtaagggaatttgaataaacatataaatagaattttttgtagtagtttatagttatgaaatcttgttcaatgtaaaagagttgtcaggcaggaagtgtccagtctagacttgctttaaaataaggtctctgaacctcagagaagttacaggctgctcatgggatcatgatctacctgtgtgtgggatagtccacacaggctgatatccaacccatgctgctttatataattctacacaaatttttgttgttgctgttgaaatccatgcacaaattttgtgatggaggaaatctttcttttgtttctgtattattgttaaggttaatattagccggcctcttctggggttgaggagctgagatttttaacattcatcagatccagaatgagcaaaaataattctttgtatacctcacattctacgaaccattttgtgtaggtattcatgtgttttgggagaccacacataagtgaaaacaagaggataaagaactgtatataagaatagctaagctccacattgcttccttcagaagctcacttcctagagtactgaaaaatttaaatgaaacagaatccccttttgaccaagatatggcaccttgttgtgctgaagggcagactggaagggagccattctccatgatgacttagacttacttccttggctacagtggtcctgatgcaggctttcttaagctaggtgtctttccttggccctgttctcctgaaccatggcctgactttcctccatgtaaacgccagttagcaccctatacactgaatgaaaaatccatgtcaacagctttgtgcctctttgcaaaagcagatttgatacccacactatgcttgaaaactcttaacggagttatatacagttaatatagatttcaaggttcggggtgactttaatatggagctttctctgaatgtgataaaatgatttacaagactttatttattggctttagcctttcctaattttttaggacttgctgtctctagaactcttctagaagctacacgtcactctaatccgtttcttacatttgcaccctagtgatgatacttctaccatctatatgtattttcgtatttagaggcttcttttcagaacaatctccgcaaaccaatgtactaccaaatatatagaacctcatctctgtaatgctacacagatctctatgggatctattttcaacaaatcaggtagaattattttaaatgtatttcctttgccagcatcaaaccctccctccttgcttgaaacacttaaatgacttctttgcattgtaatgagaataacaacaaaattctcatcctggccttcaggctttatgatacttgggcattgcccagttctttattgagttcttaagacttgcacattcactaaatctaagtcctaaatctgattgacctttgttcactttctgagatgagccaaactctttcacctcgaatgtctgcagagtgctaaaatttgtagagcctcttggtatctgcttcaatatatcatttcctgagagacacctttcctactggcattctctcacaaaacaatgtcttaggcctctttctaggctgtatgacaattcataattaatagtgacattgattctgccactcgggagctatttattgagctccttctacattccagggaatgtcttagccacctagcataaggtctttttcttatttttggttttactgttagctgcaagaaaacaatgcctagaaacactcctcatactggctgtaactttataactggacatgtagaactacaggtcatgctaggcacatggttgatatttgataaaccatgggaataagtgaatgagttaaatgtttgtacatcttaaatttaatctgatattaaaagcagaatcatgattgtgaagttgaagggtcagaagatgagctttttactcatggatgaggtcagaggaatgtacctcatcttttctcttgccttatctgtcattcacgttgattaaaagagtgtctcaaaagtatccaaataaacaaaagctgacggaaagagaaaaagagaaacactaacacttgaagagagatactcagaaaaaaaaaggaactggggaacctgcaagttaggactgatggacctatgtaattgcaaagagaatctggggcactttacaacaatttcattaataccttcaaaatacttaatgaaattggacggatgagataatctccatttattaaattatactaattggttcaagtcaagcatatctgttggccaaagaatattagtgtggtaatattaagtaattatatattaaggccattacaaccttatcacaacatttttcagattatatcaagtagctgtagatgttttaatgtgccgagtgttgcagaggcctttctatcaaccactgtttccagagatgaattgtaagactcaaaaccctcaaacagctttggcctttgcgaaacatttattggctcatagaaatgggattattgttgacaacttttgtcttatcaatgacttaatttgtatgactttgtatgatgttaaaacgatccatgcactcattctgctagctatttctttcctctttctctgtccctcttatgtacctcttcctcttggtagtgctacatggttgatgtgcagcccacctcgacttctaactcaatcttgttgatcatggtttttaaagcaattccataatttcctccacttcacgaacctgtttgagccaatttgatccattctcaatagggtctcctctctcttgtactacatggatttctgtaacttacagtgttacactgtgatgtccagccgataaatgtccttttgaacagcatgagtcctaggcattgaaaacccctccaaaacaatattctccccagatatataaactactggaaagtgacttagatatatttttatttcatcatgttgctcttaatgaatactggaatcagtttatccttgttttccaaaatctaacaaattccgaggttatcatctagctttgtgtggaatcatcttccaccatgctcagtatcccagtgaaaggaaaccagatgctatttctccaaagcatgctgacatttcagaatttctggtatctttttatccagccacttggcagcatcctgatacttcttgaggactctgtgcccttccttaaagccttgggcaatcgctgaattgggagtaggttgacataggtttgaaatatgtttaactagagagtaatggaccaccccataagggcattagtccctgtgactttcatcattgaataaaggtaaaacatatttgagtttgagtccaatgatatgtgtttgttggttcaatgtcagagaagggaggtgatatatttctctggacagtaagtagaaacagaatcaattcctctttctatatttatgttttagttttattttgagcaaatactgtttatccccaaagggaaggaacttgattccaggtcaaagaaatcatttagcatcatagaactaagaggcttcaaaactccattttcctctcaatgtcatgagaaagatgataaagaatacaggataatctaatctagactaggcacagtgccacgagttagtgagcacacatattactctgcctggaagaatgagtgagtgagtggaacttttatgcaacaaacaaaatattgttttgtttttttattaattattttaagttttgaatgttgttctcctttcctggtctccccaagccccccttgcctctaagaaggtgtttcctcaactactcactcactcctgcctcacttgtctagcattccttttctctgaggcatcaagccttcacaggaccaagggtctccccttccactgatgccagataaggcagtcttctgctatatgaagtgggagccatgtaatgactcatgtatgctctttggttgctagtttagttcctgggagttctgaggggtccagttaattgatatggttgtttttcctatggggttgcaatccccttcagctacttcagtccttcccgtaactcttctattggggtccctgggctcagtccagtggttggctgtgactatctgcatctgtcttagtcaagttctggcagagcctcttagatgacagccatacgatgctgctgtctgcaagcacatcttggcatcagtagtagtgccaggcttttgtatcagcggatgggatggatcccaaggtgatggcctttccttcagtctctgctccattttttgtccctgtgtttcctttagacaggaacaattctgggttaaaatttttgagatgggtgggtggcccctctctcaactgagtacaagtaaaatatttttaagaatgaaggctcttctggatggaatatacttttggcagttaccattttaaatttcagtccttaataagtaaacagaagaaggtttaatctattttttttctctcagtgttattcacagtaggtccaaatgaaataagcatttagtgttagtcattttttttaacttttagaaaaaatgacagctaataaataggtcatgcatacagagcctattgctaacaatgttgaattaggtatttctttttctatacaaatgtttaaaaattcagtagctttgaggacttaatttttgtctcatcatacaattgaaatgttttaagattaaatttaaatttattaaaaggaatagttcatttttcaattttcttctgctttttcaggaacagctatttatctcaacatctttctttttcttttttaattgttcagaaacaagaagaaagctgacatgatgcatagaatatgtattgagtgaatattgctcactgatagctttacataaaccaattttatgcagagcatccaattcccacacatgcttatagctgaattaaggaatttacattccgatgaagaaatacctgtgctatttcgtatgagaagacaaaatgctcaggttactccatctcctgattaaactgtagggcaagagaacagccatatgcatgcgggttgtggataaagaggttaatgttatctttgtatgtagaatgcacatttttggtggtaaataagatttaaaaatattgccctcttagtacagcaggcaaggcatcaatctcaagagtttaaaagtcttgtatgaactgcaaagaaattgtcagtacaaatcttacaaggttgtcagctgggagggatgagaaacttgactgagtaactgagagtttgtgcctatccatgaaaaataatctgagcaaggatctacagtctctttaaattttgggtgagaccaaatctcagtttgtgaatgacttgatgcaatattatacagtcacaactgacagaacatatatcaaatctgatataacattactctagaagttgaggttttaataaatataagtaacttgtgttagtttacacagcttccaaaatattattctaaagattttttaaataatggaatctacattgagtgtgcgttacttgtgacacagaataaatgagtttggaagttagtcatgaaaaaaaaatccattatcatttatttttatatactagcccatctttgacactgtgaactatcaataaatttgatgcttaaatttgtcacttgatgaaatctacttataaatttataagtgaatttatatgtaaattcttataatatctgtcaaagacaaaacaatgccaaatgcattagcacttggggtctttggtgtggaaatttcatgatttaataaaatacaataaaatatcttagtgcataaaataaaggatactccctaggactgctacatgttaaaatggggagagcatgtttgacggtgtctgatagttagaaggtaggaccacaatggactagttagaaagtgtatttttcagccgcatgtagctgttgaaatactgaggtggtctggtgtgtgtgttttgcctttttctggtgatgacaagcagacacaccacttgaatacttgtgttacagcttaggggggggttgaatttttctggtgtgaaaagaaatcacggatgtatcatgacaggttctaaggtttttatcactgaaagattcttttatgagtgatgagagatctatgtcatcccctgaaaacgtcatgcatatctgaattttttattataaaaacagacacaagggtatgatctcgtttactttccccagattgctttaagtttactgtattatgaactatccattgaggtaagttattttctttattccttataaactatgtagaaaaattgtcaagcagtttttgagactagttataaagttcttgattttcctgtttcagcctcgacaaaagctaagatatcagagtagtggaaccagacccagattgcctggaattcttaagtgaatattacatgaaaaaatttattgtttagtatgtatatcctatcactctgtacttcttttgaagaaagtactgccatcattttttcatttgttgatatttcagtatttaatggaaatttaattctcttattttatggataaccactataatgttgtcaaacttagaaataatccattaatatcattttaagtgctttctcggagaaggataaaatgagttatatgtgttatatttggttaatatattttgtcagagttgttactatgtgatatattttgtagtctagatttttacgatctgaacacatttgatgtttaatatatacacccatgttccctgtacattgataccttgataaaattagttttttatatttcagcctaactgtgtcataagtgacatagaatacttgacatttgttaccttgactcattcactccagtgggagttacacaaggttaactttatattcatgttttttggttgtttattagctgagttgtgactaaaggaagacacaaacttgatttcctcttcaccttgagaatatgccagacaagaaaatgtgtctgtaaccccatagttcctgtttgtttatattttcaaaatagttaattcgtcctaacccattaaaagcaaaccaatatccttaatgattaatttaattatgattccaggggtttaaataaaataaatgtaggccctttactctgttgtcattatgatttgaatggtgctacattttctttgtctttattaaaagagctacaaatggctccttcaaattttggcatattttttgccaaatttgcagaatttacttgtttgccagtatcagaatatattctaagctcactttgtcttctcatgactaatatcaaatccataaaattctcattgactttttatatctggaaatattggtggacaaaacagatagttgtttgccattgtaaatagacctaaaataatatttggtatttgaatttagcttatagacagatttgctcacatttggtgacttacacgtcatacagataaaaacagattagtgtagtttttcaagtgtgcagatcattctgtaaggaagaagatgatatattgagcttgaattttttatggggctttgacatgtttccataaagttattcttctatgtgatgaacttggcttcagtgagaacagctggagttatttggaagacaagcacatatgctggtttttctagtatgaacctgtaaatttagctcttcaaaaaacaaaacaaaacagaacagcaacaacaacaacaaaaaacacaaaaaacaaaacattctgctctagccactggtccaaccaatatttgtgatatgagacaactctgaattagagagatagctgccaccatctggttaatagatgaacaattcactctccatgagatcaattcctacaaaaaatgatagcagaaggctgggggaagctatcagtctgctgctgattgggggcaactaaggatgaagggcagcctcttagagatcactggctgtgctatccaactgttcagagattccgtatggaaatgtaaaccctatcaagttactagtacaaaatggtagacagtcacctacagcaaaagccagtttgccatctatgaggtggacatgcttgggacagcttttattttacttaatttagacatattaaagagcttgtatttcagcatgttacaagaacacatcttcgaggcacaaagaaagcaattttctttggtagtttgtttatccctttttaaagatatgtgatgcagacacgagcaaatactgataaaaaaatcatagcttctgtcacaattcagcctccctaagctgaagaaaacaccaggattaataatgacctggccatttcacactcaggtcctgagagcctctgactgatgcttatcagtcatccttgcccattgtcttcccaggcttatcaacactgcaagctgtgctggattctgctgcggagaagaagtggcaggtgactgctatcaatgtggggaacattaacaatgacaagaaagatgagacctacagatcactctttcaagatctggagttaaaaaaagaacggcgtgtaatccttgactgcgaaagggataaagtcaatgacattgtggaccaggtttgttcctctctgttttctgccaaatatagactatgcatgcagcatcagcattggcaaggatcattctgcaagatgcttggacagcggtttttagttcatgtacaatgcagcaaaaatcatcaattgaattatccccagcctcagtaagcaatggcagatggctgtcaataatgctgacagattggttttatcattgaatagcttcaatatataatatcaagcattcatacattacataagcattgtcctaaacttacatgcttttctgtgttggaaacactaaatttaactcttcctcaacattttaagtagatgtaattaagttgaaaaatgttcctagggtaaaagtgaaatcatgttgactcatacatgattatttcaatgtagtgtactccaagcctatgatattttatacctatgtgtcttcaacactattctattgctatgaaaagacaaccatgtaaactctttaagaagaactatttaattggagacttactgacagtttcagaaacggagtccattatcatggaggggagtacggtagcaggcatggcaggcatggaggtgctggagtgttgcctcctgatcttaaggcacgagagggaaggagagtctggcatgcctgctatactctccccagtggcacatttcctccaacaaggttcctaatctacctaatcctatccaatagttccactccctgtccattaagcactcaaataagtcgatgggggttattattattcaaaccaccacactatatctatatatctgggaagaggatgtatttttgtaagaagtaaccgttaggtttacacatacataagagaatttgtgtccacaaattctaatacacaaattaaaaggtaaagaaaatgtattccgactgtgttcacaatgcagaagtcaacagtgttcgttagggttttagaaagaataagaatatcagacctgagaatgctttttttctgtccttatcatactgccttacttcaaataaggcctatcaggataggacaatcatgaagggataccataagatacatagcaaggaaccaaatctttcactagtaccttgctggggtgtgtgtgtgtgtgtgtgtgtgtgtgtgtgtatgtgtgtgtggggggaggggaggagagagagggagagagagagggagggagggagggaggaagggagggagggagagagagagagagagagagagagagagagagagagagagagatgaattgagatagagacataggaacagagactgcagctgtttgaaaatacataaaatcagaaagaaaacaattgtgcatgcatttctattccttttagcccatgaaataaaaatttaaattcactgatgtattcctgacaaaatgttcttgaaacaagtttttaggaagccttaattgatatatgatatagacctgaagaaataaaatggagtgtcctatgaagaattaggtaactacttcaaactaatgaaacctgaaaaaataatcaaatgtatacaagagaggagaataattttaattaaaaaaaatcttgattctggtctcaggagatgaagctaggatttctgttaacttacatctctctttgaaatgtgctcttcagaatcacatttgaatttcatcagaggttattattaaaactaaattttaataatattcagtagtctggtttacaattttaaatattcctgcttcgtcataataagtacaagtgaaacccacacttgtgtccttcaaaattattagtagggaaaattgtgtagcaaactggaatgacaaaacgcaaacaatgtttgaagcaacatttataattagttaggtaagcattcatgcaatacacaacaaaatgcattgttttacatctctaagccatacatgtgcacctttagtaactcattaaattagtgtccaaaatggatgatgtaccacttaaccatttattaaaggcattctctagggggagggtgcaaatactaacaagaaagactgctatttgtatctcatgagattccttttagggcaagaaaatacatacagtttcagaacaaaaattatagcatataaacttgtgctactcagctttttgttaatataacaagtaatatagtaaatcaaattatagagaggaaatgtttattttggttcattaagatggaaatatttatccatggtcacttgcctgtgattttccgattagtggcaagactatctacaatgatgtggtgtgtgtgtgtgtgtgtgtgtgtgtgtgtgtgtgtgtgtgttggaagcaactgattacttcaatgtagaaggaaagaatggggagacagaaagggaccaggatccctctaacccctcaagcagaacttctaatgtccttaagaccttacactatgtactagctcatgaagcatgtacaaccttcttgtagcatcaaactgaggatcaatcaagccttttatattcgggctctgggttgatcatagaggagctaagctatgtaagtagtctatgatgattggaggaggatatacctatcttttgagagaaatgatttgtaaggtagtatttggctagtttcgagccattcacttatctcttgaatgaatatttcatatctttagtgtttgctgtgcagtcactgcagtgagtctaaagaaacacattaaaatattccaagccccatcaaagaatgaggatgctatggttatataatgtcaacatggatgtatcatgactgaaaagaacaaactgttctggaaaaggataactgaaaataatcatttaaattaggtcagaatgttcttcaaggaacggcattcaccaagtacaaggttgtggtaaggcacatcctaagaaaaaggacactcttttattatttcattcaactagcatttgcaagaaaacacagatggagtgaacctctttatcttcatagcagcaggaaattagcaacaaaattaacttgcattagattaagactattttaatatcatttgataaaacccaaaagacacttatttctagctgtgataagatgaaaaaagtatccagccatcaaaacacttgtaaattaacataatttttctattgtataatactaattgctattataaagcaaaattataatggctactatggcaacgctgacatttataaagacttgaacctagtgaatatttatatctcttatttttctcagtaaatagaagtaagaacaactggcatcattttgactatttatcttaattctcctatagaaaatggacattcacaaggtagcttgctcagtaagcagaatcaacagttgtttcagagatatttatgcacacaatgcatgttgattaagctgaaataaattagaatattttttactttcaagaacatattttcttcaatcttctgccttcaacctggggtatccatttttttaatgaaaaggcaatttgattatgtgatacaaaaatgggttagaaggcaatgtaagccctaatttcctttcaaacagctgctatacaacatgaacattgcattctgtagaatcttttcaagaaaatatctttgctttcgagtcaaatgtgctgattcatgcctctgactttgtctcagttgatggacagtcatagaagtcttcagccaggcgatgaccaccaggttgagactggttacaccttgtgtgttaataacacatgcttgtgatgaagtgaggacatttgtaagggaaactatagatgtaaagccctgagctgtttgtaagtaatgtgctattatggaaaaacagtttagaaaccccatgtggtctgagttcagagggagggtagagtggatctggagtagcctacaggatcactatggtattcaatgtgacgaatttgcatagagacaaagggagccagagaaacaagaagtaaactattgcattgcataatttttttgtagcttgctgtttcacattttctatttgtttgattattttctttaaaaatggaaggatagtggtccaaacttggaatcccagcaatcagaagagccaggttggcctgcatgctgagttcaaggagagtctgggctacagagtagcaccttttctgaaataataaatcaataaaattagaggaattaatttgaaaataagtgactctagacttccttgaaccattttatgatttttcagctttatgatggcatatgaatttatcagaagctgtccatttgaactctgtttttttcctgtggtagcaataggcagtatgatactccctggcatagtcactgctcccttcagacattcctcgagtcataaaaggaagaaaccatacttctctgaattcctttttgcaagctatgaagaccagtagattaatggaattaaatgcattttttttaaccttagttactttcattttacagtgggttgatcactagttggcacctctgtacagtacaaggtcattcacctgcacctattttctatgtcaatgacatagtaaagaaaatgtgccttaataatattcaaagacactaactatagccattattagagtaatctctcattcaaagatgtaagcttatcttgcctctgattcatgaagtaaaattagattcttggctactttgatgcctaaagcaaaaagcattatttatctgaactattttttagctgcatcaaggataatattatattttctcattaatatcccctaatctttccataagctttatgcctgttatgtttttaatactgttgaattgtaattataacatgtcagaatttttatcaggtggttattttattaagacacaaatataggctgttagaaataaaattattgcttgttatgaattaaatatagttgcttttatgtttccccctcagaatgtgtggtatattttctgtactgaataaaaaaggggagttattttgatttagtggttgacttcttaatagataacattattaatcactaaagtgaatcaatatattttcctgagaaatattctctgtatttgatacaaatgtttcattgaaaatgacttgtggaatataaaacttaaattttcatcttttgctaattagaccattgtagcataaattttgcaatgttgttcttcacatgtattaaatgtttgtgttttatccttgctaggttattaccattggaaagcatgttaaagggtaccattatatcattgcaaatctggtaggtcaattaattgacattatttttatctattaatttttgttacgatatatttattgatatttcatgtgtatgggtgtttggtctgcatgattatttgtgcactatctgcataaagtacctatgattgtagatgagggcctatggtccattagaactgaagtgacctatctggagccatcctgtcataacttaatcccaaacctggaacttaaatatagagccaccttcccagtccctctacctactcttttttgttgttgttgctttttaaatatttacttggtataatcatcattcggaaggaatattttaaaaaaatatagtctgattttattttattggtaagaaaggagatgttttatttgattgctttaggtttattttccaatctacatctttaaattagttccagttattacatgtgatataagaatcttcataaccatatttattcaaaaattttcttgataattttccactaatggaaacttttcaaaaatatgaagtttaactctttagttatctatttttatgccactgtgttctatatacttcttgcatacatatttgagtttttaatataaataatatatgaaactgatgcacatttatgaagaaattaattctacaaacatactttatgtcaataaaattatcaattatatattataacaatgtaatagtaatgttttgaaaatattttacttctgattttctacatattatataagtaacacaatgaaatgaaaactgaggtgttgatcatgttcctatcaatattcttgtccatgcagtacatattgaaaaagcagattggttaattatatttctttgttgtttttcttttataattatatccaatcaatttagattgttgaacatttatttttatttccaaatgggctttaaagtgggagtcaaacaggctttggctttcctcatgggctttgaatagctatgaccctgtttgtcggaaattatgtccacacaacttgatcaaaacgtggtgagaccaggaaaagaggcagcaaatgaatgtttattcttgattgtgttatgggacttcacacaagctttgtgtttattcaaatgcaggcttctttttatggttcatagtgtatcagtttatctcccagaaaacatttttagtatgacagaaaaatgtaaaaacagaacaaacacttcaataaatagtgttttcgctgagagttagtatcagtgagtaccctgagtgacagggctacaagctcctatagcaatcctctgggattttccttttagtgtgtacctaggaggttagaaaagactctgtgtagacacaagggttaacaggagacgaggctctgcaatgagttttgcccagctcggttccaagcctgaaacagcctgtacactcagtccctgtgtgaattgtgccatttgatagaagagcacagtgccacagtgaaagctgcgatctttaaaaatgtccagatggagaagattatattggaacattgagaaataatgacagaaggtgtctcatcaatttgagagttgctatgtaatgccatgaaaaaggaaagcactgttgtctaagggagcaagtccatgctttggtcatgattctatttagaaatctacctaaattatcttggatgctgaattagggtctgttttctcttccctgaatgcctgatttcctctactcacaagcttcgggtagttgtgaaggagttctgactctactggaatgtctgagaatttgacccttcatgatgttgaagtctgaaaactgcctcttgatgttaaagggtttttatcctccaagttctcaataggaaattaacactttcctgtggccagtgccttatgtatgctagaaggggtggttgtaaaagattctttaaactcctcacatactgataagctattttaagagatgctaaagggtggacttctttctttagatgctggctctaattaagttctctttgtagcctttgaaaggttaagtgatccataatatgatgagggtcataagaccctgtgctcatgtttatcctctctgctcttctcatggatttaacttgttaataaccatttagagtatgtaggcttcacaattggtaagaatcacttggttttcagtctggtgaatacatctccctaaatgataggatggttttaatttggtgagatattgcatctgacttgtctagctctctttgtgtctctgtctcccctctgtcttctaattctcctcctcctcttctttctcatccactctctttctcctttctcctcctgtttcacatatatatgaaaaatgcattattctcttccaaagttcgtgagggcagatagcattctaaacccagaaattgattgttttgtcactgcccaaggattataacagaatggcttctatcatctctgggaaactgttcaaaatgtgccaaaaagtaaagaaagaaaatgttggataaatgcagatccttatttaggccagcatcaaacctatcaaggacttcagttgaagctgttcgttgtataatcagagtaaggtgacagtatgaataaaattaaatgaaacccaaagaaagagataatgagaccaaaactgccagcaagataggaagttagaggctttatctcagtgcactaaacagatgaggcatgaggcggggcagggacaggagacatgtgtcaagcaccaagcactggaagcacacaggtggctcctgctcttgctgtgtacactcttcctcagtccggagaggcagaccttggctccatgtgcacattactgagaatttgatgagagcagcaacctgtgaggcctcaatagaaccaagatggggagaaaacagcaagaatggggtccagttgatatttgggtaaatctgattctctgttgctctgtgtcacataaactgccctgttctgttcccaagtgcatgaaggcagagggggcattctgaacgcagaaacagatattcttgtcactgtcctaggattaagatggagtggcttctacttgctctgggaaattctgttcaaaaagttatggatatgagttattatttagaactaagaaaggcctatagatcaaagcaacatataaaattatcaaatggattcctggacacctagacatatcaagaagatccttcatgcagaattctgagccctgcctttagtctcccatcgtgctattcccagagtgtgaccacacacacacatttgcacagaagactggaggtttttagaaagcacaccatgaagagccgaagctaactaaaggggccgtgattgttcctccctccttggaggcttccagctaagcatctggatgtgccgcacttgcacagcagagatccagaatccgtttagcaccgcttatgtagaaacaaaattgtgggctaacaagaagctttctttgccaaggtaaaaaaaaaaaaagtaataattcttgttttaaatattaactacaaataaaagattaatgcttaattcaggatatatttaatcgttatgtacgatagaatgaatatatttaaaatgtgaatacattaataatttccttattgaaatttgatttctatccttgaataaattcatttaatatttaatcacaaaacaatattttgatttatgaaaatgtaacatggtgctttgaattgattctttcatgccagagccactgaatgaaattttaaattgaaaaaattaaattttgaattaaaatgattatggctcagtgggtaagagcacccgactgctcttccgaaggtcaggagttcaaatcccagcaaccacatggtggctcacaaccatctgtaatgagatctgactccctcttctggagtgtctgaagacagctacagtgtacttacatataataaatgaataaataaataaaaagaaagagtaagaaaggtttaaaaaaatttttaaattaaaaaatccattatatgtgtgtacatgactgcaaagcctgtatttgtgagaagatgacatcgaagtagttactagaggatgtgacctgcccattgtagatattggaaaggaacttgggtcctctctaagagcagaacacatgcccttaatcccccaactgactgataaaatttaattgttattttaatttgtttctcatttaatataaaattgcatttctgttaaacaatttagaacaacaattagttgtttgcttttttagttgtttgcttttcccttttcattttaaaaatattttatccagtaggtgactgataagtttaactgagaatagtttgatcaatgatttccatatgtaagcacacagctgtgctccatgataaattcaatgaaggaaatccagtccttacctgacccatggaagctgactcagtatgagagaaaatttctatgtaaattctccggtgagctctacatcagatggccagtcagtaaacatattgattagggacctgccatgattcctattttatatgaggtgtgctgacaagtactagctgttaaatacatgaaatctttttgaaggcattttatgtctcctgtgtgtgtttaactggccaagacataacatggggagaggtacaggaaaggttacaacccacagggataacacaaatctgtttttatgcctagggatttactgatggagacctgctgaaaattcagtttggaggagcaaatgtctctggatttcagattgtagactacgacgactccctggtgtctaaatttatagaaagatggtcaacactcgaagagaaagaataccctggagcacacacagcgacaattaaggtttgcattaagggaaagaaggagattagaaaattctggagggagaagtgtgcagcacaagagatggcgggcaagcagaccgatgagcacacttctaacattttgcttttgtagataagaaaaatggtgttttcctgtcctgttcctgtgcctgcatcagcacaatgtcttcattcatttatttatccagtggacattttatattgtgtggatgatcaagtaggaactttgtacagattattgacttcactgacagtactggaaggctagacaggcaaaagaccatagcatgggaaggaagagtaagtcatgaaacagacagcagacaaaaacagaaattatatgtctcgggaagccttgtctaaggaggcattataaaacttaagatccatggaaaaaaaggttctggctctcatttacagtattttgactataaatacagtaaagaacagcagatatgaactttttcaaccttcaatcaactctcttgtgtatagtttagacaatcagcatatggtttggtgtgtgtattgtatgtataaaacgattgataatgagtaacctagaaacataagaaaggcgatagaaacagttattatatatatatgtgcatttatatatttatgtgtgtgtatatatatatatgtgtgcgtgtgtgtatttgtaaaaatttcctaggtatattatagaaagtttgaggagctatgtttaggatacataaatagattcttttaatttttgaatcagtttcagaaaacttcaattttgtaatatgtttaaaaaatgacttgtgttattattttctaaaaggtaagtgactacttgtttagtgaccttgaatttagcactcatgctgtctattgtgaaatcctatggaatactgtcatgcaacacagtttctgagaatggcgttggacacttggtgtaataagacatgtctccatctggcttcatggaagtttaagcgctcatccatcccttccttaaacttcaggcccctgatactttcagtgtaagatatgtagtggagagtgcattcttctcacacccttaactgctcttcaaagtcttcaacgctcactgtggcatccccatactccctctgtgagaaacaaaagaaaaatggatttagttttgtctcctgcaatccacatgatgatttggttgcacatgtcttgtaccaagacggacggggagagaggaatctagaaatgcattctgtgaaatttttgctgaaacatagtcccagaatttaatctgttgagcttacccttttctttgctccatttctgtttacaatgtcttccttttgtctgctttccctaattttcagcaagttcatgatggtacatcctagtgggatactgcaaagaaggaaggtttattagtttaaaataggtttggaatctgcatttgacccagatcagttttctcattcatacagcacgatcatggctgctatttctcagctgttgtaaagactaaataccatttagtagtttttgagcatagcgtgaaaaccatagatcctaataaaggctcattgtgtctccaatccttttccaaaacccagggaactttagccagttgtgaaggtctattccaagtagaagatgttgtgatttctctattttacctcagaggcttcatagagatcactgaaagctttggggggaaattcatgactgggaaggaatttcattctaatgtagaaacatattgctcttatactagagggccaggaaatgaattacgcaaaagaaatgaaaaaatatgaattttgctcttgagaatgctcagtataaaagaaaacacaaatatgttgatgagcaaatataataaagtgtgtcaaatgagccaagtccctgaagatgattaggacaaaatgtgggaagggggttaaggatggctctctgtagggggcgccagaatagttttcacatgaagctagaactgaaagaaacgtatggaaggggacttgggaaggagagtcatatggagactcaatgtcatgctccagcataacaaatagaaaacctcaaatcgtatgctgttgtacgaaatcatttggaacttgtaaaaagacaggcaggactcgtaagtggtatggcttttacatcagaaaccaataatcactttgtagcattggcagaaacgatcctgttgacatctttattatttctcagaagcttttgattttcccgttgagatttttgtcctcttcagcctctgcaaattcctctttacgctgtctttcctgtaaaatatgatgacaactctcaccttatgtgctgttcagaccaaacatttgaaaatattatcaccatccttcctctcgaagcccagatccaccctgcagcaaatctagccctgtctcacttctcagcttgctttgtcttgtcctctacgacgagtccaaacccagccaccacattcactgtctgctctgttatggggctttcttgagaaattactctctggcttcctctgtttcctgtcccttctatttctgtactccctgtaaaatgtagttatagcgtgtcataattctcctcccaaagccccaggatccctctgcacttggcatgaacaccaaagtcatcttcttgacataggcattgctcatgttctcccactcccatgtgacctcaattcttgataatgtccccccaccaaatttgctgtagctgtgtttttctcccttttactccttacacactgacattttcccacttagtgtctctatattagccatttcctttttgaaaaaattctcttcttttatttctcttcacaagtaagaagacagttatatttcttcatgcttgatcaaatggcatcttcctattgaagctgtaggtcagctccctaaacaatagttttttacaccattcaacggaggtgacattgagtacctctgtttcaaggactcttcttttccttcagaagtcattcttgacctctgctgtcatgtatttgcaattaaattattcttttttttcttttttttccttttccatttttattaggtatttagctcatttacatttccaatgctatactgaaagtcccccatacccaccaacccccactcccctacccacccactccccctttttggccctggcgttcccctgtactggggcatataaagtttgcgtgtccaatgggcctctctttccagtgatggccgactaggccatcttttgatacatatgcagctagagtcaagagctccggggtactggttagttcataatgttgttccacctatagggttgcagatccctttagctccttgggtactttctctagctcctccattgggagccctgtgatccatccattagctgactgtgagcatccacttctgtgtttgctaggccccggcatagtctcacaagagacagctacatctgggtcctttcgataaaatcttgctagtgtatgcaatggtgtcagcgtttggatgctgattatggggtggatccctggatatggcagtctctacatggaccatcctttcatctcagctccaaactttgtctctgtaactccttattcttaattattcttaatgctgttagttttaatccctttgcttttaagtaaaagtcatattgttggtagctgatccatcacaaagatgtaaaataaagacagaaaaatagtgccttcaaataaacttcctgcatatacaagtagagggaggtcttacacataatgatcatgctgggtaggttacagggtagaaaggattcttggaagaagcaaaggtgtttgaaacctgaaggtgagtaagttccatagagcaggggatcagaggctctaagtagaggaaaaactatacgaaagttttccagtccaggaaaacagaaatctcacatcagtctgggaactgaatagaggtatctaaggactgtgcagagtctgggagtactgacctgacaggtatggggctctgagttccatgcccagcatgatgaaaggctgtaacattcaggaggtgggtgctgatcagttgcttacaagatggtaactggattccctggcaacaagttgttgcaagaatcacaagggagaaaggtatctcaaaattgttcaggcaggccagggtggagccaacattgtgcctacagatgggtataaacaaatgcatttatcacattaccattcttccttaatttatttgtaaaagaaataattgcagacattacaaccatttgtatctatttacagttaagagatatatgcagatacaaaaaaaaaaaaaaaaaaaaaagcaagaccctgagaagcacgtgatagtagttcttaattatataatgagcacaggacaggctcacaggatagatttgtagtgaaatgaggctgtttgtaatctagcctggctttggttttttttttttgtttttttcccccttttttttcttctttttttctttttttctttttctttcttcttcttttttctttttttttcttttttcttttttcttttttttctttttcttttttcttttctttttttttctttttttccattttctggctttgttttacaagggacaatggaaatagatcattcacctctcttgaagatttcaggaggagatagagagtatacgtagacttacaagtatataaaaattataactatttccatattaagagagattttatgttgtcagaggctacatcttgcaagatatggctgtccgtacttccttttcagatgctaactgttgctgcactcttttttattgtcctgatggcagtaaggagagcagctactaccagggactcatgtctgaatggcactttaaataatgcctctcgcaccagaatctcattttactcaggaatccacttaacacattctcaaactttcttaattgctgccctaagagtattattgggccttctgaaaatagcataatcttttttttttcagtctggtaactagcataacgcattaaatagtaccctggtggcctaatagaatgaattctgccttttgagtatttaaactgaccatagacacagctaagactcagcatttactactgcaaacattaatgcaactttctcatcacacctgaaagtttggtgcctttaagtctttgtactttatagttaaaaagacatatataaattaattccataaaattacaaagctgatgttgctaagataatatatcctgaaaggtgcttgcaaataaatatattgtgctatttaggggaattattcctgtttataattgtaacaaaggacatctgtgctccattgcattgactcatttcttccccccgaagagcacttgtaagacaggaaggtatctttgaaatctctgctgcgacaattatataaaaggtcaatctcagtctatagtaaaggctacattaatatttccaatctttgccaactctctgctctcactcatggtctcttcattatgcaaagatcccaaagactggtgggtagacatctttgatcaccaagtgtggcaatttaagccagaatcattttagcatagtggttttcaacctttctaatgcagtggccctttaatacagttcctcatgttgcagtgagccctaatcataaaaatcatgtcgttgctacttcataaatgtagttttgttactgtgaggaatcaaaatgtaaatatttgatatggaggatatctgatatgtgacccccagcagggttgcgtctcacaggttcagcccgtttcctcctaagttgtcaaccacaaggaactgggcacagaaaagtgtgattgactcagccacgaaatgagactccaaaccagtccttactgtagctgactcaacccagacagtgctttaaactgagcttcttggtttattttagtttgtctaattagctttaggtacaagtttgaaactctaagtatgtaattccaagtgtctgaatcaagaggcttgctccttaagtaagatttttatcgaaatcaacaatcttgattattttaggcgtgtgtgtgtgtgtctgtctgtgtgtgtgtgtgttcctttgaaaataacagacctttttgtcatagtcattgagattatttttgttattcagggaaaataataatagttgctaattctagttgctttacactgagctcccatctccctcttgggaactgtgcctctctggctggtgtgattgctaaagagatgaagttccatgacagtttcatgcctctacgaagtgtggatccaaagggcacatgttcaagatgctttacagtaaattaaagatgaccttatcacagacagctctttgagagggtggacagtccgtgaattttaaattaagataagtgaataatttcaggctcctgctgttctctctccatgagtctctatttgattcacggatattgtgaggaattaaaataaaagacttgctaaatctttcttataaatgtacttaactttcatagcacccattactttgatcctgttgataattactttggaaagcaaagaataagaatattagattgtattagattctgcaaaggtatgttgtagtttaactaaataatgggtgctctcttagatatgagtatgaggatttttaccaagcagcaaaactttcatcctgaaggatgtcataggaaagattatttttacagaaattaaggtattgttaaggaatgttttaaatgtttgacagtgctaagcaggtgggaattaccattcagatgtcttaggctaaactctttactgtgtgagtgacctatttctgaaatgactgtaccatagaattctgttttctataaaacagagagtgattttcaaagcaagtgaaaatacctttgctttacagcaagattgatagtaatcaaaataaattgctggccaataacttacacatttagcctattttactatttgccaactctattttctattcatctacttatttaacacatttacccaatgaaatggcaactatcatggtatggcttcttaggagtcactattctctgttttacatagtgacagcctaggtcagcggctctcaactttcctaatgttgtgctgttttgatgtaattcctcattttgtagtaacactgtgaccataaaattatttttgttgctgtttcataactctaattttacaactgttacaaatcattaatgtaaatctctgtgttttccaatggtcttaggtggaacccaagagttgagaacacctggcctacggcaaaccagagagccatgccattatctctaaaatgacagagagctggcttcaaatttttcccttatagcaaacttctggggttttgtgtaaaagacaactttatgatctggaatcttcacctataaaatcagaataaaatgatttgaggcttcagatgttctgtaactaccaggtcacaaataaaactatttgtacctttgcatgttttgtatccacaaacaccatatagagacctaagtgaacgaggactcccttccttcaccatgctggtcagtacatgcccacacccaacagatagtttatgtatctttaagaagcatcacatagcacctctttggtaaccattctcgatagcagaggagtgcaggcctgctatctaacatacaagctctgtggttcccaatataggacttaaacaatttcagtggtggctaatggcttgtatttttgtataaatatcattttctctgttttctttttctttctttcttttttgtttgtttgtttgtttgtttgttttgagacagggtttctctgtgtagccctggctgtcctggaactcactttgtagaccaggctggcctcgaactcagaaatccacctgcctgtgcctcccgagtgctgggattaaaggcatgtgcaaccacgccaggctttctatgttttcaagacttagctaatatgtcagaaaacatggcctcatgtgataatcagcaaaatcttgtactgtagtcatggcatcctttctacattcatatgcataagatgagataaacacaaacattttcctctctattaccttctctggtgttagaaatggccatctcgtagtatcagtgattacactattgcattattgaatgatttgcatattgttggacatgacaaacatttaaaattcacatttcattttctctctgaaaaataagtctcaataaagatgcacttaaaatggagtaaagaatacatttggaaaatggaccatgaaaacgatttctcagatttcttgtgctgctgtgatgatgtggggcctgtgtgaagagctaagccaaatgaccccccactgaaggataaattcccaattcggctgagagagttcacaaaatataaacatcaaggcagagctacagcagttgtttctagagatggaagattgttacactgtcatcgcgttcccttcaaactgatttatatctactttagcaagtgatagaatcaaatggaaatatttaacttgccagtcaaaattgtgagcgtacttgtttaggaaaataaattagccacaaacacagagcagaagttaaaaggcacagaaggccgagtgtctcccagcacagaactgtgcttctaactgtgagttttaatttaaagagataatgagcttaacatgtgtttaggtttgaacatttgagtgaggttgaggggacagtgccccgcccccctgtgagcactgagcagcctagctgcagtgcagatgtgttgcagggatcagaatgctttttagttcatcctaatcctgtctctaatgtagtttgcagggtgttattatctgctaaaacagtttagtgggtagcctcgtgggtctctccctgtaatgagagcaagctgccttaataaagatcttggcctttagctattataattttaatacaaattgcaatattttcttaatacccaacttattcaatttaagttccattacctattctgagacctaggcattagtgctaagaggtaagtaggcaatgaactgaatgttctgcagaaaaaaaaaataaatgttttcactgtgggataataaaaatagacacatagtgagacagacaaaatctgctatatactttcttatttgcttcagcaaatcttttaaatcaacatgactttgaataggaatataatgcagcttttgttttttaatgatacacggatgctttgaaacattgtgaagattaccttcaatggaaaggaatcaagtgcagtccattctattagcactttcttctatgtttaaaggttatggacatgttatactagtctttttgaggagagttttaaaaagctataatccttccttttttcctccttatttcctttcctctttattcctttgtcatttctggtcttttcaataggtcaaacccaattgtagtctataataattcagtggtaacagacaagatctatcattctctcaagtatttattctagtgaggaaggtagttcaaagaaacaaataaagaatgttcacacaggatttaagaggcaaagtatggagcaaagactgaaggaaagactatctagagagtaccccacctggggatccaacccatatacagtcaacaaacccagacactattgtggataccaacaagtgcttactgacagaagcctgatatagctgtctcctgagaggctctgccagagccttataaatatagagatggatgctgtcagccaaccattggatggagcatagccaaccaatgaaggagctagagaaaggaccaaacgagttgaaggagcttgcagtcccataggaggagcaacaatatgaaccaactaatacctccagggctcccagggactaaaccaccaacaaaagagtatacatggagggacccatggctccagctgcatatgtagcagaggatggccttattgggcatcaatgggaggagacgcccttggtcctgagaaggcttgatgtcccagtgtatgggaatgccaggacagggaagcaggagtgggtgggttggtgagcagctggagggggttttcagagggaaaaccaggaaaggggataacatttgaaatgtaaataaagaaaatatctaataaaaaaaggaaaaaagaagacatttttaaaaaaaagaaaagaaaaggagaacagcacgtagtgaaaacaaagaaaattgacagatacaagacagatttggaagtcctcttaaagcatgatcctaaaaaggaaatcaaaagtggggtagcaattggaagagtacattggtctgaagccttttcctgcttcttcttcccttttctctccccttctctcatctcttaatttcagcccccaatcttcttttatttctttctttaagtgtggtaggagataaagaagttggatttcttgtagagatgggccagtagagagagcaagagaatgtgagctgttgagaagtattgcctgtgtgattccagaaacaagtgtgctaaaacaagccagaggagagatatcagagcactggaatagagtcccccttggaggaatgtggccagctctcatctgccaactcaggaggacttaggcttttctcctaaacaggaacttgtacctagggtcctcttattctccacaacacaacatactcagaaagagtttcgggaaatagaagcatgtggaagctatatgatatttagaaaatgatctggttcaccatggaagaaaacattgctggagaagattaagactgctcggctgtcactctattgtgactaccaccgaggttgaattacagattcagggcccagaatttcatctattttctgtctattttaactagtgaatctcttcctggacatcaaagatttgtttgttctcattttgaaagtttagatatcatcacggctgggcatagagtactggtttaatggaaaactgatctaaaaaaaaaaaggtaatagtttcagttaaaattgctaagtcactaatctattaggacattttgagaagacacagcatgttgcatagtctcattgtccacatacttttcttggattctaagatagctggatggaggagctgtgtttaacttcttagagctttttacctggtatctgtgttgcttggtaggcaagaacagcctggacgatttgtattgcatgggccattgcaaggcccatgcacagcaaagctctgaattttttctcatttttatgtgtgcgattccttttagtatacttcggccctgacttatgatgctgtccaagtgatgactgaagcattccgcaatcttcggaagcagaggattgaaatctccaggagaggaaatgcaggagattgtttggccaacccagctgtgccttggggacaaggcgtggaaatagaaagggccctcaagcaggtcagtgtcacagaatgagtgctgatgcgacttcacacaggcattaaagtggtgtttgtttttcctgccaaactaaataagccacccttcttttactcctgctgaacacacaggccctgtattttctctcagaacacaaagataggttaaagattaaacagaaacccattaaactaaccttttatttatgtatttattttaggtcagtgtgagcaatcttcacagtttgtattttggatttgataaaattataatggggctttatttccattccatcattaggttcaagttgaaggtctctctggaaatataaaatttgaccagaacggaaaacgaataaactacacaattaacatcatggagctcaaaacaaatggaccccggaaggtaaaacgtgaaggctggagagtggggtctacctgtgagcaggcagattcaatgaggagtcctcacaactggggtcaaaaagcccatacatgtagacattagtgagctacttctagaagcaacataaggtttgagatcaattttctgaatcaaatagactcacttttggtaagcaacagtggagtagaatctatgatagtacctgtaagcagaaatatacacttttttttttttaatttttaagggaagactgtaagtataagataagacaactgctaaagattgaatgagcttagaagaaataaatagccatgtaaacatgtgttgaaatttataattaaaatctttatttaaaatagtctggctaaaatatcactgtttaggatatatttgcataattactccacaatgtaaattatccaggaatgtgaaaagtgagccagttgtacttgcttatgcctttaatctatgaatgacagaccgggggcaggaggattgtgatttgaatgcatgttgagttctacacaaaccagcatagattcatcccatgttcttaccttgaataaacaaaaccaaataaacaaataataaaaatgaagatccaacccactttagaagatgatatatatacagtttcaatcctaattacattatgtttatgactgtaaattttttgctgttatttaggattctggttaatgagggtattagtttggatacaggcatgggttcgaaaagtatccagtttattacattaagatggttcatttctctgtgtttatcagctgtcacttttttcagattgggtactggagtgaagtggataaaatggttgtcaccctaaccgagctcccctctggaaatgacacatctgggcttgaaaacaaaactgtggttgtcaccacaatattggtaagtgactctatgcactcatagtcaactctggttttccatagttaaagctttctgttgtagagctggtgtttaggtttgtgggtagtaaccacaccagacagctttatttactctgcatatttactctgcatatttgtcagtgtgtcacttactgtatgtttacctggaaagaattccacatgggataagttcaaacattcagaatttcctcttggaggctgaagtggagcctgacagctaattattaccctgctgctgacacaggagaacagcagaacaaggtctatatgttcttcacacttcctttcaaatctaacccatctctggctcatcaccaccctcccatttgatattgtggtctagtagtgcttccttcataaccaatccatcttccttcataacaaagatagaccccttaaaggcacaggtgtttgtcttcatacccttcatttgaactttgtggtgactatattcctggttctatatacctgaatggtgaaagaggaaggcaaagctcacctgagtgtggaacatctaggatgtggattgaagaagggaaaagtatgaatcatgaggacaggatgcttagcaatggagggagagaaggtggaattcattacaagacatgattttgagataaaacaattgtgtacttagcagtgaggttataagtctgtgagttcattatttgacaacataagacaaaattatagatgcactcatgagagatgtagttaaaacactatcagtacatgatagtctcataatgaccatgagttagactcgaatcttgctgttgatcagaaccactatctcacttagacttataattcatgacattccaaaatggacattattagatttgtcgaataaattttgtcatgtgtcctctttcatgtgcttgaaaaaggagagtctctatggctataattgggttatccttctagagtattatatctcatagatgaagtgagacacaatggttttagaaatagaatcagtatgttgccatgacaaagctcattgattatatcagcttatagtcctacttgataattgtgcttggatgagcagttatacacaatttggctaaattttggttgttgggtgccatggtgaaaggtaaagtagaccctaagttgaatatagtggacattgaacaaacaattccctttctgatgcttaagcattacaaataagatgaggagtcatgctaacagcttttgggtatcttactctgatattattacatataagcaagccattgtaatgaccagtaatgtacagatttaagaagttttgtaatagaagcactatgctttctttttctttcaatatctaccatattatctatatgtctaatatgtgtatattttgacaaacaattattcagctaagaaatttgacataataacagtatgtaaataattcagtatgataatcagtgaacatactatctctccttataggaatctccatatgttatgatgaagaaaaatcatgaaatgcttgaagggaatgagcgttatgagggctactgtgttgacttagctgcagaaattgccaaacattgtggattcaagtacaagctgactattgttggggatggcaagtatggggccagggatgcagacaccaaaatttggaatggtatggttggagaacttgtatatggggtaagtttttaatgttacagtaattcagtttgaatcattgttgacagattgccacttttctttttaaatgcccacatctaagattgttgacattccatgatgttctagaaagaaaaaacaaaactttttaaaggttgaggcagaagcaagaagtaaacttgaagactaacagaaacatgcatttcacttgtcttcaagcacacacagtatccccagacttcaagggaacagtacatgaaatgtgtaatgacctaaatgtataatgaccttggacaagtcagataggccaactattcgtctgactctttaacccaaacactataattagtgacattctctaatttccatctccttccattccaagttttagccatttgtctcttctagccacaattctaggtcctgttattttcctgttttttttctttcttcccttacagaaagctgatattgccattgctccattaactatcactctcgtgagagaagaggtgattgacttctcgaagccattcatgagccttggaatctctatcatgatcaagaagcctcagaagtccaaaccaggagtgttttcctttcttgatcctttagcctatgagatctggatgtgcattgtgtttgcctacattggggtcagtgtagttttattcctggtcagcagatttagcccctacgagtggcacactgaggaatttgaagatggaagagaaacacaaagtagtgaatcaactaatgaatttgggatttttaatagtctctggttttccttgggtgcctttatgcagcaaggatgcgatatttcgccaaggttggtcactcacctgcttcaactttgtgcattttaggtctcaagtggatattcatggtgtctatgaattcactataaagatgtcagcagctgccgaccatttgtccaagcaaatttaagatgcttagaaggcaaatttttaccgtcggcgtaagcctgtgaaatacctgaacaatgttccttgaatgttgatcatgtgtttccctggtgaaatcatatacaccatggagaggctataaaatgcagaaggttcctatcattccatgcctgcttggaggggtaccgtgtttttgctgcatattctcattttacagttatctgtgtgttcatccacagacctgtatatgggaaaatgggcgaggttagatttttcctacagggtcaacaacttgttagacaacacttcatttgcacatacctcatctctttatttctctaacatcaattcatggaaatggtgtgtttgtgaggttattaaaagttttaaatgttaggctcctggagtaaaaagttgatcacacatatctagaaatgcagacagaaaaagaatagcttgctgaaaattcctgtgccacgttgaaggatacatactcacacacctcgattcacatcaggttataattatctcaggcttcaagtacttaattatcagtatttgtcacaaatcaccaattgctattgtttatgttacaacatgaatgataattacctgtatctcttcggataaataaatcccacttttgctagtgtgttatcattaacatttatagccaagatgttatgtgtctcttggggaagttcaatttgatctggaataaacacttttgattccaataataatctttactagttaagggagttagtttttgatgataattcattgaaatgttagtttttgtgttcttggaaaattataagcaattaatttcataatgaatataagcatttcaagctttctaagtgttttaatatcttccactggctgagaagagggaaatatatcatttaggcagagattattatatgcttatttctgagagccagttgctgttatggtactgcattacaaaaatcacatataaagaaaaattaactgaactatgtagatcttttaaaaagaaaaatcttaacttcatattcacagtggattctctttatggcatccctgaattagaaaaagaatctagttatatttgcatgacatgagtgaaggagcgtatggtcctaagtaaacagttaaccactgacaacaatggggaagggtcagcctctcatctctcatagttaccttgtttagattaaatatatgaagatcagtttctaacaatgaggaagagaaaaataacaagatttggggtcagagagcaaacattctcttccatagaacactaaattgatagtttagctttggaaagacctctgagtcagggttctaagtaaaatgtgcctggtcagcactctatcttttctctctcctctctctctctctctctctctctctctctctctctctctctctctctctctccatatatatatatatatatatatatattcagacaatttttcatttttatcaagcttgtttcttaagaagaatattttcttctgtgctttcattcttgagacaaggcttgctacattgcacatacaataacacttatttcttagaaagaaacacaggtttttagttaaggtattttccttaatattgatttttttaattaacatgtaaatatagtatataccattaaaaataaaatgtatttttctttctgcttatgcaccatatatatttaaaaattataactaaaacatgatattgccagtttaatgaccattttaagaaaagaatgaacacaactatcatattttggaatgcagtaatgaccactgcagatcagaacagtagagtgggttagtctctttttaaaagagctaaaaattaacagaccacttagaaactccttttaattatttttgaaagtgcagcaatcatcccttttcaagtaaagtctactatggacctccattaaggatgttgaaagaacatatttgaattacagtctaggatgatttaatgaattcagtgactataacttgtccaaaattacaaaagaagaaggagaagaagaagaagaaagaaagaagaaagaaggagaagaagaagaagaagaagaagaagaagaagaagaagaagaagaagaagaagaagaagaagaagaagaagaagaagaaaaagaagaggaggaggaggaggagtaggaggaggaggaggaagaagaagaaaagtttcaggtctcttcatagtaagatatgttttgaaatagaaattaggaaagaatataccatagtgattttcttcaccttgccttgttatattcacaatataaatcctaggccccttaaacatcattattttatgcatattaagaagaaatgacagtgcttttacatttatattcttcaccatatgtgatctaaagtataacttttgattttgattatggcaaatttcatcaaccctcctttaataaaacttcactagaacccccagaaaaattaattgttgcttttaaaacagttaaaaataaatgataaattctaaaacttttctatattttagagttaatgcaattaaagtaatattgaaatatttaatctcaatatttttaaacactgtatttaaaaaaaacagatatctactagtatttacttcctggctaaatagaataacatataatcatgattcttaatcatgttggacattggtacagtgccagattcattaaaaaatattcaacattagtgttgaaggacccatgcaactgggctccaagtctgccctcttagtgcagggcactaagatgtgtcctgaaattattgtgctgcatgggtagataggatacacctggagtgtgtctgtgtcaatatcagggttttctagaagcaaagtttgtaaaatacttgatcctgatcccacgtgaaaaatatttaagctttccattcctactatttaaatattttcattttattgtgactttgttatggaggctcacttatatactttcagttttttttgttttaagcaacagatattcaagatattgtagtttggggaacaggagtttccttttgtattgagtgagtggcttattctaccaaattccacaatttcatcctgtgtctaatgtatcaaaggatgaacttcttaatgctaattgccaataagtttaattatgcccataaattgcccaattttcatgttttagtattttagaaatactactttgaatttctcaaatatatacagaatcccataaaatgatttaaataacatggtagatgcctactgttacatatatagctatattattattattattattatctccttcaatatttaaagtaaactattggaaatccattaagcttctaaagacacaatatatatatttatagtcatataaatgctgctgtctcattatagttcacattagtaaatttatacctttttaaactttaaaacatctaatctgttttctttgagttttctttttctcttaagcaggaagcacaaaggaacagggtcagagcagtgcacaccattaaagcatttgatttatactcattaagaattttgttttattttagtgtcatttcatttgtccatttctttcctgtactgcatcgaatacccatgtgtttgcacgcccaaaaaacctaatggaactgggtctatttgtggggttggggtgaactgtgttaaagagacagtttctttcatgtttaaagctacatttatgatataaatcatttcttaatatttgttttgtttgaacttagctaatgttcttaggttctcttgtttgtgcatatttattacaggagtagacaaagtattttgcatattagatcaattagttgtatgtttgtacaatgaagtttctttcttgtggaattttacaccaagtatttgagtacattatgagagactcccaagaatggagtttaagtctttgggtacatccacagatctcaacctcattattctgtattccttgcccaaaaaatgagtagtaatttctagtttcactaaatgaaaagatatattgcaagctataaggtaaactcttctataagtgactacttgcatatgagtgtaaacttctttcatattagagcattcatttcgctttacgaatccatttcgtacttgttatcagatctctctctgggcgcattgttggaggtgtgtggtggttctttaccctcatcatcatctcctcctacacggctaacttagctgccttcctgactgtagagaggatggtgtcgcccatcgaaagtgctgaggatctgtctaagcaaacagaaattgcttatggaacattagactctggctccactaaagagtttttcagggtaagtgattcttatttttagtttctgtgttgttttctaaatttagcccccataaattattcccacccccattcttcccatggcccatgaaagctgatgtgtgagaaggaccagctgtctctgtcactgtttctgctctggttctgtctctatcttagaccttccatgccttctgatctccaactataaccgtgcttccatgtatccttattcttaatttctcagaggaaaatgcataatgatgctatacaatctgaattttatcaaaagtgataaacattctatgggatcaaaattgaaacaaaatacagtataagttattactgttttctaaagaaagggtactacatatttctttcatgttttataagcacagttatgataaccgtgcttagctaccatgcatgattttgtcatgaatagacacgtgcttgcatccagtatgctatttcaaaattaagaagcaggtaggaatttttgaggaaattcttcaaaggaaaagtcctcaacattgtaacatttaaaataggcaatacaattacaatgtgtgtattaagtgtaggttaactttatcttttaatccattataaaacatttgatgatagaataagtttctttcatgtttgcattgtgttttcagaatagctcattctactaatatgttttcacatagctaatgtattacgtaacccaaaaaatatgacaaaagatgatctgatagttaccaaatacctttgaacgtatatcagtgtgtgagatgttggccaatcagcagtaagataaaggcaaagaccttcaacttgttaaatgtcagagcagtagattgtgatttctacactctcctgcatttcctgtgttatctcttgctgattatcttgaattggggccatgttggaatgggaagaaatgtgcttgggaacctcgctttatataactagtctagtatagttctaacaactgtacttttaactagtaagtatgctgtcttctgatgtagtctattaaaactactgttatatagcctgctagtctaagagtgatttttgacacacttgccacttctgtttctatttgataatggggtcacctgatgtaaaacgataaatgacttcctttcttgtttatcacagtgggttttttcccaggatgctgtaactttccatctggagccatagtgcatcattccttcttgcatgcttcagtgtaaagaaattctgtcatggattacatttaaactaaaaactccaatccactgagtgtcatgtaaaatagatagatcaacacatagttaatttagaccctttaaagacaaaacaatttttttgtcaacaattcccattaatcctcagtcattagctgagcatagttgaaattttacatttctgagatagaaggaatttgcaaaggaaaggtgtgcttctctttgtgagattcataatcaccacgcacactgagtttatgctcttcttcaactgtcctttacctatggggaatttgagttttcgtgactggagcattcaaggcaggctgaaagctaaccacatttgattgttatggttgccagccaaccaggaagagggaacagaggaagtgggctttcagactgaagatgtgctggtgtgctttcttctctggacacctgctttattgactacctgaccaaactcccagtgaaagatctaattacctgtgggagaaggataattgcccttctttggattattgctctaatataacatttccttttctttttgtattaatcacacaaaattttattcattttatttatttctattgaatattttctttatttacatttcaaatgttatcccctctcctgatttcacccctaggaactcactatctcatcccccatccccctgcttctatgagggtattcccctacccatacactcactcgtgcctccccaccctctaattcccctacactggggcatcaaaccttcagggggccaagggcctctcctcccattgattcctgacaaagttatcctctgcttacatatgtggctggagttatgggtccctccatttgtacttgaaaggccatccagagactgctccacctggggatccatcccatatacagtcaccaaacccagacactattttggatgccaagaagtacatgctgatagcagcctgatatagctgtctcctgagaagctctgccagagtttgacaaatacagaggcagcagctcacagccaaccattgggctgagcaccgggttcacaatggaagagttagagaaaggactgaaggagctgaaggggttttgcaaccccataggaagaacaacaataacattttctaatatgacatgatttcattgcgttgctagctttacgtatttttgttctttaatcttggaattttattaattctgctagaacgactatgagtaactaagacaattgtctgtttctatgacagaatgctttaaatccaggtttgagataaataatttgagaagtaaggacacagtccaaatcttaaatagtagataaagaaatgaaagaaacattacaatttaaaatgaatatccatttctaaacagcaatttggatcttttacaggtgcacctaatttttattataagttttataaaataactgtttctgtaaaagtaactaatattgaatttctaatttatgatgatttctttttaacttttgtgatattagctgtttcagtcaaagccttaagtacttttagagttcagataaataattaagtattaagtcagcttatgttaatattactttattgatgccagtgtgtccatagtagatttagaagtgtgacataagctctaaattttctaatttaatctctgtattctactcattcactaatatattaacatcaatattcagttgatgtttcaagaaagggaaagtggagtcagatctagtaaaaactgagaggtgtggacctggaactgttctctatgggctggcaagttttctctctatggatcccagtatgctgtcgtgacctgctatggatttgctaatcatacttaattagagtgccgttgtaaggtacctataattaggagggaaatgggatttcaaatataaactactatttttagagtttcaaattttgataatttcccctcattaaaatagggcagatcatagttctataattttctggaaaatgatttttttgcagaacctatgtttgtcatattcccacagcaagttagaatctagagcaggctttctctttgagccagccacaggtctgtcagtccacaaaggacaatgattgacttgcagaaggggagcaagagttccttcccacatgcctcatgccacatgccccaagtccttctcactgtaatcaagccatttcctcaagttgtcacttgtgagagggcaagacacactgttcactctctgaccaagtggtatgtgttagtgctgttagtctcaggaaaaaaaaatggtctaagtaaagtttccctatctcttgagtaagtagactaattattctaatttgtaaatggcagaattactctgatcttagttcatcagactacagagttattactcaatatcatagacatgttttagtttacaaacagtataaattacagatgtgtaggatcgatgcaattgttcttcgttagaatgaaagaattagtttgaaacttgcctgattctgcatatgagagtgtttgtgtgtctctcagtgtgtgtcatgagcgtgtgcatttcacacttcaataatcatggttaccagagatttacaataactgagattattcctaaatccaaacaaaatgttttgttgctatgttgatggctttaatgacacctatttatatttacataactattgtctgagcttgggaagtaggtgcctttaatgacagctatttgggaatgagaaaatgagaatgagagagtcacaagtttgaggtctacctgggttgcagaatgatttaaaaccagcccaggaaacttagggagacttagatttgaaataaaattgcacagcaggggtcactccctagggttgtaactatgaagtagaagcagagcttgtgttcctagcacatgcaaggtcctagtttccattccttatctgcaataaaataggtaaatacaatgacaaatgaaagtgttctagtcattacacacttacttacaaaatagtatgtgctttttcagtagcaccatgatttttagatttgctgcttgcaaattatgcagcataatttcctgatacttaggacatgttgaataaagatttcactagtttgtaaatcctcctcctatttcattattttcaacactgccagatatttctgttctaggtatcaagatcgtcagtgcatgtgtgcaggcataaatatgtatctgtagactgggaatatcagccacacgtacttacgcctttcagagatttgagaaattgagtgcagtcatatatatttctgtatgtgtaggatgttactcatacaagaaaagattctttatagttcttcacacaggcttaaatatataaatagcttctaaaactgtaggcatgaaataaatgctgaatgtgaatacatagcaatgagtagtgcagtgcacatggtgaaggtatttatgcatggttagtcatatttattacagacttccattccttcgtgttatgtggattggatacagcagggcaatctgttcatctgccagctcctgcatgctaccaccttgtctagatgacccagaacaaggtgaagtcatttcctcctggttggcagccttcctttctctgacattttaattttctcaccatttcacagaacaactgaggagacgtttgattcatctgtggggttttaggacatagtcagcctgggacaaacctgctctgctgttcttgttcagcttgatcggaatagaacaccgcaaacgtagttaaagttttagcagactttgacattggtttctttaaaagtaaatgccaggcttagaaaccatgcagtagaaatccctcatatttcattgggaagataagacgaaagacatagacaggaggctatcctgactcatgtgacatcagtggaccacatgcttagaaaaaaggctatattttattattaaggtaattgggtaagctagtagatcttttcaggacaagtgggttatttttgtcccatagctattctccacaaatgtcactggcctctgactgtccagctgggtaatttagaaaccacctcctatcacaatgaatgctctgtaatcagaagacaggaagcttttgcttacagaccatacacactaagcattggttttcacaccatcaaatgctgaagacaatctcacagcaaaggctacaatgctgaatatctttgagaacactcccattttaaaatgcttaacattcccagtttacatgtttcatttggatttcgatgcattttattaccttgtttaaataaaataattacttctgtctgttttttactagtttttttttcccacactggttgccatgatgatatggcaggcagaaaacaaaattgtgccttgatattatttatcagaataaaataaaaatgaaatcgaaacactgttgctaaaatctaggaaacttttcaattagagttttgacatttgaaggaagagataacatagaaataagttgtcatacatatttctgaatagttttgttctgaatcttattaagtattctcccaaagcattttgtcttgccaatatggctgctcattttcaaagagtaatacaaactttgaaaataaatggaaacagaagggattaagcaatatcataaaatgaagttaatacaaaatagtaggcagacacaaatatttaagtttcccaaaatgaaatacattgactatgaaatgattttaatctcatatttaaaagtggctagcatagtataaaactaaatataaaatatatgaaattatctttccttgaaaattgaggtgtgaagtcactatcctatataatttaaatccaaatgaatttttgattgtttaattttgcttttctggaacagtccttcccagtctggccttgaactttccccccatctactgccttttggggacagatgctccccaatcaaagtgaatcaccacactcagctccaaatacttttctttactagaaatttactcttgagatgacaaaaaggaaagtggaattatggtaaataatttatgttgaaggcaatgaagaaaaatgaagtcgttggtcattttgtctggaaggcttagatcggtgtctttaaaactttatccctaaacacagatctggtttcaaatcaagggtgattggatgaggacagtgggcaggaaatgaagccgtagtgctagttagtaaaggacttattcctgattgctttctgaatccacaactatttgtctttttacattttcttgtatgtcaaaatgtctttatgtattcactaaaggaactggagagatggctcatttggaaaactacttgcaaaccaagcataaggacctagattccgatccctagcacccacagaaaaagccaggcatggtggagtgtgcctgtgttcccagtgttgggagagtcaggagggctcctgatgtgtgttggccagttattcttagaactctgtatggaccaggctcagtgagaaagcctgtctcaaacagtaaggtggaaattgacagaggaagacatctgaccgtcacatgccagtgtactatagcacacccatgcaaatatacacagagcctcaccagactaggtcctgtttctctcttttctaaaatcacaactccttagattttctctgatttggaaaccccagaatattgaagcagtacattgcagtatatcagagagaaaggttgagatatttgctacatggatgggtctacaaaataatatataagcataatattataattatatattacatataaaataatatcttatatatattatgcacacacacaatcatacatacacacacacaagatataggccatgaatgtagaagagatcggggaactatatacagaagggattggagagagaaaaaaaagggaaataatgcaattgtattataatttcaaaaaatttaaattaaaaaacagaaaattgttacaaaaacaagccaaaaataactcatttaacctgagagagctcatcttgtaggtctagatgaagaggtagcagacacacagactttagcagtaaatgtaggcgcacagagactgtaggtgcacagagactgtaggcgcacagacagggtgggcgcacagacagggtgggcgcacagacagtgtaggcgcacagacagtgtaggcgcacagcgtaggcacacagacatttgctgactggagacaatgaagacagcacctaagttgttcagtgcagacattgtttcagtatatccatttcccataaggcattttaataactttaaaccgtgacaataacaaattcaaattttggaaagtactctccaatatagtaggaaaatggaatttttttattgctaacatttgaactttcacaaagacaatccacaattagaaaatattttatctaacacctttataaaaaggtgttattttttatatatttatgtatatgagtgctatttgcatgtatgcctgcatgacagaagagggcatcagatcctattacagatggttgtgagccaccacgtggttgttgggtattgaactcaggacctctgcaaatgaagccagtgctcttaactgctgagccatctgtccagccctttatttaacactttaatgtacctcagatatttctttcaatttggaataattgacaaattcagtggataaattgataaaatatatgtgtaattttatttttaatcccattttagtcagcttacattttgttaccaatgtttaaacatcatatttttgtgggaagtcatgttagaaaaaatttggagttgagactatcaatttacctaaaatcaactgcagtgaaattgtagtagaagcttaaaaaaaaaaaaaaaaaagacagaaagaagaaatggtaaataagttggtttccaacaacagacaaaaattggttttccataccatgttcccaaccagtcaatgaatttgcatcttttaaatgaatctactctgtacaggatgctatacggatcattaggctgagagttggcttcctgggggagcattcttcgagctgtatggcataccagagaggaagcctggctggccagagaatgcttccaactctgatctcgggaaggcatattgtcagtattggaaatacatctatgtgatttagaaaaattatttgctgatagaaactgtaatttggtaatgaatgttagtatcttttaagggaggacacctagctatccttccatagagcagtgaacaacaatggccataggcttctgcatgtaaaagttgtagtgaagcagcagcaacatagacttatttgcctcagagacaaaggacagttcttaatctgattgccctgacatgaggttttcaccaaattaaaccgtgctcttgtgtgaagcagctaggattcctggggtggcaagctcagaaagtctgttggtctgttttaaaccaacttacgatgaattgacagcacctttttaaggttataattttccatggcatttaataagaagagcccacaaaatctcatgacttaaaaataaagatattatttcaattttgcatcctataatttctattaacatatcataataagaaaatggattattcaaagtcactccgctaaaggggattaaagtcatttgtgagaactgtgcaaagaaattcgtgtagatgtaaaatggtttgacctttctatcctggtgcaagctggttttagctttgtgtggagggtattaaaggcctcctatgaagtctgcctttgtcttaaaataaactaatctttatgatatacattcaataaataatactatttcttttcttttttatctgttgttgaaaagactagcttaatcttgagacaaagtagcctgattctcaaatattcaaaagaaaaattactgtttatttaagaaatattttaaatggtcaatggctatttccttttttaaactgttattatgcaaagcatcggttagtatcagtgtggatcatggttcatcagaggaacaggtttaatagatttaaaatatattacaatacaattaataagattggtttacataatcttgttattgcaaccatagttgttttgcatgacaatggccccattggctaatatatttggataccttttccccagttggtaaacctgtttgcaaagggataggagagatgggtttgttggagaaagtgtgccattgcagggagggtttgaagtttccaaggaccacacctggcttatctcttctctgattccagatccactgaagctgacaaccagcattaccccccacaatgtgtaatagacatctccagtatcgtttctcatgtttttcacatagcagttctactgacgtccttagtgctttccaggcccaattaggcacctagactcctgctccacctctaatttaaaaagagtattttcaatggggcaacaaaaacatccttttgctgttgtctttaataagtcccctgtgcattgtagcgtcttttctaattcattatgggttctaattacttcagtgatttcaatgacataacaaattatttgagcacttcacaagtgcaaaggaaattaattcttcatagcaatagaatttttattgacaaatgataaaaggtgaaagcttttccgcgtcctgggcactactgtgtaagcaccgagcagttcctgcctcccttctactctctcagaatcttctaagggccagttctcaaacttctctggcccctttgctttttctgcagagatctaaaattgcagtgtttgataaaatgtggacttatatgaggagtgcagagccctctgtgtttgtgaggactacggcagaaggagtagccagagtcaggaaatccaaagggaagtatgcctacttgctggagtccacaatgaatgagtacatcgagcagaggaagccttgcgacaccatgaaagtgggcggcaacctggattccaaaggctacggcatcgccacacctaaaggatcctcattaaggtgggtggaatagtataacaatatgctcaatgttgttatagtatcccacctaccctgatgtgtctttaagactcttaacggtttgtatacggatatgaggtaactcacaatcacaaaaatgatcagaaaagtttctgaatgttttgagacatttggatactctttgaaatatatggcaggctttggtttggttccgtttgctttattttataccttaatttcctttcatttttagagttaaatcatattcatttttaagacttttttttttaagcttgatttcctcttttcgtttcctttacccacatttctggcccttgtgccttacaaacaccgcacacagactaaggaaatggttggattctaagagaatcaaaccgagagacatgacactttcttttaaattttttttctttttcttttttaatttgggggatattccttggggaaaagagaatgcactttgaatttctttgcacacatctctttactatgtagttaactctttgtattcctattttgttgtttgtttattttttagtggagtcacattcaagacactgttatttgtttgttgtggatgtgagtacattgccgtagaatatagaactccccatattagcactctttccttcattttctttctgttacgctctaccaccttacccaaagattcagattttcagtaactcggtaacattattgattgtggcctttctcccacatcggttttttttttgtgtgacaagagttgccacagaagcaaaagaaaaaaaaaataaacaaaacaagcaaaaaaaaagtctaaaatctgctcaccctgtctgacaagtatgttttatcgtttcaagaaatgcggttaacctcgcagtactaaaactgaatgaacaaggcctgttggacaaattgaaaaacaaatggtggtacgacaaaggagagtgcggcagcgggggaggtgattccaaggtcagcccccgagagaaaagtcatgggtaactcgatgcaaacaaagtaagcagcagcgatgcacagtgcagcggcgagaagcaggacaggacagcacaatttgatgagcaggacactgttctcctttctttccttctttcctacttccttctttcctccttccttctttcccttttcctcctttcttccttcctttgtcctccatccctctcttccccttccatccctccatccactccttccttccttccttccttccttccttcctctctctctctctctctctctccccctccctccctccttccctccctccctccctctctctctacttttccttctttatcctttccttccttactcctttccttcctccttactgacttacttcctccttcctcactctctctctactttccttatggggaaatttaatcttattattggcttctttctaactgctcacctgctggctcctgcatccatcattcatgctaactggctctgtaactctaaccgattgcttaggcaaatggggcacggtgactatcggtctttacaacctctcgaatggtggtttgtaggaataacataaaaaccatggacccgggatttatgtatttgcccctgaagacccccgaaatcttgcactcttgaactagtgagcaaggggctttgaaaactgaaacaaaagggggtccataaatggaatgggggccaacgactcgaactagggcattggtccgggttttggtataaccaaaataaaccaccaccgaatcccccccgccggtggggggaggcccccccacctaaaaaaaagcgggagcttgaaagtattgggaaaagctctgaaannnnnnnnnnnnnnnnnnnncctcccgtccctcccttccttccttcctccttccttcttcctttcttccttcctttcctcctttctctttctgtttctgtctctatctccttaaccctgtttcatgatctgttcctcctccctctttccctccctccatttctctttctcttctcttccttctttttcctttccttccttcctcctttgtttcctcctcactgtcttccttcctcctccgtcagtctttctctacttgcctgaggggaaaatttgagctgatgatggctttgttgcaaactgttgcacctgctggttacttccagcgatacattaatgctcatctggctctgcaaatcttaccgtttgcttaggccaaatggcgcatcaatgactatcgctctttacaaaactcttgaatcagtgttatgtaatgaataacataaaataacattgataatgttatttatgttattttccacgtgaagaaccccagtaaatcttgcagtattgaaactcagtgagcaaggcgtcttagacaagctgaaaaacaaatggtggtacgataaaggtgaatgtggagccaaggactcgggaagtaaggtcagttgctgcaggttttatgtgaaaaacaaaaatcaaacacaaacagcaaaatcaaaccacaagtgtgttagtgggaatgacccatcttaagtaaaaatgtaaatgcaagtaagcatgagatgcatagtttggtaagatgttttggtaatgcctgcagagttactgatttgttttctttatttcattttaagtacagcatatgcatttaatatattgatttcagtctgtgttcatgtgttacttgtacatcctagtgcatgaaacagtgacatggtggaacagatttgatggcctaatgacaatcttaatagagcatctaagagtgttgatggggagggggtgttttcttgtctgtttcaatggcttagtttcagtatatataattactgattgcctagactacctgtgtgcatctcgtgtgctctgtttgtaccaagagataaagctttggtgacagaggaaggtagtggaagggagtactggtgatgaattgcagagtctaagagcccacaaacagtggattgcaattcttaactatcctcacacctgatttggatgaaaatgggtggacacctgcgctagccagtaaactgctggaaaactgacactctgtcttaggaatcttagcacctcaaaggcttgcaatattggtcagatcttcattgatggcactcctaagcccatgctatgaccaacaaccaaaccaagttaattatagaaaggagaaactccccatggtaactgaatatatttatatatcttagcaaataaatttgacacagcaactgacatagagagaaaggtttaagattttaatagttagaagtatagaccccgcagagagttaatttgagtccaccaaatttcttcagctaatttccatatggccttgtcatagccctttaagaacatggggaaggtcattgtttctatgatttgagtccatctcgtgtgaataggctgctcgtgtataatgctatgtgacattatctgctcttccattcgccagtttgtcctcctaataacctcttcttatatgcatcctttaggaaaagaccagtgccctcagtctgagcaacgttgctggagtattctacatccttgtcgggggccttggtttggcaatgctggtggctttgattgagttctgttacaagtcaagggccgaggcgaaacgaatgaaggtggcaaagaatgcacagaatattaacccatcttcctcgcagaattcccagaattttgcaacttataaggaaggttacaacgtatatggcatcgagagtgttaaaatttagggggtaggaacgaggctctaatacaaacttctaagtgcacgtttagctttcttgtcgcgtccttaagctcttttaactgaggaagatggccagtggatcatcctgtatgtattgttgatgctcttcatgttcctgaccagtgactaacctgcagttcacctgtctattctcctctttaatggcacagtctctggggtgaatgtggacagattcccgccataattgtgcgttattatttgtagttcagcttgcgttgtctactttcatttgctagaagctttcagatacaagtaaacttttcaaaaagcagcaccacctttactctggatgcatttgaaaaccataacgtgtgacttttttctttctttctttccttcctctctcatttaagatgaccttgagcgctgccacgaggaacaaggcaaggctgtcaattacaggaagtactggagaaaatggacgtgttatgactccagaatttcccaaagcagtgcatgctgtcccttacgtgagtcctggcatgggaatgaatgtcagtgtgactgatctctcgtgattgataggaaccttctgagtgccttacacaatggtttccttgtgtgtttattgtcaaagtggtgagaggcatccgatatcttgaaggcttttctttcagccaagaattcttaactatgtggagttcaccttgaattgtaaggaaagattaattacaaacagagcatccttttctacttcgatgtcagaggaagcgtggtggacatgcacagctaacatggaagtactatcacttaactgaagtctttgtacagacaacaaacccgtttccgcagccactattgttagtctcttgattcataatgactaagcacacttgacatcaactgcatcaagatgtgacctgttttataaaaaaaagaggaaaaaaaaacatttaaaataaaaaaaatatttttaggtattttcacagacaaactggcttttaaataaatttgcttccgtactggttggttaagacaaaaacaaaaacaaaacaaaacaaaacaaaaaaaacaacaaaaaaacaaaacaaaacaaaacaaaaaaataaagtcaaactgtgtgggaagtgatggggaaaatggtccatggtatcagttccatatttttcaaagccaaatatgtaaatgctgaggaaggaaacagaggagactccagtcttgtaatttaatattgttattaaaactttaatgtatcctgttctttaacatttggtgttaatatgaaactacttggcgatgcttgacatttgaaataaacattttttctattgttttatttgcaagtggtccagttaattttgcttagctacagtttggtcatacatccagtgatctaaagacactaatgcatagtccttaggatcccctaagaaaaagaccccagttaaaatacaggaatagtttttctttgacaaatagaatttaccccaaatagtatatctaaaactattttttctgtacatcatatatataatagtaaaatatttgttaattaaaaagcattaatctatatagataaatgcttgaagatttaaaaatcagatttattatcaaatgtcagattgtgtgattttctgctcttcaagtatttaaggttgtgtaggagcagcaatcattatatataaagtgaaaaaggcttgaaggtagctgttcagatacttatacactggccaaaatctataatctaagtatgtatttttagttttaaaattataagaactgacatcagtttttgaatactatagtcacctacaaatagtttctttccacttctatctataaaatcaactctaatatattaattcttatttatgcctcaagtagaaggagcactttaatttgtgtaatgtggatactgttccatctctgtaactttccactaaagaaatcaaactacactatttgattcatttaagccatctatcttcccttccttaaaatatcttttatgtttatttccactaatgtcctccaaataaaattactttagagttaaaagcaactgacacccagtagttatctttaagatttatatgttatttttctctcataaaaaaatctgtgtaatatttggtgtctgaccaagtgcttggtagagcatccttactgaccattttaaggatcagaaatgtaagatttaacagtagccacttgcattctacatggtaacatgtagtttcatgatgatcttcactaaattttaccatcccttctataaattccaagatcatacaaaataatttgagtgcattactcatcagggattctggaggtacattttaagttttaataataaatgctagaatgaccaaattgcagactaattatttccatattgtacttaaaatgagtttttaaaaattattttaaaagagatgactatatacaatcaaagctatttattgtacctctgggcctactcttccaaaaattgagcttatcaatttttctctgtcaagcttgaactaatgtaaataattggaataatgtaaagttatattttcatgtttttatagttatgacaagaacacttaatgtaagagtatctcgagtatgaataatgttgattggctaacacagagctcagttttaggcagtaaaatctagttcaatatccatgtaacaatgcatcagtatattgctgtatagatgtgtctgtgtgcatataagtgataagtgctcaacaaagagtggtgacagctctctcaaggttttttttttaattcattttctataaactgttatggaaagaccaaaataattatgaactattcttatgtaaatttacaattgtcctttactgtacattttgtttacagtatagtaccttattctctgctgtgttaagtgggtgtcatactccaaggagacaaacactttctacaacttctattgaagattctgggatttccaatttttcatgtgtactatgtctgaaaatgcttttgattttatttttaaatctaacatctgatggatttttcagagtgttgtgaaaccttcagtcatacataaaatatgttcttataaaatgtcaacatctttttattttgtttttacttaatggtatatcaatctaataatgagaaaccaaaaagtgtatcatatatccccccccccaaatctagatgtttttagtgagggagggcatcagtttgtcagcaaagtctgaatagtgtcaaggcagaatattttttaatttaaattaagagaattagtaattctggtatttcacacctatactcattaggttctttggacatatatagaaatgtggctattgattaaatcacttattttgtaatagacaacactggtaacataccaggcattgtgcacttagccctcctactgtgcagtcatctcatttgctgtggtactcatattaaagagcaggaaagtaacttgctttaaaatatggtttgacttttaaaaattgaccacttattatttaacttaaaaattctttccactttaactaatttcttcacaaagctggtcatttgaatatctacacaatcctatttatatgtactttaaagttattccaatattatagttctcctaacttgaacataaatttgtaaaaatttttatacttaaatgtatcaagtacttaacacaccaatataaaggtgattctgcttaaaaatacaggaattttacatttctaatctgtaaatactgtggatattttcatgatcaaggtagtactttgagaataagaagaaaattactagcaacattcctgtaaaaacctttagcacctaccatatcttaaggatatcattaacttttaattttaaatgaagtgtatgtatgtgcgtgctgatgtgggaatatgcccatgagtgcaggtgtctgctgataacaggggtgggcccaggtatatcagagctagagtggggttatagatgcttgccagctcctaaaatggtttttggagaaactagcctgggtccactgcaagtgttctttcttaaccactgagcaatcctccagcaccaataacatcattaaaactttttaaaaagaacctctttgcagttcattaaactatgacataccaatttttcatactttacctaatggcaatctggaggtccatctacataatagaaactattcgatgacttcacgtgtggaatgattttctgtgtttttaaacttgctttctgctgataaaattgattgtgcatgggttttttttttcttgagggggggcggggagggtggtgagtcctctgaaagaaagtgcaattaggtcaaatgtatctttctatttaatttatatgttatatgcaggtgtttgatcgaatgacttagaatgtttataacactagcattagttggaaatatatacattaataagagtatagtattaactttggacacttgattaggtaagcttgacaaatctttatgaatagattcaaaagaagcatattaaagaagttgcctgaaagttgcaaatatgcattaactatggaaagatgtacaaggtgctctgacacttaaaactggtttaatttacctcgccggcacggaggatgggtaagtatacacaaactgctctgagaccctgaacaaaagttgagggagcactagatggtttgggaaatattgaattaaaccttttttaaaacatgcttttaatatattgtttgggttaaaccatgacacaagacattttgttagacactcaataattacactttatgtttaaaaagaacaacccacgaacagcacacaacactccaagcccatggaggttcaaatacatttatgtaaacataacatctcagaaagtttccacaagctctaaagaagtgcccagagctaatgtggatcatgaagaatttgtgaatgtcttgtgtcctgtctgtatccctttcttgctttatattttacactctctttgtacccttagatacaagtgacatttgtcacttaacatatttccaataccatactttctcagtgtatagtttcatccatcttatttcattgcatccctccctcacactgtccatctagctttgactttccttatgagaaattttgctttgagaacacgtacaatgcagttcacttcgtccaagacaggactgaaactttcaaagtctttttaatgaccatagcaaggaactaggaatctctcaaacgaaagaggagagcatgtgttaatctccatgtttgcatcacacacgtattctgatccaacatggctgcttagctatatacccatttcacctaaagactccacattcaggagagttcctggaggatgcaggaggttctctgaagaagcagaaaacctgagaactcagtcttatctttgcccatcagggttttgatagccacttcactagaagtacaacctattctctattttaattcaattccctaggattttgaaatttatatctctcacaaagtataattataacctaattttgctattccacagccaaactccttttggatatgcataaactcagaattatttaattaatgataacctggatttactgaataaatttggtcacttttctttctttctttttcctttcaggttaatgtgccaatttcattttactgtaaattggaatgtgggggagtggattaaactcttgggagggagtcaagtccagctctctagctttatcttccccatcccctcacctctgtgtgtctcctcaactggagtatgtggatactaggacagtttcccggaatgatgaaaggaaagactgtatcttttaaaattgatgcttgaagaaacaggttcttgcatgggagtgccactcagtgcagaaagttttgttatttggttcaaaatggtttttatcatcttaacacgctagtcagttttatctgcgaacattcattcagtaactcactaatttacccatttgctcaaaaaaatgcttattgaatctattaaatagtatttattagaggtaagggctaaatttaaagcctctatttctgagaagtttctataaatcatgctctgatgtgttcccagccacatagaaataatttggttttagggttagtatctgacaattaaaattggtatatttacctgttctgtagaagacattgtactttccttcaggacaaaagtcttggcaacattcatgagaaattgcctctaacatggagtcataatttcctctcaaaaaagcttatatttggtaaattgcttccctataatcacaaattctcttctctactctcaaaaagtcaaattcagttcatcaacaaacaccacagtttgatgatgctaacctctgcctcctacatagcatagtttacatgcacctaaaatccatttcaatgataagaaaataagaaaactttagatgaaatttaagtagcaacagggaatttcccaaccaagtacagaacaatttcgaatttttcaacggaagtggttaaaaacaagtatctgtatttattattgtttaatttattttatttgcattaagtaagacataaactcaaagcaaatagtttgatttgtgtgagaaatgttttagatgaattcatatatatatatatatatatatatatatatatatatatacacatatgtataggagtgtacatgttaaagtcaattattttaatcaatacataattcattatgccaccagcagtaggcaaagaaacacatttgctaggcatcagaatcactctcaattacaaattaagaaatgtatattttacatttatttttatttgactttcataatataatttataggtttttcaggtatctataatattttttacagcatcttttggtcaagaattttctgatacaaaattcctattcttctaggagttttatgatttaagctttggatgtactggattcctaccgtctgaagcacttctgtgtaaattcagagttcaaaatagcccagtgggagtggttagcaagtttcttcaaacaatatgtagcatattgaagtcaacagtactcttactttgcctctgccttctatccttcattctccaccctgtcccagctccacatcaaaccctgtttggatgcttggtgaagacatacattgtacttttattcatctaaatctcatggcttgtagtgaggcatagcaattttcctgggatttctaggtcatagttggcatagtacttcctgcacatttttcttacacatctgtgccttcgtttttcagtggagtaaatgcaggctatctgtattggcctcacgtctatttaggttatttttaaattaaaatgtaattttggacttatacctaaactcagtctgtatctgtaaaggtttacaagcgtgtttacatgcgttattgtgttagctatttgtgttaaagagataaacatgtctgttcattttaatttaatgtttttgtgtgtttctctgtgtgtatgtttatgtgtgtattaaaaatattccatatcttctgtagtatttattcttataattatttgaagcattactaaaatatagtctcaatttttaagctcaaaacatgttaaatgttttagagtacatgattgtgactaatttatagaggcttaccatattaataaattctttaagtaggaaaaatgattataagtcacccagcccctaaccagaacatgccgcttccatctttgtttatatttatttaaatatttgattactcaagattagctttccatgagttatggtttctaattaggtatcaaatggtcttagcattagaaagacctctggtgtcaaagttacattgtttcatctattgcatttcctcatcagcaaaatgagaatgtatgggaaataaattattcaatttcagaagtgggtttctggaaacatgaaagaaatatactccaatatcagcatactattttcaaacttcaaaagataatagggttaccagcatagttcaaagcatcactgttcattctggaaaggcagtcggctgatggatgacctcctttctgaggaacagaggtgaaatcataagtgaacagggcaggcctcataaggagcaaagaggctcccgcagcaggctgttcccctctcatcactcgccttctcctgccagagagagtctttctgttctcatactactgagctattctacactagcaggtagatcctacgtagagaatgcattttaaaaatagtaactttgaatgaacataggtacacgttagaacttgattttctactcagtaacttctcttactctgagtagaatatattgaatagaaatagctggagaagcattatcatagagtttcaggttactgatatatatctggtacatgaaaacttactaacacatatttatgctactaaatatttaagatgtaactcaatcatttaatatatgtataagcaaagaaacatacatgcccatatttccttgaaagatgaatgaaaattatttttagttggtttatcagtgaagaaggagttgccattcacattcacttgctttttaaaaatctgaaaataatttacattaaaatataaacatgctttaaataatatgccaagtatataatgcagatataaatgttactattttattactgacatttattaagatactagttttattttactagaacacaaaataataatgcataggtttgtagttttaatttctacacaggtggtttcattgcataaagtccatttataataaaactagagatatctctagttgatttttcccacctatctcaatcaattgtgttcaattatttcctgtcatgtaaaaaaaaattactttgtcccttgtacttaaatgattatcatgatattaaaatttgaatcaaactaatccaattagctctgaggtccagaccaatacatttaatcatcaattggtattaatattactaagtatttttaatacatcttgacacttgagagatcaaggcaggaagattattcgatatggtgagaactcccccatacgcactcccaaataatgctggttattaaccattaactttcttaggtaccagtcattactttacacacaacatttttgaacatagaattaatgagattggtgttatcaatacacccatttcatactgtgaaatgaggcaaagctcgaccctattatttgctgacactccagtaccatctagaaatcattacaaacacattacatgtgatacccctcatggctgagttcctggtgtttccagccaaagcttttcttcctcagacaagttttcttttgtcacatttttggccctggatttccaaaaagataaatgttctcgaatgcagaaaaacataagtgaatttcatctttttggtaagtgcgaaaaatattgaaaccaactttctagcattgaaatctatcccttagttcccaattcatattgatgaccatatatcatcaggctaggtattttgcaattcattaagttgaaaggaaatattcctgaatagcccttaattttgtcttagttttattttgatatttgttatttctgcctgtgctgagtcacctctagactgtctgttgtctgagtcccaaaaggctcatgatcactttttctgtttttatttaatcatattgtactgactgtatgtgtatattaaataagtgtaattctactaaactttagtacatgggtctgctctgccccgacctgtaggacctagggcaggggagagagagtgagagggacaagaatcatgaagaacgagagcaagacaatttgactgatcaagctctgaaaaacttttttctggaatggcaatataagaaagaggagacttcaagggagcggggaagagcccaggggctctccgaaggtcaggtagcaatcttcagctcctggaaccaatggtcacagtgtcctatctacccacaaatattctttctgttatgaccatgaatgttctctcagggttgtttatgtaatctagaaaatttccacaaggccatggttgaggctatggctcctggcatctcctcccttttaattattttgatttaaggcattaaggaactggggtgatcaatagtcatctcatccttggatgagtgggcgttaaccagcagggggagcattgacttgattcctcccgtgggtgccatcacgacccacagtcatggctcttggtgtcttttggggaggggaggcagagccttagaaaaatccttaggataaggttgacaaaccaataccaacctctttgcaaaccaggtttgtctaatggggaattcagagacagttcgtgtgagacctctgcctgtggtgcttagcctcacagcacaagctgatgctcgtactggattcattttatcaagaaccagtatgcaacaggtatgaatcctatgcagctcctaaaggagaattatcaaccccaggtttggcaaggcctccatcagccaaatcaagtctatgatgactttgcaaggctcttgatgccatggaatcaatcagctgttttataaaaccagtcacaaggaatcagaagtagctctttggcttctatacacttctttacttatattttttaatgatgctaactgaaatagaactacttcaacactcccattcttctctccagctcctctgattactgggccctgaa

SEQ ID NO: 177 - DNA, 3125 bp, Mus musculus
acaggacgcaggcatcaacagccaccagctaaacctgggagataaggattcttctgccttcacttcgtggttttagcagctccttgctaaatttcgacctcaaaatgcagaggatctaatttgctgaggaaaacggtcaaagaaggaaaaggaggaaagggaaacgaggggatattttgtggatgctctacttttcttggaaatgcaaaagattatgcatatttctgtcctcctttctcctgttttatggggactgatttttggtgtctcttctaacagcatacagataggggggctatttccaaggggcgctgatcaagaatacagtgcatttcgggtagggatggttcagttttccacttcggagttcagactgacaccccatatcgacaatttggaggtagccaacagtttcgcagtcaccaatgctttctgctcccagttttcaagaggcgtctatgcgatttttgggttttacgacaagaagtctgtaaataccatcacatcattctgtgggacactgcatgtatccttcatcacaccaagcttcccaacagatggcacgcatccatttgtcatccagatgcgacctgacctcaaaggagcactccttagcttgattgagtactaccaatgggataagttcgcatacctctatgacagtgacagaggcttatcaacactgcaagctgtgctggattctgctgcggagaagaagtggcaggtgactgctatcaatgtggggaacattaacaatgacaagaaagatgagacctacagatcactctttcaagatctggagttaaaaaaagaacggcgtgtaatccttgactgcgaaagggataaagtcaatgacattgtggaccaggttattaccattggaaagcatgttaaagggtaccattatatcattgcaaatctgggatttactgatggagacctgctgaaaattcagtttggaggagcaaatgtctctggatttcagattgtagactacgacgactccctggtgtctaaatttatagaaagatggtcaacactcgaagagaaagaataccctggagcacacacagcgacaattaagtatacttcggccctgacttatgatgctgtccaagtgatgactgaagcattccgcaatcttcggaagcagaggattgaaatctccaggagaggaaatgcaggagattgtttggccaacccagctgtgccttggggacaaggcgtggaaatagaaagggccctcaagcaggttcaagttgaaggtctctctggaaatataaaatttgaccagaacggaaaacgaataaactacacaattaacatcatggagctcaaaacaaatggaccccggaagattgggtactggagtgaagtggataaaatggttgtcaccctaaccgagctcccctctggaaatgacacatctgggcttgaaaacaaaactgtggttgtcaccacaatattggaatctccatatgttatgatgaagaaaaatcatgaaatgcttgaagggaatgagcgttatgagggctactgtgttgacttagctgcagaaattgccaaacattgtggattcaagtacaagctgactattgttggggatggcaagtatggggccagggatgcagacaccaaaatttggaatggtatggttggagaacttgtatatgggaaagctgatattgccattgctccattaactatcactctcgtgagagaagaggtgattgacttctcgaagccattcatgagccttggaatctctatcatgatcaagaagcctcagaagtccaaaccaggagtgttttcctttcttgatcctttagcctatgagatctggatgtgcattgtgtttgcctacattggggtcagtgtagttttattcctggtcagcagatttagcccctacgagtggcacactgaggaatttgaagatggaagagaaacacaaagtagtgaatcaactaatgaatttgggatttttaatagtctctggttttccttgggtgcctttatgcagcaaggatgcgatatttcgccaagatctctctctgggcgcattgttggaggtgtgtggtggttctttaccctcatcatcatctcctcctacacggctaacttagctgccttcctgactgtagagaggatggtgtcgcccatcgaaagtgctgaggatctgtctaagcaaacagaaattgcttatggaacattagactctggctccactaaagagtttttcaggagatctaaaattgcagtgtttgataaaatgtggacttatatgaggagtgcagagccctctgtgtttgtgaggactacggcagaaggagtagccagagtcaggaaatccaaagggaagtatgcctacttgctggagtccacaatgaatgagtacatcgagcagaggaagccttgcgacaccatgaaagtgggcggcaacctggattccaaaggctacggcatcgccacacctaaaggatcctcattaagaaatgcggttaacctcgcagtactaaaactgaatgaacaaggcctgttggacaaattgaaaaacaaatggtggtacgacaaaggagagtgcggcagcgggggaggtgattccaaggaaaagaccagtgccctcagtctgagcaacgttgctggagtattctacatccttgtcgggggccttggtttggcaatgctggtggctttgattgagttctgttacaagtcaagggccgaggcgaaacgaatgaaggtggcaaagaatgcacagaatattaacccatcttcctcgcagaattcccagaattttgcaacttataaggaaggttacaacgtatatggcatcgagagtgttaaaatttaggggatgaccttgagcgctgccacgaggaacaaggcaaggctgtcaattacaggaagtactggagaaaatggacgtgttatgactccagaatttcccaaagcagtgcatgctgtcccttacgtgagtcctggcatgggaatgaatgtcagtgtgactgatctctcgtgattgataggaaccttctgagtgccttacacaatggtttccttgtgtgtttattgtcaaagtggtgagaggcatccgatatcttgaaggcttttctttcagccaa

SEQ ID NO: 178 - protein, 875 aa, Mus musculus
MQKIMHVLLSPVLWGLIFGVSSNSIQIGGLFPRGADQEYSAFRVGMVQFSTSEFRLTPHIDNLEVANSFAVTNAFCSQFSRGVYAIFGFYDKKSVNTITSFCGTLHVSFITPSFPTDGTHPFVIQMRPDLKGALLSLIEYYQWDKFAYLYDSDRGLSTLQAVLDSAAEKKWQVTAINVGNINNDKKDEYSLFQDLELKKERRVILDCERDKVNDIVDQVITIGKHVKGYHYIIANLGFTDGDLLKIQFGGANVSGFQIVDYDDSLVSKFIERWSTLEEKEYPGAHTATIKYTSALTYDAVQVMTEAFRNLRKQRIEISRRGNAGDCLANPAVPWGQGVEIERALKQVQVEGLSGNIKFDQNGKRINYTINIMELKTNGPRKIGYWSEVDKMVVTLTELPSGNDTSGLENKTVVVTTISPYVMMKKNHEMLEGNERYEGYCVDLAAEIAKHCGFKYKLTIVGDGKYGARDADTKIWNGMVGELVYGKADIAIAPLTITLVREEVIDFSKPFMSLGISIMIKKPQKSKPGVFSFLDPLAYEIWMCIVFAYIGVSVVLFLVSRFSPYEWHTEEFEDGRETQSSESTNEFGIFNSLWFSLGAFMQQGCDISPRSLSGRIVGGVWWFFTLIIISSYTANLAAFLTVERMVSPIESAEDLSKQTEIAYGTLDSGSTKEFFRRSKIAVFDKMWTYMRSAEPSVFVRTTAEGVARVRKSKGKYAYLLESTMNEYIEQRKPCDTMKVGGNLDSKGYGIATPKGSSLRNAVNLAVLKLNEQGLLDKLKNKWWYDKGECGSGGGDSKEKTSALSLSNVAGVFYILVGGLGLAMLVIEFCYKSRAEAKRMKVAKNAQNINPSSSQNSQNFATYKEGYNVYGIESVKI

SEQ ID NO: 179 - DNA, 163382 bp, Homo sapiens
  misc_feature (1)...(163382): n = A,T,C or G
atttgtggtaaggagatgtgagacagaagtatatggatgcacatagagagtgaagacacttatgtccttcacagatgtccatcggagggacaatcatttcggaagagaatcttaatcatgaactagatggcctatcctgtggatgacaggcaaactctttgcccagccacagttgttctctttgtaagtccacatgcaaaacgactttggtggcagcagggatggaagttatgtctgaggtcaacagcagattcttctcttgttaagactaaactacctagggcaattgctggtttgccaatttgccagcagtagtgatcgacaattttctgatggaaaacaattaatgacgtgatcacattggagaggatcatcagatagggggattgctttgttctcacagagtagacacgtattctagatgtggatttgcctttcctatactcagtacttcatctggtactactactaatggattaatggactttcagaattcattaccatggaatcccttgcaatgttgcttcctaccaagaaacacattttagggaaaagagactatagtaatggattcatgcccctgaaaatcactcatcgagctatgtactccatcactctaaagtaatgcgcttgatagaatggtggaagagcctgctggtggctcagtgttgatactagcttagagagaacactctaaagggatgggacactatcataaagaattaaagatatgctttcaataattgtgtcaataaatgatgcagccttccctaatgagaatgtaaacagttttggaatgaagggaaagtgaccctactcactgttacattcaagagtgtacttaaataatttttgcctcatgaccctagaatcttggttatggttgatttggtgatcaaggaaggaatgtttccatgagaaaaatggctatgttctagattaattgaaagctatctgtcccgtatccatatcgggctccttttgatgctcaatgaacaactgaaataagtgtctctctattgcctaggtaaatgatactgactatgcggagaaagatggtctatataatagaagagatgaggactatatctggaacctgagaagttcactattcagtagagtgcctcttagtattcccttgcccagtaatcagttaaacaaaacaaaacaaaacaaaacatctctagaaacacataaaaatacaaacatcaagaacttggatcctgcaggaatgagggtttggactatacacaccaactgaagaattctgtctgactaagatgtgttgacaaaattaatgaagatatggaaggagtatttagtgaaagtggctgtgataccattttttagtatttaaatttcattgtgataagaacacttaacatgagagataccctcttaatatttcaagtacacaacttattattgttaactataggtgtaatgctgtacagatgatctataattcatcatgcctaactgaaactttatacctattcaataacaactcttcatactccctaccatccagcctctgcgaaccatcactctactcgttgcttctacaagtctgactattttagacgcctcatataagtgaatcattcagtgtttgtctttctgtgactggattcttgacttaatatcctcaacattcatctactttgttgtaaatggcaggatttcattctttttaaaggctgaatactattccattatgtttatgtaccgcattttatctattcatatatcaatggtggtttccacatcttggctattgtgaatagtgctgcaatgaacatgggagtgctaattacctctttgaatttctgatttttattttttggttatatacccagaagtagaatttctggattatatggcagttgttatttttaattttttgagaaagcaatatgttgttttgcgtttggctgcaccatttagcattcccaccaacagtatacaaaagttcctgtttgtctacattctcattaatattcatccttttaaaaaatatataatagcctataatagccatcttaacagttgtgtggtgatattcccatactgatatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttacatcacaaataatgattaaatatgtatgatttatttattctttatgttgcaattttgaatatatgtaagttatatctcattttttattttttatcgatttattgtaattttaattaatttctatatattatttttattattcaattttttaaaggttaaatacatttttatttagaagacctgctttatatacagtgtggagtacttataacatactaataaaattctaaggcataaaattaagagatattttagtctatagtttataagcttaataatagattacagctattctcacttcatggtttaggactacatcaaaaagagggaaaggttataatttgaaatgacagcaatataggatccaagagccatagaagccactttgctcatcatcatttttaaaatggggaaattgaggccaatgtgattaagaagcaagcataagataatccagtcagcaatgaagctgcaagcacaagaaggcagcctgatagactcatggcattttggaatactagcagttctctttttagtactgtaagctccaatctccctcttcctggaaacagttccttgttctcaatctttctttatttgtttaaaccagtaaagacatgcaacttggtggggcttttctgagtccgcagagggaattgtcagagcaggtttccaggaatgagcttggaaaaagcaccatgaagaacataaatttcacacgggaagtccagtcatccatctcgccatcaattctctcccttcaaacttttaatatctaacctcatctttctttccctgtggcccgcgtgttcagtagagcgtggtggcttactttctttaggcagtgatttttcgaaacccccggccaaaacgcgatggggaaacagatttctaagtaagtctctgggaaagaatctgcatctctgtggcattcctacactagcttcatcttctaatcactttcctctaatagcctttccttaaaccagagtctcttgctttcaatctgcataaagcaagggcttctaggaaaccaagtctacatgactctacaacgggagggattgcagtgaaagctgcgagaaagacccgtgcgctctgtaactaggcgagtcagcatcacagcccaatggaatatactctaaagatgggattttcatgcaaaatatttaaaagattccatcttgatctcttgtgcggcttaagcatttaaagatataacttggggttctccctggatcctggctacatcccatgaagcccaagtgcacaattttggaatatttcctccacggtgctttgcttgcttgtttgctttcggctgggtcaggtgaggaggatgacagggcttctgtattgctaaatgggttttcacaggagatggaagataaaaatcaaaattatttgtaacgtaagacagcagggcctggtgagaggacgcttcgccgccaacaattagcaattcggcttctacacagcagccggagatcagctttgctgcatttggtccaggttggagcatctccgcagcagctgcaacagccgcacgaaggtagctccgggcggggagcgaggcgctgtcctcggtgctgaaaggccgaggcgcgcggtgggcgcgacagccccggagacccgaggtctcgcggagggacagcggctacgggccccgagctgtgctttctcagcgccgcgcacgcgacgcgtccacggtggtgcggggtgccgggcgccgtgcgggggagggggcgcgcgctcccgcctcctgccgcgagtcgcgcacgcgcgcccgggactgcctgcccctctctgtgacttgcctgtgtgtgtgcgtgtgtgtatgtgtgtgtgtgtgtgtgcgcgcgcgcgtgagtgagagaggagagagggagaagagagcgcgagagagggtgagtgtgtgtgagtgcatgggagggtgctgaatattccgagacactgggaccacagcggcagctccgctgaaaactgcattcagccagtcctccggacttctggagcggggacagggcgcagggcatcagcagccaccagcaggacctgggaaatagggattcttctgcctccacttcaggttttagcagcttggtgctaaattgctgtctcaaaatgcagaggatctaatttgcagaggaaaacagccaaagaaggaagaggaggaaaaggaaaaaaaaaggggtatattgtggatgctctacttttcttggaaatgcaaaagattatgcatatttctgtcctcctttctcctgttttatggggactgatttttggtgtctcttctaacagcatacagataggtaggtaccctttgtgctatgcttttgaattgtgcataatttggtggtaatctttgttcacagtgtacaaattaattcatgtcatgtagacttatgtcataccttgactgcattccagatttaaactacctagaatatacatgtttttcttaggatgaagcaaaaggaaaagactatgcctttgatacaatagaagaaaaggtcctctcatttcggatccccaaattttattaattctgccttagcgacattttccagtttgctcagattttcttggggtctgaatgcaaagcttgtgattacatggaaaggtgaaggtttctggccacctacctcgccttcagactctcatctgggtcttgaccccttggctagcttttggatattccacccccgctgtccgagtccgtaggtgtgtttattcggcctattcgcgtgaataagagactcttggatttttgggcgctagcgcgcgcccctcctttccctcccggggcactgacactgttctcttgcttgctgtttgttctttgcaggggggctatttcctaggggcgccgatcaagaatacagtgcatttcgagtagggatggttcagttttccacttcggagttcagactgacaccccacatcgacaatttggaggtggcaaacagcttcgcagtcactaatgcttgtaagtaatgaatattcatgcctttcgggtgctgcacgcggaaggccagcgagtgtgagtgtgtgtgtgcgtttctggggtggtgtgtgtgcgtttctgtgtgtcagtgtgtgggtgtgagtgactgcacacgcgcgtgcgtgtgaccgtgtagagagaaggtggctgtaatctcagggacccccgctggctggagagggctgaagagagagggaaaggacgtcaagagtgtgcgcattagggagccggggtgagggttggagccagggagggcggctttcttgggttcaaggggttttcgctcatcttgagtgcttcaggagaagccctcccacctcgctccccatcgagcgcctgttggcaccctgcccacagagaacacgttgttccccagggcgcgcagtcgggctgttggacaaatcccacgagggactgccggagcccagtggcctcctgccccagtagctgccgctctcgcccgctgcccccagtttagatccgcagcaccggctgggctcaccctgcggccctcgcgagctccacgttctcctctttgggacaagttgttgaaatggttccggagttgggatcggggctgttacataacgcccacccgaggggcgaggagcggggctgacgcaggctcaggccggccgggtggcgtgggggtggggcggggaggcggtggaaagggggagcgctgtcaatttctcctgctcagttgcgcttccgcttaagttggagggggcgaggccgccaggggcgccgcggtcagcttgccagcccggcgcgctttgttctcaggtagctgggctccagcagaggcagccggggaaaaggactgggaagccgtgggatctggccgagtttgaaaatctggagaagtcgctgatcagccattttagtctttgcaatgctccatattaaccctctcactccgcgcagtgctccgggactcgctgggaagctctgtgatgggttcagataaagtactagaaaccaaacaattagggatctaaaaggattggtgtggaggccagagggctccggtccccgcgctcgctcccccgcgcaggcgtgggcaggcagtcgcggccactgtgccttcctgccctcttcccagcagctgccatcatttcctgccgactgccctgcggtgattctttcctgccctaatattcgcagtcgttatttcatagataacaatttgggggagatctgcggatggctcacttcccactttggctacagagcttggggaaaattaccacaggaaaagcccaactgcagttttcccacgtcacacaaacaactggttgccatccctcctccccattttaagctttagtcatatattccgtgatttagcttgattatcatattgggcccatcatcaactcttgcaactactgtcacccggacgaatgaagaaacaattttcttagactgatagaataggggcattgtgtggtaatttaggatttaattgtttataatggatctatttaagaaggtttcactgctatatattttcttcaaatgttggtgccaagtaagaaaagaaagaagggcgggtgtgggggtacagaacgaaagagagaagaggagaattaaagtggatttgcagctttgaaaaacgtccgtaatagaatatctcagaaaattttagtacatgacatacaaagaaatcaacttaattaaaatttgaagacttctatatttgacctatttacctaacagatttagactattcatttgatatcagtaagttccaatttttcctgaattacaagtttgtcatgcaactgttctgagtatctaactgtgtgtaattgtatacttatgtgaaaatgctttgaaaagtaatgactcctaaggaacggctgtgggtataggaaggacataggttttgaatgtgaagtgaaagtattgacagctgtactttttgaaaacagtcaatgattgccaagttcactcattggtgaaaataatgagaagaactttctgcaaaaataacatatgtccattgacaaaatgaatattccttgatttcaacaaatgctaaactactgtattggggctttataaagataaaagactgtgattaggttattaggtttagatactcattctcaatatttttgaatttttaaatagaaatttttctgaaataaaatatatagccagaatatgtgtatatattaaacacatatgtaaattcatatatttgcagggtgaacacattcatgtaatcaacatgtggacttcttttaaaaaattaccacacaatttaatttgtccatagttctgagaagctggaataatcaagtcttcatttgcacagttttttcccctcctcaggaagtgaagctaaaataaatatgttcacatttccagagactaaaattacccctgcatggattattatagtaggatagtaaaacaaattattttcaggaactgaacacattttaaagatgacaacatgataattcaaaagcatgacatttgcaactcccatgttataagtaatcttactgtttgctaaaaagaactaggggggtactgtgacagaagagaggctcattggatagaaatttctggggctgacattaactcattgactgggcaaatcgcttaacatgtttgtgactccgtttttttattctctgagacatttcaaaatttagagattgcaaaatgaaatagagaatttgtatccttttttgtttgtttgtttttgtgctatggacaatagaagatgtaaaattagtttaactcttttgagacagaatgagagagagggaaagggaaagatgcttatgtaaactacaatcacaaagtcaagaaatggatgaaaatctctagtgttaaatttgtcagcatgggtcttgatcgtttaaatcctgcttaagatttttctccaatgcctatcctttgttttcttgcctttttattcagggaagtctgtgattctttcctttataaagtggaagcaacagcattaaatacattgacagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaacttcaaaagggaaaatttattagtttactaatttaattttattcctgagatggaggaaattatttggaaatgttgaagtggacgttgatatgaggatccagggagatccactgaatgggttaaggttatacaaagaaaatgaagtcattctattctgaactgggtaaaatgattgtgtgcatcttactgagctcccacatccttccctttcacaatcacagtgggataatgaaagtacctattttgttccatttgtttccatgggtacctgaggcagtaagacagattttcagtttctttcattttttctccatcattccctttttcttttcctctctcccctcactcattttttcctttcctccctccctgtcttcttagctgaaaagagaactaagattttttttcctgaaggttgttcaaacgtaagccttcattattaaaaatacaaagcataaaagcagaaaaaaatctgagattagtatctgatgtgtagaacagttgaaaccagggatgggtcctaggaatccaatcattcattcaataaatgtttagtgagtgccttcaaggtgtcagagaataaatgactgctttttttcatgttaactttttttttttttttctagccttttccctctaggctcttttgaatagttttcaaaaccttgtaggccttcatgcctttagtgtgcattggtagctgtggtcttgtctaggaactttagtatgaggatatgagggtattccagtagttcttaaacacaagcggtttaatacagcaactaaaaaaatctgcctttttgtgaaaatagtaactttcatattaatatatatatacaccacgtattgtatgtagttaactgagaaaatcaatagcaaattttaggaaaatactaagtatttttacattataaaagattttagtaaactttgatgctatgctaattggtaaagcttgcttaaaataaaactgtgtaaaagggctataaacatgagtacttgattctacagggtttgaaaattaaaagtattaaatattgaatttactccccagaaccttccctttctatttcttttgaagactgaattttacaaatagttattagtctagttaaagatgatttaatagttttatatttcaattccatacaacaaaataaattataaaaatattaaattgaaggaaacagcaaataaaaatctactttttctccaagccagcagatggagatgttggagaaaatattgttgtttcataaaactgttgcgcacaccgaatgccttttaaaacattgtaaagaaatttatttagataaattgaaaaaaataaatgacatctaatttgaagaaaattattcaaaatgctgtcttaaaaataactttcattgccttttaaaaataggttgccctatattttatgttttagaagataaagactgttagaatagattgtaaatgctcttagaggagagagaattctaaaattatattttttcaacatttttaatctcgattccccagctatcatttttgagctgtatttattattaaattttagtcacaaattactgagatttttgtatctgtgttcataaaattaattgatgtttgctaagactttattgcacttggatgaatggacttctgtgtgtatgtatttatagttacaattatagagtgtaaatagttacagattggctacgcgatcctgttttgtcatgtttgttgaggtatttactaacacctagagttactgactttaatatatgcaaaactttcataaaactagactcaagttggactttcttaagcaatgatgacaaaccatgaacacatgtgccagggacacaataccgtaaaagctggtgttgtaaatattcagttatattcaattgcagattttgaggaaatgcctctttgtatgtcagaataattaatctgttattgaagtattttcagttaaaatttcatacttcacttatcactgaagaatttcaagaaaatgagtgcgtattaagtagaaatcaaagaatggcattggttgaaatattctattttgagatgagagaaactaagtattgaaataaaaattaccttatgaaactatagaggcttaaattagtaaaaatttattcttatgctatgctatttctgtttgaaagtcttgcaaacttcaacctgctggctcaagaaggatggggtattttcatttcacatcaagcctttaaagtgctagggacattgtactgagacattatgacaagtggatgctgattcatgcccagatctcaagttttctcataatctcttccaataacacttagcaaactttcaaacttcttagaaccttgaaaattttaaggaagggtgaaaaagagcagttgtttttgagttatttcagtatgttgctatataatcaagttttcagagagtatgtgttttttctctcttcctcctcttccctttttataaaaaagtcaatagaagtacttaatctgcagagcaaatgctattacaagaaataaagtctaaattgagatagagaactgtcctttaaacattttcttatgtgagcagcgagtgcattcattcagagctaaaatcttgtatttgatgtaaatatttgattgaaatgttaatggcagctgggtagattatatttcctttctttttacagtagattgtactgaagataccccagatttcattaagtgtttgctcttttattattatagcaattttaaataaaaatttctcaggttttctccaaagatctacataattgccaaatctcttgtatgactgtgtctcttcagtacaataggaaaataagttgctgaattcaatgttaaaattagaaaatcacacatgatttgaaaatgttcaaacatcaaaatgtctatcaaatcagattttactagtttggaaaaaaaaaggaatgtgattcttacaatgctgttcataagatgtctaacacctattatttttcagtgctattcaatttaaaagttttttgtcatctttgataattttaacttatagaatgaaaacattttaaaattaacgaggagaatgtaaaatgtgggcttgttgaagacaggcccttgctgctgttaactgtgtgttcttcacgaagtctagctcagttcccagtgcaccgactcacttaatagttatttacctattcaacacatttaattttacagtagatgttcttatcataacattataatttttaaagttagaattttgtatttgctatacatatggatttcagaatacacaatttactttgtaccttccttgaatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccccccccctcccccaccaaaaaaaaacccaaaagcaagaaccttgttacaagtgggtagaacaggagatgcccttataaggcccctgaccgttatgggtctgccaagcttcaattttggttttagatgttccaaaaatgtgtccttgaatggacacagaattgttttagtaactccctccctgcccccaaccaggatattttatactacaattttctatatcaattcctttaattaattttaaaaatgtacagaatcacaaaagtattatttttacgttttagatggtatctaggaagagaagtttctggacatagtttctctttgtggaccaattgctctatttgcattaatttgtgcaattattttgtatgcgtatccttattttttctttttagggcctgcagtttatgtttcgggtttgttttctaacgattttgttttgtcttattttcattctgtggataattttcttgggtgaaacaccttgttattatatgtttaatttttcacacattatcatattactgggaaaatcatccaaagtgcttgatactactccagcctgggtgacagggcaaaaacttgcctcaaaaaagcacaacagagtcttgaaatttattggtatcttcagctgaatagaacaaataaatttaggagataccaggttccttatagaaagggaattggtgagtagctatcttcttagattgcttacgtttttgtatccatgtttctcaaacaaatgacatatgtaatgtttatagttttactatttggatttttcttcagaattttacttcataattttatatatttatggttatgttaatacttacattttttcctgattgtttcagtatttcaaatataaacacaaactgggttgaattgtgaaatggcctaaattttagttcttctaaaatactttcaatagggtattttatttctatgaagtttattttcccttcatgtaaaattgatttcacatgataaatgctatgatgtttacttgttatagtcctctaatactttcacgctgatgaatttcagtgaacctgagaaggtactcctgcaatgtaaatatttttagtctaatcttcctaagtacccaacttactgatagaaatgactgaaatgtgtttatataaactaagtatattctatgcttgttaaagcatagtagaatattacctgattctttatccctacaagaatagaatatgacctaaattaataatgtctaacttcagcataaatttaatggaaactcaagttaaataacttgatataagaaaagtttcctcagctcataaaccctttgcagctaaaattctctgtatcaaaataccgttctgtttcagatttagcattcattttacaatttctctagcatcagtattcaagatattgcagtaagaatatgtcaacaatttttttatatatattatttattgtgcatgaataaaaggatagagtgggcatgttcaaacaaatagtttcaaggtaagggaaaatatttttttccttattgtagattgaaattactatatttcttaaaagtgatggcgggaaagctgtggagaaaaagggaaaaactctaagaggcagcataacttggtgtacttggcagggctgtaagaatttgcaactcgaaattaattcattccttccttccttccttctttccttcctttcttccttccttctttccttccttccttccttctttccttccttccttccttctttccttccttccttccttccttcttccttccctccatccatccctttctgcttcctttcttccttttttttgtttaagcatctctttcatttgatgtttgcttagtttgcatgtctgtggtcaatcttctatattaaccttgagctactatagaacagtgaattcttataataattttaattttgtcaaataatggaagctagttattatttctagagggagacatgaaagaaaggaggcactatgcatttggttttgattttttttccttttattttattttattttatttcttagcgaaagggtctcgctctgttccccaggctggagtgcagtagagctatcacagctcgcttcagtcttgagctcttgggctcaagcaattctcctgcctcagcctcccaagtagctgggactacaggtccatgccatcacgctgagctaattttattttattttttatttttatttttcatttttctgagatggagtctcgctctgtcacccaggatagagtgtggtgttgcagtctcggcccactgcaacctccgcctctgggttcaagcagttttcctgcgtcagcctccccagtagctgggactacaggtgcacaccgccacgcctggctaattttttgtattttagtagagatggggtttcaccgtgttgcctaggccggtcacgaactcctgatctcaggcaatccgcccacctcggcctcccaaagtgctgggattacagacgtgagccaccatgcctggtcgcaattttattttttatttttgcagacgggttatcaccatgttgatcaggctgctcttgaactcctggccttaagcgatcctgtcaccttggcctcccaaagcactgagattacaggcatgagcaaccatcctcggctaacaatatgcatttctctgaggaaaaaacacaaatttaaggtgctttattattctgggctggcaaaaaagccatccttgaaaattatgaggtaaaatactgactgaaaaggtttgaaaaattttataggtaaaaatatacaatatggaatgtacgactagactgcattttatagggagcatggaatgtgtcatagtaaagttgtctgttgcttgaggtaactgaaatgtagcaattcttgataattgctgacggggctcatcttagtagaacagagaaaagtttgtctcttgttttatattatactggtattatatttctatttccttaacacctaagttgaagatattttttaaaaaaattaaaatatttttagtgttttaaaaataaaaacattttggatttaaattatttttcacaattctacatgtgtttaaaaagtattagtatgtcttggaagaatatttaataataattctcaaatgatatgtaatattttgtcattgaggctaactattcaaaagttattcaaaggacaatttaagactaaaatacggaacacagtgagtagttttattctgaaaaataaggaccataacatatgcaataattagtttggtctatatatttgaaaatattgtcatacacactttagtgatgctaacttggaaaattgaaaacatattcctttagggctttatgttagctattatgaattccatatatttaaggggctgcctgtgttcactgatccaggtagcacagaaatagctcccacatttctacagcatgggagtgaagcatctctcatcattgcaagtctggcagagaaagatctggaagtggagctctctataagggtgtgtgtgctttgctaggttttcttgagaagtacatttcaaatcatgtcatgattttcatctttattcgtgtgttatctgctgtttgtgagaaattgaagaatttctatcttgcttttaatctgtgcatgaaatgggagaattttggctttataattttcaagcactttcatcatttatcattttacttttatattttttaccaggtttttagtttttactagtttatgctattattactaatttacatacagaaaggaaattttgagaacacaggcaacaattcagaaagggatacaaggaagcgctgtatatagtttattctttggagggaaggaccataaaatcctcatctttatatttcagagcacacacaagttcagggttgtcatcttaatgatgaatacacaagtttttcatctgcgaagattaaaaaaaattgattcgttgtagtttgtagccttggtgtcttgggatacagaatagcatgggttaagcatctgcacttagaaccaaattctagtccttgtactagatgtatgacattggacaagtttcttagtctacatctcagtttctacctctgtaaaagggaaacagacattataggattgtttgcaagatacgcattagtcataaaacactatgagctgtgtttggcacaagtacataaaattagcaatattttattattatttcctgtattagaatttttggattgttttgatgagcacttgctattagaggcagaagacaaagaaaaatgcagttctaactttcttgctggaatcttttcctactgtttgtatacctgggcaggacataatgcctttcggtgacaaagaagagactaacaaaataaatcacataagtcactgaaagatatatttggtgcactataggacgagaatgatttttaaaacctgaggtgttactcgagtagtactttgaattcaatcttcccctttattgcatgtcacttacatcttaggatgttgaacaatttcaaactctcatatttttagcagatatttcaagcacatatttaagatatctcaatatttaatggaactgagcacattatggattcctaatgttttattttatgtaattaattaaattaaatttatttaaatgaaaatcagccaagcaacataggctttggaattaggcaaaaataggtttgaatgtaattagtaactttgtgatacagcatgtgtttttttctctttgtagaataaggctcagtttccttgtcatatctgataatattattggaggcattatatgagaaaataaatgcttagattaatttgtcagaaacgttcccagtatttatttcctccctttatatcagccctttactgatataaaacctaaaccccatgctcaaagcaatggaggaaggtgctgccttgagaaagcttagatattttatagctttatgtataatttttttctttctgaaacacttccatatctggttgatcctcactgtcgctctgtaaagctcggtagcataagtggaattgttattatacccatttacagaaaacaaaacagaaatttatgtgatttgttcttagctgctataaatttgtggagaagcttttggctacaaaacaagttggctacttcctaaaccagagcctctattggtctcagttggcaacatagctagtatatttgaataaacagacatgaattaaaattatggcttcactatttactagttctatgactttgtattaatcagctaaactttctagtcttgttttctcctctgtaaaatggggttcattataatgcctgcctcatgatgtaattatcaggtttaaatgatagtaactgctgcatataatatagtgattaatactgctaatttcagtgattccaattcccctgagtatatattggtcagatatacttagctccgtgcttataggtgcatggaagggaaggtagctaatagttttctctatgtaattttcaaaataataaacttctttaatataatacaaccattcaagctgaaaatagaggctaggattttactttattatcatttttagaatactagtgaacatgtacattttacaagaattttgatgtgttcttgatccacaaaccctccccccaccaaattcaatggataaataacaagaactaaatcatgcataatttaaaaaatgtagatgatggttaacatttagtgtgaatatctgatactattcagttaccaattccaccactgatacatttgtgcaataaaaatgatggtaggtgtttctcacgaataggaccttattaaacttggaacaggttcattgtgacttcttccgtgaggatcagttttatgcatcttgctgctggttgtctaggtcactatcatctttttcacaagtttattccccagcacagtataaggaggctcttttgcctgtttctagtctgctgaaaggtctggaaggtttgaaacattttcaaataattacttggtcagagattatttctcttagggagcagagagatgtgcagttgtgcggggtggttgggggaagatttttacttactgacaatgagtaaaaataaggacttcctacatatgaactttgtgtagttcatgaaatattcactaccttattctgaattgactcttattcttcttatgttgccttatattgcagtaacagcagccatatgaactcttcaatgtaggatcataagacctttggtcaaaattactcttttaaagcaaatctgtatatttacacaacagttatatccatgactttggatttgggctggaagtagaatacactggataaaagctatatacttatctttaaagtgcttttatctaccttgtttgtatgcaccaaaaacctatcacaagattttcttctttcttttcttcctttcttaaacttttagtagatacctgctctgtaccaatctgttattgtctgaggtgacaaagaacaagataaggcttctgtattgaacattttttatgggttcaaaatcttttctttgtggcaaaagtagaagttgttaatgtaggttagctagatgattttatgattacattagtctcggtaatagacattatttctagatcatttataaatattatcctatacgttgggcctagattttaaattatcttaaaagcagaaatggtaattcaaaaaattgtaaagaaaacataaaaaagattctcaatggaaggtgaaaagccatcatcttaaatactgatttagaatatattgctgaaaacttgggtagccaaatgagtactactgctgttaacaaactaataatgccaattgcagatctgttaaaaagtttcaatttttcgcatcatatttggagatgaaaatttatattttattttgcatatgatttttttctttcattgccacaatctcttcaaatcagtttaaactggcatagactacataaattgctgggtgatgtttacataaattatggggattaactaattaattataataaatactattttaggttgttactgaagaagctagttgcaggttttaaatagtaagttttacaaaatactttaaaatgtcaatgcatatacctattttgaataatctaagagacactaacaccttgctagtgtctcttgttaaaacagattttatataatttaaaccttggttattataggggtttgagaatttcaggtagaaaatcatgattatctgaaaaaagttgatgcagctttaacatgtaacaaaaattatctaatagaattaaaatatttgcttacaatagcattttggtactatggatgatttagaatgtaaaacatgcagaaaattttaatttagcttcttgtggtctttatattttgaagcttaaaaattgtgatgaaaataatcatgcatatggtaatttaaaaaaaacactacacacggggatataataaatattgtcttctttcacctcatttctatgtctctgagataatcaccattgatggtttccagaaatggtagcataatatacactgttctttatcttgattgttttcttcttaacataaatcggagttctgcttttatgtgcagagattttcctcttctttttttctagttattgcatggtattctgttgttatgtggcctttttgttgatgattgttttcatttttgctgtttcttttaataatatgtccaagtgggtttgtagaatagtttgctatgagtggaataacttgtagtcaaaaagtgtttgcatttaaaactttgctggatatacaaaaaaggcatatcaatttacaaccctacctagagtgtatgagtatgtctgtttctgcctaatatcacaaggttaaattttttaaagctttgctcttggtatcttattgtttacatttactatggtaagacgttatttgtatttctatgtatgtgtgtgtgcataaacacacctgttcattcctttgcccgattttcttttgggttgttggtctatttatgggtgagtctacttattattatttgatacatacattaaagtagcacacttgtgatgtgtttcagctgttttacccagctttgtgtctttttaacctgtttatcgctttttggaatgacaatttcagttcatgatttttatgaatacacatattcttaaattttatttagtaaaatttagaaattgtttgcttaatttcctcaggaattttgtgccttgctcagaaaaacatttcccaccgtagtttattttttttaaaaaactgcctgtgctttaataccatcatattttggtattatgtttccagataaatcattgaatcatctggctttatgtgattaacaaaacctacagaatcccgttttatttttccttcgtaaggttagccaattgtcacaacgtatataaacatgaatttttacttcattgatttgaaatgtataagtttttttttttttttttaattttgaaagtctcattctgtcatccacccaggctggagtgcagtggcatgatcatggctcactgtaaccgcaaactcctgagctcaggttattcttctgcttcagcctcctgagtagctgggactacaggcacatgccactgcctggttaatttttaaaaatagtctgactgtgtggaccgggctagtctcaaactcctggcctcaagcaatccttccatcttggccttccaaagttctgggactataggtgtgagccactgcacttggcccagatttttttcttaagtaaataattcctcaaggagttacaaacaaatagggaatttacccagagtgtgaaataaagaaaattaaaactgtattacaagcaaagagatgtaaagtcatgcaaggcatttgtttcctgagcagtgttgttatcataaattgtgcttttgtgtttctggggtctcagatcaataaaagaggatgtcagattttgaacattaacggagcccagagggataaataaaggatgttattatgtttttttggcttgtgtcatagcagtaatatcacttaaatggactactcgttttgcatatttcttaacctatatcaagatttaagtaatgggttacgattatgtcttggttcttgaatatcactttgaagttaattcagtgtaacaatccatatgtgttcacaaatagaatgttaaaactaaagaccgcaatctatatgcaataaagaaaggtgaaggaactcagttactatggcttcattaactaacactgtatttagtttcatccccggtttgtcttaagaatcagttatgtgctctacctaaagccaaatatcaagctatttataacataaatttgatttaaactggaatactaaataaaattctagaaagttacttgcgtcaagatatactttcagcctgccttatggtgcatgtcataaactgtgtatttttggccaaccgtcagggaaatttataaatctttaaccactttattttgtagaactatgaacttaatgtgggcttattgataggggcaaaagatgagcaaagaccttgaagacccattggctttccatgagcattaaagtggaaagattttaactttcagtataatttaaagcaatatcttttgtttaatctgcaagactctactcatctgcttatattttaatgtatctttgatagaagaaaatttgcctttttgaaagaaataaatctacatgagcagaactgcattaaagccatttgtaaacttcatagcttcataatattcacaccaatcatttcttttccatttttgcaagtttttaaaaattcttcttttatccattacaaaacactgctgcaaatgaaatttcttttgcatatgtatttttcaccatttctgatgactgaagtataattactggattaaaggccatgaagcgtttagttaagtaaatcaatttctgatatatgctaaggaaatccaatccagactataatcccatcaatagtctatgaaaagtctagtctttcataccctgtgcatcattgttacaatttttaaaattcttacctatttgatacctaaaaatattttttgttatataaaatagtttttcatatttattattgcacacttatgtttcttctttcataaacagtttattaaagtcttttgcccaatttttattgtcattgcggtactttttcctattgaattgtatgagttgtttattcaagatgactatgacagaggaagatgggactagagagttgcacatctagcaatttaatgcttctgccgaggcaagaaccatgccacatcagcttggatgtcattgattagaactattcccatgaaatacccaacttcaaggggttggagactaatcctccttatgtccagaatagaactgtgtattggtgaatattaataatgcctataatatatgacactcctttgctaatcaaaacgtatttaattcttttccatggtttatttttttctttcaattttgtatatgactttttaaaaggtactgtttcaaagatgtgcaatttttgtttatttttggaatgtgcttccctctgatatatctgcaaatgtttaaaatttccactaacagaggaagacagaatggaaaagaacttgcctctgccaattcttctagtggttaattctatattaataacataattctgttgttaattttatattgctctattttcattataatttctaataatatacttgaaactatatttcttattttgacaattagaaagattgtctttcaacttcttactttatgaattgatgacattcgtgagtcaagattcagaacatctatattctactttgtatttatatgtaaatacatgtatatatacatgtatttttgatgtcatttactttaaaaatggaaaaatcaataagtattgtttacacatctatatatagctaggtgactattattcaatgcagagccaagtaccatgctatgattagattttccatttttatatatttttcctgtatacttgaaatttccaaatgttattatacattatgtggttttaaaatatttttaagttcttactatcgtatatctaattcatgtattctagtctttcaagagactttattcatcttccttgtgcaaactagattggcttctcttgatcctcctgaacaactgacatattgagatagcactgtccttttgtggttgaccatgtaattatttcttgacttatttcttcatatgctttaaatacattttctttattacttacaatagattatttaaaacaagttttaaaataataaatcatatacacacgcacatataagtgtgcatgcatgcatgtatatgcatgggtgtgtgtgcataatattttaatgaaatccctcattgatagctttttccatgttgggaaaaggcataaatgccttcatgatatccgtaatatttttcatcttactgagtatttctattcctcagaatacattaaatttttcttcaatatcaattatgttctaatttggagcaattaatctaggtttaaattacattttttccacaaaaatttttgaaatatcttggagtttctcatttttttgtttttcttgcactgtgaactttatcttacattttatttatttcctttccttcctaatgtatctctttctccactttatgcctgggcagcaccccactggagttttctgtcttcctgcaatttgaaatcaatgttctctaatcttattgcactgcccgtcaactgggaccttctctttgttcttttgatttgaggcttgttgtctgaacccgtcgattttaatttcttttttcttattctgattttctctagagcacctccttaagttactttctttttttttttcttttatttttatactttacattttagggtacatgtgcacattgtgcaggttagttacatatgtatacatgtgccatgctggtgcgccgcacccactaactcgtcatctagcattaggtatatctcccaatgctatccctcccctctccccccaccccacaacagtccccagagtgtgatgttccccttcctgtgtccatgtgatctcattgttcagttcccacctatgagtgagaatatgcggtgtttggttttttgttcttgcgatagtttactgagaatgatgatttccaatttcatccatgtccctacaaaggacatgaactcatcattttttatggctgcatagtattccaaggtgtatatgtgccacattttcttaatccagttctaagaacgggtattttggtggtaaattatctgagtatttgcatgtttgcaatggttttaattctcctctcatatgtgattgaaggctttgatggatacagatttctaggatgaaaattacatttccttagaacttggaaggaatgaccgccttattttctatcatcagatgttgtttgagacgcctaattcttgttttttgtgcatttattatttgctttttggcagctttcaggattttatcattagtcctacctaaaaattcacagtgatgtatctaaatgggaacttttaaagtccatcctatttaggactcaatttgaaaacagattcccccatgaagacctgaaaaattctcagggatgaatacgtagaggacttgcctctctccatttcttttagttctttctagatatctgtttagttgattttgcccttcttgtatttagtgtaacatagacaaaaaagatcatacatcctttttttctgatattgtagctttaaacatttttactaatataatgcagttaaaatagattagatagcgttcatctgtttggctgtgtagaacatctatccacttctgagattgccttgagtggttctatctaaataatgcttaccctcatatttgctttatcccctcttcctcattgtatggctattagaaaatacagctttcatggaattttgaaaaccatagagcatcattggaagaaaagaaacatgtttctaagtgttgatgaaaacgatacaaaaagtaacactgagcattagaataagggaaagagatgagcagaacaacttaggcaatggcataaataataagtcatttggtttgtgtgttccacattaccaatcttatttcatctttgtagtcctctctcgtatttaattataagttgcttttcttttctctttacaagagtctgtaaaaccttatattcacaattttatctttgctatcttactcttttggtagagtcttgtgttggcagcatagttgaatgttttgtatctttttgatattttatcttcagcatatggttttgaattttaaatgtgaagatcatgataaccttcatatctagaatttcttctctaaaaaggcagtcaggttaaggcttcacctatgttttagcaatacactagtaatgaacagatagatattcagtggaaaaaaactattaagtaattgatataagaaacagagccctggcgatttcaggattttattgtttattgtcaactttttcttagctgttaccttgttgataatggagatgatttgttgcctcggaaaataaaagcacactgaagcaataaccatgtgaataatatgtttatggttgagagaaagtacagttcaccaagtaatattttttgatgaaattgaggcagattgattttatgctttctgatgatagaggtactgataagattacaaatctcatataaccattcagaaaagtttaccacttttcccctgaaaagaatctatagttgattttcattatttacagtagttatgttctaaaaattattctctaacactgaattagcaaatactgaaccattgctcctaggggaaattgaattaggttcctgtgagcctctcattacaacattttcatcaactgatcaatacataacattgtttatgtttacaaacatcttatttcatatatattgtttacagacatctttcttaatatattttgatccattaacactgaatacatggccaacagtactataattcaagcctgaagggagctaatctaacacacatattttctcagtaaagcacatcacagccttcttgtgctttaaaatgctagacagcaattcctatctatgcttgggaaccactttaaacagtgaaattactaacaaaaagtgcaaagatgcaaaataaaaatggaaattaaatagattcccaaaaggacacttgtttacagtatgaaagctgacacaagaaggcagagtgttgccttgtttgatctcagctggagatgtgagctgggtaacaatttttcactgctctgcaaatgtccatgaatgactgcaaaagtgctgcaagtattgattttgaggttacaaataaattttagagagtaggcaaatttgcaaataataaatccataaaaaatgaagatggtttctatttgatttgagccagtttaggcaaaacagatagctttttatttattttagaaatctgatagagtttaaaggatttcaccttgctctgaaatgtttataattacctgtgatgaaaaagcagcttggatttgaaaggatttggatctgagtctgactttaaactctgtggaagaaattgaggggaaatgaacacgcttattctccccaattcaaattcatggtggcacagctgaaggacaaagcattttcttttatttttcttttcttgtagtgaatgccccctaaaagagaaagatctaaagcactgaaggacattaaactcctttgaggtgtctaagcaacaatttttgtgaatcctgttatcataggttttttccacttttgttttgctattcttttcactgggaaagttagagtgctaacaaacataaagaaaagaaaagtgaggatgtgtgctgtatgtacctgtgcctaattggcacaatatttggctgtaagttgggatgcacataggctttacataggcttaccagaatctagttatcattttctctgcatgaaagattgtcctaagctctgaggggcagacattaagaagactagaaaggtggacgctcatggagcctatgttagaatgggtgaatgataataaacaaatagaaaaaaaagcagaaaaaaaaagattatagcttgagaaatgcactttaaaggaaatcagtagggagcatgatggaggaactagttgaagacaatatgttaggtaggctgagtgaggaaggtctgttatttaaggaggtaagacctgagctgagaccaggaagatgagaaccagctggacatatgaagagttggggaaagagcatccctggtagagggaactaaatacaaagggcctgaatgagaaaaaccttggtgtgattactctcaggaggaaggtgtctttgcaacagagagagggagcaaaagggtgggcaaaaacaaataaaccaacaaaagctagagagatcagcaggaggcaaagcacacagctcgtagtaagcagcatgagttttgatttaggtgaactgaagatccacataatctcagactgaaaggtaaacaataaggcaggaaaaagatcttaaccccctacctccttagcttcatcacagcaaatgtcagcaaaaatatgcaatgggaaaagcaaagatttccatactcacaaaatcatttcgagatgagaaaatatattcgtctgattggatttggatttttcctttctgtttggttggaagcaatttgttcagagtgaacatttctctagaaatgtcttcagcaacaaagagtttttattcttacagggatgtaaggtttgttgtgttgtggattgtcctatataaaagaggctactgatactagagttattactcagaacctttaaagtttgtctcttacttagcactgaaactattttctgaacaataatctgttggctttgacttcctacctcttcattgtgaatgatataaaaaaaatcatgtactgtctggcctcagggtcaccatttccctctttggctcctcaggctgaatcagagttgctagttgtgaggaggaatgaggccttcctgtagctatgtctttgattacatgaatagtttttactctgaaagtcagggtggagaaaaatctgaaatttaatttgctcatcttctgattgtcctaattgccttgcccagttttttcactggattaaaaaaatactacataaaaaaataatagcagattgtcatttctaaaaatttatatttttctcaattcatttatctaatggacaaaaacaggcatctacacacagtaaatgaggtgattattttcaaacataggatggtagcagacttagagagtgaaatcagagcttcgagtataccaggccctttaggaaagctgtgatcttcctataatctccaactcgattattgtttgtattttcaggtaataattaaggtggcatcatatacttcagggtttgtttctgctgccaggttcaatctttgtctatggaatgaactctaccttgcttgtggaaaaaaaatacactctgcttttcctttctctatattctagtgataatagacttggagttacatgtcattcaaaggaatagagtccaacttataaacaagtctcctgaatcttctcctatctgcttcattaagatacttatgatttctaagtgaattaagaccaggtttttttttggaaactgttaaaatctaataactttggaaaaatgaaagtttaggggaagcttccttgtactgctagaaacataagtgaaatgaaatccaactataatatatcaggacttcaaagccccaggatggatgtcatgctaagtagtaaaggcaataaattatcagtatttgggggatgctttctagaaagaaagattccaagacctctcttgataatctttatcacaaaataactcttcttgtcaaggagttttgcctatgtctgtctgaattttattctctgtaatttaaacatcctttcatttaggcaaccctctgagaaagagacaaaagtctatgcttcgtcagcatggcagaacttcgtatacttaacagcaataactcaaccatttattttctatgtaaaggaactcaacccttaggcttctcacagaacacgaatgtttcctctggtttatttttctcgtcatatacaacctcattccaatttttttctgataaaaaaaacaaactgaaacctacattgtgcaagagtaataatttctagttaattttgttgacagtagaggtttatattcaagataatgcatctcacttcatagtgaatacattccagtattacgtttagttttaaaataacttcttcatattgatgacatacattcaatatacagtttatttctttgttattcctgtgtttagttaggaattctaactctgctacttattgttgctatctgatattggacaggctagttaatttctcttggccttagttactttgtttgtgaaatttgaatcacatgatattgtctctatgaaaacatttaataacattttatatatagaaagtgctcaataaatacaagctttgattctcagtacatcttatgtctttatatgaactacatgcaactaacacatttactcacatgaaaaaatgtctgttaaattttatcctgtttttaatacacaattttaatgatataattaggttacctttggttccattttatactttcgtagtaataacactgatttcaaaaatatagactatcgactggatatcaagttcattgggattggtttgctttttacaaatttaactttggaataattcaggatttactcttataaattgcgatgagctgcatatattgtgatgtactctgtaatatcatctgttgaaataaaggggatatttcttatagttaatgtgctatcattttgtagttttgtagagattttcacttcttagagttgatttttcttcacacaaatattgagtagttactgtttttggttttcgatcttcacagcttcaagtgtcttaggaaacatactcagatacacatgtattaaatgtacttgttcatttttcattttctgtccattttcactttagatttctatattgttataaaactagtggtaaaaaatgaaggctatttccttttgcagtgatatttcatatgctttaactcattttctttcactagtagataggaacatggtacttggctatttattttatatttcctcatcaagataaagatgacagtcttgggactaaagatgaatagttgggacttctcaggcatgcttctgttacattggctgaacacattgtgctctccataattagcatgaactttacagtgtattccctgtgcctggccttgtgccagcctctgttaggaaacaaaactcagattcatcatctcccaacatattgcaaagatactaggagaacaaaaagacaaattcacaacagatttgaagatggattgctgtatgcctctgaatatgtttggtacatgaatccagaaagtgcaggatcattgtgattgatgaaactgggaaatccctgtattttgtgtaaatgtgggggtagaaaaaagaatgatggtcatgacttgtgactcttcaattggtaaggtgcccagaaatgtacctagcatgtagaaggtggtcaatgaaggatgtgagatagggtccaaggaaggttatttttgaatgtggggcacatacgtaatcacacaagaggacttgtcacattattccaggactgagacctgagccacgaaggtgagcaggtcacctggagcagtgggcatgcttggcttctggctggagggttatttcgggggaggcagtacacttcgactttttgttagctctggggagaaagctgagatcagagttatccaatgaatgtagaaatggtacagctctgacttaaagggaattccagagtttcacaccagaatgaggcacaggaagggacatgtgcaagaagtggagttcagggaggagttagtgaggcaggtgcaggcagaaggggcgtcaccatgcagacagcatcaacacttttctggaagagacgcttaaggtttaactctggattacaagacagacgcctaatctttgctcttattatcctcactgggaaatcatttgttattcttttgtcaaatataacaagtataaactctgcctaggttgtagagttctcccttaacgttttgtactctggggataactctttgacgtgtatatatatataatcatatcatatcatatatcatattttatatatatatcaaaatttatattagaatttgatatccagtcgatagtctatatttttgaagtcagtattattactaccaaagtataaaactgaatcagaggtaacctaattatataattaaaattgtatattaaaaacagataaagtttaacagacagcattttttcatatgtgagtaaatgtgtcagttgcatataattcatataaagacataagatgtactcagaatcaaagcttatatttaagtaatacattaaaaatacaaaatattaaatacaaagcttgtatttaaataattaatatattcaaaatacaaaaattaggccggtgtggtggcacacgcttgtaatcccaactactcgggagggtgaggcaggagaattgcttgaactcgggaggcggaggtttcagtgagcctatatatatatgtgtgtgtgtgtttatgtgtgtgtgtgtatatatatatacgtgtgtatatatatatacgtgtatatatatatacgtgtgtatatatatacgtgtatatatatacacgtgtatatatatacacgtgtatatatatacgtgtatatatgtatatatatgtatatatacatgtatannnnnnnnnnnnnnnnnnnnggcttgtatttataatcatctttattttttaacatttcctaaatttagacacgttgtgatggcactcgctgtaatcctcaagctacttcgggagggtgaattcagaggaattgcttaaactcgggaggctggtggtttcatggagcctatatatatatgtgtgtgtgtgtttatgtgtgtgtgtgtatatatatatacgtgtgtatatatatacgtgtatatatgtatatatatgtatatatacatgtatatatacgtatatatatacacctgtatatatatacatacgtatatatttatgccgtgtctatatacacgtgtatatatacacaagtatatatatacacatatgtgtatatacacgtatgtatatatatataccgaccatggcagagaattcctttctttcactatatatatatatatatatatatatatatatataaataaaataattctttttttatttaaaaaaatatgttttttgagacagggtcactctctgtcacccagactggagtgcagtgggatgatcttggctcactgtaactttaacctcctggaatcaagcaatcctctcaaatcagcctcctgagtagctgggcctataggcgtgcaacaccacacctgattaattttgaaaatgttttgtaaacatgaagtctatgttgcccggcctgctctggatctcctggcctcaagtgatcctcctgcctcagcctcccaaagtgctgggattaaaggcatgagccatcacgcccagctcacaaatattttcaatacctcaaatgtgctagacgcagtgctgagggataaaacacagccaccagggagtttgaaatctaagaagaaactttatgaacctccagagccacttgaaagtccctgtgtacttcataatttgaatatcttagaactttcctctgactgttcaagagtttagatacatccttcaacatcaaactcacattcttatgcactgtgaaccctttctggaacattctaatccttactaccagagtctttagaacttccaaattattttagtcacaatgtgaaattatagactcatcaaggccgagagatttactgattatttattgaatgcttttgacatacggaggaattaattccagaaagaccaggtgatttagtcaaaggtgacacagttatttatagaaagagcctggatttgtacctagaatttctgactcttaaaataatcatgtgcctggcaaagtgcctgggatacagaaagtactcactgaatgatagtagtctcgttcctcagtgggttacaatttctttaagaatggcattatgcttaacgcttccattgtgtgtcctggagaactggcctaggtctgagcccattgtagacgctaaggatgtatttactgttaattgttaatacaaatttatttcccattgtcttcatgttacagaggaactaaaaatcttgaaagagaaccaccattttagtggtaagcccaactgttgctgtgtctttcttataagtaatatttatggtttatgagtcttgcaatcaaacgatggacatatgctgggaccatttctctagtaaaagcaattatatattgtttttattttaaagaactgactatcatgatctgcaaatatttttaaagctaccattatgcaggcattccttaaattggaattagtggttatgcgttaatgggactgccaataattgtcgcattctataaatcaaaagaaaatggctcccttttttgttgatagatatttacagcccccagctttaagttgaagatacaagtataactgcttcaagattatattccttgaggaaagatattgcttcatggaaagtaagagtagaaacacaaagccctatatattaaagtttaacttgatgaaaaatcttatttaattgatagccatctaaatttaagcaaattattatatcttaggagactaatgccataggaaagagagtattgggctgttttctatcttatcattgaggcacagggaggttataattatggcatcctggtgctaaacatggagcagggtcaattttcgcaattgaagaaaagaagttataatagtcggtccttttttctcacctgggcaatgcatgcattacatgaatatccagagtttcttttcattcgttcctaaatggagtcaaatgcagattcaaagatataaatggggctacctacttttaaagttcacgagatacagatctatatagatgacaaaggtgataaatatatagaaacatataaacacataaacttcactcccaagttaaaacccacaattaaatcaagaaggcccatttgctacttggtaaaaataacaaatcaggaaaaggatatgataatcttgctatataataaaaatctttctccacatcgttttacataaaacacaatcttctcaacttattcccaaagtaaaaatcctcctccactcacatacttcatgatcccaggggacatttatggtattagcacagttactagaaagtattagagagggtgcttcccattctccagctatgcttgcttttcctcttcttgctgttgatgtttctgccctattgctctgtttttctcctttcacctttttctaggggttggggaatgtgaaagagcataaccctggaaacagaaacagaaatttaattacctaaattgcttggatttgatgcattatggagcctatcaaaaaaagcgtataccttcaagttttttatgaaaaatttcattgtcattttaaatgaaggaaggcaataataactagaggagagacaggggcagactcacatccttggaccaggagatggagaatcacagaaatgagagatgccatggaaaatgtctcagaaagtatttaaaatgctttccccacatcctattacataaatacactttaacaaatatttttctgacagggtggcttattataagagaagcagtataatactagtgtcctggaaagggcagaaaaaaataaaaaacaatgtggattcccaactggcattttattttatttttttagatgtcgttcagcccattcattaactcatctgttcacttagagaataaaagtttttcactggagtctgtacagttaaaattttcactgaggtgttatcttacttagtcctgtagtacatttttctctttattaattttacttcatttttcttggtagtgacggcttgctgatgttcactattaatgttgacagtatgaatagattgcaaaaccaatgaagatgcatatctttctaataaagaagaacaagcagagatgaatgttcttccaataacactgtcagtggcagagactactacaataaaatgtctatttttaagattatttgctgcatgtcactgcagggatggaaattcagtagaaaatttgttcattcagtcattttgagagtaatacaattagtagtaccactagggcagaagccttatagactagtctggtaattctcaaagtgttgtgttaggttgccaggcattcttgagaccctatacggggatctacaaaataacaatcattttcataatattaataatatcaagacatagtttgccttttccactttgttgcttttgcaccattagtgcaaccattgacatgaatcagctgtactgagtagtcatcttcatccctgccacacactcacaaaaaatccctcaaaacaaaacaaaacaattttgcttaagaatgtctatcataaaacagtaaaagttgtagattttattgaatctcaacccttaagtagacatatttttgtattctgcaaaaccaaatgaagggtatgcaggaagttcttaactgtcacatggaagtccacatgatcatatggaacaaaagcacttgtgtggttgtgactgcgagccgactgggccactcttctgtcataggccatccttttacttgaaggaatgactgatgaactagggttatttgtgtttggttatttgaccaacatttattttttagaagaataaagtaagtctgtcactttaagggaaacaatggacagtttttgttgccagttctaaaattcaagcttttaagttaaaaagagaattttggaaaaattgcctctgccattgtgagcttgtcattttcccaataattaaaggcttctcatatgaggtgtgtggtaatattgaggaaaataatattttgatattgtataatgaattatggcaacatttgggtcatctacctaattgtgaactaatattttctaaatgatcaatgcataatattagagaattaagtgtgactaaatgatccagtcaagcacaagatagaccagtggatttttaatggaatagagtataaaatgtttatttatatgggtttagaaattcacattatagataacccttaagacactatcatttgccaactgttagtgtggtttcaaagaataatatccacaattacctgaaaaggctaacaaaatactctctacatttaaaattgctatctagttcaagacagatttttctaatttaaatccaacaaagcaaaatatgaaaacccaactgtctttaaaaaagaaaaagagatttgcagaaataaaagcagtgttactctcctaattttggggggaccatgtagttatttttcacaaaatatgttattaatataaaattgtggtgtttattactattattattttttaaatgaactgataaatatcttaatcccccacctttttgttttttttttttgagacagggtcttgctgtgtcgcccaggctgaagtgcagtggcattatcttggctcactgcaacctctgcctactgggctcaagccatcctcccacttcatcctcccaagtagctgggatcacaggcacacaccaccacacctagctaatttttgtatttttggtagagacagggttttgccacgttgccaaggctaatctcgaattcctgagctcaagggatctacccaccttggcctcccgaagtgctgggattacagacatgaaccgctatgcctggcccctttttgttttaatgtaaaatacagtaagtgggaataagtgtaactcatgtatacaaaagctctttggggtccttaataatttttaagattgtataagtatattcttctgaaactgtttgagaactgctatcctaatctatggagatttcctactggtggggtttcaaaaatttaattgaaagcagaatagaatactagaacttaaaattttgtttgatcaattgcctctaccaaagtttattaaaattattatatttgggaaaattgcttctttatagaaatcaaaatgattaatcagttcctattgctgctcctgtttcatatcccacaaaattgatacaatgagataatttcactgggaattttaactagtgctgagacaagctcattaatgtttgttattattctgtttacccccactttcaggtagaaccaaaatttatcttatgctaatcagggaaatggcaaaataaacattagagaaaaaggttcttgtaaaagatttgtcaaatacaggtaacataaatctttttcgtcaaagagtagacttgtcagaaatattttaaaataaaagagtaaaagtacacgcacacacacatactttctttttttttttccctaatggcagtcacagggttagactaaaaatgagagacattaatgctcttttttctgtctagaaatccagaaatatgtatgtatgattatactctaaggataaaggaagttttttaattgttggggagggtgggagttatattaatctaccaatgatttgaaaacaattagataattatctggaaaaaataacataagctctctattttctgtgtgtactataagaacgtatagaagcatcgttttaaagtctaggcctaaacagaggtaatctgttaaaggatataacacaaagaacataagccataaaggaaacggttagtagatttgatgacataaaactcaaaaccaatttatgtcatagaagatagagttaacccatttaaaaaatcagattgggaaaatgtttctgcttcatgtaactgataaattgttaatatccatagtctatagtccggaaagagcccctgaaatcaaaaagaaaaaggcaaacaactcaatatgaaaatggtcaaggtcaagaaatgcaataataagaagagatacaaatatccagcaaacatgttaagaaactgtcaaattgataatattatatatattggaactatcctgtgttgagggtgtgtgaaataggcaatggactgtcacccggagttggagaggctttaacttaatcaaatgtgtgtatttaacctagacgttttacttctactaatttgttcttgggatattcacttatatggtcaaagatataagtagaggatactcactgtttttcagtggtgaaaatttgaatttaacgtacctggtcaccaatcatgaattagttaattaaatgacaaccaatcaatttggcatatttctgtagttatgaaaatatagtgcacatagttttaaaatgtttgtataaatttaaggggcacaagtgcagtattgttagatggatatattaggtagtgttgaagtctgggcttttagtgtaaccatcacctgaatagtgtacattgtacctaataggtaatttctcatccctaccaccttctctccctcttacccagtctccccgtctatcattccacactctatggccatgttgttcagttcccacttataaataaggtcatgtagtatttgactttctgtttctgagttgtttcacttaaaataatggcctgcaggtccatccatgttgctgcaaaacacgatttcattctttttatggctgaatacacacacacacacaccatattgtcttcatccaatcatccactgatggacatttacgtttatttcatatctttgcttttgtgaacagtgatgcgataaaaatacgagggcaggtatctttttaatataataatttattttcctttgggtatatgcccagtagtgggattgctggataaaatcctagttctatttttagttatttgagaaatctccatactgttttccataggggttttactagtttatattcttaccaacagtgtataagcattcccttttctctgcgtcctcaccaacatctgttgttttttgtctttttaataatagccattctgactggtgtaagatgatatctcatgggacttaattaaactaaaaagcttctacacagcaaaagaaatgatcaacaaagtgaacagacaacctgcagaatgggagaaaatatttgcaaactatgcatccagcaggggtgtgatatcttgaatttacaagggactcaaacaactcaacaaccgtaacaaaaaccaaataaacaaccataacataaaaaccaaataaccctataaaaagtggacaaaggatatgaatagtcttttttcaaaagaatacatacaaatggccaacaagcatatgaaaaaatgcttaacattgctaagcatcagataaatgcaaaataaaacgtcaatgagatatcattcgtacatgtagttttatatacagtgacacagaaaaattttatcatgttaagtataaaaattcttgattcttttaaataaaagtactgtgtatatgtgtgtgtaatacatatctataggtaccaataaaatgtcttcagaagatacagcaaactattgagagctgctttacatcaaattgtaatattatatattacatatatatgttatatattatatataatatataacatatattacatatatatgttatatataatatataatatataatatatatatataatatataaattatatattacatatatatgttatatattacatatattatatataatattatatattacatatatatgtttgttatacagttatgagaggtttccactctcactgttttatgtgttttctttattttttaacaataagcatgtattcatggtaaacataattagattccaatcttatccttaccacacacataacttgaataagctcattaaatattaattgaagtgtatttttctagtgaaattaaaataatgcaacagctcaaaacaacttaaatcatgatcttagatagaaataaattctgaaattatgatcacacagaaccatttgtgttctagggagcaactggaacacaaatgccaactctttcctccttttaagagaattaatttcttattgaggaactggccactgcatctagtccacacttccacattctccctatagtatgatacttaattaatctgtaactgaaactagggaaattacaaaaactttttttctgccatcctgacttgatatctagaaagcaggtgacatctggatatctagaaggacttggtatctagaaggatgaactctaagatgtgtagaaagcgacatgattttgtaatggggagagccaaatttggattctgctttgttaattgcttgatttatttgcagtaccatcatctgtaaaataggattaaattacaggtcattgtgagtgttgaggtatttggaaagcattattttttgtagtagagtttttaaaataaaaaaccttatcattctagcctgagtaggaagcattaaaaagctaatcaaagttggaagaaatcagttatgctttcaaaataacccaagtgaaaccatgacaagaaattgtcagataaaaacaagtgtcaggtaaatgccagataaacacagaggttaactttcctagtgtcaccttcgagaaagctgggatggaatctatcacttttttatcccaagccctgtgactttttactgtgctgtgccactttcagatatatcatgtggttttttctttccaatatttaatcgccctctgaggttgtgatttgttcatgggatttattttgctctttcacaccattgaagggagattttatctttgttgctttggagcctgaaaaagtgaatgtgtcttaaaaatacaggtctaactgcttacaaagatcaatgagcctttgactactttctctaaatattattcataatagatgattgcattgtcttctcaactgaaatgcaagaaataacaatttaacgaaaaatttctgaaaatctgcaggattgatttcaaaagtatcattcatcacgacacttcagcttcacttgtgagaccagtatataattttcttttgatcttttaatctatttatgaagataatttactttattaaaagaatttttatggcaaccaactaaattttctactagaaataattttatccagcacaattgaagactatgaaaacccaaatgttatagaatcttgctaactaagcctcagtattactgattcttttaaaaaatgttagagttcctgttgcgggaagtcagggaccctgaatggagggacccactgaagccatggcagaagaacataaattgtgaagatttcatggacatttattaattcaccaaattaatacttttataatttcttacacctgtctttactgcaatctttaaatgaaaattgtgaagatttcatggacatttatcacttccccagtcactattcttgtaatttcctatgcctgtctttactttaatctcttaatcccgtcatcttcctaagctgaggatgtatgtcacctcaggaccctgtgatgattgcgttaactacacaaattgtttaaacagtatgaaatctgggcaccttgacaaaagaacaggataacagcaatgttcagggaacaagggagataactattaggtctggctgcctgagagccgggtggaacagagccatatttctcctctttcaaaagcaaataggagaaatattactgaattctttttctcagcaagaaacatccctgagaaagagaatgcattcctagggggaggtctctaaaacggccactctggggacgtctgtctttttacagttgaagataagggatgaaataagccccagtctcctgtagcgctcccaggcctattaggacaaggaaattcccacctaataaattttggtcagaccggttgtctgctctcaaatcctgtctcctgataagatatatcaatgacaatgtatgcccgaaacttcattagcaattttaattttgcccttgtcctgtcatctcgccctgcctccatttgccttgtgatattttattactttgtgaagcatgtgatctctgtgacccacaccctatttgtacactccctccccttttgaaaatcactaataaaaacttgctggttttgcggcttctggggcatcacagaacctgccaacatgtgatgtctccccgaacacccagctttaaaatttctcccttttctactctttccctttatttctcagagcagccgacacttagggaaaatagaaaaggacccacgttgaattatcgggggcgggttcccccgataagttccaatggttataaggcagaaagaaacagaaaaaaattgtagaagataaaggaaggggacacccagttgtggtggctcatgcctataatctcagcactttgggaggccaagacaggacaggatgattgcttgagtccaggagttcgagaccagcctgggtaatatggcaagaaaccatctctacaaaaatataaaaaataaaacatacgtagatgtggtggtgtgcacctgtggtcccacctactaaggaggctgaaatgagaggactgcttgagcccaggaggttgagactgcagtatgccatgcttgagccactgcactccagcctgggaaacacagtgagaccctgtctgaaaaatataaataaataaagtgaagaggaagagaaaatgtctttggcctaccttcactagaatttataaattatggagcttcaaaatatgctccagcatactgggattggggagacgtctgctattgtagtgaagctcccttgaacaaatcattttgcttgtttgcatgttactttctttagctatgaaagtagttaaagctttcctacagctctgtcatgctatccaggcaattcaagctcccttactgctctgtaatcctgtagagagtttatttcacaggccattttatgttcacagatgatatgaactttagggtacattcatcctgtgtcctggaagaagaacaaaatgcaaataatttaaaagaggagcaagaacattatatgattctgttttctgttctctttactttcgttctatataatcctccttcctgtccattttgtttactaccaagtcttccactgctgttcctatttgaaagtactgaatatagattacaaactctaacttgtcctccacacttgcatttccaattgtcacttagacttgattagaatttaatgtaatttttaaaattccttataactcactgccaggtaacaccattacatctgtactttcttttatgatacttaactagattagaattgtatttgattacacatattttttatgcctcctccttgctcatacattcttcttttttacttgcacaattctgtcagttcaatctccaaattagaattcttctcattcctactcctactgttgtggtcacaagtctatgtcataacagagttcattgtccttttttcttgtaaagacaattccttatgatttgttctacacattttatttatttttctaacatacatatttgatcatgttctactccttttgaaagtgatctgtgactttccattgcagagaagctatatataatagtttagacttgtccaggactttacttcctggccttgtcattcattctctctctcccagacattctgtattttattcatatcagattatgtaccatttcttgaattcatactgttaattacaataaaaatagaccccatataactgtggcttaatcaatataaagctgtaattctgtgtcacatagcaacctagatatagatggtcaagggcttacatgatagatattttatgctattatttaggaacccagattctgccatctgaagcactttgtccctttcagcatgatcaatggtgacttagcaccaagtccccaatcctagcaccatgaacgaggaagtgaagaaaaaggtcactccccctgcctttaaaacatatcctggaatttccatatatcactttctctcacatgtcattggctacaatttagtaacctggccacatctagatgcataaaacgctagaatatgtcatctttacaaaaatcaaatatatgcccagtttcaattgctatcactttggaaaaaaagggaaaactagatattgagggataacaggagcccttgtcacattcatgatgttgttattgtgattgttggtggtctcctcctctttttcctccttcatttcctccccctcctcctctttcttccttctttttcttcccttcttctccctttctctctttctcctctacctcacctcattcctgctccttttcttcttagctccctcacttaccattttctctattgatttggcctttcatttagctctgccttattgttaaaattcttattcattgttgagggcaaagtcaaaataataccttctaagacttttcaagatattacatgtattagtccattctcatgctgctctaaaggcatgcctgagactgggtatttataaagggaagaggtttaatggattcatagttccatatggctggggaggcctcacaatcgtggcaaaggtgaaggacgagcaaaggcacatcttacatggcggcaggcaatagagcttgtgcaggggaacttctaaataaagttgacacataattttatatatcaacatttaacatatattttttaaatctttgtattcagaatatgagtatgctctaaatcttatttattttacctttgcattcaaaatgtgggtatgcactaaatgttattcctattttggtctctataatatttgtctacattgccttgtgtatattaaaatttgaaaaggatatatttggcatctaatatgttttgagtactattttttaagtgttattttatcctatcagcaaacaacaccaatcaaacaaattaaaaataaccagactcagaaattaagtaacttgactaaacttatttagctaagaaattgcagagaaataatctaattcactgaatgacaaacttgtcacataagccagtttgctgaaagacaatatgtggaaattagattagctaaattattaaggattaaaaaatacttcctccaccttcgtgatgtttcttttgctttgtatttgttagttcagctcagttgcttattatctttgggtatttacattgttctggtgtttagtattttttttgaaaatatgtgtcttttctgtcaaagcagtgtataatattgtctcttttgccctcctataccctactcttcctgccagcttcctgattttgccttcaaatcagttcctgcatcagtctgtggaagacctaggattttataggagttcaaaaattattttgttctttccattataccatgcgctttactggttatatgctcaaaagttttgatgaattgaaacccctgctaccctcttgctgggaaatataacgtcctctttatccatattagataatggtcctttaagaacttgttaattttttaatgaccaaaattgtctttaactttttaatgaccaaaattgtcttctatattttggtcctattttggtggccagtataagtatcaaaattgcatgattgaaactgtttcattagggaacttcacttgtaatcttcataaataaggagacttaataagcttattatctaaattttcatatggaagtttggtgaacacacctaactttgcattttggggagtcaagcattaggctactctttatcatcccttgatctctttctgcatccctgtccttcccaaataatggtaacttttttttgctggatgggctctaacttcaaactcaagtccatagaagttattgggccaatcttaataacgaaaaatcaggaagaagattgttactttccaccaaaccagttatgaactcccaacaaattgtcctggcaatcacctcttagacttagagggcatcaggaatgaattttgagtgcccatatggcttctgagctatagtctagctttcctctaagccttgcccccaatttcaacccagtttacatgcctagaatctattctgaccactatttaattgattaccttttgtgttgcatccaaacaaatctcttggtatatatttatctttcattaacagagacacagtgtactcctttttagctcaatttccctctctctctctctcattaacccctaaagaaaggggcagaataagagcaaagtaccgaagtcaccataaaaacttcttagggaaaccactttgcttctattttccatgtatattaatacctccaaaatgatttattactgatcaaagttgtatacggtaggacaagaaaaagcaacacaaaaccgagtccccagttacaaccaagttatacttttataaaaagacacagtgtgtaaactgttaattatttagcccagagtagttaacacatgcttactaaaaatatgacttttctggttgacatttaaatttgtcaaggtaagctacgaatagcaggatttctgcaaactaggccacaatcttacatggttatttcctttgagtggagaagccgaaaatatattaagctcttcaatttaaagtggttgatattatacccttgttttttccaaggcattctctttccttcttttttattcctgttttcttttctcattccctggtgaatactcaaagcaataagcagacactaatagattactctgagatgactgttttatatttgccttcctgaaattataaatattaatactgttttaaataaaaataacttttggttgtattcatttgaagagttttttttttctgtagtggctcaggattttaaaagtggttcgaaaacagtataccaaaaaatccacctaaacattcttgttgctgtttaaggaacgcagagctcatgtattataattctattctattttattggaattaattcagaaaatatggtcgaccaggtgggatcaaagggttttgctacttctgaagattttagcatataaatgcaccacaacagatggttaaaggatcgtttacaggtgtgacagcttctgtaccccgttgccctaaatcaatttaatagtgtgttgagttggctgccttggcagacatttagctgtttaaaaaatatctacacagtatatagtcaatgagaatcttattataattgcaatgaattcaatagttttgtccaatgaggagtcaggaagatgaagttctcttccccaagggagagtcaagatcatagatgctgatctttctggtggcgatttacactcaaaaatccttgaattattacaattaactttatttttcttttctactatttctctgtctttacctttcctcatttttgaactttactcttagttataaaaaatttaaatattatcttttttagtggtaaaatatattaataaaggaagatagaggaatctaaatggtcccaaatgaaaatatgtgaataaagtaccataaattccacaaccacttctgcagatgtatcatgtgttaaactttgaaactgcatgcaggtttataagttcaccacattgattgggtaatgtattggctttctattgctgccataacaaattactacaaaccgtgatttataacaatacaaatctattattttacagttctggaggttagaagtgtgaaattagtctcagtgggctaaaattgaggtgtcagcagggctgcttttcttcctggagtctctaggggataattcatttccttgccttgtccaacttctaggggtcacttgcatgccttggctcatggcctccttccatctccaaatcctgcaatggaaggcctggtctttcttgcattgtgtctctctagtactctccttcttttgaattcctctttcacttacaagaacccttacaattacagtggggccatctgattaacccaggataattgccccatctcaaactcagctcattagtagctttaattctaactgcaatcttaatttcatttgacatataacctagcatattcacaggttttgggaattaggacatgggggaccatttattctacccaccacagatgattgtaacataataaaagaaaaggaaataagaagatggaaaagtaaaaaaggacaatcaggaaagcaggttgctagtcccatctctgcagctagctagcaaggtgaactcagaagagctattcactttctctgcctcacagttaatcattttaataaataaataataacaactaacattctctgggagcctttagccatttgttcataaatacacacacgctctctctctctcacccacacacacatgtactataatcttatttaatcctcaaaatcctctacttctcagataattaaactgagacacagagagtttttgcaacatttcctgatcagtcagcagtaaataaaagaggcataatttaaaccatgaagtgttgtctaaaagcccagcatcttttattattaggttatactgcccttgttaagataggatattaataatgtatcttttcatttatctattaattagtaatatctatcaataaatattaattgggcacctgctgtaaaccagtaactctggtgagcattggaaatgcgatggtgaacaagcaaaacatagtttctatctctgtgagttgaaacacagacaagatggaatataaacatttgttcctgtagtctactcttacataacaaaccagcccaaaacttaatagcttaaaacaattatttaattacctcgcatgaatctgtaggtttacaggtatcagctgggcagttttgccatgtgtaaattcagctgggcttcaggttgcaggctgtaagctggaagcttgccatgtgacctgggtttcgaattgcatgatgactgcattctaaggagtgtcccagggatgaacaaatgttctaagacagaaaacacatgctgccagtctttttaaagactaggccaggggcttaggtaaggtcatttctgctgcattctattggctaagcctccttagagtgagttcatatgcaagaggagaagaaatatatttcaatcttaatagagctgtgaccaagaagctgtagccaactttattctgccacagccggaatacggaaagcagatgggagacctttatgagatgaagctgggagaggaaatcagtggctaaatctagcaaggcctcatagcaattttagaatctaaaatgacaacaatagaaagactttgggtagttttaagcagcatatttaagcatagttcagaaataatttatagataagatcactttggagaaaagagtgaaatcccaggatagaaacaatggtgacttagactagaaaggtaggtagggatgaagggaagtcatatgtgaatattgttcagaaggcatatttgagaagccatggtgactgctgcatgtagaaggtgaggtagcagaaagcaaggatcttccttctgtcttgataagttagagagttatttattgaattaattctcaatggaagagaggaaggaaggtctgaagggaaaatggtgagttccgttttagagctatttattgaacttaagaggctcataaaacatccaataaaagttgtctagaaggcaatcaaatgtatggtctgggattcaggagtaagatctgggttggagatggagaactgcattgcataactgaaactatgattgcggatgagagtacctaaagtgaaaatgtggtttagaaagaatagtatgcttaggacagaattctgaggaaaccaacagctgatggtcaacagagtaggtgaaaatcaaaggtaactgagaaagagcatccaggaaagtaggaaaacaatgcttaaagagtgtggtgtcgtggaaggcaagaaaaagcggtttccagtaggttatgaggatctctgtggaatgctgctgagaggtcagtttgttagctagagaaacaaaagtcctcggagaccttggcagatgaatttggtagagtgaatttggtaggcctgttgcagtgagctaatgaatgatggaaagtgagcaaatggggatcaggtgtgggccatggacttatctggagatgtttggctgcagagaggagagaaggagtagagaatgaggtgttcagcaaggttgttctatcttttgagagactcgaacaagagaaggaatcagttaaaaaataaaggaaatggccagttgcagtggctcatgcctgtaatcccagaactttgaagttggcggattgcttgaggccaggagttcgagatgagtctgggcagcagagtgagactctgtctctacaaaaatatttaacaattagctgagtgtggtggtgtgtgcctgtaggttcagctactcgagtaggctcagctatttgagagacgtaggcagaaggatcacttgagcccaggatttcgaggttacagtgagctgtgattgtgtcactgcactcaaacctgagcaatttaaaaaaagaaaaaaaggaagaaaggaaattttgagaatctaggaaaaaaaggatgctagctttgtgttaaaaaaaaatgttgggctgggcacggtggctcatgccagtaatcccagcactttgggaggctgaggcaggcggatcatgaggtcaggagtttgagaccagcctggccaatatggtgaaacctcgtctctactaaatatacaaaaattaaccaggcgtagtggtgcatgcctgtagtcccagctactcaggaggctgaggttacagtgagctgagatcacaccactgcactccagcctgggtgacagagtgagactccatctcaaaaaaaaaaaaaaaaaaaaaagttaaaaaactttgaatctttaatgtgggagggatatgaaaagcaaaattgctaaacactgtaaggagtttctgctaacatttttgttattaaagacctatcatcctgctgctgttattgacaattttctagttaacattaaacattttgcctgtatgttaaaatttaaaaatatgaccatgtctgtgacgtggcatgtatgtgagtggttagtttattgttgttgtttgtttgttttttcttggaacttttgaattaagaaatggcatagtttatttgtccttgggaattttttgcactgtcacttgtaagaatagagactatggaatcagaaatttttaacattaggagcagtttttttgaattcttcttgacatggctgagtaacaagtttctggatttctttgaaattttaggactgaaattgaaacaatctcaactcttgaattttttatgtaatgcatttaaaggaactctttgtatgaaaagttgaagtgttgaaaggagagatgatcaaagtttataaggtttggaagataataaacaagaacttatccaacaaattttataatgctataattagaggacacacactgaatgacaagaaagagagatttagggcaatcaaatgaaatgttcctttaaatagtcgattttaaatttatgaaatattaactaaagaggtggggcatagaaaaatacaaacagatccaaggggattcataaacgagacaggtctttaatagtatttgagttattcaaggttatactgaatgtttggaaaatgacttcatttgttttcataaaattgtcttacatgacacagataacaagttacatatgcccaagggaatcttggtgtttctagtatgggactggtgctttatgttttcatgttctagaagttaatagtatcaaatattattgaaataagtaagctcactgtctaaattagaatattagttctgtggcttacctaaatgtgtgtccttgagcaaattatttaattttgtcgtctcagttttcttatagtgaaaaataatagtacatacctcaaaatattttaatgaaaaatatgtgtattaacatacataaagaatttgtctttattgttgctgttataccaagatactgtattattagttctgttgcaatgacattttaaatatttaaagcagtttcaaactgagctgcatacttgtatataaataactaaggaaaggtagtatactccaaaaaattccttttctaaaaatataatttatttgtattggtttcttaatctagtagatcctacttattatttatttaatttaattttattccatctgagtaaattattcaactttaaattcagggaatgctttttttcttaggatataagttatcttttcttgatgatgatttatgaaaaaatagaaagaatttaaaaaccaagaaaggaaggaaattgtctggaagtcacataaatagaccttttctctttttgaatttagcaaatggtatgggcatgggttggagagaattagaaaagtaaaagtgttccatgtgaaacccacctaccatgtacatgcataaacacacatgcatacatagaaattatgtgttatgtatacttacacacacatacaagtacacacatataatataggctatagcttagtgcagatagtggtagtatgggaggttcaattgggacagttgttttttatactctcctcacccctcctttaattaataactctcatgctatttgatgccacatggaaaagaagatgaaaaaaattgtggaagacatggaaaatcatttttagaaccaagaaaggtcaaaattaggtgtccttcttggaggaaagagaaagatgaaacccgaaaacactggaatgacctacctatggtctaggtagatagaaattatcatagttgttaataaagtcctgtgttttcttgctccccaaaacggttctgagaaataatcatttaatttgagtgttagagcttaataaaactaagaaattgtctagtaacatttgctcattttataaattagtaaacgtacctctgaaagcttaggtaggtaacttggccaagatctcaaagggaactaagagatgaagtaatagcagagttctagactcttgactggcctgaactgttcatcatcatcaccactgcagcttcctaagaggcatgacatgagctttcaactgatatcttttcttttcttaatagtagattatacaagcctaggtgtttcatcatttaacaaatatattatcctttagatgttaaatcaagaattatttgaaatttcatttttggaagacagttatggactccttaactattttgaaatataaatttaaatgtgtctgttaaattttacttattttaaaatgatttttattcggtatctacagcctttatctgtttaggtatcttttttactaagacagagactgaatgatatacttttgagctttcttttatgctcatatataagtaccttgaaaagtgggcccatcagtctttttataaataaactcggatttttctatctttaataattcataactgccttctattaatatctgactttttccattaaaagtgacttcttaagaggctctatttaaagtgattttgagaagattccctttgtaagtataaactgttttcataattaattcaaatgatgctcctcaaatttgtataacttttaatttcatatgtgatattcagttttttgaatgagggttggagctttatgtggcagaggagacttcaagtgcttccattcttccactgccttgtgcctttccagaaagttggtgtgtgttccgtgtaatgacacctggaagtcctggcactctaaaaggcagtaggccattcacttcaaggtattggctcatgctgagagcataccacctggcagcctccacagcttgtgctttcaggtttccttttggcagagaactcaaagtgttcaatttgtggtagaaattgttgaatagttaaaatgtgtcagaggttgagtcgtattttccttgattattaaaataacttaaatatcaccaaacaaattatatttatgagcaaacagctcattattttattcacatatttaagactttaaatcttttctgaccactattctagaccattttctgtgctcccagttgatggaaaagtgaaatatacagtctttaactccaactcatactctggctggaaaaaacacacaagcgaactgattgtaagactatgacaccttgtgtgcacccttatggtgaaggattacacaaagtattacggcagtgctgggaacattgggcccagattggatgtcaggaagacgttcagaagagaagcgaagcattgaggttaatcttggagagggaggaggaggccgtctgtagtgtagtgagaagttgaatgtgtggggaatagaaagactctcaattcagttgctgggttaaaaaaatattgtacattattggaactacaatttgtttttttttttgcattgtacatttttaatgagctgtttatttctatgagtttgtttaaatctttcaatattaagcaaagttcagaaaaggaaatatttgattcatttggatgataactaaccatattagaatatagattattactggttcatactagtagcgtattaagagaagaaaaaactcatgcacaattaaagcactttttctgtttttttactcaacaacaatcaactcggaagtcttctatgaccctatatatgtggggtttccctacacaccaagcaagtagtaatttctgtagcagacaccaggtaggtgtcctccaatttaattctgacacagtctaccctgagatagcatcagatcccagtggttgaaggctcagtccccaagaatgttcccctccctgctgctgccttcagatgctaaccacaagccacaggttgttttagctgtgctttggaggctataaatcagggttcccatgatactctttttgggtttgattaatttgcttaagcaggtcacagaactcagggaaacacttacatttacaggtttattataaaggatattacacaagataaatatgaagagacacatagggtgaggtatgggaggctgctccaccctccagaaacctccacatattccactatctagaagttctccaaactctgtccttttgaatttttatggaggattcatcacattggcatgattggttaaaccactggtcattggtgatcgacttagtcttcagcctctctgccctccctggaggttgtgggtggagttaaaagcaacaaccctctacaggccttgttttttcaggcaattagcctctgtcctgaagctaccttgggttgccagctatctgtcaactcatttgcctatagaaagacatcactttgaagtttctaaggatttttaggagttgtttgtcaagaaacagggttgaagaccaaatgtatatttcacagtatcgtactttctgtgctttattcctgcaaagaatgccttttagaactggaaaaaaggactttcggaaaatgtattttttctacatttttctgcaaagtaaacacgcatagattaagaaaaattcaataaactctgataacattgtagatcaaccagctgtgagttgtttgttttttaaaatagctttttgttattttcaatatatttagattatcttggatttcaaagcaaccctatgaagtaggtaatgttatttgcaaataaggaatcagcatggtaaagggaaggcaaatgactgaccacaatcaaatagcaggacttctcgtttccagactggtctgtaaggaccttagaatttgccactccattaaactaagtaaaaatctgaacagacaaaaatcaacaccttttcttgatctaacacagatgcgaagtcacagggcaatttgccacccctaaaactggagagacacacaggcagatacatcagagaatcccaaccaactggagcagaaactcctaaggagaaacctccacaggaagaagtaggaaaacctggactgtaattgaaaaattgttgcaggctcagtgtggataaatctttgagttaaaaactccagggagacccagtcattgctcactcccttcatcactttaatgtgtttcaccttctagagttctaccagattctcacagtgaatatcagagaaaaatcctcttgtgcttctggcagggagaggggaaaatggctatttaaaaatacgccagagcattctgttcatcttaaccaaagcctgcccttaagagaaactacttcaccaaagcctgatcttttgggggtttctcagagcccagctgacctagagaaggggaaatactcaacactggcctctgccaaacattctgtctcatttaagatcagggaaaataatggaaaggcacatgtgaagttcatggctaatgggaacaggctcactaaaagatggagatctaagcatagggttatagaacactttccttttccccacatcttaccaccatatcacagaaagtctgtagtaaacccatcatatccaagggttccacatccatggattcaaccaactacagatcaaaaaccttttgacaaataaaaaagagagaaaccaacaatacaacaataaaaatgatacaaataaaaatatactataagaaatatttacatagcatttttattatattagttattataagtaacctagagattatttaaagtatataggaggatgtgtacagattatttgcaaatgttacaccattttatataatgcactagagcatccacatattttggtatctccttggggtcctggagtcaactccctgcaggcaccaatggagaactatatttacggtggttccttttacccagtacatcatgtccagaaaaatacgagggatactaaaggcagaaaacagctgaaacagacagaacaagcatcagaaccagagtcagatatggaaagaatgttggaattattggatgatgaatttaaaacatcaatgattaatatgctaagggcttcaatggcaaaagtaaacagtatgcagttatagatgtataacgtaagcatagatagaaattctaagaaagaataaaaaagaaatactagaggtcaaaaacactgtaagagaaataaagaataccttgaaaggcttgttaatagactggaatgactgaggaaagaatatctgaacttaaggttatgtcaacagacactttcaaaactaaaaaacagagagaaaaaaagattggaaaagtaaaacagaatagccaagaactatgggacaactacaaacagtgtaacatacatacacataatgggaatatcacaaggaaaataaagaaaagaacagaactaataatgactgagaatttcaacagttagtgtcagacattagactacacatccagatatctcaaagaacaccacacaaaataaatgccataaaaccccatacctatctacatatttaaactgcagataatcagagataagtaaaagatatgtaaataaacatacatgggaaaaatatctcacctatagaagagtaaataaaagaattatatctgacttaccctcagaaaccatgtaaacaagaggagagtggagtaaaatagttgaagtgttgagagaaacaaaaccactagtgtagatttatgtattctgccaaattatcatttagtagtgaagaggaaatacatattttcccagacaaacaaaacctgagggaattttttgccggtagacctaccttgcaagaaatgctaaagaagttcctcatcaagaaagaaaattatataggtcagatatgcagatttacataaagaaaggaattccattgcagaaggaataatgaagataaataaaatattttattttttttccaatttggataccttttatttcttttttctttttttttaattattatactttaagttttagggtacatgtgcacaatgtgcaggtttgttacatatgtatacatgtgccacgttggtgtgctgcacccattaacttgtcatttagcattaggtgtatctcctaatgctatccatcccccctccccccaccccacaacaggtcccggtgtgtgatgttccccttcctggttccatgtgttctcattgttcaattcccacctatgagtgagaacatgcggtgtttggctttttgtccttgcgatagtttgctgagaatggtggtttccagcttcatccatgtccctacaaaggacatgaactcatcattttttaaggctgcatagtattccacggtttatatgtgccacattttcttaatccagtctatcattgttggacatttgggttggttccaagtctttgctattgtgaatagtgctgcaataaacatacgtatgcatgtgtctttatagcagcatgatttataatcctttgggtatatacccagtaatgggatggctgggtcaaatggtatttctagttctagatccctgaggaatggccacatcgacttccacaatggttgaactagtttacagtcccaccaacagtgtaaaagtgttcctatttctccacatcctctccagcgcctgttgtttcctgactttttaatgattgccattctaactggtgtgagatggtatctcattgtggttttgatttgcatttctctgatggccagtgatgatgagcattttttcatgtgttttttgcctgcataaatgtcttcttttgagaagtgtctgttcatatccttcgcccactttttgatgagtttgtttgtttttttcttgtaaatttgtttgagttcattgtagattctggatattagccctttgtcagatgagtaggttgcaaaaattttctcccattctgtaggctgcctgttcaccgtgatggtggtttcttttgctgtgagaagctctttagtttaattagatcccatttgtcaattttggcttttgttgccattgcttttggtgttttagtcatgaagtccttgcccatgcctatgacctgaatggtattgcctaggttttcttctagagtttttacggttttaggtctaacatgtaagtctttaatccatcttgaattaatttttgtataaggtgtaaggaagggatccagtttcagctttttacatatggctagtcagttttcccagcaccatttattacatagggaatccgttccccatttcttgtttttgtcaggcttgtcaaagatcagatagttgtagatatgtggcattatttctgagggctttgttctgttccattcgtctatatctctcttttggtaccagtaccatgctgtttttgttactgtagccttgtagtatagtttgaagtcaggtagcgtgatgcctccagcttttttcttttggcttaggattgacttggcgatgtgggctcttttttggttccatatgaactttaaagtagttttttcctgtgaagaaagtcattgttagtttgatggggatggcattgaatctattaattaccttgggcagtatggccattttcactacattgattcttccaacccatgagcatggaatgttcttccatttgtttgtatcctcttttatttcattgagcagtggtttgtagttctccttgaagaggtccttcacgtcccttgtaaattggattcctaggtattttattctctttgaagcaattgtaaatgggagttcactcatgatttggctctctgtttgtctgttattggtgtataagaatgcttgtgattccacaatggaattaaagtaaaaaccaataacagaaagatagctggaaaatccccaaatagttgtatattaaacaacacacttctaaataatacatgggtcaaagaagaaatctcaacataaattttaaaatattttgaaaatgaaaatgcaactaatcaaaatttctggatgcagcaaaagaagtgcttggagggaaatttataacattgaatacacatgttagaaaagaagaaaaaagtaaaatcaatactccaaatttctactttaggaaactggataatgaagagcaaataaaactgatgtaagcaggagaaaataataataaaaaatggagcagaaagaaatgaaattgaaaacagaaaatcaagagtgagaaaatcaatgaaaccaaaaggtgtttttttaattttttaaagatcagtaatatcaatcagcttctagacaggttaactgagaaaaaaagatagatgatacaaaatgctaatataaaaaatgaaagaggcactaccactacagatctcatggagatgaaaaagattaaaaatagagtcatacaatgaataactctgcatccacgaatttgacatactatattaaatggaattataatgtaaattccaatgtaaattccttggaaaatacaatttgcctaaagtcacaaataaagaaatagacaattgaataaacctatgtctattaaagaaattaagtcaataattaataattttctgaaaaagaaagcaccaggcccagataagtttactggtgaattctaccaaatatttaaggaagatatgccaatttacaatagaagccaagggagtatttttcaggtctttttataagcaacattaccctattactaaaagcaaaaagacattatacaaaccagaaaactacagatcaatatctctcatgaacatagacacaaaaataattaacaaaatattagcaaatgaaacccaataatgtataaaaataattacacaccacagctgtgagatttgtttcaagtggcaaggatagttcagcattcaaaaatcaattaatgtaatctatcacatcaacaaactaaaaaagaaagatcgcataatcatatcatatgcagaaaaagcatttgacaaaattcagcattcattcatgataatgattatcagcaaattcaagttaggagaaacatcctcagtggataaagaatgtctacaaaacatctgtagctaatgccatacttattgtgagaaactagaagctttattgctaagatcaggaacaaagcaaggatgttctctttcaccacttcttttcaacataatagtggaattcttagctaatgtaataatacaagaaatggaaattaagttatacagattgggaaggaagaaataaaactatctttgtttgcagataattgtctgtgtagaaaatctgtatgacctgacaaaataaactcctggaactaataaataattatggcaaggttgcaggattcaaggtgaatatacaaaagtcagttgcttttctatacaacaacattgaaccagaagaatttgcaattaaaaatacaaccccccacgaaatgaaatactaaggtatgaatataataaaatatgtatgctatatatatatgtatatatgtatatatatatgtatatatgtatatatatgtatatatgtatatatatgtatatatgtatatatatatgtatatatgtatatatatgtatatatatatgtgaggaaaagtacaaagcactgataaaagaaatcaaagaactaaataaatgggaagatattccatattcatggatagaaagactcaatgttgtcaagatgtcagttcatcccaacttgatttatagattcaatgcaacctcaatcagaacctcagccagttattgtgtaggtattaacaaacttattttaaagtttatgtggagagaaaagaatacctagaattgccaacacaatattaaagaagatgaacaaagtcagaggactcataccaactgactttaagactaccttactacaaagttacagtaatcaagacagagtgatattggtaaaacagtagacaaatagattattggaacagaatagagagcccagcaatagactcatataagtatagtcaactgattatgacaaagaaacaaagacaatacaatgggcaaaggtagtctttttaatacatggtgcaggaacaacggaatattcaaaaacaaaaaaagaacctgtgacacatatcttatgccttttatacaaattaactcaaaagggagcataggactaaatgtaaagcacaaaactataaattcctagacagtaacatattagaaaatctacatggttttgggcatgttgattacttttaggatagaacaccaaaggcacagtctatgaaagaaatacttactgagctggatttcattaaaattatcttctgctctgtgagatgcagtcaggagaatgagaggacaaaccacagaatttgagaaaatatttttataaaagacatatctaataaaggcttttatctaaaatatgcaaagaactcataaaactcaacaataaggaaatgaataacctgaataaaaaaaaatagacaaaagacttgaacacacatctcattgaagaagatatactgaagatatactgcaaataagcatataaaaagactttccacatcatatttccacaataagataccactacatgcttattaggatgtctaatatccagaacactgacaacaccaaatgctggtgaggatatgatgcaatagaaactcccatttattgttggtggtagtgcaaaatggtacagccaatttggaaaacaatttggcagtttcttggataactaaacatacttttatcatatgatccagcaatcatgctccttggtatttatccaaatgatttgaaaatatgtccatacaaaaacctgtacttgggtatttatagaagttttattcctaattgccaaaacttggaaacaaccaagatgtccttcagtaggtgaatggatactgtggtacatccagacaatggaatattgttcatcactaaaaagaactatcaagccatgaaaagacatggaagaaactttattgtatattactaagtgaacaaaacaatttgaaaaggctacattctgtgtgattccaattatgtgacattctggaaaaggaaaaactaggaagacagtagaaaaatcagtaattgtcagaggctgaaggagggaaggatgaataggcaaagtacagagaatttttggggaagttgggtgatattatgtttcaatgtagattcattaattgtaacaaatgtaatactactctgatgtgggatgtccacagtaaagaactaataatatgcatagtattattagcaatttcttgatgagtgcctctattttttcactatttatacataagataattgaaatttacccaggtagttaaggctagatttttaatccaatgtttattcaccctaacacctttcttttataacataattatcaatgtatttaggaatagaatagtgatatccctagaaggcatctgatgccttgtatcatcatttttattttgtttcttgttggaataatctcttctattattaaaaacatatgactcgcctgggcgtggtggctcacccctgtaatctcagcactttgggaggccaaggcgggtggatcacctgaggtcaggagttcaagaccagcctgaccaatatggtaaaaccccgtctctactaaaaatacaaaaatcagccgggcatggtggtgtgcacctgtagtcccagatactggggaggctgagacagaagaattgcttgaacctgggaggcagaggttgccataagccgagatcacgccactgcactccagcctgggttacagagtgagactttggctcaaacaaacaaacaaaaacaagtatgactcacataaataagtacaatatttgtcttgtcatttggctaaagatacaaccatacttataagtagcaaaatatttggaagacgaatacccttattaatgaaatgtcaaggaactgtgatgcttgagagttgaagagtcacaggaaaagtgagcttgttgaaatcccttagaatgaaaatagaacaagcaagtagagagttagtgcccagtgcaacaatcatcaggtggacttctgagtgtcttggaagatcttagactgtaagtaatagtgataggaaaaaggtagttgtattaattatatattactgcacatactcttttttcctaaaactttatggctttaaacagctatttgatttctcatgattgtgtggtaagttgtgagtttcttcaactagtgtttcttaggttcacttaggggtctgcattctggttagtgagtcagctgggagctgggatggttgggtctctctcgtgtgtgcgtgcatgtatacgtgtttcccaagaaggctagactcgacttcacagacagtcttagaacagtgttctaagagagggaagccccatgtgcacaagtgcttatcattcctctgcttgtattacatttgcttatgtcccattgctcaaattaagtcacacagtcgtaacttgaatcaaggagggaattacatgcaggcataaataacaggagtcatgatttattctgaactatttagtaacagtctattgtggtctgtcctctggccctgatgattcaggtaaagatacacatattacacacactccatccctgctgccaacacccttaaaatctcattcaattaacagtctcaaagtccatgatctcatcatggactgcatgcaaagctttatggtaaagctcctccttatccagagaactgtgaaataaaaaataacagtttttccatgctcccctgtgtacaatacccaatgtaaataggtgaaaggcacagaataacctcaacaattcaattcaataatttaataacagaaacaggaggcacatagaattcactggcccacagcactactgaaatctgtccattgtatgcgccagagttagagaatgttcattaattggtattactaattactaacatatcatacttcctagaagtttccctaattcattgctctctgctccacttggtcctgttttttgggtactcggatctgtcatttctttttagtaagagctggtccatattttcagtgagtagctttctcagcctgtttatttcccataaaaaatcattttgaactatttgtatgcattttagttctagcagatttaactaccctaaaacttttgtagactttttaatggttttatttggggctcattccatgttcccaaagccatatccaaaagtttttcaagagaatcttctgctttctaagaagttctctgtgacaatacccttaatattttgtaaatattattttgtaatatattttgtaaaatatattttgtaaaactctctcttttttttgtctaattgtgtgggtctccttaggcaaagcctcacatcttcccaaggtcttaacaaagggttctgtagaaacaactttgattcagtctttaccctgaagccatttcttaactgtgccaggtggagatactgaaaatgtgaaacactaaatcttccaaaccagcacgtcctagcttttttatgtatcctctaaattctacttgcaaattgaacaggtctctctttagctcatttctttcttgtaccttctcataagcatctaaaagatacaaactgacactttagcatgctgtctcaaaatgtcctcagccagattcacaggttcactaagtacatttccaatcttccagtttgttacaggtgacagttatgccaatgttttcactaacacaacacatgagcttccatttttgctgtgtccaatagcagttttctactgccattttggcttctgttaactgtttatctgccattcttctaagctttactaatagtctctgtgatgattttttatcctctgtccattgtgcggtcccaaagtcagtaccacatggttagaacagccaatcacatggccgaacccagagccaatgcagaaggcaagtaggcaagaatgtgggtattgggaggtgtgatttattacgggacatgagtggaacaatctaccatatgacctatgtcaacaggtaccctttctattaagtagtaagaagtaggagtcttaaaagaagattctagaaaaggagagtctttagaaggaagacagttttgaggaattataaagattgggcaataagaatttgggaaaagtttaagaatgaagaaaatagtgtgggggattgttgacatggatttccgaagacctggtagaaggatgatatggggttaagaggagtaaggatgaggcagacggagacaaaaatagatttcaggagttcacactttggatcaaggagggatgagaaggagatagctttatcctgtgccagtttggtagtactaattttgtttctggtagattttgcttcagccagaaaatatattgttaaagatttatgaaaatcccaaacaaaataatacaattaccatccctccatatgcctgtgtaggaacatcactcaggtctatttctggcaatgtttaccaatcactatcgttggcctgagcccagaaaatatgtatgagccgacatccaaaagaatgcactgatttcacaaaaatataatgaaacaaactgggtcacctactttattcactgacatagagtttgcctagatacatttaagatgctctttttacaacctcaaatatatgtcagggaaatatggtggaaaaatcagtgttttaaaacggattttatttttgaaatgtgaggttttagactattgaaatatctacctctagatgatattttttcaaatataaatgcttttctaaactttcctattatattttttcatatgtaaaagcttttccatatataaaagctttccagaatctccctcaagttacactgtaagagcctctcaaagagaatgctatgttgatttaatttggcttctgtattattaatatagtgaccccagttagcaaaataaagtttgagattgtcggactttgcagaccaatgcaaagtcatgtctgaaagaggaggtggtattctatctttccagaaggggcgtatctcctagctgaataatctgaggctgaaaatattagatccataatgagtgtgaggaagacccacaaaggaaattaccataattaatgtgatatttctaagtattaaattacttataatgtaggaattataaatatagtaatgcttacttagcttaattaaattaaataaacccttaatgagcaaaaacaatttcttcagtgcaaaaattcatcagaatcactggccttatataaacagtggatatgtgtattacatctttgtcagtttggatatggaaataaaccttttagtggctttaattctatttatcatattttaatatttgcaattctgtaatctaattttcctttgtgtttttcacttttaacctgtgattttgaaagttgttagaaattaatgtctttcctgaagtaaattaagacactcactagtaatctttagagaaaattagccaaatcttcattggtaaaatagagataagatttattttattaccttgtgattatgctataagatgaaagagatattagatatgatgtctttcccaaaggtaaaggtttagagttgtaataaatgactagttaatgacctgctttttgagattaatatccaggctaggataatgttagagaggtttttaatattgcagcattaatatagtaaattcatatttagtagaaaacagatatctgaagagaagtagatctcaggtttctgtaacacaatagcactttgacatttattgtttcaactatttgtaagtggcgtgacccagaagaaacttaatgagatgcaatttataattcttctgaagcccaagtttgaaataagttgaagttgtgtgagagggggaactgggtcagctagtggactaattaagtagtcagcatttatttcttaacacagcttggttgttactttattgagaacttaaaaaaaaagctaattaggacactgcaagtggcattaaactttccatgctgagacttttgtggacttacattggatgtgctgtattttctgttcttcatctcatccttaatgactttaatcaggttttcatatgccctgctctccaaagcatccattattcattcaaatcattttattaaatatgtcagacctacacacagttatacagcatattaaagcaaacatcctgataatgcggcacccagttcaagacataaaacattaccaatacaattgagatgtcttgagttccttccactattgtatgccctccatgtaactcatatctcatatttgatgtgtatcttttctacaaattccactgtattcttactactcatatggtttactctaaaaagagtatatagcttttcaaatttatgcaagcagattgactatcttctgtaacttgcttttcccttactcaaagatatgtatttaaaattcttcagcacttaatatttatagttctacatcattattttcactgccgaatattatttcattatatactccagtgcctggtggtttgtggatgggtgttttggtagtacaagcaatgcagccatgaatattcttttaaatatctccttgcatacatttctaagtgtttcagagcacaggcctgagaatgaaattattgctggtgtgtacttctttaagtctacaggattttgcccagctgttcttcaaaatggtttgatgaattcacatatctactgtcagtatatgacatcttgtttttatatgttattaattcttggtatcagacttttcactttgcctatttgtggatatggcagggtacctcaattggtcttaatgagcatttccctgatttatagtgtagatgagcatcttctaatttttcaattaagccttctgagtcccttttaaatgcaatgtctcatgtcattcttaattttatattgggttgtctgttttttacgtactgattcatagttctttagataaccacaattctaattcattttcacttatattggatacagatatctcgattaatgttgtgatttgcctttatattttctttatagtacctttttataaaaacttttaaagtagaggaatttataaattttttatggtttctgctccctgtgtcttgcttacactaccttttcctatatttaatttacaatgacattgacttatattttcctccactttaaaaagtttttatttttagatttagtttttagcctacctataatatttgtgtgtgtgtgtgtgtgtgtgtgtgtaaggcttttttccttatggttaataaatttcctcaaaagcttctaactgaagagtctatttccctcaactttgctacaatgctacctctatttcaaacattttttatatgtggattggcttctacgctctgtgtactgtactggtgtaatagttgaaagtgtctctgctattcttggtctcttgcttttttataaaagttcaattcattatttgttatagtaataattactaataacagtgactacaatttatagatcacttattgttccagctttgtgttaattcataggtgagcatgtctacatttatatttgaggagagtaaagagtagaggattaagtaacttggcaaatatacacaactagtaggtgatataataataaggatttaaacctatgtccaactgactcttgcatgtgttattaatttaataatacttctgaaattaaaacaagaatagctaagctatattaaactgtttctatgtatcaacctttgtaaaaattattttcaaggatcatttcctttaatccatgcagataatataccatatagaatctattatgtagaaactatcattatctcatttttacagatgaaaataattatgtaatgtgcccaaagtcatacagctgttattcccagtaatacttgttttttattgtatatttttatggtgcacaatatgatgtttggaaaaaaacaatttttcacacatgaaaatgtctattcaaatttttatttgaaaatgtctatcaaatttttctgtgatcttggacaagttatttaggctctcttatttcctcatccattagttcccaaactagtaacaaattatgacacttacatgacattttttttggagagttaaaaaagttaaaacagtattatgcccaaagttagggcttaataagagctagcttttactatacattcttttaaagaggacttggcatctttataatatcatctttctatccatgaaaatagtaaatctgtttatttatttgtctttcataatatcttccaataaagtttgtaattttctatgtgtaatttatgttagatttttatccttaggtgcaactatttctattcttttagtggttgattttggtattttagaaggcatttttatttcaggaaacaaatcaatacgattataggttacaatttattttctccttattttgtaggtattactctactgtcttccagtttcctttgtggcagtcaacacatctgctgtcattataattcaaattcctttatagctgttctttcttttctatttgattactctcacattcatctgttttcctggataaacagtatctgaagtagcctttgtgaaagtcaatttattgagttgtgttttctaaaatttaaaatatttttttgatcaattctagaaaaatttcagccttctctttaaattactgtctcctattctctattctgtctggaaacaactccaatctgttgtctggtgttgtctatttctttgcttgctttgatgattctgactaattctcagtaaaacatctattttaataattatttaccaggatgatctcatataactcctaaatcaatccattggatttttatgtttaatagttaaatttattattttggagattatttttctttcaaatttaactctgaatactttatagttccttactgaatgcttatattttcaatatcttatttactctttaaagacttaaaatattttacattgtgcatctgaaatgtaatattgctgttttttatttctgttgatctctgtctcattattttgtgtgtgggagtgtgtgtgaatgtattgttttttctttctaaaaaagttttgagcttacagttgggtctcattaatctgttggaatcctaggtgtcctggttggagggtatgttttggtttagggagcatatgtgtttatttgcttttgcttagtgattagagttaaattcaaaattgctttcgattaatttccagagttgaggttttccactatgtaaattgaaactgaaaaatggtgggttttgtggcctaaggttatgagttccaagaggtgacttttgtttccactcagagcagagtcgagtaagagatttttttttttatttcatccccttgccagccgaccaccttttcacaattctgtcctatgttctcatactagggagtatccaaagtctttctcttttctccgatgagccattaaaattcaagattctaggtaaaactgaaaattaattgtcatgaagacagtcttcaatgtcctgcctaacatttctgttttccgtgtattatcttgggtgtttttcttgtgatctgagtcttgcatatatattacattaaggaaaaaaggagagttttggagatattgagccagtcagattgctcacaaagaaagtgaacctagtgtgctgtaaaaatactgaaaagaatcctaataaagtattatacatttttaggacccctgtttggaaatactaaaaaacaaatattttcagatgtctcaaagtataatttttttttaattttagtataagcagaatcacaaattcttgtactaataaacttgaatgttgttgaatggtgcaaggagtcaccaataattgaatctctaaattgaaatgaatctttgacgtcacctggtctcagcagcaaagcaccaatatcaagaaaacgacagccaaaaccaaaaccagtttacattttttaggtactaaccctgtatcagatactctacttcctccattattttttctcttttaatctaattctgtctttaactttatttttttaggcctcgggttactcgatctccattggaacatcgctgtggcagtgtgccacagcattttataactaaagccactgagtcctaaaaatgttaagctaattatctaaggctatagtggatagcatatggcccacctccaatcctggactttatttatttatttatttaccacaacacatatttcctttatgagtatcaaaattatcttgtgtatactttatataatctctttcaaaattcagggaagttgggctatttaaaaagaactacagaagatttagccattagaaacagacaaatatcctctgtagtttgtattcagataggtggttatgtctaccaatgataatgttgaggttagggacattttggtgtatttctatattcagtagttttgcataaggtcttatgtttctttatgctgtataatttctggatgttttgaggaaataaatattttaaaattttgattatatatttggggtatgttatagtgataactggaagaaacattgagcggaaacagaagtaaaattgagccttgcttattttggggtgaaatatttaaaaaatcatttgttcccttttaacaatgtatttgtttttagcgttaaccttcctctgcagcttcattgctgacctgggtaagaagtggcagaaagtacattggagctctgctgtgaccaatgctgagaaggcagcaaagatttgatttgcaatcaaactggtttggttttaagtgttagaaaaaaatgttgtgaagggaaaatgtctacctgaacaggggctctttttaaaaaaactaatttcaatatgtcccttaaaattttccagaataatgtggacataaacacataaggacttatataattaaaaaatgttttttgtttagtacctgagcattgctggaagtaatgaaagtaaacatgagtgcatcagtgcccccaaatgttacatttatgaaatttaaaaaacatgttacaattgtctagagtatcaaaatcataagactttgcgaatacttgatgtaaatacattgattacattaggcaggttcttgctgtgtcccattttattttgtagaggttgtagaaatacagatgagaagataatgtacaggtaaaattcaagattcttaagaagtcctggttgtgtcatgaaaggcatatatcaatacttatcttcatttaacttgttacttcgaattgttttcttgtgacttgtgacaggaaaaggtatagcaaagattaaatttacaaattataaatatcaattaataaagtttcttgatggattatttgtcttatttggatgcatatcatacagtagcatgcaagcacacagacacacatacacaaacactctacaagtttatatattaaaaataaaagaaaagaattttaaataaaaagctagagagattatttttccctaatgtctttttgacttagaaaatctatcactactctggaatttatttttattgtctattgaaatgtattttcaggttttcttgtgacgttttctagctgcttctagactgcctgggttcaaatttcagccctactgtcactatctgtgttaacttgggaaacttacctgtctgtatattggttattgggagcattaaatgactttatagatgtaagaccttacatagtacctggcacataattttatatgtaagtcttagttattacttaaaagaataatggttatagaaatcagtcatactgtcctttttcccaaagcatttttaaaaatttcattcaattaagtggtagattttggtcatgcaattatacagcaataatacataatacatcatactaacttactttaggggaaatattattttatgaaagtactataaaattttgcaaacaatttggcaaaatcctatcaaatcagtatatggttacatttggtccaatgctgtttaatatgttttgagagcatgagatgtgctgagtaaaagaaaggtatacttacacatacacaaatataactttctctcttcctcattaatattcatgttgccttggacattctacaagattcgtattcaaaaactccattcttgtctggttacatcactgctttttttttttttttaatccagattaccctagaaggaactagttcatggaatagaatagcaatttcattcatatatagatccagcaggcatattttagttttcctaacttcgatgctgacttactttatattattcacattgataaaagatccattgtcatccttattgaagtatgacatatgccttaactttgttcttaaaagtttgaaatcagaacatatgctttgattcattgataaagtgttttagaagctctggttctccccagcttgttttttttatgatatcatctcttaaggacttggcaactatctagtggctctgaaaaagccagacaaccaacctgggtagttcacaattcagtattgatttttgctcctgctttattttcaccagtcgcatttaatttagacaccttaaaatggacaaatctgcaatatactctgtgatttatatacagaagtgcatatgttctccagaacaagacgttcattcatttagatatcttcgaaatgatggctttaactgaattcatatgtgcctattttccgtgatcacatgcagttgaaataacttacggtgaagcacattattaatattttcccttgaaattagctatcatctgctcattccaattttctccatgtttttctgtcacagaaattaaatagctattagaattctaatttccagggagcttcacgctctttcccgaatgcctccttttcagctgttcatttgttgcccacttcctttctccctctcaatggtttagctccatcttctggcctttactaatgaataatggttgctttgctatttttttatttgccttgttgcagctatggtggtatattcagaattggctatgaataattatagaaaaaatagacaataactaaatattgatgttatgtaacttgcaatatattttctcctattttttttaattggctgaggaccacagagtaaaacagagaatttgaggaattattcacataacctatgggctttttaaaagtccatctattgaaaaggaagaattatgagctgcataaaagagtttaattatatacattgatcaaatgcatcagataattattgaaattctcaattttcattgcacagataacatattaattgcatagatcccatattaatggtatactttgtagtttatcatttttattagaagtacagtagaaatacaaagctaaggagaaataatttcacaaagtagaaagttccaaaagtgagtagagtaaaattcttacaaaaatcattgctttctcacctagaagaatccaaaagaatcaacccaaaagctcatagaactgataagagggttcagtaagatcactagatataaaattatgacttgaaagccaatggtactatcaatatctaaaatagaaaatataaagaaaaatcatctgacagtaatataagaaagatataaaatatctagggataaatctaataaaatgtttgaaaggtatgaataaatgtgtgaaactactgagaatcataaaacagttcttagtcaatagtgattggctataatgtggtaaatattaatctctgccaattagtttgtatttctatctcatcctaagcaaaatgctaaagaaaaaaatgcaaaacaataggtacaaaaattttgcaaaaggacactgacagcaatagttatttccaaaaaagtgtagtaattaaaacacttgctttcatcttcagaaataggcatagggacatatagcaacgtagcataagataaatgtgacatttaaaaccaaggaaatcaataaaattacattaaaagcattgggaaattgaacatctatgtggaaacaaaataagttaggtttttactattcataatatccagatattaatattagaagaatttaatgtaaaagggatagttaaaaatcaaacatcccagaatagtttgaaaatcttagaatgggaaatccttgttacacaagacataaaatttaggaatcatcaaatgaaggatcgagaatttggttacaaatgtcatcataaacacggaaaaaggtaagagaaaaaggaagaaaaataggggctttacatatgaagaagattaaagtacgttagaaatcaaaacttaaagggtaatctaatagtaaaaagaagtgtacaaaatctaggaatagatgattaatagaggaaactataaaaatagatgcactttcttactaatgatgatgggaatccaattttcctgtttatcagtgaggtggctgatgaaaccagctctggagtcaggctgcctgggttgacacccactcacccatttctagagatgatagctgagaaaattacttaacttgcttccaagttttttaatgtctaaaatatggataatattaggacccatgtggctttacagtataacaaattttaagttaatacataaaatatactaagagcaatgcgtactgtcaagagtacaaaaacgtaagttgccattattaaaacaaaaatgaaatgtcatttttacctgtgattagtaaaaactgaaacaatgaaaaatatcaattattagtgaattacacacaaaaagttattttattgatagcaatgttaattgctacactatatttgggtgataatttgatagcatggataacctttcacccagcataagatttgaccaaccaatcctacttttaataatctgttctgcagaaataatagcacatgtgctccaagatgtatgtattcacatgttcactgcagccttgtttgtaatcacaaaactctgaacaatctaaatatctttcaattagggaatgttaataaaatgttgctgctatcttcaaactagggaatatcatacaatggtttaaaagagtggactaagtctgtatcaacatggtaatttccctgccagatatcaaagtaagccacaagataattgttctgtggtgtccttaatcaaaaacataacaaaaccagaaacgcacaaacaaattcgactcttactagaactatggggctagaggtacatcccacattattgttaacaagggttgcttctgggaagaatagtaagcaaagggaatttacatccttttaatcagtatgcttgtttaaatttgtgctataatatactcctgctatttttgaattacagacatttaatttagagtattcaaataaatgtaagggccaaaaacaaaataagctacaaatcctttctggaaggaatttgtttcacaccatcagttgtaactaggcgttacaatggaatagggcgacagtcagggcaatgttagagcaatgtgccatgatcccttaacaagcatgaagtcataattttaccaggactcaatgcatcaagggtgtgtgagtccattatgctaaagataatccctccaattccttggcaatttagagatgaatgctaatggcccagagcatttagcatatttatatgattttgcattatactatattgaaaaaaatgtgtcctttgaaaataaatgtatgtgggttaacacataagtactatggcacatgcgcaggaacccgcttgcttaccaacaagtaagaagagcaagaaagttctgtgaaaccttcagaacctctttgagtcattcaaaagcaaaagtgttatacaagctaatttgagggtatccagacagtaaggtgataaagttctgtcttttttttttttgtattttatttaaaggataaattttaagtagaaatcttatagtcatttgaacatttttcagttattttgtttaaaagtaggttttatcatagactctaaaatgattatttggactgagatgtcattgaatctatgtttaacacatacataatccctcggtcttgtacattctaattaagatcagacaagagattgcaggttttttaggcattaagaccaatggtggctataaacatgaagaagagaaaaaaaaagagagagagagaaaacagagcaagaggaaagaagaaatataaaacaaagaggaagaaatgtaaaacaaagaggaagaaatataaagaaagaaaaagtaataaaacagagaatgatattatttaatccttgaaatttattgtatctcacatacattttccatgagaaagtatgtgatgaataatatatatgcactacctgacattttctagaatttctctctttgatgttcagccacacaggcccaagtatgagctttgagggcatggagacatttgaaagctgagacttgccagcagcacacagctggctggtgtcacagcaaggattagacgccaggcctgcagacattcattcagcctggcactctttatccacaatattcaaatttcatcagggcatagagtgcccagaactcacatagagcatgagttgagcaagagttcacagaggatagaactatatgaatttataaggagaaaatacgtatcccaaagataaagaatgagactatcacttgtgaaatagcgcctgatacagacagaggtaattctctttcgtttatgtatccagaacccatcattaaaattcacatgagaattattgcctattactgctggttctacaattgcctgctatcccagataatgaatgaagccagaataaatgttatagattttttaaagctgcatataatatgggcaacagcaataaactttcgccattttacctcactcagcaaacataacatgaaggtcaggaggggtaaatatttgttagagagaaagaaaaatgtattattacagcctcattgtcttctactgctgagtgatgatgttgcatcaatctagtatttctgtgaaacattagatcaaaacgtatgcaaaagagaagtaatttatcatcataaatatttgtggcagagctatagggaaaatcatcattgaggcaatttatggaaaatgtcattggggtgtatgtttattattctttgcatttcctctgaatcacttggtgtttcattcagtagctatatattgagtgtctgtgctaggaactttgctgggctctggggaacaggagtgaacaaagtaaagggtagacttttaaagaaatgagagttttttgagagatgctacactgccaggtccagaatgggaaatcctttctgtccatagataggaaaagaatttgccccagtggaaaagtgaactttaaaataaccccattaatgcaaagtagatggtttaacttcatttcatcataagaagagaacattgtatttacctacattttgtgagagtaaagaaatcacaggtctatttttatgattccccccaatttttacctggaaacctaacattacatgcactatctgttacaataattgtatttttaggggaataaatgtcacttacgacaaactttaaaactttaacaatttatttcaattatgtaaataagacatttgaaattgtgggaatttttctctatattttcatgtgcaaaatttgttattgggcatatattccatgcaaagaaattcaatgtatgttccaggcaaaaaaatttacctcatttcatttaggttttcaattgcagcttgcgctgtgtactttttcaggttggtaatgtcccctttcttggtacaaacttctccacttacaaaatgtatatggaaatcttaaaataataaaatttcacaaatattctaaatattatattttcatactaaaaatgattgcgcttttttcctattaggagaatgaattaactacatttcataggtaattttaaactaacagctgttattttgcaaaatgataacaaaggataaaaatattgttttgacatgatttcagaaataccccactatcaacggaaatgaaattttctcataagaacccgttttatgtctttgctagaccattggttctgattgtatgttcatttgacaaatatttaatgattatataattgtgaaaacttctgatttggatattgcagagaatacaaaaattattgtggtttatttattgtcaataacacatttacctaataatttataattttttccagtacatctctatatattatctaatttaaacttaaaagaattctcatgagatagacaggagaggaattaatagccccattcaatagattaggaagcatgcttaagatcagagactcttctaccaggtgcccagggaaacatagagctgggcttccgattcgggcaactggggagtgtgctgatggagttcataattagggaggatcatattcagttgatggcaagcaaggaacccttcctggaagaattggtagttattaaatgacatttatcagttgcctgctgtgtgccaagtacttgacaggcattcataggtaaatggcacttcattctctcctttcaattagctcacagtttatgggcaaactagacaaatataaaacaggctaatacacagaaaggcagattgctttagaatcacatgcaggagcagcttgtaattcagaccacacagagcaggtaacacctgagcaaatgctatacgtgctcttctctaagcaattgcaagaaattgatggattttaagcaggagggttatatctgccatgagaggaaaaagatttattatgaaggaggctttttgagaggttatttcagccatctagtcaatagatgtttaaggaccatattaaggcaatgtcatgagagctggagagcacagatagagaggtctaatgggcaatatttggtgacaattcatatgctgagaataaaggaagagaagtcaagagtgattctaacattttttggcctgaagagatgggcttatttcaacacataagcacttgtcttgtggaattgatgaattttagactaaaggaaaatatgagcaaaatcctggtgcatgattaataaatagttaatatcaacattaattagaacattaagatgtaggaaagtcatgagagactcatagggccaacactcttttcagcttatgtttactttaatacttccctgtcccacaatgaggcaggtaggtaatatttttatcgttttttacacatgactaagctcagacagactagtagagtaacttgcccaataaatccagatagaaaatggcaaagccaggattcaaacccagtttgttctcacttttagcccctagagctgctgtttctgaggtcagagccgcccaagattcttgaaaacagaataataatctctctgtgatatttaattgtttagattaaagtaatatgtgtttagatattgtaaaacagtggcattttatgtatttcttttttctttttttattctagaaagctcacacatgagttcatgaaagaattgaatatttttaattaaaaattataccaacagggaaataaatacaaaataatcatgaaaatacattattgaaaaattaatatatatttacagtatatatttttatcagtaaataaaggatgacagctagggtgatgatgaaagtttggaaaatatttgcataaggagttgaatttgaccttgttaatagggatgagaccgctaaaagatagattttgaagaaaaagaaaaaaaattggaagacagatccttgactgatgcctttatgtgatgtgctttaggaagactaatatgacaagagtgtaaattgaaggaaggagagagaagaggtgggtcacatggcagaaccaaggagaaagaaaaggaaagtgaaggtgcaagagatgcttaagaagtactgttatggaaacttcatataagtggggaacttacctgttgtgcttaatactgtcttccccaaacctagaacagtgcatagtaggttcttaaaagtgctttgtaaatgtgcaatgaaagaagtagaataaaatttaaatggtgatggatgacatgcataggacaagaaagggcaagaaggtcattattctgaactattgcatataaatgatggcaatagttatcatgcatgagcaggaagggaaaaataaacacatagatatggttcatcagaataaaataaaacattttttcattatttttatggaattagttggaaatatatggttttagaagtttccatataatgaactgagggacactggaaggtgacagattgaagctaagcttttttttttttttttttttttttttgagagagaactattctctagatttgaacgttatattttatcaaaaatgactcagtgtggaacaccaaaacatagtagataaaattccgtttttttcctgaatcagctcacaatactcatcctctttgttgtgcattttctaaacctaacactatgcttgtcacatagaatatttacagtgcattttttggtaaataaatagttttaggagataactgggataatagtgaaggcttgggaaatatgtgcataaaaattgaatttgaccttgtggaaaggggtgagaccactaagaggcagagtgaaagaagataagagaaaacaattggaagacaaatccttggagaaggtctttttaatttaggatgtaggaagaagataaggcagtgaaagataattagagcgagaggaaaagtaccaagatggtataattttacttggcagctatgtggaaaagaattagaagagagcaagactagtagcagcggaaagggaaagaattttaagaggcaaattttggtctaataaattcagagaagctaagaaagctagatccaaagaagagatgattatttttagttaccaggagatccttactaacagatgatagggaaatttcagtactgaaatcaggggcaaactatgcatggggttaatgtcacaagtttaggagagaaggagagaggctttcagtggtttccatattttgatgtcagaattccttggtgatgcagcttttaccagtttttgttcaaactgcaaagaggttgttgccatttctgcttatgaagcagactatgctgattcattgaagtgaatctcaacttataaatctaaaatatgtaaaacaaaaaaaacatactcagttcttctccctttctactcaataactatgcgaggctatttagattttgttcagcatacagactgtatcatgtatgctacattagcagcaccaatgagcagagtgacctaagagaaaaagatgtgttggatgcaccatcagcattgttgttggcttatatcatctgggcttgtaataaaaagtgaaataatcagcaaattacttatacccaggagattatcatttctgctgtttgacataaagtgtcttttagaaggacttgccctttgctgagtttctcaaagttgatattaaatatttaattacagaactcagtgagagcatctttacttactcctttgcaatctggtttgaatctcaaaacataaatgcaattctaatattaatcaggactatcattgagaaacttataatagtgtctcacagtgttattgtgaaggtcatgaagctggaggtgaaaatgaggattcatgtttctttctttgcctccagatgtgactatatagggtgttggtattgtataactcattttagaaagttgtctttggattgattttcagagtttatgacacgttatttctgatagtctcggtggtagtaaaccttccttcattacaggatggatcaaagttaaggaaatggctttaaattttggaggcatcattggggaataaggtaaagatgaaaatgaataatttcccttctaatgaagtaaagagtaattccaaagtactgcagctaatattcttgtgaaaggtgtcagtaggttatgctgcctatgctaaattggggcaagcatcaatatttaaatacgaacagtcttggatatttggggataacatgttagaagcatagtgctaagtttttcatcttcagatggttaccacaaacggggcaagcaaagtaccttagtttaggtaagcattctgatggatttgattgattcctggctgtaaatctcagtggcattcttatcctgcttggggacagagacagtgactgtcctaaggtacagagagggaaatgagcactgttggccgaatggctgttaactgtatgcatagtcaggggacataagaaagaaatatccagaaaaatagaggatatatgcaaatggacacttgagtaagtgcaatgaagaaataaaggataagaagagagggttgagggagaccaaagagagtcaggagagaagagctattgttgtaaaaataggttcactggagaattagctgaagtgcatggggaaaaataaattgtcttctgagttaggtggatcattccttatgaagttgtgtgcagcttgtgcctgttgttgggtcaaagccagtgtttccagatggccgcaataaccaggaggtcccttgacaactcactccagggcctaaaacaaatcgaaaatgaaaggtatggctccttattaagcttgtctgtgtattcaaacagtggcattctttatcaggcatcctgctgatgctgtggctgctgttttcatcacagaagctatttcacttaagatgagaagaggtctcattaataaatcatattgcatgatattcctatagtacctagatgacatgcccacactttgcagggaaatggaattaaatagacccagagagaattttatagcaagtctttcttttatgtgtcatttggaatcatcaattgctgaacaaatttaagatttaagatatacctgtcagtacacatacacttatgtataaaataagaaatcactgcagagttttcctaggtgagatgaaagctatttttcatgtatgtgaagaaaggacatagttatcaaatacactaaaggttattttcaactctgtacccagacaagaacaaaaagtatgggcatgaataaaagacagttatttcatctttgccttatgttaaggtgtgaaataaatgtaatgaaatgcattcagttgctttttgagatatttcagtctgctttgtagaagattggtaataaaggatgtgtaaatttacatattacacaggttttcggcaaataagggccacttaaagaggcaatcttgctttcctttggattcataccgtacaacagttactaaacagtattgcctaatattttttgattgtctagaattggcaattagaatctgtacatattttagcaatgctcgtattcatgaaacaaatctattttttctacagaccatctatttttgtgaagtaaatacaatgatataagatagggtttgttttatccttcaaaaaggattattttaaaaggatggtagatgttatgttctaggttgttagattgtgtttctggatgactggtttccagtttttggattgaaatgaccccgagattgagaaatatcagctatttatctatttaaagccacatatttggccaggcatggtggctcatgcctgtaatcctagcactttgggaggccgaggctggtggatcacgaggtcaggagtttgggaccagcctgaccaacaaggtgaaaccccgtctctactaaaaatatgaaagttatctgggcatggtggcacatgcctgtaatcccagctactcgagaggctgaggcaggagaatcgcttgaacccgggaggcggaggttgcagtgaggtgagatcgcaccactgcactgcactccagcctgagtgacgagcaggactgtgtctcaaaaaaaaaaaaaaaaaaagacacatatttgactttactagtagctttaagcactgttctgcggatcgtcagtgctctgtagagcattacaggggatcagtcttggacaaagtaaccctttttctcgaaaagatattactggatttatgtttcaaaatattattcttattatattgtggagaattgaatggaaggaatgtaagtggaggaaggaggacagttgggtagatatttcactagttgggtaagataagccatattactttttaattaagagcatggattctgaatccagactttctattttgaatgtagcatctatctcctatgcaagtgtctttggtagttcacttaatattattctatgtgtcaatctttctatcagtaagttggaaataattatagttcctacctcaaaagttatcatgagaaaaaaatgaattaatgtaccctagaacatgccaggcacagggcaagcacaatgttaagtatatactgtcagtgaactaggatgtttggaatggggagaaaaataagtggcccttatttgagtatatcgaggtattataatgagcacataacttagttatggactgacttttgggggaaggagtgaaagcagatagtgtcatatgccattcactggaaatagaaatattggaagaggatgggggattgtgggagtgatgaggatgtgcaaatacaatactatattattatttgtttaagaattaatatgtagtgtaacatatagggtaagttaggtccatggggaagattaaaatgcaaagttttggactttatttaattgcttctcgactgagtgacacaatatgacagaagtagctttgtggggacatgcgtctgtatttatcggggagtctggtatctatcttgtcttaaagaggttttggtcagcatttggagtctatggaagcacattaacttttagatgtaaaagcatcataaatacagtaaagatttttaaaggaattggattatgtagggaatgagctgtcattaatgtgtataaatcttaggagactacagtttgttcttatagctaattttttttacccatacatttttcatatttgttcctaaaatatgttaatacttacatagcttgttaaacaatgatgtttgcattttcttgtaaccagaactactttttatgctttagaatcttttagatcccacaaatagaatgctaagtaaataagtgttaataaattacaatggatcattaaatctatatttctttcaatatgttaattttgtattttatgtaaaaggacattacgttttaagcaaattcatatgattgtgtgccaatttcaatgatttttcctttctatttttcctattcttctagtctgctcccagttttcgagaggagtctatgctatttttggattttatgacaagaagtctgtaaataccatcacatcattttgcggaacactccacgtctccttcatcactcccagcttcccaacagatggcacacatccatttgtcattcagatgagacccgacctcaaaggagctctccttagcttgattgaatactatcaatgggacaagtttgcatacctctatgacagtgacagaggtaagtgacagtatctcatctctttgtaatggggcgaattcaatgcctacacttgacacttctatggatgttataaagctacaaaggtgtgataaagcccaaggatcccttggtttaattttgctgtgataatgactaatgcaatttaaaacctgggaaacatatttagagtaaaacaacaacaacaactacaaaagctgtctgtgtacaacttagagagatagactgtatcaacccaatgaccaaatattcagttgtaatataaaaagcaattttttgcatcagcagctaaaagtctatgacagctatactactagtccaaggtgaatgaagtggcttgagtacatttaagtgaaacagacagtaacatacagttattaaatattgttatatgcaaaagttttatcaggcaggtagcattattattgcccttgccttaaaacaagattcccgaatctcagagaagttaaaggtttttctcaggatcaacccacgtatggtacagcttacacacaggtctctgataccaaacctatgcttttgacaccattccacataattgtttataatgggatgattttgaatagcatgccagtcttgattcattatgttaaaatgtaatggagggaggtacaacctgtatgtttctcatatcccttgttgtgaagtttagtattagcagacttgcttgatttatgtcatagaatcccaggtgtttttaaccattcccaggtccgtaattgggtgtcagtgggtttgtgtactccctaaattgtatgaaacatcttgtgtgtgtgtgttcatatggatatgtttttagagagagtatccgtaaatcaaagtcaaagcggtgagggacaacgattgtcctagtacctaagtaccatactgtgcttccctcagcagcttgcttcctggaatatttgtaggttcaaatgaaaacccagaagcctatttcgaccaagatagggcaccttgttaacccacaagggcagacaagaagagagccagccgtcagtcaattctccattgatcagtttgtagtcatttactgcagcaagctcgagtcaggagtgcaggagctaggtgtctgattctctgccctgtcctcctaatcctgggaatgagaacactcagtggaaaagccagtcagcactatacaagctgaaaaaaaatttgctgtgtcaacaactatgtccccctgctttgagaagggagtgctttgctattcccatagggaattaaaaactaaaaccgagaatcatttacagtaaatacagatttcaatgtgctggatgtttccgacgcacacttattaatgtgataaaagggcttataaaactgagcttattaaataatttttagtttttcctcttgttctctgctaacttctttagtattttgtgttgttcaagctagcctgaaatatgggtgtattcttaatacctctttcatccttgcatcctattgatgtgatttccactgcctaattatatgtctgtagacactcatccttgtcgttgccattaccccaggccaagccaccataatgtgttcagtccctcatctctccagttccacccttgtctttttttaatccattttctatgaagtagcaggaattactgttaaaaaattttttttggactgcattactctcttgtttaaaatacttcaatagcttctcattatgatgaggataacattgaaaaattttagttggctttaaggtcttataatatccaattcccactcaactctccattgcattctgctgtcttgctcactcattaaaggtaaatccatttgaccttctttcactttctcagatgcaccaaactctttcacttcaaatctctgcctgtatcactaattcttactcctccttgagaactgggttcatatatcatttcctcagagatgcctttcacactgttatctttcaaagcaatctcttttcctttatagtacttaggacaatttataatgaatgggtgatgttcattctgtcacttaagaattgcctattgagcccctgctatgttccagggactgtcttagtgtcataggataagcattatgtttttcatgtaaggtgtggcaataagctccaggaaaagagtgcccaggcagtgctcagtgtactagatattcagctcatgactctgtacccagtgcttcagataatgctagaaagagagttaatgttcagtaaatggtgttaataagtaaatgagttaaacatatgtgtacagtattttaagttcaaggtgattttataagctaaattttgcttgcaaaattgaagaattgaatgactaattctctttacactttgataaggttgactgaggatggcatttttagtttaagaatacacttcgccttcatccttaccctcaccattgctccctctagttaaaactgaacttttgagaaaaattcaaaaagacaacagctgatacaagtttaaaaaaagagaaactctagtgtgtgaggagagatactcaaaagacaggctctggaattagcctgtgaagatggatggacttacgtacttgtgaaaaaaatctggaacattttaaaatacttttattaatacttagaaatattaaatgaaattgaagtgatgagataatctacaattattaaattatacaagttgatttgagttcaagtgcatctgttgagataaaaatgttagagtgataatattaagtaataatatattaaagccaaaatgaccttatggatatattttcaaggtgttatcaagtagctattgatgttttaatgtgaaaaatatttcagtggccttctatctgaagttattttcagacataaatatgtaagactctcataatactggcaaaagacttgacctttgtgtaatattttacttggctcatggaaatggaatttttgctatttgtttttttcttattaatgacttaatttttatggctttgccatcatgctacattttaacgagtttattcatacatttagtgtgtgaactgttttcccccatttggtccgaaatcattttgcttatgcttcaaagtaggcacctccttgctttagtgtcacatgatttgaagaatgcacctgtgttccctttgtccacattaaccacagtctggaaaatagatcccatggtttcatcactctacttagatctctacatgcctcagtttcaaacaatttggtctgttcttgatgggctgtctcttcacctccttgattatgtgattatttttaggctctaatcatcctcactttttagagagtctaggtcaggaatatatattggttaattataatgtctaaattactgttctttggaatagcatagggtccaaatgtgaaaatgatctcccaacattctgccctaatcatgaactagatgaaaatgacttgaaattgttatatgctgcttagtttcactacctttagctagtgaaagccattcctgcttcctggctatctgccacaatgctgagcaacaggccaagagactatataccacttttaaacaattagagacatggatgcatggatagaaacatctttgtatagcagcatctttgtatggaaccctctttgactaatctaagtttactggtgagaggagagctgaaactctgcatctggtgccaggtgatcttttaggttgctggtgtcttctccttacccaggccatgtggcaacagcctgacactccttgatgaccctgaaaactgcatatcatcactccataaagagaaattcaacacatttttaacaatagagcaatggggttatctatgttaatgcattcaacattatataatagttttatttttggatatatatgttgtaagtttgaatcaggacttaatccaaatgtggtttttatttattggtttagtgtcaacaaggtaagataatacatttctacagagagtaggtaaaaacagaattagcactttatatctgtatatcttggtttcaatatcgagcaatattatttgtcctctgaagggaaggcactttgcctgcagttccaagaaaacatcatgcatagaacaaaaatgctttcaaattataattttttccctcatattcctgagagagctgatgagggaaatatatgttaatctaatttggcctaggcatgctgccatgatttagtgatcataaatattaatttatatgcttgaaagaataagtacagttaattttaaatggagcaaagaaaatatttttaagcagtaagacatggtttgaataaaatgtatattttggcagtaatcatttttaatttaaccctttaacgtgcaaactgacagacttcccctgtgtaccgggtgaccttttaaagggtttgcatacagacaggtggctgatggcttgtctataactcagagtgttattaatactgggtcaagatgagactatcactgactgactagtagtaatactttgggagaattttaggaagattgtcattttatgaataggttatacaactacaaccagtcagtaacaataggcacatgaagaagtaatgcaatttaacattatgtaatctagccattttttattttagcaaaacatctaagaattcagtagagtttagaacttacttttagactgtagcaatattcttgagggtttaaaagaacatactatattttaaatatatttaccaggaggaataatcttccagatttcttctgtttttagatgatcaactatgtatctcaacagttttgttttaagtaattcaataaaaataagtgagtctctgctatagaaattcaaatatcctaatgtagtactatggatattagagttgaataactattgcatactaatagctttaaatgaaccagtgtttatgcagaactcccattgtctatacaactttgtattctgaattacaggatgaatatatttatagatacttctgtgctagtttgtgtggaaggaatagaggcagatctcaagtcatactttctcctgtaattgaatacggtacaaagaggtcaagagcacaaatctgtgttatgtttgaagagtttaatttcactttcatatacattttcagtgattttcaaatttaaaaatggtatattgattataaagaaatcagacaatataaaacttttagttgtgaggaatgaggtgaggagatcaaattgagagagagtttgagagtcagttactattactgaaaaaaaaccacctagggaaatgggttattaagcattgaatggtggtctcttcaaattacacgtcagataatgcaatcacttgtgaattacttctgcctgttgttaggagataatttaatattattcagtgtcttctgatgaaactgaatttattaagtctgatacagcactacttgagcagtttagtttcttaataatatgtaagttttgttaggttccataggttacaaaatattaatcttgagagttttaataacagtgaatcctgaatccacagccactgtaaattacttttgacacgtagaacaaatgagtttgaaagtcagagaaatttcttggttttttttttttttttttttgaaatggagtcccgctctgtcacccaggctgtagtgcagtggcgtgacctcggctcactgcaatcaccacctcccagcttcaaggaattctcctgcctcagtcttccaagtagctgggattacaggcgcctgccaccaggcctggctaatttttatatttttagtagagatggggtttcgccatgttggccaggctgatcttgagctcctgatctcaagtgatctgcccaccgcacctggcgcaagttaggcatttctttaaatgcattctttttgattttatacatcatctctatattcttttgcaaggtgaactgccggaaattttagatttaggatttccacttggtgaaatccatttacaaagtgtcatttatatttaaactttcttataatatatgtcaaaagttgagacataatattaagagcattaccacttgaaattgtattatatagtatgctttataattaaataaacaaaatgaaataagctatttcagagaataaggatgcttactggtaatttctatatggtaatatatgaatagcacagagacccccatccatggatataatgtctttaagaaggtgacaagggggagttgaaccatgactgtgatgtaggaaagtagaacccagcaaatggaaagtggcttagaatttagatttctttttctcttacttgcagagaaaagtgggtagacttaatggctgttttcaagtacattgatagctgtcgaattgatcataatgaccagctgtgcgtgttctgtctctgcagatgaaaagggaaggatttaactgacctatagtgtatggaaatcataggcgatctgtgatgtgttttaaagatctgtcactgaaagtttcaaaaaatgacatatggtctttttacattatcccttgagaaatttaggtttatttatatcttttgccagaagactggacagaggaaactaatttcattttgccagaaaaaaagttaacttttttcagcatgtggttcaatcttccattctgaaataaaaataaattatttttaatgtttatgttaaaatattttaaataacaaattagaatgctataaagattcccaaacactcttaacatggctttattaaagactagtatatgagcaattttgcttgatctatatctctttttttccctgcaattatttagaaacaaataccagacatcctgccatctcatctgtaaatatttcagtgtttatttggaaaaaatgatttttatattttaaatataatggtaatagtattattatacctagacaattaacaattcataaatattattcttttttccactgtttgaagcaaaataaaaatgagatccatatatcgcaattagttaacataatttttaagactcttagaatgtaatgcagtttcccacagtctagattttgatgattgcaacactatggtgcttaaaatattttcttctatatatgccctataacttggtagttagatttagaagtgtgatgaaattcaagtttacattattggcatgaatgtagccaacactaaataggtatatacctattcaacaccaaaataggtgggttgaatattatcatttggagacatatctctgttatctctctttttgggtagttaccagtagttgatgtttgttgtcttgattcattaattccgtaggtgttacaagatggtgataatttcaaatatatattcatccatcatctattagctagagtatttccaaaaataaatatctttagttcattattaccctgaaagtggttcatataggaaatgcaggaaaatgcttgttttatttcattatttaccagtcttcaaattaattaattggttccctagcatctaccaaagtcaagcacgtttttaaaacataatttcatagatttaaaacagtttatgtatttaagtatttcgcatttattattctaattaatattcaaatgttcccatctttatttaaagagctcctcttcaaattagctcctgtgtgctttgaggtaatgctgatggttttagagagttccttcccttctggtgtcataagatgttttagactcatcttgtacactttttggccaatattgaatccataaaatttttaatggtggtttttcttttttgaaatagttttcaacaaaattgataattgactctttttcatagcaaaaagatttaaataaaatttggtatctgaatttagattttgaagagatatgttcacattaggtgaatcctacattttattaatcaaaagggactaatattgttagagaaagatgcaggcttttctagaataaggaagatgatttgctgagttctggattcattctggagtctcgattttgcgttgtttattaagttatcagtataaatgatgaatttggttttgctgtgaatagtagaaataatatgaaagacaagtttatgtagcatgtctccaagtgctaaactgaggatataacttttcaggaaataaatcctctagttgttgtaactcttagtcctaaatatgaggtaatatatggacaattaaaaaaacaataaaaattttccaagtgatatgatgctataagcaaagttactaacaggaaaatagacatatttggaaagagaagtaaatctatgctagagaaataactgccaccatctggttaataggtgaccacttcaatttctctgggatcattcccaataacaaaaaaaataacataacagaagactgtggaaggaaaaaaaaatgaacccaaactgctgacttgaaaacaataggagaaaatatagcagcctcataaagaatattgcctcttatcctcacatagacttacatagattcctcattcaaaatgtactcgtcttcttcaggatactaatatcaaatgacagactatcatgtatgactaaacaatttttttccattctgtaagagtaagaaatgtttgtgatgccatttcatttcacttaaaccaaagatattaacattacactttagtaatactctaaagaagacagctgagggtgttgaaagaaaaggatattattttctactcaaataatgactcctttggtcagaatagtaatatttaggtaatgagtttttgatgtgaagtgacataagtagaaggtgataaagatcatagctatagctttttttgaaggagtcaacattcctttagttgcacaaatatatcttccttaaaaatatattcactggcaatttcataacacaatcctgagttattcacgtatctttatcagtcatcatttttctttgccttcctaggcttatcaacactgcaagctgtgctggattctgctgctgaaaagaaatggcaagtgactgctatcaatgtgggaaacattaacaatgacaagaaagatgagatgtaccgatcactttttcaagatctggagttaaaaaaggaacggcgtgtaattctggactgtgaaagggataaagtaaacgacattgtagaccaggtttgctactttctgttttctaatgatgccagatatagaatatgcatgcaatgtcagcatttgcaatgtgtatttgtgtaaggtgcttgaacagcagtttttgctttatgttttatgtcggatgcagcaaagatcatcaattaaattatctctggcttcagttagcaatagcaaatggtcatcagtaatgctggcacatcatgttaatcattaaataaattcaataaataattcctgacttttatgttttatatgataaatgttaccctaaactttgatattttcatttgaaaattttaaatttaagtctgatgaactttttagagttaaagaaatagacatgtattaacttaagacaagttgagttctaagggaaaagtgagtaattcatgaaatttttggagttacatagaccatctatgcctccagaaagagtatgtagttatctttgcaagatatattttttttcttctgttaagggacttgtgccactataaaaaacattgatttgtgaaattaaaatatgtaggaaggacacatttgggctgtgtttgctatttgagaagtaaactagatgcatccccttggactgtttgaaagaatcactgacaccagtgataaggatatttttatctgtgcttagatactaccttgcttcagtttaaggtctttcagggtaggggagccatgcagtgttatcttaataatacaggtaaaatccaccatgatttacaaatagggtaagtgactagggatgatagtggcacagcatcaacattatgattgattgaataaggtctcctttactgatatctgcatctcttcctagctgaaaatgtgtgtgtgtgtgtgtgtgagtatgagtgtatatgtgtgtgtatacatatgcatatatgtacatatatatgtgcacatatatgtatttatacagttgaccctaccaatatcctaccattgaccagaagccttacagataacacacagtcaattaacacatactttgtatgttatatgtattatataccatattgttataataaagtaagctagggaaaagaaaatgttatttagaaaatcataaggaaaacatatttactattcactaagtggaagtggatcatcataaaagccttcatcatcatcatcttcacattgagtaggctgtaaaggagaaggaagaagaagggttggtcttgctgcctcagaggtggcagaggtggaagaaaatccatgtataagtggattcacacagttcaaacccatgttgttcaaggggcaatagtatacactgtggctgctagtgccttagaatactgtggaagtgcaaggaaaatacacacttgtgtatgcatttcttggctcttctagctttgaggaaaaaatttgattcattaatttgttcaacacaaaacattctgtaacataaatgttgattaaatcctaattgatatataataatacaggccctaagacatacaaaatagatctttcatggaatattgaataactgaatagaactaacttgttatgcaaaagaactaaatgttgaatgccagagaggtgaataatttcagtagaaaatcttgattctagtctcaagagatgaagttaagattgtttttaacctgaaggcctcttgttcaaatgtgaacctcaaaaatgcatttgaatttcatagaggttctcattaaaactgaattttaataatattcattagtctttggtttaaaaaatttaaggattcatgactcatcataataaatgttagtgaaagactatataaaaatatatttttccaaaatgagaagagagaaactacaaaagcaaacgggaatatattgtaagtgatgttttgattacataaacgtccatatggacatctattcaaaatgcagagtattttgcacatatatattataagtcccttgaatgtattaaatgagcacatgcaatggatggcctcagcaaacatttattgaggccatgctttgtgcctgaaatgagggatgcaaagaaaggtaagaaagagtgatgtctgcatcccatgaactcattgcttagagataaaaatgtacacaatgtacacagacagcactacagaattacaagttaaaatgcaatgtagtctaggacatggaggagaaagaacctttcttaaaaggggaaggacaatttgtgaagggttcacataagacgtggcatttggctttgcttggattcattcatttatttgttcagtaaatattccctgagtgtctaatgtttgccaggcaggcactgcagtagatccaaggaagcaatgttaaacaataggccagccaccatcagtgcaactattaataatgtatttacagaaattaatatataattatactaatgggatacactataaatgaaaagaatggtatgctatgagagatcattacagaaagaattaatttagattgggatattgttcaaggaatagattacctggcaaaaaatgaggataaggtacattccaaaaaaaaaaaaaaagaaacaatgtttattcactcaaccagtgttttttcaagacaacagagatgagatagcactccttattgcaacagtagcttgaagttagcaataaattaaattttattaggctatgggtttttttttgtttgtttgtttgttttgttttgttttgttttgttttgtttttgacacagattctcgctctgtcgccaggctggactgcagtggcgcaatctcaggtcactgcaaccttcaattccctggttgaagagattctactgcctcagcctcctgagtagctgggattacaggcacacaccacgcccagctaatttttgtaatttttagtagagaccgggtatcaccatgttggccaggatggtctcgaactcctgacctcatgatctgcccgccttggcctcccaaagtgctgggattacaggcgtggactatgggtattttattatcattttataaaactttgacagcacagatttctagttattattaggtggtaaaaagattcagccatcaaaaacatttataaattaatataacttttccattgtcagtgcaataataattgttattataacacaaagacatggtggttagtatggccagtgcaaatttttatatagatgctggggtagagaattttcatatccttcctttctctcaagtaaactcaagtagggactactgatacaaccttttatactatgtttttaaaaaatttctcagcaggaagacatggatgattcagagagtagaatgtacagtaagcagagctaacagatgtcagcaggaaataggagggacataatcaatctgattcagctgatgctaatttatatgtttttcattcagaaggacatcttttcttcagaattctccccttaacacggagggttcagtttcttggaaaaggcaatttagtcatgttacataaaactgagtcagaaaacaatgtaagttttaacttcctttcaaacagctatggcttaatatcaaagtggcatatggtagaatcattcctaggattttgttcttgctctttaactaatagcattgctctggagcacctgactttgtatccgattagagaaagtcagggtagttttctcccagggggtgtaagaatgttcaagagttaataaggcaaaggatatagtggtggagctttccaagcagacaagcagaggaagcaaaatgtgtgaagccctaaggtgatgagaagaagcttccctgtgaacaaaaaaacctaaaagggccaatgtgacttgagggtacagaataggaaagttgagcctcagaaacttgcaagatcattggactttggaaagcaaaactcaccaaaaccatttaatcagagaaatgatttggtttgaatttttgtctatagccttaacatttcatgctttccactgttgtgatcatctccttaaaaaacatacattacattacatttgaatgtccctgtaccaggactaaagcatggccagtttgcctatttctactctcttcgtaattgatacagatcattcaaaagtcaaattgatcaataatgtccaaaaccgttgtcagcattacaacgatgaccacttgtttcatgctgtgtttatcttgacattcattttagatttgggtttgtggagaaaaattagcttctctgatactttgctctctagagctggcaataatgtccctttggactaaattataaacatttcacggtccttaggataggaatgttattttacatatccatgtaagaattcttttatatgcttttaaatattcttttgaaatgtatgtagtactataaactctaggtgtatttatttgaatatagacatatgaatataaaatctcagatgttaaacagtttgagatgtttaatgttttattaaaaagacaaaaacatagcctttgtaggaatagaattctgacttgtcatggactaaagatactttggtttcatgcttcttaacattctgtggttttattttttactattgacaaaaatgaggtaataatttttgtttagtgacttcctgaaagagaatcatttattaagcgttaatatgtattattactttttatgagagaaatattatctaattttgataattatattttatcaaaaatgacttattttggcacatcaacaaacctagcagataaaattccacgtttttccctgaatcagatcataataccattaattttacacttgcattatttgtattaattaaataattacttatttgtgcttattaggttattaccattggaaaacatgttaaagggtaccactacatcattgcaaatctggtaggtgaattaattggtatatattattttactagatatgcttatttattaaaaatttaattttgaatggccagcatttatcagtggtgttttaaaaaatacagtttgattgtaattagccaggtgtagtggtgggcacctgtaatcccagctacttgggaggctgaggcaggaaaattgcttgaatccagaaggcggaggttgcagtgagctgagatcccaccattgtactccagcctagtgacaagagacaaaccctgtctcagaaaataataataataaatatagcttgattatatttgatatattagatatattgctgcaattatgttttagaattgcttcccactttgcatcttctaatcaatttcttattattataaatgatataagaatttatagaacaatatttgacaagcttcataaattgtcttagatgctgtattttaagaaaagggaaaattctcaaaaatatttaaagtttaattgtccacatattcccttgtctctgtttttcactgtctctattttttataaactctgccctctgcatattcctttaatttttagcatatataatatctgaaataaatgtaaatttgtgagaatatgtcttagtatgaaattaaacctgaaaaaatctagaatattgagatattatgcattatttatgacttcctacttactatgtaagcaaccaaatgaaaattaaatttctgtagccaatcatctttttattatgattcctgtcaaaataaggaccacttaatcacggcttcttgggtttgtgttttctctgggccgtggtcactcatattggctcagaataaaccttttacaattaaaaaagaaggtagtatactgaagcaacagagtagttaattctatttccctcttttaagcatcatcagagtcaatttagaattatcactagaaatttcttttttcaaaataatttaagcctttactgctacagagtttaatgttatttaaataattaagatgctatgtgattcaggatcactatacctctacacccctgtctcacccaagaacaagaaaaaaaggtgagagaaagagggagagaggcagagagcttattttaaatagcataataggactttgaaaagcttttgacatatacaaatttaatgattcctagtgtatcacattgttacatcagaagacattagttctagtggtgacagaaagagataaaacaaaacaatacaacatttacagccttccaactgataaatgttgttttcactagaagttgaaggaatttagaatatgaaatctcaaaactgcatgctattgggttgctcaagacaaaatttctgtttggcaatgaaatgggtaactactataaaaattctctaggactttcctttagagtgtattaagatgctaaggactccctgaagagaaacaagagttaaactagatgaagctctgtattcagtctctccagaaccacattatgtgcaggaaacagcctggacagtcagtcccctgtgtgaatcgtgccatttgatgaacaacacagagccacattgaaagctgtgatctttaaaaatgtacagatggagaagattatatttgaacattgagaaataatgacagaaggtggctcctcaatttgagagctgatatctgatgctattaaaatgaaaataagtgtttgaatgaccaaattaaaaagaaaaagaaaaagcaagttcatgctgctgtcatgcttcttgagagaaaatctacctaatattttatctgaattcaagtcttgtttttctttttctcaatacttggtttctttgccatatggaacttctagtgaatcaataagttcgaaaggctgtatagtgttgcaatttctgagaatttggaggacacttggaaattttactgacattcaaaattaaacaatgccacccgaagttgaagggctttcatcttccaaactcttgagactttccttttcttccccctgtcaggttgtaatgagttctataataggtgtttatagaagattttttaaaaatctgcagataatattattgattaatttccttaggaattgctgaatgcttgattgggctcctaaaacacagtgtataattaagtcccttacaacagcactgaaaagggtaacttgtaaataaggtgatgaagaagtggtcataaggaaatccagttctcatttctccaaccttactacccttatagatttaattctttaaaaagccatggttccataatgaattccagcattaagaaaggggtctcctagaaattaaaaattcaagaaaaagttgaaacaaattacctgatatgtttgaatattttattttctaaaaagctttattcataggcatgaaatgttttcatggaagcactggaaaaaatggggataagcatatagaaatctctagcattgaaaaaatgggacatgattataaacatgggctgagatcatgttcgagaaagaaaatgcaattctagtacactatttggctttgctctgaataacatttagagttataagtactgattaaaatgggtgagaagataaatggttttgtcatgtaagcaaattacatactcatgtgggatacacaaaaactcaataaaatttcaaaaattgataaattaagaaagagcagtaaaagtgtcatgcagaagtaagaggtaaatatgtgaaaagcaaatatattaaaattgaatgttttgaagcaacttaactggaacatacctacggtaaaacagaatatatgatttttgttatatacctttttgcactatttgcattatcttgataaacagaaacaaaattgtgagccaataaaaagtaattaccttctccttcagctaaataatataataatatgcatgttttaatatcaataacaaagaaaagattctcctaagttttggggtgtggtaattcaaaattaatttaggatacttttaacttttgtgtacaataagataaatatttgtgaaatgtgaaaacatttataattgtgatatatggaaattaatttcatctttgagagagatatactatcaagttgataaaattcatgtcagcacaatatttgaaatcaatgtaaatatcacataatagttttagtaatgactgaattcattgcaataacacaagagaaatttttttttaagatttaatatattctataaaattagcttctggctgaatgtgaaattgtttaattgttctcaaataatgactggacatttagtacctcattttgaagatgttcctatcacctgagtgaagaagtaattcaaacaggagtaacttgctcacaaggttgtagttcttcgagaactactttaatgttattaagtgtctgtaaccacatggtggttctccgctgtagaccaagtaagtaaaacctagtccttatcaatggaagatttctcaatagagtggagaacatttatgtaggtacaaccatgagtgtttcatgagatgatccatcagtaaacgtgtattgattagggaaccactatgatgctaatgtggggttaggtgctgatgaagaacactggctgataaatacatgggacattttctgcaggcttattatatctcatatgttctttgaaatatctaaaaccacaatgtatagagttatttggtaaatgttaagtagcattttgttctcaaacaaaaagcgtgatatcaatgtgttctatgtttagggatttactgatggagacctattaaaaatccagtttggaggtgcaaatgtctctggatttcagatagtggactatgatgattcgttggtatctaaatttatagaaagatggtcaacactggaagaaaaagaataccctggagctcacacaacaacaattaaggtttgctttggtttctgtcttttctttttctttcatatgtgaggagagagaagagtcttggcaaataaggaggaaggagaaaataataaagggagtagagagcacgtttcaaaatatggcaaacatattgactgctaaatatatttttcacatttttatggtttaagtaaagctattagagctttactgtattactcttgtgttttctacttccgtacacctatgataatttataataaataaattcattcatttattaatccatttggcatttttattgagtggattctgagccagacacttttttggcaaataagacagggataatgtccctgctcacagttgaatggaataaagacaaaagcattgacagaagaatgccacgagggaagagaacagaaaactcttagcgacatggagggggtagggaatttttaagctgagacctgaagaataagggacaattttaccctgactgctgtttagaatattatgtttgcaaataaattaaagaacaataggtgtcagtttgttcctaatcttcaaaaagccaacttgcagacagttcttagttcagtcaataaacgtatggccacaaagagagagagagagaaagagagagagtgagaaagagagagagagagtgtgtgtgtgtgtgtgtgtgtgtgtgtgtgtgtgtataaaataacagttgatgagtagcctggtctcttgaacactttaaaaagaagataaaaatctcaatttgccttaataattaaaacataactgtaatgctttatgcaatcaaacaaaaaattcttgaacgctaaatattatttgttcctcaggtataagagctacacagactgatctttgttctccatgggtttggacacaatgagatcttcacttgtttatttgatgcattttattgggtatacacatgcgtgcatgaatttacttccaagtagtcaatatttctgctgttgacaggaaggtatttttccttcagttggtaaccttattgagagcagagttaaaatgaaaaactggctaagggtagtttaaagagtgagtgggttgaaagttaagatgatgttcacattctttatgaaaattaagagcaaaagttgaaaaattgtatagtaattttgtttgtgaattataaagcaattgtatatgaaccaggcaggacagtgttatttcagttgctctcacagttgtacctgagtatgcatcatagagatgttgtttgatgctaggtgcatgactgtctatgagattggtcctagaaaaggattagaaattttgaagttctttacttttggatttataaatggatcttttaatttttaagtcaattttgtaaaagcattccataggattttaaagaagaacaccaagtaactttttttcaaaaacgaggtgacttcctatttggtgactttagttgagattcagtatttgtggccgggcgcagtggctcacgcctgtaatccctgcactttgggaggccgaggtgggcggatcacgtggtcaggagatcgagaccatcctggataacacggtgaaaccccgtctctaccaaaaatacaaaaaattagccgggcgtggtggcaggctcctgtaatcccagctactccggaggctgaggcaggagaatggcgtgaacccgggaggtagagcttgcagtgggccgagatcgcgccactgcacactccagcctgagagacagagcgagactctgtctcaaaaaaaaaaaaaaaaaaaaaaaaaaaaagacatactgtttatatcggggaggtacttttcatgtaacgaggcttctgagcaggtagatggatacccagagccttagttggtgtcagcgtatgtatccatctgtgcctagaaggggtctaactgccgatcccattctgtggaattgcaggcttccgtccattcagagatggtgccatgtaagttctctgatggagtggatgttatcctcaaatggaaccagcatgctcctttcgaatattctgttagtcattgtgttgcccccaactgctgcctgctaggagaagcatgaaagcaaaatgaaattatgtttttctcctagaagtcgtatcatgattcaagttaatgtgtcttgcattaaaatgcaagaggtatttgcagtgtgagagatgtttggcaatgcattctgttaaaaattttgccaaaactagtgccagatttcactgagttgagaacctgcattgtgacctttcttgctcccttcctgctgtagcatttcccctccataatgcctcccttttggtggcttctgcccattttcagagagatcattatgcttcttcacggtgaggtgtttcagagaacctagactaatgtgttttaaaacttaggctgtgaatcactgtttgaccctgggtccaggattctcatctgtacaatgcagtaatgaccattaattcccaggttgctgtgaggattaaataacacttgcaaagggttagcacagctttggaaacataggtgcctataagggctaatttgttttcccagccatttcctaaaatgagagaatttcagccaatttccaaggtgtattccaactttaacattttataatccctctaactccacccagaggcatattttatgaggtccctgaagctcaataaaaattactgaaaatctgtgaggagaatgtgtttggggaggaagtttatcctaacaaagaaatgcattgcttatgtactagaaggccagaaactaaatataaataaatgaaaaatgtatgaatcctgtctttgagaatccagcctaaagaaggagacaatcatatcaatcagcaaatataatagactgataaaatatgccagtttcttggccatgattttgacaatgtttggagggaaggtcaaggaaggctttcatgggagggatgcctgtgcaaggctttgcacatggttgagaaggaagaaaagtgtgagaagttgcttggggaagtgcaaaatgtacagagactcgaagtaaggcaacagcatgacagatccagggaactgcacatttgttgctactgcaaaaatgtaaatatttgggaccagtgaggagggaggtcatgttatggaagttgcaagaggtaaggtccttaaattgtcaacagatgtggaaggtagtaacaagagcatgctttcataattatttttgcttccagacagaagagaggaagaaaaactaggagattatatagcaccctctaaatataaacaaagaatatagtctcaatatattatttgcttacagaaagggagtgaaatatttctaatgagattattaacaatgaggttatgtcctttgatgttgtcttttgggtgatcgactgaattggatacattgcctgataaattcatatcacattttactactcaactactcaacaataaaaactagtgctattggcataaaaatctataaaaatacagttcaatacaccaaattctttccatagttagggtttaggaattatagaaattatatcaaatcgtgggagtaataaataaatgattgttcaacgttttcatcttcccctaaagttaaatcagcttccaaagttttcaaattaaaataaattttattcagtaaataaaaataaaatgtaaataaggtttaatatttaacatattttaataaccaccaaatataaattacaatgtttaaatttcttcattcttacaaactatacaaaaaataactaaagtcatggcactgagattttaggtctgattcccttttactaatttgctatttggggcaacattcattcattcatttatgaattcatttatttactcaacacatatttattgtctactccacagcaggcactgttctaggtgtcagagaaaagacaaagttctggcccttaaggagattacagtcttcagactagaaaccaacaattaaattgtagcattgatggaggttgtcttattgccatcttaaacttatatattcaaaactaaacttatgattttcctcactacttcctcctcagcctctggaaactattccttcagcggtctttcttatcccagttgatggcaactacgtctttcagttgttgcttagaccaaaaacttggtcctttacttttctctttctcttgtaatctacatcctatgaatcagaaaaccccattagcactgcctcacttcctaccaccttctcttcagccaacctaaatccctaggtagctaccaccataggattattacaacagtttctaaaattgatttccctccgttcacccctgcccctgttatcttccatccttgtggtccttttagagtataaatagattattttgtggttctgttccaaatgctccaatgtctctccatttcacttggagtaaaagagccaaagtcatcctgttgtcttatgaggccctgtcacccagtcccatggagccacatctctgtacactggctcactctgtttcagccacattggcctccttgctgttcctcaaccaacctaagcaacttcctactttagggcctttgaactggctgtttctttttcttgactgttgtccccttaaatatttgcatggctaagtctcctgcactccttagatctctttcaaatcctgtcttctcatggaaggcaatagtaggctatgtatttaaaactgcaatcttgccaccatcagggtttgtgcatcacccttccctgatccagctttcccaattcttaccttttagtttactgttcttatcatttatgtattcatttcactgttaattatctcctcctacttgaaagtaagtgccatttaaaaaaaattcattgatataactcaggctcctagaataaatcctcatacatagtaaccatctaatagatacttcctgaatcaacaaataaagaaaagcaaaggtactgtggtatcacctatgagaagctcctaatcctaattctagaggtaagaaaaggcttctcaatgggagcaatatggaattggagacctgaagaagtaggagttaggagaaagcataaggaacaatgattccagataaaggaactaggatatgtaatgtctccagtgcaaggaaaatataaatatttccataaggctttaggttgaacagaaatgatttgaagaaatgctgagaaatcatactttagaactgtgtatgatccagaagttttatgccttgttgacatattaaggatttcttgtctaatttgaagagcaacagggaactacaagaggagagtgctgatcatggctttgatacaggaagattactatggctgccctgatgacaagagattgcagggagcgctggtggaggcagggaagcttttggaagatatcacagtcagacaagagacaatggttgtcttaattgtggttgtggcatggggatggagggaaatagatggatttgttacatctgccttttctcttaatttcttcataaatgaaataataattgtaaaatcgtaatcattcataggtaatatactgatataaattcagtcaagagatatttgtgggttagaaataagcctttcaaaggaaatctggctcatttgtatcttattagccttaaatctcacacagtggtttgcaaagagtaagcacactatagatatttgtagggatgaagagtaattatttggaaaatattgaataagtaaaggaaaaaatataacattattattgtgatgaaatatgatttagatttctgccatagatttctgcatgtgtcctcttattgagccctgacagaaaagcaatgagttactttagttgataaaatgtaaagttaatgtagttatctgacctgacccatcatagcaccaggatttacatgggaatattaaaacagtcattttatcttccttaaaagtaatttttttaaagagaaagagtataaagatatttcccactatctcaaaaataatttatgaatatttctatttttagactgatttttagtatttttaatgtctccaacatcgtgtaaggtatgactagccattctaccttatcacatagtaacctttgttcaacttttgtgtcttcagtctcctactggtgttaaggaattcaacaataatctgtggctgacatttgtgtggcactttaaataatggctttcccacaagaatctcattttattcaggaaacaacttcacacgcagactcaaactttcttaattgctgtcctaagagagttattagatctgcctgaaaatagtataatctttttcagttcagtaattagtgtcgtgcattaaattgtaccctagtggcctaatagaattaattctgcttcttgagtgttttaactgtccaaaccacagctggcagactggcgttcactcttcctaatattacagcattttgcccaacacaacctggaagtttgaaatttgacatattaattccttgtattttatagtttaaaaagtgtgtaaatgactgaaataaacttataaattttatattgataagattgtttattttgtaaacatgaattttaaaaatatgtatatcacaccattaaaaataaaaatgtgttattaatatttataatttaattcagggcatctcacatcttattttcatatttctttatctgtaaagggaacaagtgtaggtaaactcttaggtttcctgcaaatctctaataccatgattatgtgaagtgctaacttaagccctcaataaaacattgttaacatttcaaatttttgccaaatctctgacatctcaagtggtgcctctgtctcttagagattgtagtgacttgcaggtaggcagacaactctgatctccaggtgccgaaactgaatcctaaattactctggacaatgtatattttgtttttcatagatcataaaaaataaagaactttcaccttgttataagatttctaggaagtggagagtcagggagagggatgtgttcaaccaacaaaataaaagatctgcttctaaggaagtctttacctatggctgaatcaaaccagacaatgccttgatttcagcatcttttttctgtcttggtgaatctgattagctttatctgaaaatttgaattcttaagtaatctaaagttcctgaatataaaattcttaatctgtaagattttcagtaaagattaatagccaatttgggtaatttaggcaaaaatatgttgttttacatttattccttttacctgaagactctttcttcacagaaaattaaaattattttattatttatggagaataataaaagatgttaatttaggtttcttgccaatgcagctcccttttcacccttggaaaatgtgatagagcttgtgtgcttactaaggtttttatgaagatttttatgcctttatgcagtgaagtttcaaagggcacatattcaatatgctttacagtaaattaaagacgaccttatcacagacagctcttttccatagggtaaactgtagttgaatttgaaattaagacaagtgaataattttaagtttataatacatttcctcatactgttcatttgtcttatggccctatttgatttggtcactgttggttatcttaaaaaaaactttcttaaaatttttcttatagatttacttatctttcctagaaatcataatttttgaccctgttttaaattattttgtaaaaggatgaaactgagaattaatattgcataagattctccagaggaatatcaatcaatgtataaaaattttttaactaaataattgaggctattttagaaatgagtacgtaaaatgtaccaggccataaaactttttaacattccgaagtatgttacataaaacactattcttatggaaaataattgatgttaaagaaatttcaaaattggtcattagtttgggaaatactaattaaacagttaaactgttattgcgggatttctgagggtctataatatgtcaatgtgaaaatcattttctgtacttattagatcacagaacccttttgtgtggagtgagatggtggttttcaaaacatggtaaaaacaaactagttttgcatcaagatagatagtaacaaaagaagaaaataatgcaaacctactggtcaataacttacatatataacatattttacaactcatcaagcttctcacctactatacatttatttgatacagtatttgccaaataaagtaactaaccatcccagtgtacctgggattgaaaaggttcctgggactcaagacttttccttgcaaaattgtgacaatcgaggaaaaccaggaccattggtcatcataattacctcggaatcacagagatctggattcaaatccacttttgccacacattttttgtgaagctgggtaaaatgaaagtttataacctggaatcttcacctatagaattggaataaaaacagtggtggcatagggttttttagacttactgggaaactgtctacctcaggcttgtcacaaagagaacaaggtaaacatgaatatttttccctaccttccttttcaacgctcttgtaacatagacagaagaagcattgctctccttattttactaaacaaccttagacaataatactttagttcacttgcccaaggcaacagaacagtaaataataaaatctggacttgagccttgtcttctgatgctaaatgcaatgctttctaaactatagtcaactaaattcaagtgttaaagaaaatttctgaaagtcgccattcatgggaaatatcgtcacactttaatagtacttaaattttagtactttttctttgaatatattttttcaaaattttattatgatgtagatactatgtttagaaaaaggtgcccgtcattgtgataacccatgaaaatttatactgtagcctatttatcctcttttatgttcattaaatttgagctatacacagaactttttttcattctccccttttttggtgttagaatactgttttctggtatcagagatcacagtaatgtattattgattggtttggctgatgactattggacataacaaacatgtctaaaatgcatatttcattttatttttgacaaataagtctcaataaatatacatttaaagcaaagtaaaaagcacatttggaaaatggactgtaaaaacgatttccctgattttttcttaatgtgtggctatgacgtgattgtgatatagcactgcaaagcaaaatggtcctccactgaaatataaatttccaactcagctgagggatttcacagaacataaacacaggggcagagatgaagcatttgttttcaaaggagatagttacattgccatcatgctcctttcaaattaatttacatctagtttaatgaatggtagaataaaactgaaatatttaactatccaatcaaaaaatgtgaacatatttgtttagaaaaataaatgagccatacatgcagaacataagcaaaaaggaactctggaaacagaagctgttgatattctctcaacccagaattgtgtttctatgattgtgacttttaatttaaaatggtaataggcttaagacttgattagttttgagcatttgaaaaaggttgaaaggatttttactcttaatgtgtgcatgctctgaatcatattcataatatgctacgtggatctgaatgctttcaattctttcaagctaatcatattttttttaatgtagttaaccaacatttgtagacctcaaacacatttggtagacggctttatagctttcccttagtaatgtgagcaagctaagtcaaaaatgttggctttttgctatgatcataatttccatacaaactgcaatattttaaaatatttgacttattcaatttagcttacatttctttttcagagacctagacattattgtaagaattatcttggcaataaacttatcactgtataaaaacaaattaatcaatttttttcctttagagtagaaacaaacatacaagtgaagcagatatatcttgatgtgatatttcttatttggttcaagaagtcttttattaagtagatgtcctgtattgtcatctcaggtgaacaacagagtatggggagcttagtggttttactgttagatggcttatcttttttccatgacaaggaaggcaaggttttcagtggaatttagagaaagagaaatgtgtggaggtctcagtatttggagaagacaaagatgaaattatcatttttgagagtgaaagacctgaaatactaaggaactgagtagaattatttgggaatgctgagtacctgttttggattggtgatcaagaatttagcatgtcacaaagtcagtatggtacagtactgcatttttttctcccaagcttcgccgtactcttagtacctacagattgaaaaacaatgacagaaattttctcaacgttcagtaaaactttaatgtcaaaatgtagttaatcattaactgacagcatcatccatttggcaaatggtagtatagatacatgcacatactactacttatctagacactgacaatgccttgtacacatgtacctagggcttggccctagaacctgtaataattctgctgtcccactgggatctgaataccataagtttggaaccaatgttatcatatactattgaagcatggaggcatgggggcatagaaattatgaagttttgtggttcttctacttgattaccagaatcgcctaggggagcctaagtagacacccctaaaaccactgcagatcagtgtgaacatgaccagggttgaattagagactaagaatcctgaaagtaatccatattccttctgcattgacaaatgaatttctcattggactgtaaagaaatattaattgttagtcttatagttttgtatatcaccatagcaggctataaagtgaggctgtaacaagaagcaggttagaaaaaaaaaaaagaaaaataaacactgacacaattattatgaaaaggtctaacctgaaacagctgagatattaacataatagaaaatgtttagagtcaggagcacatttcatagtccccatgttttgtaatgcttctcttcgattcttaggtttctagatgcagaaattgtgtttaaattcttggacttttaaatggtattgtgtgctgagcaactgcagtcttgattgctggggtgcagtgagtttctgaattttctcccgttcttatgaaatgtgtgtgatcctttgcagtatacttctgctctgacctatgatgccgttcaagtgatgactgaagccttccgcaacctaaggaagcaaagaattgaaatctcccgaagggggaatgcaggagactgtctggcaaacccagcagtgccctggggacaaggtgtagaaatagaaagggccctcaaacaggtcagttactcaaaataatcgttaacgtgacttaatatggccattaatgttttcttcctgctaaattagtcatccttgtcttattccttgtgtctaatatacaggcaatgttcttttctaacaacacaaaggtaggttgaagagagaaacaaatattattgatgtagttttcttgacttcatctggttaaagtaatctgtacagtgtatatgtttggttgaagtaaatatataactctgctgctttcccatttcttcattaggttcaggttgaaggtctctcaggaaatataaagtttgaccagaatggaaaaagaataaactatacaattaacatcatggagctcaaaactaatgggccccggaaggtaaatccttagtgatttaaaggcagttctatgtgaggaggtgagttagctagcctatgagttcacccttccagagaattctggagatgtgtattcacatagagtttaacgacttccagaaacagatatattttgaagtttttttttcctaaagtctgtttatttctggtaagtaacattgaattgtaattttaaaaataattataggtagagctgttgaactttaattttttagactgaaggggaagtctttaatgaaaagagaaagaattattgttgaaggtttacagttcagaagacaaaaagtagctggtgcaaatacacatgtaactgttcaattcaacatcaaccttttagctgtttaggctaaaatgtcattatttggattttaattacatttctatatgaccactcccaaacaattactcttagaaaatacaaaaagtgaatatgaagagacaagtcatttttaggaatttttttatacttccttttattcctgttagattcacatatataaaagacatttctatttagaacaagtccagtaaatgtggttctaatttcagattcagacatggctttgaaaataattaaatgctttgctaatagacaagtcatttatccatacacctgtctgctgtaaccttttccagattggctactggagtgaagtggacaaaatggttgttacccttactgagctcccttctggaaatgacacctctgggcttgagaataagactgttgttgtcaccacaattttggtaatttgctacatatgccatgttttactttgtattttcttatggctaatatctgcaggagtagctatttatattttaggagaataatatctgttttgcttcttttgcaatgttttaatcatttatttcatatttactctgttaaaaggaatacacaagatctagctaaagcattgaaaatgttccccattttctttaaggaacgctacagtttacacagataattcctaccctggtgcttacatcggtgaacaattggggaatgtcttgaagagtgttcctcatgtttctgcgagttattcacctttccattcccacccgatactgtgtaaattctttctttccctttgttacatgatttcatgatgatgtcaagttgtctttattctatctaatgaaagatgatctccttaaaaataaggattatttcccttgtttttactccaaatttcagcactggttggcacatagctagtacacaaaaaatgcatattgaatgaataaggaaaaattgaactggatcttcaacacccaggctttggatagatggaagagagatgtggatcagcatgacaagctgttggtgaaatgaaatggagaaaatggtgttcgttataggacagaattttgtgacaaactattttgttgtattttcttttacaaaaaaaaatgggcttagcagtgaagttgtaaattggtgtgatttattctcctaacaatattgagagcagatatagatagattggtaagggatttgaattaaaacattagtaggcaattgaaaatctcttgataagtgcaaattagacatttgaggatttttgcctttatcatgccattgagaggaactatctcactgagaccccaaatatcctcagtgccactttccaatggagaatattggactgtgttgattcattttttcttgcttcctttttcttatgtttacagggggaagctactctctagctatccttgtagcatcattctaggatattgtatctcacagatgaagtgagacctgaagcctgcgggggtagaatcagtacatcatcatgacaatgatcctgtcagtttgtgtatcactgaccatgaacctgatttccacatgaaccttatctttgggacagcagtgacacagggttttgggtgaatgctggttttgggattggcctaaccttaatcaaggataagggtgtggtgaatccaaacttgaataaaataggttttgagcagtaatattttgctctaagtcctagcagtgacaaacatggctagagaacatacaaagagtttgtggttttgagtatcttgttaactcagtatgcttgcatacaagccgtcttaatgaattatagtgatagacattccgaggctttctggggggaagcattatgcttaaattattcctctactgttgtgtgttcaccatctatattcttcattcactctggctaatgggtaataattaaaccagaagatttgattcaatgagagtacataattaacacagatattttaatcagctaaagcaaagtcttttcatataggaatctccgtatgttatgatgaagaaaaatcatgaaatgcttgaaggcaatgagcgctatgagggctactgtgttgacctggctgcagaaatcgccaaacattgtgggttcaagtacaagttgacaattgttggtgatggcaagtatggggccagggatgcagacacgaaaatttggaatgggatggttggagaacttgtatatggggtaagtatagctcttctcatagataaagtcattcaatttgaattgttgttgacagactgcttcctctccctgtgaagtatctatatctgaggttgttgatttcccacattactctagaaacattatcttgttgatttgtgaacatctgaaagattaagattgaagccagaagtagacatgtagattaactgagacaagcatttcatctctcttgaagcatatgggccatatgtattgtcaaaaggctgcaaatgcatggatgcagtgcagatgtgtaatgatcatagtcaagccagctgggtatactgtgtattcataaagaggaggggcattcggggaataattcctttttgtttatcctttactgggactataccaaggaaaaaattattgtcatttttctgatttcctctcctttttctttgatccagtgacataaccacgattcctttttcaccatgactccaggtactattactttcctttttttcccttacagaaagctgatattgcaattgctccattaactattacccttgtgagagaagaggtgattgacttctcaaagcccttcatgagcctcgggatatctatcatgatcaagaagcctcagaagtccaaaccaggagtgttttcctttcttgatcctttagcctatgagatctggatgtgcattgtttttgcctacattggggtcagtgtagttttattcctggtcagcagatttagcccctacgagtggcacactgaggagtttgaagatggaagagaaacacaaagtagtgaatcaactaatgaatttgggatttttaatagtctctggttttccttgggtgcctttatgcagcaaggatgcgatatttcgccaaggttggttactcacctgcttcaactttgtgcatttcaggtctcaagtggacattcatggtgtttatggattcaccctaaagaagttaccagctgccgacttcctgtccaagcagtttaagactcttgaaggacatcctcttagcttcggcataagtctgtgaaatatttgaacaatgttctttgaatgttgctcatctatttctctggtgaaattatacacaccatgaagaggctataaaatgcataaggttcctatcattccatgccttcttggaggggtaccgtgtttttgctgcatattctcattttacagtcatctgtgtgttgatccacagacctgtatatgggaaaatgggcaacattatttattaactgcaaagtaacaccttgttagataaaacttcgttggcacacatctcatctcttttattttcccatcattagttcatggaaatggtatgggagagatattataaaatttattttttttctaggtgaggttgctggattaatataatagcatattttcaactacccacaaatgcctggaagggactaatcattcattaaaaaacctgtccatatcgaatggtaatacacacacacatggaataaactcacctacctttaatctcattatgatatgttaaatccctgcactagaatacctaattataatgaatctaccacaaagtacccattgattttattcatgttgcacgtatgaataagaatgatagccatgtttggctcttcagaggaataaatcatgatttttctagtgtgattaacattttaagtcaaaatgattatcactctactggcacattttaatttgggctctattacccttcttcgattttacaggatatcttaataactagtggagcgggtgcctttcatgatacaattttattatattgtaaatttttaaaatcacttttgagaataacaagtgattaatttaagaaaactgtatgagaagctcaaagatttgcatcttttgcaatctttttagtatatttcactgagtaagataaaggaaatacatcatgtagccagaaattatcagtagcttacttctctgatagtaggtaattatagtgggaatgataaaaaaaaattacatttttatgaattatacagattttaaaaatttcagttccaccagattccctgtgacttccctgtgggacttcagtgaattagaaatatgccaatggaatttgcacagcatgacatatgtgtgtatatatatgtgtatatatatatatatatatacatatatatatataccatatatctcaccgtactatcgttcatctcccacaacatatataagattcatagatatctcatctctgtatacagtatatttgatctcagtcagagatacacagagacatctccaactaatcggaggcaacactccccaaattggggactcggccaacacactgacccatcacatgatcaagatgtggttctccccatgctcagacgcaccatgagagtcgcaaccctcgctctgaccgtcacccaccaacctcctgcgccatgtcccgcaagcactcccgagacgtctccgcggccacctacgccgccggctgacccaccccccacagacctcggctccagtacacgaccgcagcacacacgatcccaccgctcgtactcccccacggcccacctcagtcccccggcaaccgannnnnnnnnnnnnnnnnnnnatctttcacttatgctatatatgaattttaaaattcaacataatacattggaaaagttaatgatttttaatgaacaaaactatcattttttaagaatgcaatgatggttaccctagttgagaagaatacagtagcttattatcatttttaaaaagcatgacatccacagatcactttagaaatgtctttaaatattaaaaaaattatgattcttttccaagtaaaatatgatatgaaactatattattaatgttaataggacacatttaagttgtaatctagagttatttattaaattaagtgatttctcatttttctgaaattaagtttagaatatcttatctataagacatggtctcatgaagaatagaatcacagaaattatgagagcaatatgctgtaaaggttatttttattgtcctgtttgcttctggattgtccccaatgaccctaaaggaatcaaatgaatataaaaacatatatcatttaaaaaatgatttagtagggattaaaaagaaataagagcatatgcacatttctttattcctttagtgctgatgctgatgggcgaaagttttacttttaattgtagaagtaatttttgtctgtcaccataaaataatattgaatttccttctctgcataatttctcaggaactctttgagaaacatgaattgatactttaaaaatacttaaaagtaaataataaatagttgaagtacttttcacctttgaattatttataagtccaataaaaatttttagatatcatgtacattttaaatcagttgacatattaaatctgatataaggactggaatagaggacaacttacatctaactttccttaatttttacaactggaatagaatgacacaaaaatgattcttaaacgtgtcataaattaatacgcaatatgtagagtcaaaagcaattaccatgtaatcagcttttgttttaagggatttgagcaggcaggtactgaatctgcgctcttaaatatatgatatgtgtcatataactatacttcccattgatattggataaatagtgaacattttgagagtgattttgtctacataaggcatttttcaaatgtaaaatatatttaatatccttttcagaatatatgtgagaagtgtttaactttttccatcctttcatatttatttttttgtatttcatacagactttgtgataaagtcccttaattatattctttttgttatttcttgctatttttctctctctatctcctttattttagcaactgatgtttttatatcaaaaaacttttcatttaagttagcttctctcctttcttaactgcttgagtggtttattctacaaatatttcccaagtgtttgatctagaatatgtttcatcaaaagatttatttcttactgttaattgtcagaaactttagatcacaaattgccaatcatgatctaaatttttagaactatcacttgttcacactagcaagtctaattgttagacatagtagagttattgacaacagagaaacggttagttttattggtttgtcaatatcacttaaatacttagttacgtgcagaatcccatcaaatctttcaaaataatacagtatatatctttttctatatctctatacctgtattcctctacttcaggttttaaagtaaattattgggtatctattaagcttttaaaaactattttatgtaagaatttgtagtcagaaaaatattgttattttattatacatcaaactagaaatttatgtcttcacaaacttttaaatgtctaatttgttttctttgagttttatttttttttgagcaggacacataaaggaacagggtcatagccatccatactctgaagccatctgatttttattcattaatagttatattttgtgcggtatctttgcttgtagcattattttttcctcatttttctctcctgtactgtatctaatacctatgttttacatacacaaaattaacaaaatttgaggccttttttgttttggaaattcactgattgaattaaagggaggatttctttggtgtttaaagttacatctgtggagtatgctttttttaatttttgattttgttcataaatgttgttatgaggtttgctggtgatattacattctcttgtttatgtttacttacatcatgagtggataaacttttatgagtatttgtaaatttcttgaaattgctttcttatgggattcatgtcataaactatttgggcattacaattatgaaagtattccagaaatcagaagttttgacctgtgtgtatgttattaaatttagctactctgtactccttgcccaaaatgtttaatgatttccagtttcattaactagtagatacattgaaaaatataaaattaaatattcccctataagtcaatatttgcataatactgctaacttgtttttttattaggtcattcatttcactttacaaatccatttcatacttgttattagatccctctctgggcgcattgttggaggtgtgtggtggttctttaccctgatcataatctcctcctacacggctaacttagctgccttcctgactgtagagaggatggtgtctcccatcgaaagtgctgaggatctttctaagcaaacagaaattgcttatggaacattagactctggctccactaaagagtttttcagggtaagagattctgctttgtagtttctgattttgttcctgaaatttaacctatttaaactttgtttccctcccatagtcaattccaaggtactatgtgaaagcacccctaattctatttcttttcttgactttgtctctgtttctgacccttccctatcctgatacttcggtccagctctagtttctgattcctgactccttaggagaaaaatcacaatgttgcaatgaaatctgttttacaaaaattgattgtccttttggaacaaaattgaagcaaagtatagtagttaagtttagattattatgctttcagcaaaacatcttatttttatttgattttaaataaatatgactgcatgtatcttacctagtttataattgaaaaactcacattcaaaccaattatgttaattatgtgtgaggaaacagactatgttcatatgtgtcgattctgaattttctgtgcaaagcttccaaggaaaagccaacaaaggctctccacttcctaacttttaaaatatgtagtatatttatactgtgtctattagatgtaggttacttttttcttttaacttttgttcttatgctctgtttataggataagcccaaggacctgatgttggcataattttctttctttctactattgtgtgtataaaacaactctttctatgaaaatgtttaaatacagctgattaacttaggtctgaagccaatatatgtgacatataatggtctctgataatctacaaatatattcgaatatatctgagtttcagtgaaatctagtccagcttattccggaattaggattaggaccttcaaatggccatcaaaatttgaagactatctcatgctacattacctctgatctcttttctgaataacttcacttcagctgaagatactatgggagaaagggttctgggagtgggggtggtagaaccatggctaataacagatagtaacttgggtgtatgtgaagagtccaggaccttgatgaattaattaggtacctcaatataagtgcaaaaatgtggaccatcagcagctttttttactttaatgcagattttagaatgaatcttgtaatgtagatttcttactaatgaaaatgtattatcatttctaaacatatatgcaatatgtgtatgaatactcggtttaaaaatgtatgttcctcaattagaagtgcatttgaaagcatttttaatatttgtatgcagtgtagcttgcttttatcttatttggaaaaatgaggtgctccctcttgaagtaaatgagatctatgagaatgatgcagatgcctgttataacaggatttacttggtgctacttatgttgattaaaataatcttaattattttcagactctctcttccagttgagcatgcatctatggagagtttcagttattaccttgtttggacagtagtagtgtcagctacttttcactactacacattcacattcacaaagcttttcagtatatcttcactgagtcaatcatagaaacacgtgtcttaatcaccaaggtgccagaattgtatggccagtgtattcacattccctagtagacaagacaagaaagctagttgagtttgggaaaagaatgttgctactcttttgtttcagtgcactaacttcatggagcccatttgttccaatatgcaatcgtggaggttgtataaggttgtggagcttttcttccctagagtaatagagaagtgatgttggatagttaggcaaattgatgacttctatctatcagtatagctccccaaagaagtttcttatccattacctcttttaatctaacaatatttctgtctgatagtcagggcaatgatttttgtttgatatctgtgcattattaaacagaagctcagatattttggggtatttgatcacattcatgcaactaataagtatgctgaggtcttttcctcctagccagggttctttccatacactatttttcctcgtgcagcaaaatctctggatttatttcactgccttcatgctctgttcttggttacatccacacttgtttgtgtaatgctagagacacggttgaaacccaagcaagtcctcacagttcctctcaaactatctccaaaaggaactgttgatgaaatgacattggctaggtctcagtgcatataatgttgtagtgagcgtctccttatctagagaaagaagagtgtgggctcaaacttgtttaaaatcacattattctgtttgtaacaaaaaagagaagccaataaaacagcatgcatcaccaaagagaataggaactgtatatgttaattatttcattgaaatatatgacacggttgcaatttgggaaattatgtatataaaagttttgtttcttcaagttgaattaaataaaaatgttgctagttcatgagtaattttgagcaatttttctaactgtattacaataatatttgataattagatgccatgatgataatagtaaggaaaatattatttttgcttctggttctcaaaatgttttctaggatactatggctttccaactgtatccatccagtatcatacctttcacacagagttactgaattagtatagggaaattgaataacagattccctttgagtcaataacttttttcatagaatgttgtataaaatattgaacaaaatgaagccaatttagagacattttaaagacaaaaatatttgattttcattaatattgtttccttaaatcatagggtcaactgtaatatgtctattggctgtagtgtggttgaattactgactttctgtggaaaaatgtggcaagggaaattcttgtttctattcctaaaattaacattcaccacaggtcttgggttcatcctctctcaactttcctttggtcctaaggaattttggggcttctgtgtaaggtagatacagaacagagtgaaagctgacagactgattattatggtgcccagcctgaccaggaaagggttatgggtgaagtgggctaaagccaggctgaaaacatgtattgcttactttgttctctgcccattcattatgcttacttttggagccaagacccagtaaaatagcagattacacatgcaataatacacttttaccacttgctaatctttaaagttctaacatttatcttcatgttttgtaatgtggcttaatttgcctttagtgatagctttttcctttttatactcttttataactaggaattttattagttatattattgttaaattttctgctatcactgagtttatcaagtcaacggttggttttcgtcatagccagagatttggatttagcatcgcagacatggatttgagaagttaggtcattgtctacatttcaaataataactaactgaaagataaaaaatatgttgagaccatttagaaattaatggccaattctaaaatagaattcagaatttggaactcctagtcttttgtctcaatgttaattgtttcataaaagtatattcttgttgagataaaagcacttcatataaatttataagatgactattttatttaatagttagggatctgttttgtactgacatgatgtttttctttccgttaaagtctaagatattttcagatttcaggtaaataatagcaaaccatattatattaatattactttagtaaagtcagtgagtatgtaattgttggagaagttcaatttaagctgcagattttctaatttaaaatctatacttttcttcagtgatgatcattaaacgaaacattcatgaaatatttactttgttttgcttgaaagagagagtaaatggagaacaatcttgtaaccaccaagagatgtgaggaaaattagtctatgtcttcattttctgcagttttctgtttatggaacccatgcacatccttgtacagagtgaatgataaagtctgaatcattttggagttactgatcatccctaattatagtgccactgtagcatacctataattaagagagaattagcctctcaattataagccactatttttagagcttcacattttaataatttcttatctcaataaaataggacagatcttgaattagatgactttgtgtagaaaatgattttataggacccatatgcagtatgttactacagaaactttgatttttaaggacaggaatggttttcttatctaaacctatcattggcctgtcaaaccacaaagcacaattattaacttgcagataggaagtaactcttcatgcctgtgctgtctcccacactgcaatctgttccttctggttgtctcctctgggaggatgaaggacacagattattctctaaatatatggtctactttgttgataattttggaagaaaaaaattctaaacattgcattgccaaaataaaggtatttgccttcttgtttaatgcagtttgttccatctgcaaaagataaatttagtctgataataaaccatgagactctactattattgctcagcattgtagactttttatagtttagaaatagtataaataatggataactagtattaatgctgctgttacttaccagtgaaataattagtttgaaattttccatatgcatacattgtctactatataatcaatattacaagagaattaaaataattgagagtatttttttaaagatgttaaccttttttcaactctctctacggcatacaatacacttatttatatttacatatgaaaacgttcctgaaaagtaattgcaaataaaaatggcctagccattatgacacctcttctatggaactgtattaattgctatttcattaaagtcacatttaagtcagttattgtttgtgtttggtaataatacagcatgatttctttattgccatgttataaataatggatttcacaaatttgtcattccccgtacttattttattattcctgatattgctaatgatttatctgccacaattgcctctattgcctattcctaggaaggcagaaatatgtatgtctatgatacatatgtatatatctatttatcaatatataattatctttcaaatcttttggaaataaaatgagtgtagccatttgtgtctctatatatgcagaacgttactcatatcgaaatagacccttcatagatctgtcaccaatgcttaaatatttaaatagtttcaaaaatagtaggtattaaataaatgctgaatgtgaataaataaggaaaaaatagcatcgtatacatatgttgcaagtcactcatgcatggttagtcatttattacaaattttccttcctcagttttttgggggcttgattatagcagaacaatctgcacagctgacaattcttgcatgcccaatccttctctagatgatccaggagatgttaaaatcatttcctctctggttggcagtttttctttctctgacattttaattttttctcaccattccacagaacatctgagaaagcactgaattgaaaaagcatcctaaatgtatttacgaatacatttagcctaagttgccttcagtagaacccatgatctctgatttcagctaacgttagctgggttaacaatacaggaagggtcaaaatgtttcctttaaaacgtattgcccagtttaaggaccgtgcagctcattcagtagttcttaaatttcataggaagagaaaaataaggagatgtagaagaagccataatgaatcatgtgtttttggtgatccaatgctaaggaaggtgtatgtccccttgttgaattgtaattattgtgcaaagtggcagctttttccagggtacatgtgttattttggtcattctctttccataagtattctttgccaatgtcaatgtgctctgtaaccatgcaattgtgtcttttaaagaccactcttgccatacactcgctaaataatttgactaataagattacaggaagctttctattattgtccataccaaagagaaagcattccttttcataccaatagcagatcatgagaacgattaatctagaaggaaaggttaaaacaatacagaagtgatttgggattagtctctcatttcaaaacctttctaaaattcctgtttaaatgcttcagagagaatattaatttcagaataaattgtacaggtgctttaaatgccttagttttcaattcactttattattgtatttaagtaaaagaatgatctctgcctacctctgttggatctttcacactggttgccatggtaataaacatggtcccagagctctatagagaagagaatagaattgttcaattatttaaatatattgggaccaaatctcaactagatataagtattatcgacaaaattttgaacattcttcaattagacttttgatatttgaaggaaaatttgatggctcatgcctgtaatcccaacactttgggaggccaaggcaggcagatctcgaggtcaagagattgagaccatcctggccaacatggtgaaagcccatcactactaaaaatacaaaaattagctgagcgtgacggcacgtgcccagctactcgggaggctgaggcaggacaatagcttgaacctgggaggtggaggttgcagtgagccgggatcacgccactgcactccagccaggcaacagagtgaggctctgtctcaaaaaaaaaaagaaaatttgatattaaagtaatttatattttgcatttctagcagacaattttgctctgactcctactaagtgattagccaaagcaaagaaattggtaaaggtggctgctattttcatagggaaatgatcttttgtttgtttcttcaaacagggcctcaccctgtcacccaggctgcagtgcagtggcatggtaatggctcgctgcaacctcaacctcctggcttgaactgatcctcctgagtagctgggaccacaagtgttcaccaccatgctcagctagtttctaaattttttgtagaaacgagatctccctatgttgcccaggctggtctcgagctcctgggctcaagtgatcctcccaccccggcctcccagaatgcaggtattacaggcatgagccacctcacccagcccaaaaatgaaattttaaaaataaaatggacattggacaaatcaagcaatgacaaatattatcaaagttccaaaatatgctatttcatcgtgtctttaaaggaacaaagatcttatcatagtagaggatgttttatagattttaaaatttatagtatctctctcagattttttagtctatgttgcttctttaacaatattgagtagaattaaaagtctcatattagcattaaaataaaacaaacaaaattagaggcttatatgaatatttgcttatatgaattatatgcttttcaaaatgaaatagcaaccattaaaatgactgcagacattttactgtggctagcatctgatgatacaaatatgaaatatataagattaccttttcttaactgtgtataaaaattatgaagtcattgtcctatataattttgctccaaatacttttctgactagtctttcattcctgacatagcaaaaagaatgcagacttaagctaaatccttttataaggcagacagtgactattgatggaacaactttgatctttttatcagaaagatggagatcagagtcttcaaacatttatttcaggatacagatacactttccatctatggcttagtaatatgatatttgagggtaagaaatgtagaaagtatcgtggtccttgacttaccaaagggatttatactgatactacaaggggcccattctatcttatgtatattagtgggattttcctgggtactctttgaatttgcagccatttttccttttatgttacttcctgcgttccagggtttttgtacatttccttattttgaaatcaaattcagtgctgtttttttttcatagtcaaattttcttaagattgttaaaatcttccttctttccttccttcctccctccttcccccgcttcctccccccacccttccttccttccttccttccttctttcgttcttttttgtaacctcaaaatattgaaacaccactctttagcttggcagtgggacatatagagatatttcctaaagcaatggtagctggtttatagagcacagcaccaatggtctagtagtgttcctagtttccaaaaaaccaactgtgctggccttaaaatttgtttatttataatgaaaaagaatatcatagacttttaaattaggatagtttgctaacacaaccaatttttctcataattattttcactttttaattgcataaacacacacacatatacacaaacattgaaaatgccctatttctgaatgcatgttgttgaggttggatcaagatgctgaattaaagtattttaaaagccaactctcacattgcagataagttccttctctgtggtaatctctaatgtccgtatcatctgcaaacacagaagttagattacaaattagtttccaaattctgttcattttagagatatcataacatttattgagttaatcatccaaacaattcttgaatgtaccttatgaattcgttaagagtcactatttttattgacaatctattctgttttgttttcattgttatggtctttagaaagttcttataagatcaaaacttgtatcctaagtattttcatttatttgtcttaattctgacttaagtaattgctttcttttgcatactatagatacatcaaatatatggagagaactatcatctctttcataacttttctcatcactagcctaaaagttctgaattccctcaactattaattattatattttcaaacccttgttatggttttcatatattttaattgcaagtttgtccatgttagtcttacagtgcggtatctagatctggggtctgatttgatctacttatagaagatctttttaatttttttaatagattttgggggaacaggtggtgtttggttacatgaatcagttctttagtggtgatttctgaggatcttgacctgaatccaaaaattaagatttcagaccacaatttcaatctgaacattcatgttcttcaggcggcccagtgtttacatggagaaaaaaaaaaaggctctaatgaaatcatgtattcttcagttactacaatcacaccattgtctattactctattgctatttattttgcttacttatatatcctccctggcctttaaagtatttgaaattagaattctgttatctagactctataatttcatttaaaatctttaagtttattagctttttggtaactgcatggaattaattgcttgccttaatttgaagtttactgaaaacctggttgattttaatgaattgtggtaagcctcatgtattccattctatgaatatgaactgattgaagctacatgccagattttgcattcactcctgtttaattttacattagttttttctttttttttttttttttgctcattgtcctaatctcataacattgaaatactggttctatcatatacagtagtaatatctgcaaatttgaaatatttgtcatgtatatcttcatccaaattgttgactgaaatactagacataatggaaatgagtatataatcagtggtataacaacagcttctgttgaaatcagcatttgtatatgaagaaataataatcaatgttctttaaatatgattgatattttcatcacaaactcacctaattttgataaagctaattttctacctaaggcacaaaaatatgatatacttttcaagtgttttgatcgtaatcaagatgttcatgatagatcttgaatgtgccaattgaataacactattaaaaataacactattaaaaaatgaaagacagggtcataggggtatcacttgctcttcctctacattatcagttcacattgtatgcatatatgtgcacgtatagttaatacataaggtataatgagtaggcattccattaatgatataatttaccattcgtaaggtaatgagaacatatggaaataacatttgcattgacaactttaaagtcattgttttttaagcataaaaattaccaaaaagatatgattctatgactagtacaagcattaacatgtgatatggctagcctttgggtcactacccaaatctcaccttgaattgcaatccctataatccccataatccccatgtgtcaaggaagagaccaagtggaggaaactgattcatggaggcagttttccccatgctgttcttgtgatagtgactgagttctcatgagatctgatggttttataagtggctcttaccctttgctccatacttcttcccgccaccttgtgaagaaggtgccttgcttcccttttgactttcaccacaattttaagttaaatgagtcctctccagccatgctgaactgtgagagaattaaacttcttccctttataaattacgcagtcttgtccagttctttgtaacagtatgaaaacgaacttatatgacatgactctagttttatcacatttgagagtcatttcaaaatgccaaagagagctctgagacctagctttacttctggtggattaaaatgctgcgacagcctctaatttactcaagcctcagtttacttataaattatatgtagatatttactggattgctctaagttttataatattgttaagtgacttttttatttttaccaaaacatttttaatctaaactctatgttgaggatttttatgctttagtgtatatacacatctattgaaaatttggatatccaggtgttattcctggttcttctatgggctaatgagctatgctaacttaggaaaggtaatctttttgaatcttgattctataataaagggcttagattgtaaaatttttagatttttaagattcattctagtactaatcatttgaaaaccataaactgttaaaaatacttatagttgaccaggcacggtggctcatgcctgtaaactcagcactttgggaggccaaggcaggtggatcacgaggtcaggagttcaacagcagcctggccaacatgatgaaaccccatctctactaaaaatacaaaaaataaatagccgggtgtggtgatgggcgcctgtaatcctaactattccggacactgaggcaggagaatcgcttgaacccaggaggtggagtttgcagtgagcagagaccatgccattgcactccagcctaggcgacagagtaagactccatctaaaaaaaaaaaaaaaaaaaacacacacaacaacaacaacaaaaacacttataggcccggcatggtggtgcacacccataatcccagcactttaaaaggctgaggcaggtggatcaactgaggtcaggaatttgaatttgagaccagcctgaccagcatagtgaaaccctgtctctactaaaaacacaaaaattagttaggcgtgttggcgggcgcctgtaatcccagctaccggagaggctgaggcaggagaattacttgaaatgggaggcggagattacagtgagccgagatcgtgccactgcacttcagcctgggcgacagagcgagacttcatctcaaaaaacaaaacaggccaggcgtgctagctcacgcctgtaatcccagcactttgggaggccgaggtgggtggatcacctgaggtcgggagtttgagaccagcttgaccaacaaggagaaaccctgtctctactaaaaatacaaaattagaccagcgtggtggcgcatgcctgtaatcccagctactctggaggctgaggcaggagaatagcttgaacctgggaggtggaggttatggtgagccaagatggcgccattgcactccagtctgggcaacaagagcaaaactccgtctcaaaaacaaaacaaaacaaaacaaaaccttatagttggccagggcgtggtggctcacgcctgtaatcccagcactttgggaggccaaggtgggcggacaacgaggtcaggagattgagaccatcctggctaacacgatgaaaccccgtctctaataaaaataaaaaaaaaaaaaattagccaggtgtggtggtgggcgcctgtagtcccagctacttgggaggctgaggcaggagaatggcatgaacccgggaggtggagcttgcagtgagccgagataggagatagagccactgcactccagcctgggctacagagccagactccgtctcaaaaacaaacaaacaaacaaacaaaaaaacaaaaaaaccttatagttataattgtcaataaataccatttacatttttaagaagctgagaaattacattattttagtgttagaagtacaatttaatgcaaatcttgttaatattttaaaattagttttatttaaaatgataaattaatcgtatagaaaaattttcatgaaaaatcaaactacttttctttaaactattttattaactgtaaccctttataaaaaactaatttattatattttaataaaaaacagaaacattgtgagttttcatataaaatgtcatgattacctcatgcatctgattttaatgattcgaaaaatattttatgctcacttgattcattacttcatggaattgacagtttgaatacaaattcttttaatccaaaaactgaaacatgacattttaggagagcttaatgtgcaaaggaatgtcgagagaaatatttttattgacttcaagtatttaccattaagtttttaatttcatataggtaatatatgatgtagtttttgtgtaaaataaaattaatatataagcaaaaacctaccatctttagccaaatgaataagaagtagtaagtcaatggaattaagctctgtgaaaatctttattggtacaacacaactttattattcaggcgtgcttaatttatatgaaatgtttcttcaacaatgctagacaatgagcatgtttttcctttgactctttaaggatattaatatgatacactgttattttctgtgaattattagttggactgatatgcctattaataacacaaaaccatggaaaaagatttgaatagctatgtttaaagaaacttgacttcttaagaaacacagagaagtcaaagtatgcaccagattaaactgtaggcatcatttttctcctcatcaaaatgtgatggcagatgttgttactggtgcactgggttcttgcagtctcccaggatagaaatcaagagaaactaccagttatagcagcaaaaatgaagtttatttagcttgtgcacaagggtcccagcactgagaggggaaaagaatgctccattagggtagtgcgtatgttagttttataggatctttctatagggaaggattctgtcaggacttttctagagcttgggcagtggcgcaacatgctacatatgtcatatgtagcattagcattttaagtcttcccccctgggaactatttataccattaaaataaggaaggggtaactataggttggagtttaattctaactgtgcatgcagtggctccagggaagaccctaaccttctgaaataaaaacttacaattaagagcttcttgggtcttttgttactgattgactgagagttagataagctagagcttgagtgaggggcttttatcatttttctccagctcatattaaaacagggaaccaaccagcctgcttgtctcaatgtcatcctgaattatttcatttcactttattatacttgcttaaagaatgattgtatttgatttaacatgtaacttcaaaatacacagtcttccggccgggcacagtggctcacgcctgtaatcccagcactttgggaggccaaagcaggcggatcacctgaggtcaggagttcaagaccagcctggccaacatggtgaaaccccatctctactaaaaatacaaaaattagccaggcgtggtggcacgtgcctgtaatcccagctacccaggaggctgaggcaggagaattgcttgaagccaagaggcagaagttgcagtgagccgagatcatgccattgcactccagcctgggggacaagaacgagacttcatgtcaaaaaaaaaaaatacacagtcttccttggcttagctgtatgggaaatatatatatatatttatttatatatatatttatatatatttatttatatatatttatttatatatatttatttatatatatttatttatatatttatttatatttatttttatatatttatttatatatatttgtatatatttatttatatatttatttatatatttatttatatatttatatatattagttcatatatatttatatatttatatatattagttatatatatttatatattagttatatatatttatatatatttttatatatttatttatatatatgtatatattaacatatttatatatattcatatatttatatataaatatatatattaatatatttatatatatttatatattaatatatgtttatatatttatacatatttatgtatattaatatatatatttatatatatttatatatgtatttatatatatttatatatttatatttatttatatatgtatttatacatatttatatatttatatttatttatttatatatatttatatatttatatttatttatttatatatatttatatatatttatatatttatatttatttatttatatatatttatatatatttatatatttatttatatatatttatatatatatttatagagagagagagagtttaaatttcgtgaaaagcagcatgtagatttgcgaaagaggtagaaaatcaaggtgcagttgttcctgagaaagacttgtaactcttccctggggccatcttgacagaaatgattgtcaacccctgtgttttccttttgcattgcatcatgttcttctctggaccagcattcagatcagtattacagatgatgggaaattatgtggtttattttaaaagtgtgtatggcttgcctgtgttccctcttctactttggtaaaatttgctcaaatgtagatgttgcttatgagggtggtgatcatcattgcctggcgttcatctccaaagtccacacaaaggggctaattgaggcaattcgatttgtctttgatttgcattttctttacaattgcttaaattatctgggtgcttttggtagaacaatgtgtgcatgtaacatgaaattgctggattccaaaattttaacaggaaatgctattaagaacagtatcttagttgaccacatggtattacattattttttagtgtatttgtaaatatattataagaaataagtggtcaagaggctggagtggatccgatgattgtagtgtgctccccagtgcatcaggtagaccacaaatatatgaattaggccaaactaaacactgtcacctacattaacctactaggttggcacaaaagtaattgtggttctgccattgaaagtagtggcaaaaacagcaattacttctgcaccaacctaatgaaaaataactataatttatcatgcatcttcttagatgagaagcccaaaactttgctttacctttggaatgtttttctgctggttacttttttatttttgctatggttttggagaaaatcaagatttctaggcatcatttttattatttagtctaagactctttctgatatgtttaatagaaagtaaatgcatatattctgaattgtctctcagtaagaatgtcatcagattcctctaattcttgttttgaaagtagctgtgaaattcaaattagtaaatgtcttgtcctaatgaatcgcagttttcaacagaacagtattataatgtctatgagttatcttatttgtctacctttggctaaatatgttcaaacaatagctcttgaaaagatagggtcatgaaaacattttattaactttgttaaaaaagggaacagtaaactaaaaactgtgagccaaatgatttagctgaggaaaaattgtctatcttacagaaattctgacttatgaaaaaagttactttcagtctgattcagtatcatcaatgtgtattttaaagtctcagatactttatagatgttattaatctacaattacatcataaaatcatgctcctcataagaatatgtcatatatgttataatacatgtgaagcctcattataaaaaaatgactaacagaacttgtatgtctaggtgacctaacataccagaactaatgacctaacataccagaactaatatatcttctaaatgattcaaactgcaaagacagcgatcaacagctgagacgaaagtagctaggtccattttttttctagattgtattttaaaatcctttcattcttggaaatattatatttacacttagagaaatattcttaaaaccagccgaaaatattttatgaatgaaacagaaaatgttattgctaatttttgaattttctctgaagggcattcatatttcatgtaatattttaatgcctcaaaattgatattttaaacttggaaaaattgacatttaatggatgatttgataaaataattgtgtcatcattttgaactcttctttatcagcctgtgattttgttccaaaattgtgatattgacgtcatgtttttgtgagaattcacattacaaaaaaactttgaggtttagccagattgcttcctatttaatcaaactcaaatgctataactaatctttcaatttggttgagaatatgaaggcagactataggagaaaacacaaacaagcagtttctacagtaggcaaagtttcagaaaaagcaaaaatggtttttcattcctaactaaatcacaaaatagctaattagaatacatttattaagaacctactatgtacaaagcttcatgctaaacatagctggggtcctagtaaaattttcactctcatagatatgcttttacaacagaaagaaagcttgattcactaggtaatgaattttaaaatctaaaatctgaagcggcattgtttggtaatagatttaacagtggtttacttaattaggtgagagaataagtattaagaagtaaggaatgttgacatatctttagagttaaagtgcctttttcaggagacagctggccttctgcctgcatagaccactgagctgaaatgatccatgagcctgtctcaatacaacagcccctactccaatggtgacagtgagaaacacaacttaagtctgagcatctctgttatgctatcataaaccccagtgacacaagcatactctatactctatttgcacttgacccaagattttcaccaaaatagagtgcttttatatgtaaagctacctgaatcctcagagcagtattataaaccatttggatttatatcatatgtctgctttttgtaaggtaaaagttatattttttaaattccttagaataaaaaacaaacaaaccccccccaaacctcttaagttttaaaagtaagtcttcgatttcaatttttcatttcaaacttactaaattaaaataacaaaaggggttattcaaagtcatcttcccaaaagggattaaagtcatgagaaagttgtgaatagaaaaataagcagacattcaaatgctttgactttccaactctatgctcagcttcttttgagtctgaataggaagtattaaatgactcttttgatgtgtatctttgcttttgagtccattaagttttaagataaatattcctttaataatacagtttcaattagcctttctttctttcatatctgtcactgataagaatgttggtttttttccagtatatcttgaaataaataggattttggtgtttaaatattcaaagaaaaaagtcctgtttaattaaaagaaaacttcaatggccaaagaatattcttttaaaaatcagtgttattctagaaatgtttcagtcagtattagatagaagtttccagcgtaatattatctttattccacagcgaataggcatttcattagaatctcaccacttacatgcctgaccaacccacattacacagatcctgttctaccactaattaggaatcgaccatttaggatttgggcagcaaagatatcctttttgttgtctcctaatttgaattattcctatagatagtatagtgcatttttcaatttattttggattgtgactatttcagattacttctagatatacagtattttgtttaccatagtaaatcgatgtttcaggtccttgcgaatctattaaaaatgatttggcataataacaatttcatagaattgttattagtgaaaaaaattgttgaaagatgagatttgttcatattgtgtatatcatctatgttttgaaaagtaatacctctttttgtgttttgtgagtaattttttagggccatctcttaatgctatctggccccttacttttcctgcagagatctaaaattgcagtgtttgataaaatgtggacctacatgcggagtgcggagccctctgtgtttgtgaggactacggccgaaggggtggctagagtgcggaagtccaaagggaaatatgcctacttgttggagtccacgatgaacgagtacattgagcaaaggaagccttgcgacaccatgaaagttggtggaaacctggattccaaaggctatggcatcgcaacacctaaaggatcctcattaaggtgggtggaatagtataacaatatgctaaatgttgttatagtatcccacctaccctgatgtatctttaagactctcttacggtttgtatacggatatgaggtaactcaccatcacaaaaatgaccaaaaaacgtttctgaatgtttttaaacatttagatactgttttatatatttatgacaggattttgttttgtttggtttgctttgttttaaaacatatccttttttttttcctttaagagttaaaacacattcattttaaggaatacatgtttgtttagctttactttgtttgagtttttttttccacatttctaactaccttgtcagtctaccagcctgcttacaaacactctgcatacagactaagcaaatggctgtatcctaacagtaaactgaaataactaactgagaaatatgccactttttaattttcattttaatttttgtttaagggatatactttggggaaaggaaaatgcactttgaatttctttgcacacatctctttactatgtagttaactctttgtattcctattttgtcgtttgttttttttttagtggagtcacattcaagacactgttatttgtttgttgtggatgtgagtacattgctgtagaatatagaactccccatattagcactctttcctttattttctttttgttatgctctaccaccttacccaaagtttcagatttttagtagctcatagtaacatattattgtggcctttttcccacttcatttttttgtgacaagagttgccacagaagccaaagaaaaacaaattaaaacaaaacaaacaaaaagtctaaaatttgctcaccctgtctgacaagtatgttttatcgtttcaagaaatgcggttaacctcgcagtactaaaactgaatgaacaaggcctgttggacaaattgaaaaacaaatggtggtacgacaaaggagagtgcggcagcgggggaggtgattccaaggtcagccccagtgagaaaagtaatgggtaactcaatgcaaaacaaagtaagcagcagctatgcacagtgtgggcactccgtgccaccaagtttccaacgctaagctgaagagtgcaattggatgaccaggacacttgacttcttctttctttcttcctctacttctctttccctctctttctccatatctcaaggaaaaatttgtaactaatggatttgttgcaaactgttgcacctgctggttacttccagcgatacattaatgctcatttggctctgcaaatcttaccgtttgcttaggccaaatggcgcatcaatgactatcgctcttacaaagctcttgaatcagtattatgtaatgaataacataaaataacattgataatgttatttatgttattttccacgtgaagaaccccagtaaatcttgcagtattgaaactcagtgagcaaggcgtcttagacaagctgaaaaacaaatggtggtacgataaaggtgaatgtggagccaaggactctggaagtaaggtcagttgctgcaggttttatgtgaaaaaacaaaatcaaacacaaacagcaaaatcaaaccacaagtgtgttagtgggaatgacccatcttaaatagaatgtaaatgcaaatatgcatgagatgcataatttggtaagatgttttggtaatgcctgcagagttactgatttgttgtttttattttattttaaatatagtatatgcatttaatatatttatttcagtctgtgttcatgtctaactcatacataatagtgcatgaaacagcaacatactgaaatagagtaaatggcctaatgagaacattaatgaaacacttaagattaagtgattatagggatgtgtgttttccttgtctgttttgatggcacagttgcagcatctatagtatcactgattggcaagactattcgtgtgcatcatgtgtgctctgtttgtattgaatggcaaagctttgttgtgagatgtagtctagtggatgagagtacactgaggggatgaattttggagaccaagagatcaaaaatggtacactgcaattctaaacatgtccaaagcctacttggagagtgagaatgtactggaaccttcaccagccaacatattgcaggataacttcctgaaggtttatcttagccatcttagtactttgagggattggaaatgtggtcagtcctccatttatgactctactaagccagtaacatggtcaacatttaaaacttgcttctacaatcacacgtatggtttattttagccctgttcgctgtcagctttaccagattatttataggatgaagaaactgtcttgtaccttcaatttttcccacggtaatggaatataactatttatcaatttatcactgcaactgacatagccagggaaatgtttaagaaatgaataaatagaagtttattccctgcaggtagtcgattgagtccaccaaaatcttaagctaaattttatgttgtttcatggtagctgttatgaaaatggaccatctaagagaaaatccattgtttctcaaattcaaatgcattctgtgtgactaggttgttcccgtgataatgctatgtgacattgctgttctcttctattcaccagtttgccttcctaataacctcttctcatatacattctttaggaaaagaccagtgccctcagtctgagcaacgttgctggagtattctacatccttgtcgggggccttggtttggcaatgctggtggctttgattgagttctgttacaagtcaagggccgaggcgaaacgaatgaaggtggcaaagaatgcacagaatattaacccatcttcctcgcagaattcacagaattttgcaacttataaggaaggttacaacgtatatggcatcgaaagtgttaaaatttagggggtaggaacgaggctctaatacaaactttttagtgcacgtttagctttcttgttgcgtccttaagctcttttaaataaggaaggtggccaatggatcatcctgtatgtattgttgacgttcttccatgttcccagttggtgactaacctgcagctcaactgtctattttcctctttaatggcacagtagcttgggtgaatgtggacagattcctgccataattgtgctttattatttgtagttcagctttgcactgtttgctttcatttgctagaagctttcagatagaagtaaacttttcaaaaacaaccctgcctttcctctggatgcatttgaaaaccataacgtatgatttctttttctttctttccctcctctctcatttaagatgaccttgaatgatgccatgaggaacaaggcaaggctgtcaattacaggaagtactggagaaaatggacgtgttatgactccagaatttcccaaagcagtgcatgctgtcccttacgtgagtcctggcatgggaatgaatgtcagtgtgactgatctctcgtgattgataagaaccttttgagtgccttacacaatggttttcttgtgtgtttattgtcaaagtggtgagaggcatccagtatcttgaagacttttctttcagccaagaattcttaaatatgtggagttcatcttgaattgtaaggaatgattaattaaaacacaacatctttttctactcgagttacagacaaagcgtggtggacatgcacagctaacatggaagtactataatttacctgaagtctttgtacagacaacaaacctgtttctgcagccactattgttagtctcttgattcataatgacttaagcacacttgacatcaactgcatcaagatgtgacatgttttataaaaaaaggaaaaaaaacatttaaaactaaaaaatatttttaggtattttcacaaacaaactggcttttaaataaatttgcttccatattggttgaataagacaaaaacaattaaactgagtgggaagtgaataaaaaaaggctttaggtatcgattccatatttttcaaagccaaatatgtaaatgctaaggaaagtaaacaaagaggagattccaatcttgtaatttaatattgttattaaaactttaatgtatcctattctttaacatttggtgttaatataaaattacttggcaatgcttgacatttgaaataaacatttttctattgttttattgcaagtggtccaattaattttgcttagctacagtttggtcataaatcaagtgagtttaaagacactaccaagttgttaggtgcccagagaaaatttctcccttttaaaaaggccaggtgatttttcaaatgtaatcttgcccccaaagtaatatctgaatatctttttgacatgtctaaatatatatatatataaagaaatatttgttaacacaaaagcatttgatctatgtagataaatgctaatagatttaaaaagctaatattaacaaataccagaatacgtgaagttccatttttaaagtgtttgagcttacagaagagaaacattcattttaaatgaagtaaaaaatgccttgaaagtaattctttagatagttgcccattgattaaattccaaaaactaaatatgtttttagctttaaaattataaaagctgtcataaactttatatattatgaattttaaaatatgtttgagtctcctgcaatatagtttcatcccattgacatcaattaaaaataaccctaatatattatttttatatttattcctcaggtggaatggctattttaatatgcccagtgtggataaaatgtcacatttctgtaacttttgactaaagagcctatatttatctagttaatgaatttaaaggatctatctttcccttcataaaatacctcttatttccattaaagccccccaagtttaattaatttaggattttgaatgattattgacatccaatagttatttttaatatttgtattcttgttatttctggaagaaagcctttgtgtagcacttggtattttgcaaagtgcttttaaaacattcttacttaccgtatttcatagaagggaaggaaaaatgtaaggtttaacagtaagcacttgcattgaacatggaggcatgtggtatcatgatattcttcactaaatttagctgtccctaatcacagatcctaaggtaatataatataattttagtgcatttctcctcatcaggaatgctggaggtgcattttaagttttaataataagtgctagaatgaccaaattgcagactaattgtttccatattgtacttaaaatgagtttttaaaagtgaaaaagaaatgactatatacaatcaatgctatttattgtacctctgggcctactcttctaaaaattgtagcttatcgatttttctctgtcaagcttgaactaatgtaaataattgaaataatgtaaagttatattttcatgtttttatagatacaacatgacaagaatacataatgtaagagtatttcaactatggataatgttgattggataatgcacatctcagttacaagcagtactcatagtttaatatccatgtaacggtgcatcaatatattgctatataaatatgtctgtgtgcatataagtgaaaagtggtcaaacaagagtgatgacagctgtctaaaggtttttttattcattttatataaaaactgttatggaaagaccaaaatgtttatgaactattcttatgtaaatttacaattgtcctttactgtacttttttgtttacagtatagtaccttattttctgctgtgttaagtgggtgtcaaactccaagaagacatacactttctataacttctattgaagatattggaatttccaatttttcatgtgtactatgtcagaaaatgctttcgattttatttttaaatctaacatcggatggcttttccggagtgttgtaaaaacttcaatcatacataaaacatgttcttacaaaaggcaaagatctttattttttttacttaatagtacttcaaactaataacagtgagaccaaaaagtgtatctaagtttattcccaaacaaacccaactgttcctactgaatgaggacatctttgctcaatttatttatcagctaagtacgaaggtaacagaataaaaaaaattttgtaagctaaaataattaacaattcaggtcattcatacctacactcattaagtgcttcacgtatatgtaggaatatggctatgaattatattactcattttattatagatataccctgctactacaagatcaggcaataccatcaccaaccattccattgtatgttatccattcagctgctgtgatagtcacattaaacagcagaaaggtgacttactttaaaaattccataatgtgtttacaaaaaggtgttctttcagtattgtactgaaagagagtgttgatgagaagctaaaattcttgccgcattcagttttttttacaaagataatcattttttaggtaattctatccacaaatattcaaaaattattaagacactatagtttttcaaagttacacattaacaccttttaattttatagattttaatagatttaatgtttcatacataaatataccaatgaatctgcttaagataacagttggagatcttaattttcaaatctgcagatattttaaatattttggtggtcatgatagcaaataggaaaaatgaagggaagcattagcaatataagaaagctacaggatgatttccaatacaacaccttaacaatatcatttaaaaaacatttgttgaaattaattagaatatggcaaaatgtgatttctcccctttcttctactcccaatctcatcatttcctagaggtaccggtctagcaagtttaaacaagccaagaatcacttctaggttagaatgtatttctggatatttacattttttttctgctggataaaactgattatatatttctttttgaagtaagtggtttgattgacttagccacaaaagttgtcattattatcaatgttaattgataatatatgattattaataataatattctgtgggcttcagagactattttggttacatttcccaaattttatatgtactctcaacaacttgttaaaggaaatatcagaatataaatatctgtttaaaaatagagcaaattttgtgcaaagagttctcatacttaaaataggtttatttttaatcaccaacataaaagatgggtaagtataagtgaatcatcatgatcttctgaatgaaaatttggaaatgcattaaaaggtttgtaaaagttgtatcacattttaagcaggaagggattcattctcttaatgtgttgttttggcaagaccatgacaacagaaattctattagctactaatcaggaaattatactttctctatttatgtgttttaaaacaaaacatagacagcatatggcactccaagtacagagaggttcaaacatacttatgtaagcatgatgatatttaaacagggggactaaaacaaaagctgtaagatccagtgaatatagaatagtacctagagtaaatccagttcataagaatctgtctatgtgttttatatcctgtctctattcatttcttcttgctttaccattttatgatctcttcttgcccttaaatactactgccatttttatacctattatactttaaatggtatctcattttgtagtttcattcattttgctttttttttcatgttattccatctatttctagcttgcctattctaacagattttgctttgtgggcacttgaaatgcagttcattttatcaaagacatgactgacagtttcagagtctacttaataactataataaatgactaaggatttctcttgtgaaataaaatttcttgttaagctctatttcagcatttctcacatattctgattccataattgccaatttgttatattcctccatgtatttacagagttccaaaatttatagagtttctgtaggaaacgagggtctcttctatgacacaggaagaatgagaactctatttgagtgtttgcttatcagaattctcttttaaagccacttgacactgagcacaagccaattctccattttaatttcattctcaagcacttccagattattccttaattccttttttcccactaggtataagtaaattttgctatttaagagccaaattgctttttcgatatgcataaactcactattacttcattggatatgcctgaattagctgaatgaatttggtcatttttctttcttttttttccctttcaggttaatgtgccaatttcattttactgtaaattggaatgtgggggagtggattaagtcttgggaggtagtcaaaaccaggattctagctttactttccctttttctcttgcttctctttgtctcctcaactggagtatttggacactaggactgtctcactggaacgatgacagggaatttgatatgattattaaagataggatgcaacaatgtgtcttttaaaaataatggtttaaagaaatgggttcatgtttggagtgccacttggtgcagaaaatgtttttggtatccagatccaattttatttcatcatctcaaagcattagtaaaacagttctatcctgtaactttcatttattaattaatttacttattccatctgacaatatttattgaatttttttcctgtataaatattggccaaggtaagggctaaatttgaagcctctattctgaggattaagtgttatattttcattaaaggatgtagttctttcatcccattcatgtagaaataatattatgattacttggattagtctgtccaacaatttttaaccgaagagattcaaactttaatttagaacagatatctgatagcattcctcaacaatcttaaatatggactcacattttattttcttatactaatcttagattgtgtaaattgtatgtctaaatttatttgccattcattcaatatttttatctctattctcaaagagtctaattaaatccattaacaaatatcagtttggtaattctaaatctctgccacctgtatagcttatgtatgtatatctagtatctatttctttgtatgagtgttaattcaaaaaacattctaagtatttttgcttagcagctaaacagcatcttatacacaaatagcaacaaaaattaaagaatatatatatccttataaaggtatacatatgtatcttaagtaaatatatgtgtctatatttattttttaaaatatggtaatttttcaaccaagagcctaccaattcggaatttattccagaaaatgtttaaaatgaatatcactatttgtcaatatttatttttatttaaatatttacactaaatcacacctaaattccatgagggtagtttatttcagatgggatagcctcagggaaaatttgaagttctattaaattttgtaaaaaaaaagaaaaacatattttgtgtttaggaacatatatgttacagccatcatattttgattactatcactcattatattgccaatattaataggtgaggaaattcatttgataagtatcagaatcaaagccaggtataaattaatagatgtatattttctagttttattttactatttatattcaatttagaggttttatatatataaatcacattttttccccagcttcttatggtcaagaattttgtggtgtaagaaatgtgtgctcactgtgctgactggaattttatgatttaagctattgagtatagttgactcatatctaaaggcacttttgtgtaaatatttacagattttaaaagaaatcacctcatgaaaagatttgaaagtttcttaaaaccattatgtagaaaatggaaatatgttgtactatgaactacgtattcttgctttgcctatgcattctatttccccacccctacaaattaaaccccgtttgactggttatcaattacagaacagttttactgaagtctaagtcatgggttgcgatcacatgtaacagtcaattttacatgattcctagattatacacaacatatcgaactttgcacatccttcttgcaaatatgtgccttagttcacagtgagggataatgtggatgattactgttcagctgtcatgtctatttcgggtttctttttaaattaaaatgcattcccagctttataatcatatttagtatgtatcttaaaaggctttcaagtctgttttatgtacattatcttgtcagctatttgtgttaaagagataaacatgtctgttgatttttatttaatgttgttcgtgtttctgtgtgtgtgtatgtttatgtgtgtattaaaaaatccacatcctctgtagcatttactctgataattatttataaaattgttaccataaattatgagtttgtaatgcaaaaaacactagataaattggaataaattatttatggattttttaaagggttttcagaagaaattaattagccactcttaggttggatatatgagtcaaagtaacttaaacttgagtccaaaattatgccttgctgtttttatgtgaaatttattttaaaggacttacttcaccaaaattaaatttccaagatttgtcattcataattagctatcaaagcatttccacatggaaaaggcttttggaatcaagtttaaattgtctcatcttttgcatttatttcatcagaaaaacaagaacttgtgggaaataaaattacacttcaatttcagaaatagttttctcgaaatcagaaaaaagtatatgcctcaaatatctaaatacagtttctaacatcaaaggttagtaagttatcgatacaattttcaaagtgtcatgatcatcttcaggacaccactttccctgatgagatacttcccgaggcttggagaaactaagccattggccaagagaacatagctagtaaatgacaaagcaggattgtaactcaggtatgattctctatttgaatacttttttttcctttatcaaataaaatctcttttttatcatacaaacagctatatgtgaggatagtaggaatgctctattcagaggaacataggatttttcccccataattgatgtcttaccttttgaattaggatacactcttgcaattcaatttgtatccagaaacttttcttactctgagtaggatatcatatcatagaaatggctgtagaaacatcatggcaattttaaatattattgctatatatttttagtaagtaaccacatttatgtttattaatatcctaaatgtttatgatgaaaacataattaattactcaattagcaattagaaaaaaagatacatgtccatttttgcttaacagttgtcctaaaaccttttttaaaaaggtacattataagacaaatgcaagttgtcattattatatattaatttgcttttagaaaatgtgaaaatattttgcaaataaaaatatgaattagttaaaattataaagtatgtaatgtcaaatatgcattttcatgtatcagatgtttataaagatagtggcttttaactctattttattattaaagggtaatatctgggcttatagtttacataaaacttcacattaaaatttaatactatcatacagcaatacgtaaatttcaaagcactttcatgtttgattcttaggtttttagtcattattcacacgtcaccacattattcctattgtcatatcatctttcccaatacaatagcaaaaccagaaaatattttcacaagcgtcacacttattttatgttaggaaaacatgcatgcatttactatttttacttcctctgtttcacacttatttttcctataattttgtcttatccatctggccagctttcacttataggtattgacatgacaatggttgtttgatcttttattttcctcttccttattgttaaaccctataaaaatctttcccatatatgattgagcaaaagtctagtaatctctcaagcagcatgttaatgttttgttttcttgtgacaccttacctgtatctcccatactcactctgccctaagcaaagctgattaaatatttttcattgttcaaatgctgtacctggttgaaacgtctctaaaggagcaatgatgctatactctagtggtttgcttaaacatcaaattcctttattatagtgcaagcttcctgcagcagagaatacatatgtcttattcatcgtcaagtacctgacaggttttgggaatgataataataacatataattacaatgcacataatatgtcaggcatcacattatgaagaacacactattgttgtaatcttcattttacaaataaggaattggaggcacaaaggcatagagaggttagataatttgctcaaaatcacatagctagtagaacgaagaacaaggttttgtacctgggtttgagggtagcagagttagcacttgtaaccttcacatgaaaagagatgggtcacaatataaatgctatcagataaaaaaatgttctaaaaataaaaaaaagtgttgacacaccaaacagcagacaggtgcccagggagtagatgtgtaacaagcactcatacatcactggaaaacatcaccgaatgtataatgaagtggagaaaagggtatttagtgaagtccccatgggataatagtaggtgtagttggaagactgctctaataagtcatttgggctagagtgagatccctgacaaatgtgctccagtaataatggagaactgctaacctgccacgtagagagagcgtatcatgttaactgcagagcttttgctttgctgagtttggtgctggagtagaattgctaagaaaataaggtgaaattaaacataaattgtctctttcacagtaattttttataccacattatttttatgtagggctgcttttttttaaaaaaaaatttattttatggccagattactggaaaatatcgtctaactaaatgaagttaattttctttaggaatctttctaatgacttcctttcaaaatggccatattgttgcaatttctccttagccgccctcactgaatcaactttcactgcttataatgtgaacatagatattcctgggagatatttttcatcctagctcaactcttttcaaattgcactctctatctcgtaggaaaaccattttttcctatggattttattatcatcttcatgctgagttttctcaaatgtatgtgcacagccctggccattttcctcagttccagacttgtatattcaactgttcagtaacttattgttaatataattaatattattaataataatgactaatagtaattgaaaagctataagatgccagccactattttagattttacatatattaatgcttttaacacagaaatgaaatgcaatcaatattatcattatctctattgtaccttaaataaatggaggtaaaaagagattacatagtttgtccttagtctcaactgcatctagaaatctccacagggactcaacctggacaggctttaaaactgaattcattatcttcccagtaaaaattgttcctccttctgataagtcccttttggttacatttggtccttagactaccattgtaaatgtgaactttcttacctgtagaaaaaaacataaattctattttaattatttgcataaatgcaggagaaactctttcatagctaatctttcctcattcataattcacacttatgagcacatacagacactaatcaaggtattttggaatatttgtaagtccaagagaaaaagaaattcacaaacaatccttaatgttttgtttcttaaattgtagttcattttattttagcaatttatcatcgctccttgtgttaaaaatcacttctagattgtattatgttagagtcctagagggctcatgctaatgttctgtgccctcatttaatgatgtatttatttactgaataaatacttattgaacatgtattatgtggcaggctttataccatgctagaaaacatggtactactgtcagttacattttgtctatttcaagttgaaaaaagtaaattattcaaggtattcattaaattattttactttcacttattccttacatatttcaaaccctcttactatcttgctacattacttcttatgagatgtggaattaaattatttt

SEQ ID NO: 180 - DNA, 2771 bp, Homo sapiens
atgcaaaagattatgcatatttctgtcctcctttctcctgttttatggggactgatttttggtgtctcttctaacagcatacagataggggggctatttcctaggggcgccgatcaagaatacagtgcatttcgagtagggatggttcagttttccacttcggagttcagactgacaccccacatcgacaatttggaggtggcaaacagcttcgcagtcactaatgctttctgctcccagttttcgagaggagtctatgctatttttggattttatgacaagaagtctgtaaataccatcacatcattttgcggaacactccacgtctccttcatcactcccagcttcccaacagatggcacacatccatttgtcattcagatgagacccgacctcaaaggagctctccttagcttgattgaatactatcaatgggacaagtttgcatacctctatgacagtgacagaggcttatcaacactgcaagctgtgctggattctgctgctgaaaagaaatggcaagtgactgctatcaatgtgggaaacattaacaatgacaagaaagatgagatgtaccgatcactttttcaagatctggagttaaaaaaggaacggcgtgtaattctggactgtgaaagggataaagtaaacgacattgtagaccaggttattaccattggaaaacatgttaaagggtaccactacatcattgcaaatctgggatttactgatggagacctattaaaaatccagtttggaggtgcaaatgtctctggatttcagatagtggactatgatgattcgttggtatctaaatttatagaaagatggtcaacactggaagaaaaagaataccctggagctcacacaacaacaattaagtatacttctgctctgacctatgatgccgttcaagtgatgactgaagccttccgcaacctaaggaagcaaagaattgaaatctcccgaagggggaatgcaggagactgtctggcaaacccagcagtgccctggggacaaggtgtagaaatagaaagggccctcaaacaggttcaggttgaaggtctctcaggaaatataaagtttgaccagaatggaaaaagaataaactatacaattaacatcatggagctcaaaactaatgggccccggaagattggctactggagtgaagtggacaaaatggttgttacccttactgagctcccttctggaaatgacacctctgggcttgagaataagactgttgttgtcaccacaattttggaatctccgtatgttatgatgaagaaaaatcatgaaatgcttgaaggcaatgagcgctatgagggctactgtgttgacctggctgcagaaatcgccaaacattgtgggttcaagtacaagttgacaattgttggtgatggcaagtatggggccagggatgcagacacgaaaatttggaatgggatggttggagaacttgtatatgggaaagctgatattgcaattgctccattaactattacccttgtgagagaagaggtgattgacttctcaaagcccttcatgagcctcgggatatctatcatgatcaagaagcctcagaagtccaaaccaggagtgttttcctttcttgatcctttagcctatgagatctggatgtgcattgtttttgcctacattggggtcagtgtagttttattcctggtcagcagatttagcccctacgagtggcacactgaggagtttgaagatggaagagaaacacaaagtagtgaatcaactaatgaatttgggatttttaatagtctctggttttccttgggtgcctttatgcagcaaggatgcgatatttcgccaagatccctctctgggcgcattgttggaggtgtgtggtggttctttaccctgatcataatctcctcctacacggctaacttagctgccttcctgactgtagagaggatggtgtctcccatcgaaagtgctgaggatctttctaagcaaacagaaattgcttatggaacattagactctggctccactaaagagtttttcaggagatctaaaattgcagtgtttgataaaatgtggacctacatgcggagtgcggagccctctgtgtttgtgaggactacggccgaaggggtggctagagtgcggaagtccaaagggaaatatgcctacttgttggagtccacgatgaacgagtacattgagcaaaggaagccttgcgacaccatgaaagttggtggaaacctggattccaaaggctatggcatcgcaacacctaaaggatcctcattaagaaatgcggttaacctcgcagtactaaaactgaatgaacaaggcctgttggacaaattgaaaaacaaatggtggtacgacaaaggagagtgcggcagcgggggaggtgattccaaggtcagccccataaatcttgcagtattgaaactcagtgagcaaggcgtcttagacaagctgaaaaacaaatggtggtacgataaaggtgaatgtggagccaaggactctggaagtaaggaaaagaccagtgccctcagtctgagcaacgttgctggagtattctacatccttgtcgggggccttggtttggcaatgctggtggctttgattgagttctgttacaagtcaagggccgaggcgaaacgaatgaaggtggcaaagaatgcacagaatattaacccatcttcctcgcagaattcacagaattttgcaacttataaggaaggttacaacgtatatggcatcgaaagtgttaaaatttaggg

SEQ ID NO: 181 - protein, 916 aa, Homo sapiens
MQKIMHVLLSPVLWGLIFGVSSNSIQIGGLFPRGADQEYSAFRVGMVQFSTSEFRLTPHIDNLEVANSFAVTNAFCSQFSRGVYAIFGFYDKKSVNTITSFCGTLHVSFITPSFPTDGTHPFVIQMRPDLKGALLSLIEYYQWDKFAYLYDSDRGLSTLQAVLDSAAEKKWQVTAINVGNINNDKKDEMYRSLFQDLELKKERRVILDCERDKVNDIVDQVITIGKHVKGYHYIIANLGFTDGDLLKIQFGGANVSGFQIVDYDDSLVSKFIERWSTLEEKEYPGAHTTTIKYTSALTYDAVQVMTEAFRNLRKQRIEISRRGNAGDCLANPAVPWGQGVEIERALKQVQVEGLSGNIKFDQNGKRINYTINIMELKTNGPRKIGYWSEVDKMVVTLTELPSGNDTSGLENKTVVVTTISPYVMMKKNHEMLEGNERYEGYCVDLAAEIAKHCGFKYKLTIVGDGKYGARDADTKIWNGMVGELVYGKADIAIAPLTITLVREEVIDFSKPFMSLGISIMIKKPQKSKPGVFSFLDPLAYEIWMCIVFAYIGVSVVLFLVSRFSPYEWHTEEFEDGRETQSSESTNEFGIFNSLWFSLGAFMQQGCDISPRSLSGRIVGGVWWFFTLIIISSYTANLAAFLTVERMVSPIESAEDLSKQTEIAYGTLDSGSTKEFFRRSKIAVFDKMWTYMRSAEPSVFVRTTAEGVARVRKSKGKYAYLLESTMNEYIEQRKPCDTMKVGGNLDSKGYGIATPKGSSLRNAVNLAVLKLNEQGLLDKLKNKWWYDKGECGSGGGDSKVSPINLAVLKLSEQGVLDKLKNKWWYDKGECGAKDSGSKEKTSALSLSNVAGVFYILVGGLGLAMLVIEFCYKSRAEAKRMKVAKNAQNINPSSSQNSQNFATYKEGYNVYGIESVKI

SEQ ID NO: 182 - DNA, 2653 bp, Homo sapiens
atgcaaaagattatgcatatttctgtcctcctttctcctgttttatggggactgatttttggtgtctcttctaacagcatacagataggggggctatttcctaggggcgccgatcaagaatacagtgcatttcgagtagggatggttcagttttccacttcggagttcagactgacaccccacatcgacaatttggaggtggcaaacagcttcgcagtcactaatgctttctgctcccagttttcgagaggagtctatgctatttttggattttatgacaagaagtctgtaaataccatcacatcattttgcggaacactccacgtctccttcatcactcccagcttcccaacagatggcacacatccatttgtcattcagatgagacccgacctcaaaggagctctccttagcttgattgaatactatcaatgggacaagtttgcatacctctatgacagtgacagaggcttatcaacactgcaagctgtgctggattctgctgctgaaaagaaatggcaagtgactgctatcaatgtgggaaacattaacaatgacaagaaagatgagatgtaccgatcactttttcaagatctggagttaaaaaaggaacggcgtgtaattctggactgtgaaagggataaagtaaacgacattgtagaccaggttattaccattggaaaacatgttaaagggtaccactacatcattgcaaatctgggatttactgatggagacctattaaaaatccagtttggaggtgcaaatgtctctggatttcagatagtggactatgatgattcgttggtatctaaatttatagaaagatggtcaacactggaagaaaaagaataccctggagctcacacaacaacaattaagtatacttctgctctgacctatgatgccgttcaagtgatgactgaagccttccgcaacctaaggaagcaaagaattgaaatctcccgaagggggaatgcaggagactgtctggcaaacccagcagtgccctggggacaaggtgtagaaatagaaagggccctcaaacaggttcaggttgaaggtctctcaggaaatataaagtttgaccagaatggaaaaagaataaactatacaattaacatcatggagctcaaaactaatgggccccggaagattggctactggagtgaagtggacaaaatggttgttacccttactgagctcccttctggaaatgacacctctgggcttgagaataagactgttgttgtcaccacaattttggaatctccgtatgttatgatgaagaaaaatcatgaaatgcttgaaggcaatgagcgctatgagggctactgtgttgacctggctgcagaaatcgccaaacattgtgggttcaagtacaagttgacaattgttggtgatggcaagtatggggccagggatgcagacacgaaaatttggaatgggatggttggagaacttgtatatgggaaagctgatattgcaattgctccattaactattacccttgtgagagaagaggtgattgacttctcaaagcccttcatgagcctcgggatatctatcatgatcaagaagcctcagaagtccaaaccaggagtgttttcctttcttgatcctttagcctatgagatctggatgtgcattgtttttgcctacattggggtcagtgtagttttattcctggtcagcagatttagcccctacgagtggcacactgaggagtttgaagatggaagagaaacacaaagtagtgaatcaactaatgaatttgggatttttaatagtctctggttttccttgggtgcctttatgcagcaaggatgcgatatttcgccaagatccctctctgggcgcattgttggaggtgtgtggtggttctttaccctgatcataatctcctcctacacggctaacttagctgccttcctgactgtagagaggatggtgtctcccatcgaaagtgctgaggatctttctaagcaaacagaaattgcttatggaacattagactctggctccactaaagagtttttcaggagatctaaaattgcagtgtttgataaaatgtggacctacatgcggagtgcggagccctctgtgtttgtgaggactacggccgaaggggtggctagagtgcggaagtccaaagggaaatatgcctacttgttggagtccacgatgaacgagtacattgagcaaaggaagccttgcgacaccatgaaagttggtggaaacctggattccaaaggctatggcatcgcaacacctaaaggatcctcattaagaaatgcggttaacctcgcagtactaaaactgaatgaacaaggcctgttggacaaattgaaaaacaaatggtggtacgacaaaggagagtgcggcagcgggggaggtgattccaaggaaaagaccagtgccctcagtctgagcaacgttgctggagtattctacatccttgtcgggggccttggtttggcaatgctggtggctttgattgagttctgttacaagtcaagggccgaggcgaaacgaatgaaggtggcaaagaatgcacagaatattaacccatcttcctcgcagaattcacagaattttgcaacttataaggaaggttacaacgtatatggcatcgaaagtgttaaaatttagg

SEQ ID NO: 183 - protein, 877 aa, Homo sapiens
MQKIMHVLLSPVLWGLIFGVSSNSIQIGGLFPRGADQEYSAFRVGMVQFSTSEFRLTPHIDNLEVANSFAVTNAFCSQFSRGVYAIFGFYDKKSVNTITSFCGTLHVSFITPSFPTDGTHPFVIQMRPDLKGALLSLIEYYQWDKFAYLYDSDRGLSTLQAVLDSAAEKKWQVTAINVGNINNDKKDEMYRSLFQDLELKKERRVILDCERDKVNDIVDQVITIGKHVKGYHYIIANLGFTDGDLLKIQFGGANVSGFQIVDYDDSLVSKFIERWSTLEEKEYPGAHTTTIKYTSALTYDAVQVMTEAFRNLRKQRIEISRRGNAGDCLANPAVPWGQGVEIERALKQVQVEGLSGNIKFDQNGKRINYTINIMELKTNGPRKIGYWSEVDKMVVTLTELPSGNDTSGLENKTVVVTTISPYVMMKKNHEMLEGNERYEGYCVDLAAEIAKHCGFKYKLTIVGDGKYGARDADTKIWNGMVGELVYGKADIAIAPLTITLVREEVIDFSKPFMSLGISIMIKKPQKSKPGVFSFLDPLAYEIWMCIVFAYIGVSVVLFLVSRFSPYEWHTEEFEDGRETQSSESTNEFGIFNSLWFSLGAFMQQGCDISPRSLSGRIVGGVWWFFTLIIISSYTANLAAFLTVERMVSPIESAEDLSKQTEIAYGTLDSGSTKEFFRRSKIAVFDKMWTYMRSAEPSVFVRTTAEGVARVRKSKGKYAYLLESTMNEYIEQRKPCDTMKVGGNLDSKGYGIATPKGSSLRNAVNLAVLKLNEQGLLDKLKNKWWYDKGECGSGGGDSKEKTSALSLSNVAGVFYILVGGLGLAMLVIEFCYKSRAEAKRMKVAKNAQNINPSSSQNSQNFATYKEGYNVYGIESVKI

SEQ ID NO: 184 - DNA, 2870 bp, Homo sapiens
agggattcttctgcctccacttcaggttttagcagcttggtgctaaattgctgtctcaaaatgcagaggatctaatttgcagaggaaaacagccaaagaaggaagaggaggaaaaggaaaaaaaaaggggtatattgtggatgctctacttttcttggaaatgcaaaagattatgcatatttctgtcctcctttctcctgttttatggggactgatttttggtgtctcttctaacagcatacagataggggggctatttcctaggggcgccgatcaagaatacagtgcatttcgagtagggatggttcagttttccacttcggagttcagactgacaccccacatcgacaatttggaggtggcaaacagcttcgcagtcactaatgctttctgctcccagttttcgagaggagtctatgctatttttggattttatgacaagaagtctgtaaataccatcacatcattttgcggaacactccacgtctccttcatcactcccagcttcccaacagatggcacacatccatttgtcattcagatgagacccgacctcaaaggagctctccttagcttgattgaatactatcaatgggacaagtttgcatacctctatgacagtgacagaggcttatcaacactgcaagctgtgctggattctgctgctgaaaagaaatggcaagtgactgctatcaatgtgggaaacattaacaatgacaagaaagatgagatgtaccgatcactttttcaagatctggagttaaaaaaggaacggcgtgtaattctggactgtgaaagggataaagtaaacgacattgtagaccaggttattaccattggaaaacatgttaaagggtaccactacatcattgcaaatctgggatttactgatggagacctattaaaaatccagtttggaggtgcaaatgtctctggatttcagatagtggactatgatgattcgttggtatctaaatttatagaaagatggtcaacactggaagaaaaagaataccctggagctcacacaacaacaattaagtatacttctgctctgacctatgatgccgttcaagtgatgactgaagccttccgcaacctaaggaagcaaagaattgaaatctcccgaagggggaatgcaggagactgtctggcaaacccagcagtgccctggggacaaggtgtagaaatagaaagggccctcaaacaggttcaggttgaaggtctctcaggaaatataaagtttgaccagaatggaaaaagaataaactatacaattaacatcatggagctcaaaactaatgggccccggaagattggctactggagtgaagtggacaaaatggttgttacccttactgagctcccttctggaaatgacacctctgggcttgagaataagactgttgttgtcaccacaattttggaatctccgtatgttatgatgaagaaaaatcatgaaatgcttgaaggcaatgagcgctatgagggctactgtgttgacctggctgcagaaatcgccaaacattgtgggttcaagtacaagttgacaattgttggtgatggcaagtatggggccagggatgcagacacgaaaatttggaatgggatggttggagaacttgtatatgggaaagctgatattgcaattgctccattaactattacccttgtgagagaagaggtgattgacttctcaaagcccttcatgagcctcgggatatctatcatgatcaagaagcctcagaagtccaaaccaggagtgttttcctttcttgatcctttagcctatgagatctggatgtgcattgtttttgcctacattggggtcagtgtagttttattcctggtcagcagatttagcccctacgagtggcacactgaggagtttgaagatggaagagaaacacaaagtagtgaatcaactaatgaatttgggatttttaatagtctctggttttccttgggtgcctttatgcagcaaggatgcgatatttcgccaagatccctctctgggcgcattgttggaggtgtgtggtggttctttaccctgatcataatctcctcctacacggctaacttagctgccttcctgactgtagagaggatggtgtctcccatcgaaagtgctgaggatctttctaagcaaacagaaattgcttatggaacattagactctggctccactaaagagtttttcaggagatctaaaattgcagtgtttgataaaatgtggacctacatgcggagtgcggagccctctgtgtttgtgaggactacggccgaaggggtggctagagtgcggaagtccaaagggaaatatgcctacttgttggagtccacgatgaacgagtacattgagcaaaggaagccttgcgacaccatgaaagttggtggaaacctggattccaaaggctatggcatcgcaacacctaaaggatcctcattaagaaccccagtaaatcttgcagtattgaaactcagtgagcaaggcgtcttagacaagctgaaaaacaaatggtggtacgataaaggtgaatgtggagccaaggactctggaagtaaggtcagttgctgcagacaaactggcttttaaataaatttgcttccatattggttgaataagacaaaaacaattaaactgagtgggaagtgaataaaaaaaggctttaggtatcgattccatatttttcaaagccaaatatgtaaatgctaaggaaagtaaacaaagaggagattccaatcttgtaatttaatattgttattaaaactttaatgtatcctattctttaacatttggtgttaatataaaattacttggcaatgcttgacatttgaaataaacatttttctattgttttattgcaagt

SEQ ID NO: 185 - protein, 807 aa, Homo sapiens
MQKIMHVLLSPVLWGLIFGVSSNSIQIGGLFPRGADQEYSAFRVGMVQFSTSEFRLTPHIDNLEVANSFAVTNAFCSQFSRGVYAIFGFYDKKSVNTITSFCGTLHVSFITPSFPTDGTHPFVIQMRPDLKGALLSLIEYYQWDKFAYLYDSDRGLSTLQAVLDSAAEKKWQVTAINVGNINNDKKDEMYRSLFQDLELKKERRVILDCERDKVNDIVDQVITIGKHVKGYHYIIANLGFTDGDLLKIQFGGANVSGFQIVDYDDSLVSKFIERWSTLEEKEYPGAHTTTIKYTSALTYDAVQVMTEAFRNLRKQRIEISRRGNAGDCLANPAVPWGQGVEIERALKQVQVEGLSGNIKFDQNGKRINYTINIMELKTNGPRKIGYWSEVDKMVVTLTELPSGNDTSGLENKTVVVTTISPYVMMKKNHEMLEGNERYEGYCVDLAAEIAKHCGFKYKLTIVGDGKYGARDADTKIWNGMVGELVYGKADIAIAPLTITLVREEVIDFSKPFMSLGISIMIKKPQKSKPGVFSFLDPLAYEIWMCIVFAYIGVSVVLFLVSRFSPYEWHTEEFEDGRETQSSESTNEFGIFNSLWFSLGAFMQQGCDISPRSLSGRIVGGVWWFFTLIIISSYTANLAAFLTVERMVSPIESAEDLSKQTEIAYGTLDSGSTKEFFRRSKIAVFDKMWTYMRSAEPSVFVRTTAEGVARVRKSKGKYAYLLESTMNEYIEQRKPCDTMKVGGNLDSKGYGIATPKGSSLRTPVNLAVLKLSEQGVLDKLKNKWWYDKGECGAKDSGSKVSCCRQTGF

SEQ ID NO: 186 - DNA, 52637 bp, Mus musculus
  misc_feature (1)...(52637): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccgtgcttcccgccatgatgatactggcataaacctcagaagctataaaccaacccccaattaagtgcttttctttataagtgttgtcctagtcatggtgtctcctcacagcaatagaaaccctaagacatttttttttcatatccatactgccatttgtattgcatgttttgagagctgcctattaattttgtgagaccaacagctattaacttggatgatgttttcccgtttgtttgtgtgtttgtttgtgtgtgtgtttgtgtgtttgtttgtgtgtgtgtatatgtgtgcgtgtttgtgtgtgtgtgtttgtgtgtgtgtttgtgtgtgtgtttgtgtgtgtgtttatgtgtgtgtgtttgtgtgtgtgtgtttgtgtgtttgtgtgtgtgtgtgtgtgtgtgtgagagagagagagagagagagagagagagagaaacaggatctctgtgtggttctggctgtctgagagctcacacagattctctaacagtgtgcaccagcagacgctgtggagatcttgaagtgctttccctccagtctcctctaacagtcctagatcctgcgcttaaacaaaggtccgagatatatttagatttgattttgtacatggtgaaataaagagactgagtttcattcttctccatgtggacacccagtttctcccagtttccccggcaccatttgttgaaggagatgtctgtgttagttagggttttactgctgtgaacagacaccatgaccaaggcaactcttataaggacaacatttaattggggctggcttacaggttcagaggttcagtccattgtcatcgaggtgggaggttggcagcatccaggcagacatggtgcaggaggagctgagagttctgactcttcatctgaaggctgctagtggaagactggctccaggtagctagagtgaggatcttaagcccacatccacagtgacatgcctactccaacaaggccacacccctctaaagtctggcacttggaaggtggaggcaggagagttgagttcaaaactagtctcagctatatatacagtgactttaagggccaagcatatacaaaccatcacaatgtctcttttccaatgtatattttattttattttattttttaaagcatctttataagaaccaagaaatcattatctgggagtgatggcccacacctttaatcccagcactcagggggcagaggcaggcagagctctgagtttgagtccagcctggtctacaaagtaaattccgggacagtcggctacacagagaaacccctgtctccaaaacaaaacaaccaaaaatcaaacaaataataataataataaaacaagaaatcacctggctatagctgcatgaattgttactattttactgcctcgtttagctcagtttgtccttaaaatcactgtatatatagctgagactagtcttgaactcaactctcctgcctccaccttccaagtgccagacttagaaggcacagaattgaacttgtgggggctgtcagctccagcaaccttttgacaaacctatgtcctgagagaggcctgcctgctgtgggttagctggaatcattttaactcacctatgcaggagctcacagagtatcatgaggcacagcagctcaaatgtggctgcaaggtactctttaaaagaggcatgaggacttgacctaggtcccagcacacatgtaaaaaccacactttcataaacgtctgtgtgcccaaataccactccccatgtggtgggtctctgcaaacaccagggcaggcagagtaacaatccctgtgaagcaagaaggaagtcctcttcaacagaactggaaagctggtgtttcaaacttccagagtctgacactgggcagattatctgaagtactgtacaatttggagaaagtcccccgagtggtgccccggaccaatcagaaacccgaaacctagatttaatttgttttccaagacagggtttctctgtgtagccctggctatcctggagcttgttctgtagatgtgtgtacgctggcctccaactcaaaaatctgtctgcctctgctttctgagtgctgggattaaaggcgtgcgccaccactgccagactaaattctttaagtccaaaacctgggactgtcttaccttcagagatcccaaatacaaaatactcaggtagacttagttttagggggcaaactggtgaggggtagccaatcactggggttgaggttcccctaggaccataatccttacccttgcctagagaagccccacctcaggattcagggcatcttctcagggcttagtggtatcttaattagggttttactgatgtgaggagacaccatgacccaagcaactcataaagaacaatatttaaatagggctggcttacaggttcagaggttcagtccattataatcacagcaggaagcatggcagcatccaggcagacatggtactggagaaggagctgagagttctgcttcttgatcccaaggcagccaagaggagactatcttcagtagacagctaagaggagcatctcttccacactgggcagagcttgtgcactaggaaccctcaaagccaccccccccccaaacaatgacacacttcctcgaacaaggctacacctattccatcaaagccacacctcctaatagtgccacttcccatgggccaaacacattcaaaccaccatacacaggtttaagtatacagaacgtctttataagctggtcggggacttcactaagtgttcagcatcagtggccccaagcctttctcaggatgatctcttaattacaaaagccatatcctggtctgacatacttccgttaacaaggacagttagccagaagcggagctacagaagccaaaaagcaaggtcagtacattttaaggactttccagaactctggactttgttggattaggatattgattttgattttgccagtggtggtgtctctgtgctgagttttgcagcctgaatggtatttccatcatggcgacagttgtgctaaggtctgggggcctggaatattccccacaggtcttagtgaatgcgtcaaatcatgggctcatcctgttctatagaggtatagttggtcttaaggactatctatcaacttgactcaactgatacataattgaacatacagtttaggatgcaggacccaccattaatccaatcagaatgagaattaaagaccccagggctgatagcagagttgttagtcatggggaacaggagagcagagactggtaccaattttctgatttacgtttttgtttctttccctttttgaggtttttccccaccataacaagactttctctaagtacttctgatcacttagcatagaaacaacaggatttccctaaagccagacataatcccccttatcgcacaaggagtaagtctaaacctctggattttgtaggaccccatctgtaaggaagtctaactgttattttcattcagaaatggaaacttttattttgtcttgtttttcaagacagggtcttctgtgtagccctggctgtagtggaattcactctgtagaccaggctggcctcgaactcagagagatccacctgcctctgcctcctggatgctagggttagaggcatgtgccaccactaccaggacaggaaaatggaaactttttttttttttttttttttttttgggttttcgagacagggtttctctgtgtagccctggctgtcctggaactcactctgtagaccaggctggcctcgaactcagaaatccacctgcctctgcctcccgagtgctgggattaaaggcatgcaccaccatacctggcagaaacttttaaggtcctgatcaacctgtctacttagtttcttaaactttttatctcccatgataaaagccaatctgcccatgatagctgaactggcctctcctgctccaaccagaagagggaaggggcggggagagggatggagaggttttttccctttgtggtccagggcgcgagcaaacatggttttcccttcttctccatcatataggtacacctggagcacagtgtgtactgtgatgcataacagatggctctcagtgtgtgtagaagatgcacatttagtcaaaacattagggcttgcccaccgaggaatctcagcggctcggtagcattgctgttctccagacgagctaacccacaaggcagactagtgggcatcagaacaggggaaggggcgttggtagctctggtgagtgaagggctcccagcactttattaaactgctgtaacctaaaaagttgtgttcagtgaggttattggtgggactctaggaggatgccaggtgggacagaatcacatgtgaatcaagacagcaagccagatagtcagacaccagcagaagaatcatgtccatagccttatctacatctatgtctatgtgtatacacatacaaacatacatgtgtgtatacacatgtatatgtgtgtgtgtggtcttagggttttactgctgtgaacagacaccatgaccaaggcaactcttataaggacaacatttaattgggctgccttacaggttcagacgttcagttcattatcatcaagttaggaacatggaagcatccaggcagacaaggtgcaggaggagctgagagttctacatcttcatctgaaggctgctagaagaatactggcttccaggcagctagaatgagggtcttaaagcccacacccacagtgacacacctactccaatagggccacaccttctaactgtaccactccctgggccaagcatatacaaaccatcatatataagtatatgtacatatgaggagagaagagttatgtatggactcgagaatctggccttagaaaggcaggtagaccaacgaacccctcaaatccctcacaaagactgcactagggctggagagatggctcagcggttaagagcactgactgctcttccagaggtcctgagttcaaatcccagcaaccacatggtggttcacatccatccgtaatgaaatctggcaccctcttctggagtgtctgaagacagctacagtgtacttacatacaataaataaataaatctttaaaaaaaaaaaaagactgcactggcagcgcaggggagtctaggaagaaaagcatatatctattttttgtttggttgtttggttatttttggtttggtttggtttttgggttgttttgttttagggtttttttttgttgttgtttttgttttgttctgtgtgtgtgtggtttttgtttggtttgttttttgttttttttcagacagggtttctctgtgtagccttggctgtcctggaactcactctgtaaaccaggctggcctcgaactcagaaatccacctgcctctgcctcccgagtgctgggattaaaggcgtgcgccaaaattgctcaacttgaaagacaactttatataagatgtcatgttgggaccagcgagatggctcagagggtaaaggtccttgcccctaagcataaataagggcctgggttcaattcctgagacccaaattctggaaggagagagctgactccccaccagttggcctttgaccaccacccatgtggtgtggcaagtataggtacacacacacacacacacacacaaaatacatgttgttaaaaaaaaaaaaaggaatgtgtttttcaaatgcttcagccaccacagcagaaagcctggtaggccagcaggctggggctgacaggatgctgggcacactggtaaccatctcaggtagatgccaagatggttgctgcattccaactcctacctagagggttgtcctgtaactcagaagtcagcctgcctctgcatcctgagtgtaaaggtgtgggctaccacacctggatatctgcctttggtatttatattgttttatattgttttacaggccccttactggcctgccagtcacgattcatccagccccagggatcctcctgtccccacttctctgatgcagggctttcaagcacacaccgcagtacatggcttttttatgtgggtcctggggctcgaactcaggtcctgaagcttgtaaaggaacactttacctctccagtcagactgtgtaagcacacgcaggcgcgcgcagttcccaaagagacctcaagagggcgccagatctcctggaactgaaattagtgacagactaaaagagcagctagtgctcttaggtgctgaactatctttccatcttttctgcaaacagtttctagatcagtggttctcaacctgtgggttgagaccccttagggagctaaatatcagatatcctgcatatcagatatttacattacaattcacaacagtagcaaaattacagttatgaagtagcaatgaaagtgattttatggttggggatgtggccacaatgtgagaaacagtattaaatggtcccaagctataagaaggttgagaccacagctccggatttaagataaaattgctgcattgtctacacccacttggtggcagacagaaaaatgacaaaactataacaagaaggattgatggagggatgactgtagacatcactactaggtcttccaggtatggctcgattggagggctgggccttgggcaaagggctgggccaaagttaaagtcagtgactataggttggtgattgctgctactgcaggcatgcacaggagtgggcaatgtggagtctcatttgtcagaggaccaattagagaggcagaatggggggctatttgctgccaagtgaataaggaaaggtgcccagggctccaggcagggctgcccaccctcagtggggtgtggtgattatagtcctggcataaaaagccacaattcctgattgcctcaaatcagggactgaagggctctgcccatcatctgccacctcatgacagagacaggcaagcacactgccctccacccccaactgtaggtgctcctttcctgctggaccagaaactgcccagcgccagcctcctctggtcagtagatggtctctttccaatagaaccttctggaatgagtctggaaatattacaggctttcccagtgcctcagtgacccagatttcacagtttccatgatgcacttgggtgtttagccccactcccacctccttcctttgcatgagctgggaagcctggggcacaggcctgattccaactctctcacaataggtcccttcctccagggagccctcccttccccttaggttagtcagcggctctcctagtctccgttgattttcaactgtcctctgatcacagccttgtctgggggtgggtctgaaagggggctgtgatacacagagggctgaaggaaaggagagcacttctcttttcttttttgatttatttatttattatatgtaagtacactgtagctgtcttcagacactccagaagagggcatcagatttcgttaggatagttgtgagccaccatgtggttgctgagatttgaactcaggacctatggaagagcagtaggcactcttaaccactgagccatctcatcagcccccaggagagcacttcttaagccccatcgggtcacaagctgggcaagggtcacgggatttagtagatgaatacttagaaacaaacaaacaaacaaacaaagcacgtttcagagaatgaaggggttgccgccaagcctggtaacctgagttagattcctgagacccatggtggcgagaagcaccgccctccatgttaaaagaaaatgttagccaggcgtggtggcgcacgcctttaatcccagcactcgggaggcagaggcaggcggatttctgagttcgaggccagcctggtctacaaagtgagctccaggacagccagagctataaagagaaaccctgtctcttttttttaaaaaaaaaaaaaaagaagaagaaaaaaagaaagaaagaaaagaaaagaaaatgttaagttctttagagtgaacttgccccagattttaaaacaaaaacaaaaaaccctctgctactcagtgactttcacacttccctgaacttctgtttctaggggaggtagtagggtgcggtggggggggggggtgttgctcaaacagaggctgcctcactggttccccttggccagccacgctgggtgggaagaaaatggaggtgctggggaggaggtccgggaagactggtccaaccagtgtgcacgcttcatctcagggcatgggtggagccctgaaaggctgggagacagtggaaggggatgatagggctcggcagcctccaagcctggctgggtcccgtggcacccgctggatgccccactgaacttcactcttaagagagcaagaccccagcctgtggctctcagtgcccttgccatctctacaggaagcaagatggagaccctggaccccaccgggctgcttctcaaagggcctcctgttctcaggtaaggaggaaacagcctcagagggctgagggacaagatgaggcagggtagtgacatcacagctccatccctatttcatctatggcatcttctagaatgtcaggactatgagggtaggaattagtgtttgttttcccagggggttctggggagtgagcgaaggagggagggaagggactatagagactgagccaggactggtgagtcacacatagactcgcagagtttgtaaggtagaaggacatcctgaactacataggcagttcaaggctagcctggtctacatgagaccttgtttcaaataaaaagcaaaaatctaggaacaagccagccatagtggtgtatatctgtaatggcagcactttggaggctgaggcagaaggatcacaagttggagctggactgcataatgagttccaggcaaccctgactcaaaagaagaaggaaaatgaggagggaggaggaggggggaggggggggaagaaggaggaggaagaggaagaggagggagaggagaaggagaagaaaccaggagatggtggcacatgaggaggaggaggaagaggagaaagaagaggaggaggaggagaaggagaaggaggagaagaaaccaggagatggtgacacatgactttgatcccagcactcaggagacagaggcaaaatgaatctctaaggccagcctggtctacagagtgagttccagagctacacagagaaaccctgtcttgaagaatgaggaggaagaataggaagaggaggagaagacaaacctagatgatgtaattggtctatgatgaaatgtatttacttattcatcctttaaatattggttgaataagtaaattcagagggtccaagtgtttaggaacagaccacatagcatctcaggacagaaaacccttctgccactggcgtggcagatctgtggcatctgtgcctatattcctactcccagggcagacatcactaatcaatctcattgtcatttccaatgtgcagcccttatggtctttgctgcggttgagagtctgtaaagaggaaggttttgttacctctgcccaaaactcgacctcaggcctcctccatacttttccacagccttgttcctggcccttgagctgccccaaggctcacaggcagccctccacatcgagatgatcccagagcagcctcaaaagaaccaggaccttcttctgtcccttcacggtgttcccagcactgctcaggatttcatctggtacctgggggaggaggcttctggaggcacaaggctgttctcttatatccccggactaccacggccccagagggatggcagtgccatgggacagcgagacattgttggcttcccaaatggttccatgctgcttcgaaatgcccaaccttcagatagtggcacctatcaggtggccgccaccatgaaccctgcctggacaatgaaggccaagattaacgtccatgtagctggtaagtgggacagctgtgatggcagggagaccaagtgcaaagaccatgccatttagcctcctcattcattatatacagtgtgcattgattgagcatctgctgagtaccagaccatggatctcccagaccctaagatataccccatttcattagttctcaccatactctgattgttcccatattcactgagcatcttttatatgcctggtcctgatgaattgttcaattttcttgatcacaattcaagtatttgttgatgtagccacaccagatgaagagctaggggacagggtggggaacaaaggtgacatctaacatttcttgggaatcttaccaggccaagtatgaatctaaatactttccctagatcacactgatcattaggactggctaatagcttcgagtagagagctgtgcatctcatagaagctttacagcctctctggtcttataagacattactagtgcttgctactcacaagaatcacatgctaggttttgacaagtgtccccccagaaccagggtcacctctgaaggaggaccacaacaatatagtaagtactttgcacttaaagaagcttgctgaggtggtcgccatcgttatctccattctatagatagggaaactgaggcacactggggttataatttgcctggctcagaaaattaaacaggctaacatgacacaggagaggaagtcagagaggtctcgctgaagatgacctgtagttaggtttggtgggatataagtgtcatccgccactgtgtagactgaggaagggtagttgggaattctcaggcagcctaagccacataatgagatcctgggctactgaacaggaccatgtttcaaaaatgtcaacaggatcagtaagctagcccaaggggtaaggtgcttgccaccaagcctgatggtccccaggacctcaaggtagatggagagagccaactcccaaaggttgtcctctgacctccacttgctggtgcagacacatatgtcaataaataaataaactaataagaaaaacagacaaacaagcaaatgccaggtggtagtggtgcttgcttttaatcccagcactcaggaagcagaggcagcagatctgtgagttcaaggacaggctgttccacagagtgagatccagaacaaccagagctactcagagaaaccctgtctaaaaacaccaaggaaaggaaaaacaaagagaagaaaaaaagaaagaaagaagaaagatcacacgccccagcccctcactgggggattctaggcaggggctctcccactgagccacgcccccagcccctctctgggggattctaggcaggggctctaccactgagccacgcccccagcccctcactgggggattctaggcaggggctctcccactgagccacgcccccagcccctcactgggggattctaggcaggggctctaccactgagccacacccccagcccctcactaggggattctaggcaggggctctaccgctgagccacgcccccagctcccttagctgctgctaactctgtccttgtccccatgcagtgtcactgatgtgccattttttgattacaagtcagtcagtgccccacattaaaagaagagggctaaggtaagtgatggtggcgcacacctttaatcccagcactctggaggcagaggcagggggatctctgtgagtttgagcccgtctacagagtgagttccaggacagccagggctacacagagaaaccctgtctggaaaaataaaaacaaacagaaaacaaagaagagggctcagaccctcaagcttgttagagtaacaactcagcacaggatggggtgtgggagacactgtttccttttgagctctagaaatcaaaatgtttcacctacactgataaattcactgtttatgctcaggaagaaatagtaacatgttaccagagggagacagttcacctgaggagactgcttctgtctggtggacagcgatgaggaagtgatgagggacttggaatactttaaacaccatggcccaggactatgagccctgcctgggttgagattctagcgcagcctgatggcggaggcaggaggatagaaagtccaaagcaagtctgggcaatttattgaaatcctgcttttttttgtttttgtttttgttttttttggtttttcgagacagggtttctctgtgtagccctggctgtcctggaactcactctgtagaccaggctggcctcgaactcagaaatccacctgcctctgcctcccaagtgctgggattaaaggcgtgcgccaccacgcccctcaaaattacagaaaagaggaggggaggaagggaaaatgggaaaaggaaagggaaagcattgattttaaaaaatgatttacaaggctctcagattgctcacagataagaagaccactggctgctcttccagaagagccgggtttggttcctagcacccacacggcaactcacaaccacctagagttccaatgcccttcttgcctctgtaaatacatgacatgcacatggtacgcagacacacatgctggcaaaacactcagacacatacaataagatttttaaaaattcacataggctgtacatgtggctcagttggcagagtgcatgcctggcatacacgaagccctgggttaaatccctagcaacttataaactgcacatggtgaacacctgcattcccgggtctgggtcagtctcagaggcagaagttcccctgagatttgctggcgacccagcctagccaaggggacactccagactcagtgagagacactgtctcaaacaccaacatagacactgattgaagaagacacttgacacccacttctggccttatctacatgcacacacacgcatacacacacacacagacacacacacactcatgtgcaggaatttgagcatccttagctatatagttcaaggtcatccttagctacacagtaaatttgaggcctgccttgactataagagaccctatctcaaaataaaaatatttttttaaaaactgataacatgagtgggcagagtgaggggctgtgggcgtggctcagtgggagagcccctgcctagaatcccccagtgaggggctgtgggtgtggctcagtggtagagcccccctgcctagaatcccccagtgaggggctgggggcgtggctcagtggtagagcccctgcctagaatcccccagtgaggggctgggggcgtggctcagtggtagaatggatgcctagcctgcttagcatggcactgcaaagtaaggaattaggtgagggcagacagatgtcttccctgagacaaccatcactcctaggtgcacgcgaggtctcctcactcctccctgtccatgccgggatcacggtagccatcatcattgggagtcttgctatcgggtcactacttgtatgtggcattgcctatgtcctggtcactcgaagccggaagggccggagccccaggtacagttcccagaactccctctgtgtcctctaactcctctttcccctctaactctcctgtctttcccaggctgggtgaaaatcaagttaataggtaggaatcagggagacagagtctctaggatgtcggggtccctctcctccaccctagcatctcagggttcttctatgtacccctaggaatccagccacagagaagccagaagtgaacctgagtcctgaatctggtaagccaggagaaagtgcctttgcacccagcccttccgtgtctcccccagttaaaggcctccatgcccacatgcagtcagagtccttggggacctttgggcacactggggagctccgagagatttaaggcccctcctaaccctctagggttccttctcttaacaagtcttctgctaataagccttccatagctcccccagtgccttgggacagacttctgtctccctagcatggctctcaggtccctcattatctgcagacagtgggctctcttgccaagctcctgcaggcttccctcctgcctctggccagttctcacttcccactgtctcagatgaaccctcttccaggtagtcctccctgatatccagcctggccaggactgtttctgtttccacatcccctattccccatcccccatccccagccttagactctctggattgtcactctctggggatgggtctcttttctcccaagggactttgggtttaagaagggtgtggcatggattgtctgggtcaccactgtgtccccagcacatatctggcaggaggagaaatttgcacaaatgttagttgagcaactgagtgagcgaaatggacaggcaggtagaacgggttctacagtggtgagtcatctgcccatgggacccccttcctcctctacttcaggtgacagcaacatctatgaagtgatgccatctccagtcttcctggtgtctcccatcagtgacatggagcaaggaagcccacccatggtgagtcctgtccccttagatcttgcctctcgaaaaacctctacccggagttagctatggtgcctgggcacctggaagccatgactcttcatttctctctccagtcaactcattctgtcttcctctccttcttttgcatatgtgggggtggagggaggaacacgcaccatgacatgcatgcggatgtagaggacaacttgtgggagtcagttctctccttccatcatgtgagtgcttggatttgaactcatatcatcagggttagcgacaagcaccttgcccccactgagccatcttgccagcacctctctccaattcttgtgtgtctcatcacctgcgatagcccaacgacaactaaagcaaggattccatcgaagtccagtggtgaaccagtgagttttgtagggtcacttacaggaccgtggcagccacacccagtactggtgagggctcatggaagctacacgatgtgcaggcagagacaccaaagaatcacaacgtccccatcaactattatcccagagtgtgggcactggaggcaggagagtcaggagcttaaagtcagcttccaagtttgaggccaagccagaaggggatagcagagccagggacaggcaggattccggtccagttggcagtgagtgctgaaggggtgggagaagagagaggccttcttcgggaatcttagtgcgtctcagcttggctcatttcagtgaaggccttccctgtggggatctttgacgatgcatctctgtgagaccatctttgcttgttcatgtttcattttgttctttaaaatcacttacttcttgtatgagggttctgctgcatgtacacccgcataccagaagagggcatcagatcccctgagagacccaccatgtggtagctgggatttgaactcaggacctctggaagagcagccagtgctcttcaatgctgaatcatcgcttccagccccttgttcgtgttccgttattggggaggatgtagatgctttattcggggtgaaccagggattatataattttggggaagggcataagagtacccaggaagggaaggctctggctgaaggctacggggattgagatactctgtggtatagaggaggaagaactccaggtgctgagctatgtgactgaatacccatggtcctggcagttggtggccatggttacatgctgcagagcaggcattggaggctggagtgtggcagcgccactcctgccagctcagatgtctgagattcccacctcagcagttcttatgcccatctggtagcgctgtccaagtgcttgacaagcctggactagattgagaccctgcctcaaaacaaaaacaaaaaccaacaacaacgaaaggaggtggagggagttggctggaacatggctcagcatgttcttgctacttttaaggacccaaatttggatcccagtaccctcattggcagctcacaactacctataattctagcttcagaggacctgatgccctgtaccagacctcagtgggcagtcacgtgcacgtgctcacatatcatgcacacacacatactcacacacatacacgcagagacacacacactcacacacagacacacatagcacagacacatacccatacaccatgcacaaacatacagacagacagacagacatagcacagacacatacacacatactcacacacataaacaaacatactcacaaacacacacaccagacatacatacacacatatacaccacacacagacagacacacacatacagacaaacacataaacatacactcacacacatagacatacacactcaaaaatacacacacaccacatatacacaaacatacacacagacatacaggcatccatacagatacatgcacacatacacacacaatcacagacacaaatacagacacatacacacatatgcatactctcacacagcacagacacaccataccatacacacagagacatacagacacacagacatacaaatacatgcacacatacacacacacacactcacacacataatcacacacacacagcacagacacaaacagacacacacacctatacacacagatagcacacacatacacataccatagacacacacagcacacacacacacacacacacacacacacacacaccaataaaaattagaagaaatctttaacggatcaggaaaacaaggagccagacaatggctgagcaggcacttgctcctctaacctgggccctgagctccattcctgggacccacataaaagtcaaagagaactgatccccaaactcaccctcagacgtctgtatgtgtgcaccctacatacaattattgacgttgatgatgatttgttttgtgttttcaagacaggggttctctgtatagccctggctatcctagaactcactctgtagaacaggctggcctcgaactcagaaatctgcctgcctctgcctcccaagtgctgggattaaaggcatgcgccaccacccctggtaataataatatttgtaaaagactgacagagacagagagagaatgtaaaaacaacaaaggcaatttgcttaaccctcgtgttgaggagaagctaggcttctgaacaggccagaagccctcacggtcgggcccattgcctaagatgtgtgacacatgctaagtggcctcataaccagagggtcagtggggactctgaatctgggcctgtgcgtcatacataacaccaggatcaaagactggagggtgtgaggaaccctctcacctgtacctctcccctgcagagtcagcctccaccacctccaccagcatctcaggagccagagccagagcaccagcactatcaggtatggattgcttaccccccaccccacaagaaccccatggagccatgagctagaaggtcagatgggcagggacatggactgtcctctcctctctcccttcaagaaagctccccagtgaaacctgcttcagcttccttgagactgaaccactggacctggccttgccttcctgggcctgggctccttctctgtagaaatgatcgaaagcttcaaatctatacaggatgagcaaggtccagagagggaaaagagattgcgtagggtcacacagcagagcaggtcaggcctttatgcaattccactacatgaagggacccatttctggattgggtatcaggtctctccaatcttctcctgggtccctctccctctcccctctccccctccctctccccctccctcttcctttccctcttggtttattagtatctcgtcctctcctctttcctgtctggccttgcccctgttattttgggtacacctctcctgctccctagtaccccctaactctggggctcaccctctttcagtctcctggttctattctctgtcatatccccaaccccactctgggccaccaccgctgtctctcttccaccgccacctctcctgcccctcatagttcctgttgccctcttcctaggacctactaaaccctgacccagccccatactgccagctggtgccaacttcctgatggaccctcggcccagcctgcacagaagacagaatctcaacttccagaccccacccctcagggcttcacacctatagaaaggacacatgggacacccacaggacaacgctgcagggaaactggcaagatgggctctgccatagactcagcatgacatggagtcagtgcctctcgggatgagagactgacaaccccagatccccaatgtcccaacaaccttcagtctgtgcctcttgggccacctgcctctaagaaagcaggctcctgccccacccaaggccagcggccccatccaggtatttgagtgatgggaagaaggccttggtactccaccataaaattccatccagctttaaccagttacccagaagccctttccttgggaagaaagcactaccaggaaggccgcacaaccaccggaggttctcaacctgtgggtcaaacctcttcagagagtcaaataattgtttcatagggtttgcctaagaccatcagaaatgccagatatgtagattatggctcataacagtagcaaaattacagttgtgaagtagcaacaaaattatttttatggtcggaggttgtggtgacaacttgaggaactgtattaagggtctcagcaatacaaaggttgagagccactgctcatagagccaaacacctgtcaggaagataacagccttgggcaaattaactgcccgacccctgacctgcttcaaaatcagccacacagaggactgggactgtacagcacagctgtagagcgcctgcccagagcccacccgtgagggactgagaacatgggggcgcggctctgcagatgggctgcttgcggaactggagagaggcctgggtttaatcctcaaccgcagggggacaaaacagtagttagtcctcagccactgggaagacgtgacacgtgacacgcctggaggaagtctctggaagcttgaaagctcaagaaactgccccaccctgtggcctctgggcccaaggatcagtgacggccactttggactcacggcgtttgattgtaagatgataaactgtagttgttttaagccactctttgatagcaggttgttccagcaaacaggaaatggggatgctgaaggatcccagggaggggacgttacaaccacagctgattggcaatatgcaaatgagcccctcggagggacttccccaggctttgatctcatacaaccagtgcatgactaagctggccatccagatcaaccatgtgacctgagggccagaggagacagaaggagtgaataaaccagggcttaattatgtctttttaaaagttcttcttttgagacaaagtctctctgtgtagccctggctgtcctgcaatttgctttgtagaccaggctgacctcaaactcacagagatccacctgcctctgcctcttggttgctgagttaaaggcgtgtgctaccagcagccagccaaatttataatttaaaaaaaaaaatttatttgagtgtgtgtctgcatgtgcgtgtgcgtgcgtgcgtgcgtgcatgcgtgcgtgcatctgtgtctgtgtctgtgtctgtgtctgtgtgtgttttcaagttcggttagatgatgttcacactgtgctctttctccctcttctggccttaggtggaattgcatttccacagcccctaattagaatgcaaaaagctctgattaatgaaatgtgggtgcaagcagtgcccagtagtccaggtgcgccatcactttccctccagactccagtcacagtgactagccctgtcagtcaggttcctgaatgagcccacctaaagctgagttctcctgacccttttcatagctgtctacctgagaccgaagtatcacaggagtgagaaatataaaccctaaatgagccacgctgtgagtaaaatggggcttcttattactgcaccgtagcccagctcaatctgaccacaggtgaggagacccagccttctcaacataaaaactacatttcccaggagtccttgcaactagatctggccacctcgtggttaagttcaatataatcaaaaatggaagttgtataaacagttcacagagaggtcttccctgcaagaaacagagcaagtgagagagttggggtcctggggatgctgtagacagattcaccatgctaattagagagagatctgagcaaaaactccctaacttaagtgacttctctggggagtcacaattttccaggctctttctaaacacgtttaacccacatccaagcagcattttccagatagggcgtctaagtctaactgctccactctcacaggacagtctggagaatgctgcactagtcatagtgtccctaataaatgcattcaaaatatatgcatttattaagtatatagcaagccaaagtaaaaagaataaataacaagtcaggcatggaggctgtactgcctgggtttgtgtcaacttgacataggctggagctaccacagagaaaggagcctttcttgaggaaacgcctccatgagatccattttctcaattagtgatcaagggggcagggcccattgtgggtggtggtgccatccctgggctggtagccttgggttctataagagagcaggctgaacaagccaggggaagccagccattaaggaacatccctccatggcctctgcatcagctcctgcttcctgacctgcttgagttccagtcctgacttcctttggtgatgaacagcggtttggaggtgtaatctgaataaaccctttcctccccaacttgcttcttggttttgatgttttgtccaggaatagaaaccctgactaaaataatagtgcatacctttgatcccagcaatcaggaggcagagaggcaggcagatctctgtgagtttgaggccagcttggttggtctacagagcaagttccaagacagccggggctacatagaaaacccttgccttacaaaaacaaaagatgaataaaattttaaagtaaattaaagataataaatagcaagcaaaaggtaaatagcaaaacactatcaaagcagatgctcacaatatccagtgggaacctacctactgggcatggacatcaggcgtcagcagtggccccactcagcttctctccatggaggagctcctggctcctctctgtgcagacacctttatatcagaggacaaaggataacagcctcgggctggagagttggctcagccattaagagcacgtgcttcttttcctagaggacctgagttccattcccagcacacctgcctgtaactcctgcctgtaactcctgcctgtaactcctgcctgttactcctgtagtcacagacacattcacacaataaaaataaaagtaaaagaagaagaagaagaagaagaagaagaagaagaagaagaagaagaagaagaagaggaggaggaggaggaggaggaggaggaggaggaggaggaggaggaggaggaggaggaggaggaggaggaggaggaggaggagtaagaccttggaaatgacttgtcttctagctgtcctcaaagacataatactttttaaaaaaaaagatttacttatttatttatttgtttaatgtatatgaggacactgtagctgtgcagatggttgtgagccatcatgtggttgctgggaattgaggacctctcactctggccccacttgctccagcccaaagatttatttattattatatgtaagtacactgtagctgtcttcaggcaccccagaagagggcatcagatctcattacggatggttgtgagccaccatgtggctgttgggatttgaattcaggaccttccgaagagcagtcagtgctcttaaccacagagccatcactccagcctcaacataatgcttttttactcttgagttgttttgctgtcttttcctccctgctactgaggtagggatgtttagcccttccccagacaaggggccttgggggacactgagacaaacatgctcgggtctgacgtggggggtgtttaagctccaagagcttaaacagaggagttcaattctcagcacctacactgggccgttcacaactgcctgtgactccagcttcagaggatccagcgccctcttctggcctcctcaggtcctacactcatgtgcacaacccccctgctccccaccccaccccacacatacacataaaaataagtctctaagccaggcctggtggcacacgcttttaatcccagaacttgggagatggagaaaccctgtctcaaaaagattgaaataaataaaattttaaaatcagtttaaaaatcaacaaaatcaatgacaaaatcctgtataatttattaaatattatgtatataatatgctgtatcacataatatcatattctatattatatattttgtgggtaggccatgacctctgacctcagattttcaagagtcttagtctatacattgccaccttgtgactggagacactggggctggagagccgatgtggctgtctcgaggcagcacgctggtgatgggaaggaaaggttgtttgttgttgttgttgttgttgttgttgttgttgttgttgttgttgtcaggatgagctggattttgctgcagtaacaattagccccgtgctgtccccagcttgaaaagcttgtaagatttatttttttcccctcctacaagtttgtctcaggtggataggtgtgacaagggtcagaagaactcagctgcatgtggacatcttcagaaatgaggctgacaaggttactcactgtagcagggaaaagcagggcacgtgggtgtgcacccagcgatttttataacacacgttccccctcccccccaaaagctggaaataaggcttccactcactttccattggctgaataaagtcacatggtactgagttctataaagaccgcagtcttgcaaatctcctccgaccggaagtgggagacctggagtactgtatgcatcctgggaattgaaccctgatccagctcccctgacaaaaatatctaagcaagcctgccctgcttaagttattttttccatggactccatttatccagcagacactgaaccagagcatagaggctaggggcaaaccgcaagtgccgatagatgcgacgagggtaaccttggcagaggctggttgtagattgaaaagggagggttagaaagcaggaagggtgaagagaaacccatccattcatgagctccacacgtatttattgagcacctgctggatacagcactgttttaggtcccaggagacatctatataaccaaaacagagacctcttccttggggggctgagctccccgcaaggagactacgggacaatcgaagaggtgcggaccaaaccacagaggtgacattgttgggaaggggagcaatggaataaatgttcagaccactaagatatttgtgcttctgtgtccataaactaaaaacaggccagcaagatggctcagtgggtaaagggccttgcggccaagcctcgtggcctgagttttgctctctggtacccacacattggaaggagggaactgacttctacatacgacatacacacaataataagtaagtgggttttttggtttggctgggagatatatatcggaaggagtgtgaaaagcagtcattcttgaatccaggaacctgcagatcccacacagttcattaagtaggtgtgcatgctgaaccagcaggaggcagcaaaggctaacacatagcccgcctagcacaaactcggccacaacctgatgcccaccccaacccccatctcccaccccactttccccaccttgtgagtattcacagcccactctactgcctcctgtcaaaatacccaaccttgatcagcctctgcctgcagcaagaacaaatgctatcagcccctgaacttagctttcccagtccccacagcccagcttagaccaggcagctcccctcccctccacctcagcctctccatggcctgtctttctccccacgcaaagcagcccaaggagctttgttcactccaaaaatcaacccttcccctccctgtctggaacaggccattgcacccagtgcctttaaagacaaacttttcaggctgggtgtgaggtgcacccctttaatcccagcactggaggggcaaggggggagcaggagcaggtgggtctctatgaggtcaaagccaatctgatctacatagtgagttccacgccagccaagactacatagagagaccctgtctcaaaaaccgaaacaaacaagcaaacaacctccccccccccaaaaaaaatagcagcagtatggtggtacacacctgtgatcccagtggggacttctggtccccctttagtattctgtaccccttatccccactttgggatccacagaactgaactgccttctgtaccccaaaactcaacctggggctctcctctccctctctctggaagaatgcaaacaaatacaaaagagaaggacccaaagtgtaaccaaagcaggtgtcaaggaggacgggattccaggcaacgcagcctgagctgggtgtccttgactggaactgggcagcagcaggggtccctgtcaccggcccctgccactcccaggatacagtcagcttttaaaagatagtggctccttgtttgacaaaagaggaagtgggcctggggaaggaagtaggctgggctctgagcccagagtcaaaatgattcaggggggaaaccttctgttcggaagccacctctgtgggcgaaaggtcctgtgcccgcttacagggtcacaggatcatcccgcatagactggtgatcagaagtgtagacgcctctcccaaaacagcagacttccatgaactcccaagggcaccagggacggtgtgcaggcctctgtagggtcacaggggtgacctcatcctgcccctgtggttggtgatgagctgagatggaggtagccctgggccaggaagtgaaggccagaactgaaagcagccgtccacagcacaccagtcgggaagagagaaaccagtgcagagttagtattcagagactttctgctatctgtctgtctgtctgtctgtctgcctgtctgcctggctgtctgtcttggaactcattctgaatatcagtctggcctcagactcacagagatcctcctgcccctgcctcccttccaggtgctggggtcacaggccaattgggccgccatggttggctttctttgctcttatacaatccagggcctcagaccagggaatggcacctctcactttgaggtgagtcctcccacatccattaacacagtcagacaatcccccacagacactccagaggccatgctgctgccctcaacagtcactcagagactcacttcccgggtgatttttcagggtgtgtgaagttgagacattaatcatcacactggaggattctaggtggttctctacctccaaagtcggccttccctgtttgaagtgagtcctccatacacacttcccaggccccaaatcatgggttctaccaactatgcccaatatacgcatgagggactggagatgaacctgcatcttcacgccaccttaaaagctggcttggccctctgtctataaccccagcgcagaagggcagagacaggaggatcactggaactggctggcagccggcctagctctgggttcagcaagaaaccctgcctcagggaacaggtggagatgtggacatcccttgttttcttaggggccagggagggggtcggaaacacacatatgcaccgacccacacaacatacagtggagaaagtgcctgctttttgaggaatgagggcctgggttcagatgcctggcatcaaggtcaaaagccaagtgtgacaactcgtgcccaaaccctagcactggggtggacgtggtggtggtgaaggaggggtgtctacgctcaccagccaggcagagcacagaaatggtgtgctctaggctcagtgaaagaccctggctcgaaagaaagaaagaaagaaagaaannnnnnnnnnnnnnnnnnnnnnnnnnnnnnnnnnnnnnnnnnnnnnnnnnnnnnnnnnnnnnnnnnnnnnnnnnncaggcaggcaggcaggcaggcaagaaagaaagcaagcaagaaagcaggttgggtgcacagctttgaccctagccctttagagacagagacaggttgatctctgtgagtttggggccagcctgatctacgtagagcgttccagaccagcgggggggggggggagtgcatagtgagaccctgtctcaaaaaaaaaagtaaaaattgtaaaaaagaaagaaaataaaagggaaaggtgatcgctagacatggagctatagcacggcatttacctagtctgcagggggtcctgagttcaactcctactgcctacatgaaaaattaacaaccgttgtgttgtgtggggcaggagagacagcacccacctggtgactcacaaccacctgcaactccagttctagggggtcagacatcctctccaggctatttcaagcactacatgcatgtggaagctaaatataatacacacacaataaaaataaaggttaataataacagtagtaataatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttccatacctcttttttactttttattttgagacaggattttcataattgtctgaactggcctggaatgtacggtatatgcctcggtcttccaaataactgggatgagaggcctgtgccaccgggcctgactgctcactcgatgctgtgtgtacagtaaggagtgaagagcacctggggtcttttgattggtctaacagcctccgtggcccagctggaaactgggattttgcctcccagccctgtttggagggacaccccctacaggtcaggtttaccataactgctctgccctgtgtcctcggcttccccagatgaccagggaaatgaggaaggggactcctctcccgatttactgagacaagggtcctgctgcagagcctccccaatctaatccaggttcccagagtattgacagatcagaagtaggcagagtcttgacaggaagggagatggttgctccacttccagccttgagctccccagggaactattgaggtggcagatgagataagagagcttgggaagggagcctcataaaacaaggtcacagaccgtgtcctcaaacggccgggagaagcgaaagattggcctgtttgcatgcgttttgttttgatgtggttttgagggtattttgttgttgttgattttgtcggtttttaaatttggttacattttatctattgggggatggctggtgcccagaccttggcacaggtgtggagggcaaaggacaactgttctctcctttcaccctgtggtgccaacaatagagctgaggtcatcagacttggcagccagggcctttgcccaatacaccagctcactggccctgtttctggggtttgaggggtttcggttgtttttgtttttgagacagagagttgctgtgtggctcaggctggcttcgaaccggcagcaatcctcttgcttccgcctccctaatgctgagattacgggtgtgtgcctcagcagcaggctgctctagcatcagaaggcagtggttcagcggctcatttaacctcatacgatagtggggccagaggctggataaagggacaataaatgtgtcaccactgttagctccagttcaaatggctcacacaaaggctagggatgggccttttggggcacctgcagttccagctcctttagaaactgaggcagaaaaacagtctcatgttcagggccagcacaggctgtgtagagagatcccatgtagcaaaaagaaaataggccagcatggtagcgcagatctcttgtcttggatcccagcacttcaaaagaagaggcaggtggatctctgtgagtttcaggctagcctggtcaacataatctggttccatggtgagaccctatctaaagaaaagaaaagtgaaattgaaaaatcaggttcaggaactttgaacagtttgataaagtggttgcctagcacaaaaccctacctttgagcttctgtgtggagtaaaggctgtgggtagtgtgcctgtaatcccagcattcaagaggtgggaggctagaggcagttcaagggttcaaggtcaccctccagcacacagtaagttccaggcagcctgggttccatgaggctttattccaaaaatagaaacaaaattttaaaaccatatctccttctaatgtaacattctaggccatctgtatgtgttgacttctcggccggaagttgagctgcctgtttgttctgttccaggctgggaccccagctcacacacagacaacgcttacacacacggtgtgtcaatcggagagtgcccagtgcacccctccaccccctgcactttcctgctccagctggagcagcccaggtataccagctctaaccccagaagagtcaggagtcaaggttgtggccacccactgctcccttcaacagacaggttgaacgtgcaaccctgggccaagcacgtaccaagtacacaagccactacagcttttgcttaaactcaaagggttcacacaggggccagggatggacctttgttgatagggcgattgaccagcattccagaagctgatggtgggtggattcccagccctgtataaaaacccctgtaatcccagcacccaggaaatggagacaggaggagaaggtcaaggccatcctcaactacatggtgaattcaaggctagcctgggctacacagacagtgtctcaaaaacaaaacaaaacaaaatgttcatactagcagaagaccaggaagcagaaagggaggagggaggaggacagagatagcaagggcagcagacagagaagggtcatgtgatgctttgacgacttgaagtcatgacacaggttagggacaaaaggtacctctgccctgccagaaacctgggcctccctggagactctcagctctgtgtcatccacacctggtgtcagcttccacgagctctctgaaccactacacagtgatggggacactgtgggggcacagtgcagggaggggagagacaccgccctcaacagtgagaactgaaggtgtccaaggctcacatggggaggggggaagctgagatcatgctgggaagacacactggaggaggcgggaggcttgggtgcacaggctgaggagtctgtattctgcagagggctctgggcagcccggcagcctctgtgctaatggagtaagggaggcataaggactgagacccaggtccttctaccggtctcaggggcagtggcatcctcctggctgagagcagggaaatggagcaggtctgggaagatactaaggtcgatttgggacaaggtgcctgagtcagaggcatccagggacattggggagctatgctgaacaacaatgggaatgagtcccagtatttaggcgagagtgtgggagcagggccagacagggagagcaaggtgaggtaaggtcacagttgaaggagggcaagaggcagcaaacccagcctctgccacccccactctccctagccttcctcagccctccccagccctccttccccttgagggcagcccaggacacagtgatactcttgaggaactgggacaggagagctgcaggtatggcctcctgcccagaagtaggctgcagggcagcagaggagccaacacccacaactacgccatcaactaagccatcagcgatgacgtctgtcacatggtgaccaaagattctgaggtcactgcctggacatcctccctccaccccagtgcagggggcagaccccctttctaaatgggcaacccccctttctggatttgcttttccattttcagtgagggttttgtttttgtttttagagagggtctcattatgttccctggcctggcctggaactcacaatgatcctcctgcatcaggacaccatcagacctaacctttaagtttttctgttgttctgagacagggtctcacatagctcaggctgacctggaactccttaggtagctgagcatcctctgaccctcccacctccatctcctgagtgacagggtgataggcatggtccagcacacctggtttatgtagttctgggtattgagcccgggggcttcatgcacgccaggcaagcactctacccactgagccccagccccagctggttctacatttgcctccctgatcctcaacaaacacagggacttaactgatttttgtaactaaactctctgaccatctgtaacaaggctggcacagagtaggtgctcattcgatatttgtggaaggaatgagtttgcgtttattgagcagttactgtatgtcaggcatgattgtaagcaccatgcatgcttgtgttacaggacccacgttgggcgggggacagctgcccttcattactaggggtgaatactgcctgaagaacccaccaacattcacagttgctccaggtcttcctataaatggcagcgggttttaaacagcctcagcacaagggctctacccctgagccactcccccaggccctcactggtggattctaggcaggggctctacccctgagacacacccccaggccctcactagggggggggggtttagacaggggttctaccactgaaccatgcccctgacttcatagtttttatttatttatttttaaagaattatttatttcttttatgtatgtgagtacactgtcgctctcttcagacacaccaaaagaggcatcagatcccattacagatggttgtgagccaccatgtggttgctgggaattgaactcaggacctctggaagaacagccagtgcttttaagcgctgagccatctcccctagttcttatttttaattaccaaaggaggatgaagagttcaggtaatccagaaatgtttgttcacaaggatcagtgagccttaccttccagaatcttgccaatgtctttgtatttatggcatcacatgccgatcaagtgtgtgtgtgtgtgtgtgtgtgtgtgtgtgtgtgtgtgtgtgtgtgtgtgtttaaaaaaaatattctgggccgggttagtggtggcacatgcccttaatcctagcacttgggaggctgaggcaggcagatttctgagtttaaggccagcctggtctacagagtgagttccaggacagccaggactacacagagaaaccctgtcttgaaaaacaaaacaaaacaaaacaccaacaacaaaccttctgacattctgagcatccttgtacttctagtcacctagatggctgttatgcaaatgctatgcaaattcttgttgaagagaagagagaggactggagagattgctcaacagttagagcattcattggctgcttttccaaaggacccaggtttgattcccagcaacccatgtgaatgagctatggaccacggaagctgtgtagtaagaccttgtgtcaaaaaaagctgtttagtgggtggatgctcttgcagagggcctgagttctgttcccagaaccctaactgggaggctcacaaccacctgttactccagaggaccaaacacccctggccttcatgggtacctgcacactcatgcagagagccacacacaacatataaagacacttaattaagaaataaaaataattggctttttgaaaaagggaagaaatatcagtgcggtggctcaatgggtaaagccgcttgctgccaagcctgatgacccgagttcaatccctggagccacagataggagaggagactgccaaaggtatcctctggcctccacatgcatgagatggcacatgccacccacctcatgtaataatgacaagacaaagaaaggacagtagtaggagtggagaaaagagaaggaaggaagggcagagcttagggcagagcttagctcagacaacggagcacttactgtgtatccatggggccctgggttccttcccaagcacaacacacaaaccaggcatggtggcaaacacctatcatttcaacaacactcaggaggcaaatgtgggaagatcagacgttcaaggttatccttggctacacaagaagttcaagtctagcctgggctacatggaactctatttcaaaaacaaaacaagacaaaacaaaacaaacaagcaaacaaaaaccagagtcttttatttccctttgatttttttgaggcagggtctcatgtagcccaggctggtctcctcatcattgcctagctgaagaggactttgaagtcaagacccccccccaaacaaatgtaagtgttaaagatgcccacccaccccacagagttgtgccattcactgtggtgacactggccactccctggctgtcccgagggctggagaaagagaagtctccaacatctacccctcagtgaccccactatgcagcagagacatcacaggcatggtagtcaagaactgcgtcaaaattttcctgcctccctcctccctcctccctggcgacctggttctcctctcagtaccaaatctgggcctttggcacaaagtggattaggcagctgccccaggaggcctggccaggtcatggcccctggccggtgcctgccacacccaccctagtgcccaaacagggccccagatcttctgtgactcgatccctccaaattccggtgatccgccccggttccaaattgccgaaagatcccaggtccagtggcagactgagccaagcctcaaccaggaagggcctctgagcaactgggacaccatcaccaccaaccatctcgaacatcagccttggatgaaaatgccattgacctggtacagctggttcctcctcagtggtgagcgagaaggggtcccccaccctgtcagcccactccctgcatctccaagagccttgagacagagaggggaagccctgcccgggagaaggaaagtgtgagccttcttcaggcatgcactagggagagcaactttgcttccctctggagcagtttgctcttgagaggaggcctgtagggcaggctggagactgccactaagagatgtcagcagggaggctttagagcagccggagcaaaacaagccacagagctgactagtgtcagggcttccggactcttgtttgtggcttggtgtgggtatctttgaggtaaggactcctatagccaggtgggcctcccacttactttgtagtcgaggatggccttgaacatctaaccctcccctctagtgctggggtttcagctgtgtcatcatgccaagtttattgggttctggggtttgaacccagggtttcacaggcactctacatcccaagcacctttatgcatcactggtgacccggctaacctggaactctctctatagaccaggttggcaccgaactcactgagatctgcctgcctctgcctcctgaatgctgggattaagggcgtgtgccaccatacccagcactacagaggctgttgtgttgttgttgttgttgttgttgttgttgaggcaggatctcattatatagcccaggttgacttcaaacttgagacagtcgtcatgacacagcttcctgagtgtgaccactgtgcccggtttctgctgctcagcctcaggctaacttagctgtatataacagggcctagttgccagggtcagccagaggtcctcagaagcaggggtgattagcacttactgtttcccgacttcgagtcctttctccttgttagcaaccaccccagaaggatgttcacttgtggcccgacttcctagagaggaaacctagggcttgaagaggtggctttctggccagggactcacaacacaaatggcagagttctgccttaagcccagaacctgccactaccatccacatcctctcagctgggaagggactgaaagcctggccaagcctgcaagtgtgtctcgtgtgagaaatggcagtgcagaggcgtcagacaagcccagtgagaaggaagaacgaggaccagctctgtctgcgtgcagagaaggggtgggagaggctcaggatgtggctcagaccgttgggtgctccgctaacactggtgaagcattgtgtttgatccgcaacactgcctaaactgggtgttgcgctgtgtgcccggaatctcaccactcgagaggtgaagacagagagatcagaaattcaaggttatccctagccatatgtcaagcttgaagccagcatctggggccatagacagaggggatggggtgggggtggggtgaggggattaaggaaaaggacaggaaggaaactgaaaaagagggaggtacttcacagatctctgctctctatgtggggggtccttgggcatacagaatgagcaccccaagctggggtgaaagacttggacaggccctgatgtttgcatgaggtcacagacacagttggctacatgagtggagagacctgtttgagtctcagcctggtgcctctaatggaaaacttggtgtcccaccttgctctgcagagtaatggctaggcaaggcatcaggccaggtggcaggggctggggctgaatggtagagtctcttcctagaaccccccagtgaggggctggggacatggctcagtggtagagaccctgcctagaatcccccagagaggggctgggggcgtggctcagtggtagagcccctgcctagaatcccccagagaggggctgggggcgtggctcagtggtagagcccctgcctagaatcccccagagaggggctgggggcgtggctcagtggtagagcccctccctagaatcccccagagaggggctgggggtgtggctcagtggtagagcccctgcctagaatctcccagagaggggctggggcatacctagcaagagtaaggttctaggttttatctcaggagaagtgtgggtatagaaggcacaaatctttcttttgtctgaccttgtagacactggggatgtccccctgtgagcttttcacctcctgtcaaatgaggtcaattctgccccttctgttccttctcagcctggatcctgaacactggggccgagatctccatcacccccgagcctgcacaacctgcagagggggacaatgtcacgctggtagtccatgggctttcaggggaactgcttgcctacaattggtacgcagggcctacgctcagcctgaccttcctggtggccagttacattgtcagcactggtgatgagacccccggaccagcccacacagggcgggaagctgtccgtcctgatggcagccttgatatccatggtgccttacctgggcacacaggcacctacatcctgcagactcttaacaggcagtttcagacggaggtgggctacggacacatgcaggtctatggtgagccaccccctctgacatctccgggactttccactctcttcctcatcctcaccctcctttgaggaacaaaagagaaaaaaattattctttaaaatagcattgtgtgtgtgtgtgtgtgtgtgtctgtctgtgtgtgtctgtgtgtgacagtatacacgtggaagtcagagaacaacttcggagagtcagctctttctttctaccctgtggaacccagggatcaaaactcaggtcatcaggtttggtggcaagcacttttacccactgaaccatcttgccagctcttaaagatgcttttacagttgggtgtgggggtgcctaaatcaacacaaaaatgctcaccttctccattctggcttccaggatgataactgtcttccaaagcccttctttgtcactatggctcgggggtacagaagtacagcttggtggtacttcttgcccggggacaggaggtgcccctcccctccccctctgtctctcgctccgcccatagagatcctggcccctcccacggtcatggccaacgacactgcgctggtggagcgtagggatacccttcgtctcgtctgtagcagccccagccccgctgaggtccgctggttcttcaatggtgacgctctgccagttgccgtccgcttgggcatgtcccccgatggcaggatgctgacccggcatggcgtccgcagggaggaggcaggtgcctaccagtgcgaggtgtggaaccccgtcagcgtcagccgcagcgagccactgaacttgacggtatactgtgagtcttccaaggcacctggtatcacagatggggaaactgaggcccacgacgagaagtccacagttacacagcaagtcagcaagcaagctggggaaggagccagggcccctctaaaaatatacttgcctactttatgaaagtacgggttatggctaatacatccaggtcgatgtaggaccctgtagatgagagagggagtacacacctgccatcccaggtatccggaggtggagggaagatcctgaggtggagggaagaccaggccatggcatatgtctggcgtgcaccaaattccatctgcaacaccacaaaaatgcacagcaatcctctgagccctagggaaatggagacaggatcccgagcacccttccccaacagctacatgttaagtccaaggtcatcctgtgctacatggaggcctgtctgaaaagaaataggaaaaaggaaagatgcctaaggaaacggatagcatggacacaaggacactgagcttggaaagggtcattaaccatcattggaacccagggctcagcggggacatcacaaaagctcatcacaagaaacacacagtacttcctgggccagcagctgtgtgtgtcaaatcctgagaatacaaatgatggggttgcctagccatggtggggcacccctttaatccaggaggcagaggcaggtgaattgctgtgagttcaatgtcagccagggctacataatgaggctctttctcaaaggaaaaaaaagtaataataataattataataataatagcagtaatttcaaaagtaaggccggtgtacagaaactaaaattctagaatcctactaccagagtattccagatgccggaaactctagaaccagagtctagactgccaagcctaaaatcacaagaagtagagccctagaatcaagttctaacatctgagagtctagaacctcagaggtgaagatttctagagcccaagaagcctagaacctagaagcatgggttctttttgtttggttgtttttgttttgttttgttttgtttttttgagacagggtttctctgtgtagccttggctctcctggaactcactctgtagaccaggctggccttaatctcagagagccacctgcctctgcctcccaagagctggaactaacagcatgtgccaccaccacccagctctacacattcttttttttttttacagataaaaacaaaacaaaagaaaaaacaaaccaaaacccaaaaaaccaaaaaactcaaaaaccaagttctcacgggaggggaagtgagtctcaagattgcagtggtagaagtcaagatgtgattgggaaagactcaagttctttctgccctctactcagccctgccaaccccagggacccaatccggtagattgaagacctgaggtgcatgcctctgtcccctccaaccccactcctgcccctcctgtgtctctccctcctgccctacagtcggccctgaacgagtagctatccttcaagactctaccacccgcacgggctgcactattaaagtggacttcaacatgtccctcaccctgtggtgtgtggcgcggtcttgccctgagccagagtacgtgtgggccttcaatggaaaggccttgaagaatggccaggatcacctgaacatcagcagtatgactgcagcccatgagggcacgtacacgtgcatcgctaagaactccaagacgctgctgtctggctctgcctcagtggtagtcaagctgtccggtgagtcagccccagcctgatagccacctgctctctagagaggcccagctggcctttgctgactgggctgccattttccagaaaataattggattcccagcacactcattggccagttgtgacacggtggcgtatcagattgccctgtcttgtctaggtgcggaaagaggcaggcaaagcctattgcataggaaagaaatggtgactcatatcctctgccttgaggtcagacggagtgacaaatgagcccaagtccccatcttgtggggtgacagagtgggacaccagggtccctgtccttccatgtaattgccccacatagtaaaaaggcactcgctgctgagagccctgcccaacccaaggcacacaaaccttctgccaactagattgtgtgcatcaattagtctagataggatgtgggcatgctcgagtgcccatgcgagtgttctctctctctctctctctctctctctctctctctctctctctctcacacacacacacacacacacacacacacacacacacacacacacacaccacagctggaaaaccacacaccagaagcactttcttcacacctctgttccatgcatggggggttgtggtgctgagggaacagagctcatgccccaagaatagcggctttgaacatcaagttctcattttacagcagatgtatagtggtgtaggcaagaggatcaggagttcaaggacatccttagctacacagacagttcaaagttagcctggactacatgagaccttgtctcaagggggaaaaaatgtctcattcattctagctgggtttcttctcaaatggccattgtcccttggggacagtgggaatcgtccaccccctcctccctcccttcttcctccactaacaggctgggtctcatgcaaagggtggggatggaccctctttcacgcagagcaaagatgactgtcgcaaaggtaagtgtgcctcctgtcttacctgtgagggaccttggctggaaacagggtggaccagatgacctcagggccaacatggggggtatccaaggtctgaaggtaggtgcaggctgtgcctaatgtaacacttccaaaactgcttccccaaaagctgccaggaatcctgtggcaggtgctgagatcgagacagagacatggctgttatcccacctgggaaacaagctgaggtgatggaggaggcatggtctttctctgacctcagagggatcagtgaagctgccaatcaaagagaagaggcaatgcctcacgttctctgggctccctggcattggtgtgggagacataaaactgtctagtcaaagggaggaggcacaaggtgaaagaatttccaggtcattaggagacatgacactactttaaatttcatagtctgatgggggagacacaagtcccactttgggaacatgtcaaatctgatgggggagtacaatcttcccactttctatgaaatttttctatcagagacaattattcccaactttgggcatcttcaacttgattagaatgttccactcccaatagtccacaatttctcagtctgatggaggagacagaaactcccaccttctagggaatcttaatcttgggtcccaaacttgattgaaaaatctagaatgtcccaatctgatggcggagacacaatccacaccttgtgagaattttccatgtgatacaggatgcacagcttcatctctcctagagtcgtctaatctgatggaggagttgtcacctcccatattcttaggtctgctgctctcacagaaaagacactatgtggacgagacattccaaccatctgatgggggagacacagccccatattctagaatttccagtctgataggggaggcatggtccccagaggtttttttttcctaccctgatggaggagacatggccagaccctgtggggtctttcaattaattacatagggcctgtaccatcatccaaggctgaaatttaaacaggagagatgtcttcctggcatctgagaaagagagtctatgtgatcaccctagaaatcacctccatcctctgtctcctccccagcacctcatggggagaagcatcagtgggggagctggccaagggagggggaggactccacaccacactcaagccgttctggctgactgtggcggtggttctctccccagcggcagctgtagccatgatgatcgttcctgtaccgactaagccaacggagggccaggacgtgaccctgactgtccagggctaccccaaggacctgctagtctatgcctggtatcgtggacctgcctcggaacccaaccgactgctcagccagctgccgtcagggaactggatcgctggcccggcgcacacaggccgggaggtgggcttcgctaattgctcactgctggtgcaaaagctgaacctcactgatgccgggcgctacacactcaagaccgtcacactgcagggcaagaccgacactctggaggtggagctacaggtggcccgtgagtgagcagtgtgggatgggatggggggggggcacccaaagatgtccttctcctccctcacatgcctgtgggacacaggcatgtgcctcttccatctgacctgagtgtccccatgtgggcgtttgccttgcctctcaaacgatgacgtccaccaaggtatacgccttccatatggatatatagaccgtaaaaggggtgtcaagtgagggtgggcatcttttctcattaggtgagtggaaactaaaccatggggatctagcctcttccaccacactggggagctggggtgaatgcaggtgttttcctcccccataagacatggcatgagggcaagaagtttccaccttcagacaccagagctctcccaacctgaatgtacactaggatgcaggctgctaggtgtgcctcttccatcagagttctctgttgggaaccacctctcccctatcaacctgggggctcccacagtggaaaaccatgtctctctcatcagactgaaaattgtgtctcctccatcagactgggagctcccagaatcaggcaccatgtctcctccatcagactgggggctctcaaagtcagagatcatgcctcctccatcagactgggagctcccagagtcagggaccatgcctcctccatcagactgggagctcccagaatcaggaaccatgtctacaccaacagactgggagctcccagagtcagggccatgtctcctccatcagactggaaccttgtctcctccatcaggctaggagcacccagtcaggaaacatgctcttatagtccaaggctatgtcttctccatgaaactggtatctcccagagtcaaaagccatgtctcttccatcagaccagaaattcccagaaatcttcaagaccttactagggcaggtgctctggacaggcgctcccagacggagaacaagagtctggggtcctgcctgtcgcatcagactagacactcagaagtcaaatttccgaagccaggaccagtccggacccaaccaccagatgtctgggttctcacaggctcactcctaagcctgtgcactcggggattccttttcagcttcctttgtcacagtccagctggaggaccagtctttcttcatgcagcaccagaccccagatcatggcacaggctgagcggggcgggtggggaccgcgggaggcgcggtgggcggggccgcgggagggtcctcctgctgactgacaacctcctcgtccccgccccggttctcctgcacagccctggagtagccaccgccgcctcttcagctgcagcgcaggccgctgagacctggagagaaacgccccttgcagcatctccccgcatccgcccctgagcccaggaccgctcacctgcagcacggatgccggccatggtcccgccatcctgcctccatctagtcttagcgccgagctgtgggagagctgccaagtccataaatgtcccaatgaacgcacatgggtgtcagcctctccttccaccgccgccagcctggccaagcgcagctagtgttctttgctttggtacccaccccagagcatgcccagactgggcgcatgcgcacctagggatgcttaacccacaccccctctgctccagggcagagcctggcacctttgcataggtgtgcagttcacaaggaagtgtatcctgttcccccagtggattaaggatgggccctctccaaaaagtgtggagtaggaaaagacccgcctcactgagtaactcctgccttcatcctaccctaaggcagagttacttcccctcaaaaaatggtgtttctcagccgggcgtggtggcgcacgcctttaatcccagcactcgggaggcagaggcaggcggatttctgagttcgaggccagcctggtttacaaagtgagtgccaggacagccagggctacacagagaaaccctgtctcaaaaaacaaaaaaacaaaaacaaacaaacaaacaaacaacaacaacaacaaaaaaggtgtttctcaagggactgtccagaactgtcgggacctcatccattacatcaagaacgcaactgaacacggtggtgggtgcccgtaatgccatcagagctggaggcaggagggttaggagttcaaagcattgcccagtctatgcaacaaagtttaagatcagcctggcttacaggagatagtatctcaggaaaatttaaaagctatagagaaactgaagagagttgtaaaagtagtttatatgaatctaggatcagttatcccacacatctttttaaatgctcagaagttcattgttgagagtagagtggagtccccacaatgtcatcagctatcgatttttatcttccttagcgcagggctttcagtttcccagtcacctcaagtgcccggatggctgtcgggtttttttttttttttctggttgcaagggactctgagaagtagtctttctcttgggtctgttgatacctccaaacaatgtcaagactgctcagagagaatagttccaaagtgggaagctgacagcctctgctatgatgggttgaaaattctgcctccctggctagacaaaatggcctctttcacatgcagccactgcggaggagccatggaaaacccatggccagatctcagaaagcctggggacctgggatgccacctgaggctgtgtggatggggctttgcatgaggggtgagttcttaactaggccagcaggagggggacagggaggagacctctcaagattctaggtcaagctagagtctttatacttagtacccagaagctcaggtgtcccagggccaagccacacatccctctcagcatctctaggcgccatctcaagccagtttaagtctccttcatttacagtccatgtgagaaacgacaatcatcacaagagagtgacatcacaagatagtgacatcacaagacagtgacatcacaagacagtgacatcacaagacagtggcatcacaagatagtgacatcacaaggcagtgacatcacaagatagtgacatcacaagacagtgacatcacaagacagtgacatcacaagacagtgaccgttcttgtagccaggttttgtggtgaaggcacttagctctgggtcccaaccccgcaagagaatgatcatgagaataatgtgggtagttttatttttcattgctgaggaatgaacctaggaccttgttaagactagaaaatcagccgggcgtggtggtgcacacctttaatcccagcacttgggagacagaggcaggcgaatttctgagtttgagaccagcctggtctacagagtgagttccaggacagccaaggctatacagagaaaccctgtctcaaaaaaaaaaaaagaaagaaagaaaggaaggaaggaagaaagaaagaaagaaagaaagaaagaaagaaagaaagaaagaaagaaagaaagaaagggaaagaaaagctctctaccactgagccacgcccccagcacctccctgggagatttcaggcaggggctctacactgagctatgcctccaacctagcccattccctttgcttttgttgaggcagattcttaccatgtagaccaagttggcacagaacttttgatcctgccacccatgtcccctctagtgttgggactctgggtctgtgccacatgaccaggttttgtccctttactttatcggttcctataacatctgttatgcatagttactgccagttctgaatttcacaagtaaggaaaccaagttttgggagtgctgtcaactttactccagctattgtagttccccaggctgccaggagagggcgcaggtcgtgtttctgaacaggcaaatactaaacctcagcacgctagggaaattggctctttgcatttcttcatctgtaacacgcacaccatcatagtacttgcctcctaagactgaagaagctatcaatatgcagaaggaaacctgccccgagtattgtcaataatgctcatgacctagaacaaggtatttgcctttagccacagacagatagaaaacaaacacatttatctgaatctcctagtgttagagctattacaattcctcagtgaagggcaaaggatgtggcctagaatcccccagtgaggggctgggggcgtggctcagtggtagagcccctgcctagaatcccccaagggactggctgagggagtggctcttggctaggatgatgagtccctgggttccatccccagtagttggggaaacaacaacaacaacaacaatatgggtttctgcaatgcatcttcccacatgtgtgggtctttctcattttgtataatacttaatggacatgtcataaaaataattcattctgccttccaagaaaataataaccctaagccagtgtaagttcttggacttgcaataccaattccaacagcatctggaacctgtgatatggatgaagtttctgacctcccctccaagcttcactttgaaaggggctccagttcccaaagctcctaaatgtttatatgcacatcagtctcggtgagtttgaggccagcctgatctacagagctagttccaagacagccaggactacacagagaaaccctgtcgagcgagcgagcgagcgagagagagagagagagagagagagcagttgtagaattgctgtgttggtagaatgcttgcctgccgtgcatgaagccctgggttcaaccccagcaccacataaacccagtgaggtggcatccaattgcaatgccagctctgtggatggaggtggaggcagggggtcagaagctcaaggccaatctcagctatatccatccagatccaagccagcctgaggcacagaagagcctgcctttggccaggtacagtggcacatatctttaatcccaggacgtggaaagcagaggcaagaggagtttgaggcctgactggtgtacttacgtgggttccaggccagtcagggttacacagtgagagcctgtgtgaaacaaaacaaaacaaagcaacgcaatcctgggttcaatccccagcacccatgtggtggctcacaaccatctatcttgggatctgatgccctcttctgacaagcaagtatgtgaatacagatagagcactcatatacataaaatagataaatctcttttttaaaaaataagagagagagagagagagagagagagagagagaagaaaccaagcagaaagggggagaagcaatatgtcccaattttaaattaataggatgcacagacaggtcactggttttccatcaccagaggtcaccaagcacaggtagcatttggagccttcagattctatcagcacaggagaaggcagacacagcgacagagacagagagacagagacagagagagatggaaagcacctccaagacatctctagctcctccagccccgtccccagatgccctttctcaagaatctgccatagatggcttgggctggacagggaacgaccttgaggccgcacacacaatggcccagttgcctgtggagcctagccaggaaaggaaggaagtctgaccccctttttttttttcctctacagactgtagcgccaaggtggggaggagtaggataaggaggaggccgcgagcgagcgggagaagggctgggggagcggggggggggggggggggagaagcctcaaggggcgggggagggacctggcgccaggctgccagtgttcacctttcagaggcaagaaaggtatctcacccatgcatcccattctaacccccagtgcccagagagggagcgctcgcctctagagggcggcacagcagacgacctctggtgggagctcttgtacaactcccccaccccccaccccaccccacccccaccccgacacacaacatgttttagaggtggagtcagcctcttcattcctcacaggagaaaatcaaagcctctagagctaaggtttcttctctcttcgatgcaacagacctaggccttgtttgaatgtctgtgagtttattttgtgctttgggggcagcgttttgctacagcccgggctgacttggaagcgcctcctgaataccggcaggacaggtgttcccaggagcgcccggcttcgcagttcttcccaaggaggaaatgcctcctgctcttcacgctcatccctcctttatgtcccagaactccagaggaatgaagcaaataagtaaatatgagaacggggctggggcgggtgactgggcagcaagatggcttgtgggtacatgcgcttgctgtcaatcctgatgaccggagttccatcgctgggatccacatggcggaaagagagggctgactgccacaggttgtcctctgacttctgcctacatgttgtgacatgtgcacacacccaaataaataaatacatttcaagaattgacctggggacacagcacagcttgtgggatgcctgcccagtacgcacaaagccaccccataaaccaagcagggtaatgcacacctatattccagtggaggaggaggcaggaggttttaattcagtccggggctaacctggactacaaagaccctaaaacaaaagacccactctttttggctaggcatcgtggggcacacctgcaatcccaggactccagagatgaagcaggagactcatgagttcaaagtcatcctcggctacaaagcaagtttgaggctagcctgggctgccaaagaaactatctccaaaaagcaagaattaacagagtggccgagaaggctggaggtgggtctttgtccacttgaatgtccagagccaatggtggccaacttgaggcacttcaaggcacagaactgcatgagtggttcaagatgccagaagtctaagaccaaggcactggtgagggagacctcactgtgaggactcctgcctaggctagtaggcagccatcttgctttggcctcataggagtctcttctctgagatacacagagaggctgaggcagatggggcagaacccaggctctctgataaaggtacaaatctcatgaagccagagctttatttatttatttatttatttatttatttatttatttatttatttatttatttagacagggtttctctgtgtagcccaggatgtcctggaactcactttgtaatccaggctggcctctaactcagagatcaacctgcctctgcttcccgagtacagaaattaaagatgtgtgccacttcccagtagagaccctcttttatgaccccacttaaccttaatgatgctcttatgggctctgtctctaagtgcagtctttttaaggggttagagcacatgggagtgagaagcacacactgtccccacctgtgtcacccaccttcaaggacagtgccaggcaaacaactggtgctcaacagatgcttgaaaaatgggtcagtgagtgcgtgagtcagtgaacacctgaaacctgcatgttggccatgcagtctgtaaaggagccaggtaaagtttaggggtgtgtattgaagagggcaacaggatctccagcctcagcagtccaaatgggaagcagagaattgggaaagtctgtagacaagtcattaaagtgatatcctgaaagctgtgaacaaagaaatacaagggtatgaaatttagacagatgagaagcagcctcccaggcaaggacattcaaaatatgcattcgagactgggggcgtggctcagtggtagagcccctgcctagaatcccccagtgaggggctggggggcgtggctcagtggaagagcccctgcctagtattatgagtccctgggttctagctccaacacttcagtgcagtggaaaaactaaaaactgggctggcaaaatggcacagctgacaaaagtatttatagcagaagccaaaggacctgagtccagtctctagaaccaaacctgaagaagaaaagaactgagtcctggaagttttcctctgacctccacatgggtgttttgttatgtaaggcagcacacattcacgtgtgcgtggccacgctaataatatcaataataacgataataatatcaacaacagaaataaacagaataaagtgtacgtgagtttcctctgctgctgtaacatataaccacaaatttggtggcttaagctatgatccctaaagctaaaactagatgttccctgagctgccctctcggggctccggagaagaaattctgcctctcgtcccattcctggaagctgcctgtggttccctgacctgtgcgccgcacgtgccacagctagaaggcaaacgggggtagggggtggggagtgtcacatccagtatgacccagtaaagacaacaagaggaatatagaggaagtggaacaggggtgggagtcaggacagttagccagttgcctgaggaaggtgggcactgtggagagctccgggcagagaatggacaagctctaacttggatgccactagctcccctgcagctgcctgtgaacatgggcctcaccggaaggggagaaaagaggtaggggcatgtcaagctttggggcccagcaactgtcagacaaagcacacaggcaggtgagggggaccagagaatagagtaagtcacacatcctctggaccctgagacacaggggctccggagggaagtgggtgacgagtgggctgtggtttttcacccatctgtgaagaagcctcgttttctctccgacttcccctcctgtcccgcagagctgccttgtttgttcccccatccttcgtttatgatgggaaaggctggatttcccctaacccagcagacacctcttccctctgcctagccctaccctcccacctcgggaagccccgtgcggcctcccagaatgtcccagaaggatgagtgtactgatataccctctactacccattcatccagccagacgggtccccaaaagaggaaggaggtcacccgcagtcacccagcatgtggccagctgggaacatcaggacttcaccttcctacgcccctcccagcaccccaagacactcatgtgagaaacgggtttataaggacgttctgcagaagggggagtctagattcaaacccaggtctcagaattggttttgctgtaagtttagaggcaaaggccacagattaatggaacctggcttatgccaggaagacaaacctgagccccagacaaccaaggcccaccagatagagaagtacaggtaggagctgagaatagtcagaaaggccttcctggaggaggcatacatctctctaaggctctctaagtatgggatgaatcagcctaagtgtcccctagagatggaacagtgtatgcaacagcctgaggctttgtaattacatccattgctctcccggtctgagtaaacagttcagtgtcctctcattcattcaataaacacttcccggagtgaagacatgtggagagcggtggtcccactggatcgtgaccttgacctgggaatcagagagggttctggaagaaggaagacgtgcagaggaagggaaaaagaagaaaggacactccagatagagggagcagcctctgcaaaggctggaagtagcttcttacagtgacacgatttaccatccgcccgcagttcctctgaagcttggtgtccttgctcagagaggccatccctgtggcctttggggtacacagaggagaaaaacagtaggttgtacctcggaagccagcctcctcaatgcccaggggaatgaatacagcgaagccattagaatttgtacctaggtcggtcccggcctctgactaggagattggcttgtagtagcctccaggtggcgccagtgagccacccgccgagcctctcctgctacaaaggtggatctggcctgagcagggcactggggtcccccagtcgtgtgcccatgctccctgacctattagaggacagggattcctgatccgttccctattgcctgggaaacctttttcccaactcagatttattggaagcccacggtgtcaccacccgacctgcccatactcctgtgaaactcctgggctgggaatggtggggg

SEQ ID NO: 187 - DNA, 1596 bp, Mus musculus
ccttgttcctggcccttgagctgccccaaggctcacaggcagccctccacatcgagatgatcccagagcagcctcaaaagaaccaggaccttcttctgtcccttcacggtgttcccagcactgctcaggatttcatctggtacctgggggaggaggcttctggaggcacaaggctgttctcttatatccccggactaccacggccccagagggatggcagtgccatgggacagcgagacattgttggcttcccaaatggttccatgctgcttcgaaatgcccaaccttcagatagtggcacctatcaggtggccgccaccatgaaccctgcctggacaatgaaggccaagattaacgtccatgtagctgcctggatcctgaacactggggccgagatctccatcacccccgagcctgcacaacctgcagagggggacaatgtcacgctggtagtccatgggctttcaggggaactgcttgcctacaattggtacgcagggcctacgctcagcctgaccttcctggtggccagttacattgtcagcactggtgatgagacccccggaccagcccacacagggcgggaagctgtccgtcctgatggcagccttgatatccatggtgccttacctgggcacacaggcacctacatcctgcagactcttaacaggcagtttcagacggaggtgggctacggacacatgcaggtctatgagatcctggcccctcccacggtcatggccaacgacactgcgctggtggagcgtagggatacccttcgtctcgtctgtagcagccccagccccgctgaggtccgctggttcttcaatggtgacgctctgccagttgccgtccgcttgggcatgtcccccgatggcaggatgctgacccggcatggcgtccgcagggaggaggcaggtgcctaccagtgcgaggtgtggaaccccgtcagcgtcagccgcagcgagccactgaacttgacggtatacttcggccctgaacgagtagctatccttcaagactctaccacccgcacgggctgcactattaaagtggacttcaacatgtccctcaccctgtggtgtgtggcgcggtcttgccctgagccagagtacgtgtgggccttcaatggaaaggccttgaagaatggccaggatcacctgaacatcagcagtatgactgcagcccatgagggcacgtacacgtgcatcgctaagaactccaagacgctgctgtctggctctgcctcagtggtagtcaagctgtccgcggcagctgtagccatgatgatcgttcctgtaccgactaagccaacggagggccaggacgtgaccctgactgtccagggctaccccaaggacctgctagtctatgcctggtatcgtggacctgcctcggaacccaaccgactgctcagccagctgccgtcagggaactggatcgctggcccggcgcacacaggccgggaggtgggcttcgctaattgctcactgctggtgcaaaagctgaacctcactgatgccgggcgctacacactcaagaccgtcacactgcagggcaagaccgacactctggaggtggagctacaggtggccc

SEQ ID NO: 188 - protein, 532 aa, Mus musculus
  VARIANT (1)...(532): Xaa = Any Amino Acid
LFLALELPQGSQAALHIEMIPEQPQKNQDLLLSLHGVPSTAQDFIWYLGEEASGGTRLFSYIPGLPRPQRDGSAMGQRDIVGFPNGSMLLRNAQPSDSGTYQVAATMNPAWTMKAKINVHVAAWILNTGAEISITPEPAQPAEGDNVTLVVHGLSGELLAYNWYAGPTLSLTFLVASYIVSTGDETPGPAHTGREAVRPDGSLDIHGALPGHTGTYILQTLNRQFQTEVGYGHMQVYEILAPPTVMANDTALVERRDTLRLVCSSPSPAEVRWFFNGDALPVAVRLGMSPDGRMLTRHGVRREEAGAYQCEVWNPVSVSRSEPLNLTVYFGPERVAILQDSTTRTGCTIKVDFNMSLTLWCVARSCPEPEYVWAFNGKALKNGQDHLNISSMTAAHEGTYTCIAKNSKTLLSGSASVVVKLSAAAVAMMIVPVPTKPTEGQDVTLTVQGYPKDLLVYAWYRGPASEPNRLLSQLPSGNWIAGPAHTGREVGFANCSLLVQKLNLTDAGRYTLKTVTLQGKTDTLEVELQVAX
